United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 18

SEQ ID NO: 87333 - DNA, 3861 bp, Glycine max
  Peptide Sequence Number=SeqID_179018
atgacgagttcaagcgtgaagaatgaagatgaagagaaggggtctctagctggttcgagtaagactgagatttttagggatagtgccaaacactcagtctcaaacgcactattttgttctttttttgggttgataatgagacttcaaaatgacatcgtagaggaagattacagagatatgagttctcaaattcggagagaaagaagggaatggtccagggttccaccacaaggtgctactcgtcaagaatgggtccccagaggggctgctgctgctgctgcgtccaccaatgtcgctcagccatcaaatttgcattcaaacaacaatgctgatgctggttcttccaatctaggggtggctgttgctgctccgtccgtgagtcgcagtagaagcaacaatcatgggaatgatgttggttcttccaatcaaggggtggctgttgctgctctgccggtcagtcggggtagaagcaacaatcatgggaatgatgccgggttttccaatcaaggggtggctgttgctgctctgccggtgagtcacggtagaagcaacaatcatggaaatgatgccgggccttccaatcaaggggtggctgttgcttctccgccggtgagtcacggtagaagcaacaatcctgggaatggtgctggttcttccaatcaaggtttggcagttgctgctccgccggtgaatcgtggtagaagcaaaaatcatgggaaagattctgtctcttccaatcaaggggtggctgttgctgcactggggagtcgtggtagaagcaacaatcatgggagtcattggatggaaatggaaaaggataaggggagcaggagtgggagtcaggtggagaagggattgagagtgggagtcagagactctagtttgcctcaattggtgcaagagattcaggagaagctcatgaaaggtaccgtggagtgcatgatttgctatgagatggtccagaggtctgtgccggtttggtcttgctccagctgttactctatctttcacctgaactgcatcaagaagtgggctagggcaccaatctcaagtgatttgtccttgtccgtggagaagaatcacgagcttaattggcggtgtcctggttgtcagtctgtgaaatttacctcttcaaaggagattagatatgtttgcttttgtggaaagaggatagaccctccatctgatttgtatctgacaccacattcatgtggagaaccatgtgggaagcctcttcagagggaggtgttggttcctggagggaatagggatgatctttgccctcatgcttgtgtcttgcaatgccatccaggaccatgccctccctgtaaagcatttgctcctccgcggttgtgcccttgtgggaagaaaaatattaccacccgatgctctgatcggcagtctgttcttacctgtgggcagtgctgtggtaaacttcttgaatgtgggcgccatcgctgtgaacgcatttgtcatgtgggttcatgtgatccttgtaaggttccaagcagtgcaacttgcttttgcagtaaaaatatggaggttgttctttgtggggacatgactgtgaagggtgaaattgaagcaaaaggtggggttttttcttgtagttcctattgtctaaagatacttggttgtggtaatcatgtctgtagtgagatttgtcatccaggaagctgtgtggaatgtgaattgttacctagccgggttaagacatgctgttgtgggaaaacaaggttggagaatgaacgccagagttgtttggatccgatacctacctgctcgaaagtatgtggcaagctgcttcattgtggcatgcatagttgtaaagaggcatgccatgttggggagtgtccaccttgtttggttgaagtttcacagaagtgctgttgtggctcaacttcccgaactgtggagtgctataagactatgatggagaatgagaaatttatgtgtgaaaagtcttgtgggataaaaaagaattgtggaaggcatcgatgtagtgaaaggtgttgtccattttctaattcaaatcattataatacctttagtggggattgggttcctcacttttgttccatgccatgtggaaagaagctaaggtgtggccagcatgtgtgtgaatgtctgtgtcacagtggtcattgtccaccttgtttccaaacaatctttaatgaattggcttgtgcttgtggtaggacttcaatacctcctcctctaccatgtggtacaccgcctccctcatgtcagcttccatgctcagttcctcagccatgtggtcattcagtctcacacagttgccattttggagactgtcctccttgttcagtgcctgttgcaaaagaatgtattggcgggcatgtagttcttagaaacataccttgtggttcgaaggatattagatgcaatcatccctgtgggaagaccaggcagtgtggtttacatgcatgtggcagaacatgtcaccctccaccttgtgataatctatctggtgttgtgcaaggtttcaaagcaccatgtggccaaacatgtggtgctccaagaagaagctgcaggcacacatgtatggctccttgtcacccttcatctccatgcccagatataaggtgtgaattccctgttacaatcacttgctcttgtggccgtataacggcaaatgttccttgtgatgttggtggtagcagtagcaattataatgctgatgccatacatgaagcttccattattcaaacattgcctgtacctcttcaaccagttgatgcaaatggcaagaaagttcccctaggacaaagaaagctgatatgtgatgatgaatgttctaagctggaacgcaaaagggttctcgcggatgcttttgacattactgctccaaatctggactctctccattttggtgataactctctttcttctgaattgcttttagattttttcaggcgtgagccaaaatgggttttagctgttgaggagagatgcaaaattttagtacttggcaagactagaggaacaggaactacacatggtttaaaagtccacatcttttgtcccatgctgaaggaaaaaagagatgcagtgaggttgattgctgatagatggaagcttgcaatcactgctgccggctgggagccaaagcgatttattgtaatttctgttaccccaaaatcaaaggccccggctcgtgtgataggggttaagggtactacaactttaaatgtgcctcttcctcctgtatttgatccgttggttgacatggacctgcgacttgttgtctcatttccagacttaccaagggatactgaaattaattccttggttttgaggtttggtggcgagtgtgagcttgtttggttgaacgacaagaatgctttggctgtttttcatgatcctgctcgagctgcaactgcgatgaggaggttggattatgcaacagtttatcagggagctgttttggttgccccgaatgctggggcattggtggcatcttcagctaccaatgcctggggaggagctggggcaatgaaaggaggaggagcgctgccagcattgaaaggtaactcatggaaaaaggctgtggctcaagactctggttgggaagattcttggggtggtgaagagtggattgctggttctgtgaatatccagccatctgtttggaaaaaggaagcacctctggctgcttctttgaatcgttggaatgtcttggagcaggaatcgagttcaagtttgtcgtctacaactgttagagctgaagtttctgggaagaaaactgaaaatgctggtgaagaaggtggctcaaaggaagaggaaaagttggatgcagcttctgaagtagttgatgattgggagaaggcttatgaatga

SEQ ID NO: 87334 - DNA, 1332 bp, Glycine max
  Peptide Sequence Number=SeqID_179019
atgactaacagtgttgcagagtctgaacgacattaccttatattcatagtggctatgatgcattcgaaaaacggttttgtggatgtctgccttcgccatgagaatttggtgaaacccttgcctgagatcgagtttcgagaaccaagatgtgtcactcagtttatccaggaactcgtctatggtaggcataggaaattgatctttgattgtgatcgagttaagagctcggtaggagatggatatggtgggcaatggtgcgaggtggaggtaaggttgtgggctcatgaaacaagaggtcaaaatgacagaggagtgtggtttaatgatgtggtcgaggcgggtaaccaggatagatggagcttggcggagatgttctggtacggggcccaaatcttgcaaccattggatcccaagcacaatatctgcactattaaggcccaagatgaagaggtcgacctgaaaggaggtggagaggttcagaaagttggcgacacatggttgtacaaagttgtgtgtactaccatcatccacaagaattgtcacctggtggatgaatgtggtgggcttagagggtcatcaggtggagtctctacaggcaacaaagtctcaagacctttgtcgcagcataccgctaattcctccgatgataagcgtttcaccggaactcgtaatggtgagggtcatgtaggaggtggcatggaaaacaagggaggagtttggccactacgacagcttggggcaacggtagaggttgcaaggcttggacctctcaacggagttcaagacatcgccgaccaagacgtcaggaagccgttgcgcgacatccattggttccggcaaagggctggaccttccatgaaaaatgatgcgatggtggtggttgtggggttggtggtgagtgcggtgatggaggaaaggataagtaaggcagttgacggcctcctcaagacgttcggtggtagccaaatgggtattgtgttcgggcatgatggatatgacagagcagctggactcctaggtcctaaaatccaagtccccaatgagatgcagcgtcttggctccatgcgccacggtgcggcaacgacagtggacgagcatctcctcgagcatgttgtcatgtctatggatcatcatcgccacagagttgccgacgagatagatgtcgatgccgatagtgtcgaggtgcaccgcggcgaggtagttgtatgcgatgaccaaggtgatgggctaggaggcgcggtgcttctaccacaactagttcagcgtcacacacttaagtcattcatcacacacacgaggtggaagatgaaggttaaggaggataaggagtga

SEQ ID NO: 87335 - DNA, 510 bp, Glycine max
  Peptide Sequence Number=SeqID_179020
atggaatctgagaggcctagcactattaatgagacctacaaacaacaacaagaactagaagaagaagaagaagaagatgatgatgatgataatgaagaagaagaagaagaagaagaaaacaatgagatcctcaagaggagaatctccaaccaccctctctatggtctgctggttgaagctcacttggactgtttgaaggttggtgacatttccaacttggagagagagctgaagatagatcagatgcaagcaacggagaagcaaaacttgggcatgttcagccaatctgagcttgatctcttcatggaagcatattgtttggcacttggcaagcttaaagaagcaatggtggaaccacaacagaaatccatggctttcataaacaacatgcattcacaacttagggagctcactaaggcaaccttgcctgcacctaataatgctgaaccagctgcagcaactacatcttctactagtgagtccaaattcagaagaaagcccacaatttag

SEQ ID NO: 87336 - DNA, 1307 bp, Glycine max
  Peptide Sequence Number=SeqID_179021
atgggtccaggtccatggattggtccacgggcttatttgtttatgaggacaaagaagaaggatactggtgaggaggagcaagatgtaactcgtgtctcaactaaggatgctacccctcatgttgttgagatgcctgtgccgccaccatctattacaaatcccatgatcaaacgagagccaattccagaaaacgaacaatgtgaactcttgaagtggatattggaagagaagaggaaggtcaaagcaaaagacgcagaggagaagcggaaaattgatgaagagaaagctctgcttaaaaagcttattcggtcaaaatccatcccaaattatagatttgtgaatttgagagttcagggtcctgacatcctaaattgtcatttgcagaattttggatgtgatgtcatttggattttcaatatatttattggttttgtgaataaagccaaatttgagttagagcctcagcacatggcaagtgcagaggctggtgcacctacagggtttggtggttctgtacaacactcttcatcaaacaggagggattatgatgatggtgggtcaccaaagaggaaccttagtttggatggtttacctcattttgagaaaaacttctacattgagtcaccagctgtaagggcaatgacagatgctgaagttaatgagtaccggcagcagagggaaataactgttgaaggtcgagatatcccgaaacctgtcaagtcctttcatgatgctggttttccagaatatgtaatggaagaaattacaaaagctggctttactgaacctacgcccattcaatctcaagatcctggagatggaccaattgtgttagttttggctccaactcgtgaacttgccgtccaaatacaacaagaggctactaaatttggtgcatcatctaggattaagagtacatgcatctatggtggggttccaaagggacctcaggtgcgtgatctccggaaaggtgtcgaaattgtaattgccactccaggaaggttaattgatatgcttgagtcaaatcataccaacttgcagagggtcacataccttgtattggatgaagctgataggatgttggatatggggtttgatcctcagctacggaagattgcctcccaggattatgttcatcgcattgggcggatagggagagctggcgcaaaaggaactgcatacccatacttcacagctgctaatgccagatttgcaaaggatcttatagccatactcgaggaagctggacagaaagtgagtcctgaattagcagcaatggggagtggtgcaccacctccacccttcag

SEQ ID NO: 87337 - DNA, 438 bp, Glycine max
  Peptide Sequence Number=SeqID_179022
atggcccttattcgtcgtcgccaccctaacctctgcctccccatctctaagcctattcagtgtcgcccccacttccccctttacttaaccctcaccaccaccaaacgcaccaccaatgatgccatcaccattgatgaccttgcgaaactcattattctcggccatggaaatggcagaaccgtctacaaggtctaccataaagtcacctccatcacttacgagttgaagatcatccatggtgaaattgacgccatcacacactgtcatgcactcttagaagcatcaattcttcgtcgtaccattgattgcctccatgtggatcactttcatagctctttcgagatgcccatcggtgatgtggcaatcctcatggagtacatgggcggtggctccctcgagactgcccttaccatcaacagcatattctttgcagagtaa

SEQ ID NO: 87338 - DNA, 357 bp, Glycine max
  Peptide Sequence Number=SeqID_179023
atgtctgatgaagttgacatggatatggatgataccgttaaaaatgaagattgtagcaaaatctttacaactatgaaggtgaactttgacaaaaagaatggtgtatgttgtttatgtcaaacacaggaaaataacctggaaggaagacatttttcatcttgggttgtgagaggggtggcaaatatagacataaaaaaagatgcaaaggcggtcactaggactagaaaatgtgattgctcttttaggttgaaaggaagaccactaaagactagtgaaggatgggtacatagggttctgtgtgggtcacataatcatgatattgccaagacattgatcggccatccatatgttggttga

SEQ ID NO: 87339 - DNA, 696 bp, Glycine max
  Peptide Sequence Number=SeqID_179024
atggattgtcctacagagtgtgtcgatgaagatcatttgacaaagtttgaagttgcctgtgcaccttggcgtgagtttgttgcctatgtcaaagaaacttggttgatcttacacaaggaaagatttgtaaaggcatggacagataaagtcatggtacttggggttgagtttgcccattgggcgttgaagtggtttctccagactagcatgtatgcattgaatcatattgcagatgaggttcacaaaatgcattttgttggtgtagacacgtctcgttgtggatgcattgtaagatctacacatgggttgccctatgcctgtaaactagcttggctaagtttcaacgacatggagtctactgatttaaacgatgagttctttgtgcaacaagagtttgatgttataacaaaacgcttaaaagaggtcaaaaccaaaagtttgcagaaaagtcatgcaagtaaatttgaacggtcaacgaagcatcatccttctttatttaagcatgtggatgcattacattcacaacatgatagttcatcttcatggaagtcacctgacattgtagatgtaagatcagatggtcattgtgggtattgggaaattccagctttacttggtatgggtgaaaattcttggcctttagtccataacgatttgcataaagagttgggacaatggcgtgacgaaaatgattga

SEQ ID NO: 87340 - DNA, 176 bp, Glycine max
  Peptide Sequence Number=SeqID_179025
ggtttgtatttttctttcttcctcactccatctcggctattccgtcactccatcattacagtgcgactacaaaagcgaaggcaaggtgctccgtgctcgtgcgtggtggtcgtggcgacaatgcaaagtggaacgatggtgaagttcgtggtcgcgatgacgttgaagggagttag

SEQ ID NO: 87341 - DNA, 2214 bp, Glycine max
  Peptide Sequence Number=SeqID_179026
atgagcttgaagaaaagggcactttccattaacattgaagaggctgctgtggacttcttcaaccacctcttgcaggagaagcctaggattccagtctttattcctttgattctgattgcttgggcaattgagagatgggtcttctctgcctccacttgggttcctcttgcacttgctgtgtggactactatacagtacggtagataccaacgcaaactgcttgtggaggatttggataagaaatggaagcgaatcatactgaacgtttcgcccatcacaccattggagcactgtgagtggctgaataagttgttgacagaagtctggtccaactattttaatcccaagttttcaataaggatatctgctatagttgaggaaagagttgaactgcaggagttttcgctaggatcatgcccccctagcttggctctgcaagggatgcggtggtcaactattggtgatcagagatttctgcaactgggttttgattgggatacaaatgaaatgagcattttgttgcttgctaagcttgcaaagccattgattggaactgctcgaattgtgattaacagtcttcatatcaagggtgatcttcttgcctcaccaattctagatggaaaagcactcctgtattcttttgtatcaactcctgaggtgagaataggagttgcctttggaagcggtggaagccaatcacttcctgccactgaatggcctggtgtttcttcttggctgacatctaggaggcaaccaaatggtacatccaatggttgttcagaggataattttgatgataaggatctacaaacatttgtagaggtagaaattgaggaattaacaaggagaacagatgtcagactgggttcaacccccagatgggatgcaccatttaatatggttttacacgataatgcaggaactctacgtttcaatcttcacgagagtagtcccaacaacgtgagatgtgactacctagcaagttgtgaaatcaagttgaggcatgttgaagatgattcaacaattatgtgggcaataggacctgattctggagtcatagcaaagcaagcacagttttgcggagaagaaattgaaatggttgtcccatttgaggggtccaactcaggagaggtgagcattgtagtaaaagagtggcaatattctgatggttcacatagtttgaatagtctccggagtagcagctctcagcagtcaattaatggatcaccaaattttcagttaagaactggaaggaaaattaatgtaactgttgtggaaggaaaggatcttgctgcaaaagacaaatctggaaaatttgacccttacatcaaattgcagtatggaaaggttgtccagaaaacaaggactgttcatactccaaatcctgcctggaatcagacgtttgaattcgatgagattggtggtggggaatacttaaaaataaaaggtttttctgaagaaattttcggagatgaaaacattggtagtgcacatgtgaatttggaaggactggttgagggctcagtcagggacgtatggatccctcttgaaagagtgcgttcaggagaattaagacttcaaatatcaattagagcggatgatcaagaaggatcgaggggttcaggtttgggcttaggaaatggttggattgaacttgttctgatagagggaaggggtctagttgctgccgatgtcagaggcacaagtgatccatttgtgagggtcatatacaaaactcttaaccctcagtggaaccagaccttagagttccctgatgatggaagtcaactaatgctttatgtcaaggaccacaatgcattactacccacatcaagtataggtgaatgtgttgtagaatatcaaaggttgcctcccaaccagaccgctgacaagtggatacctctccaaggggtgaaaaggggtgaaattcacatccaaattactagaaaagttccagagatgcagaagaggcaaagtctagactctgaaccttccttgagtaaactacaccaaattcctaaccaggatggaaatcttgaaggactctctgcaacattgagtgagctagaaactctagaggatacacaagaagggtatatagttcagctggagactgagcaaatgcttcttctcagcaaaataaaggaacttggccaagagatcattaattcttctccttccctgagcaggagatcttattcaattggaaactga

SEQ ID NO: 87342 - DNA, 651 bp, Glycine max
  Peptide Sequence Number=SeqID_179027
atgctgagaatatttggcttattcatgctggatatgttctgtaatctggctgaaattgatgggagatttgtcaagatgtacacatcgaggaagaaaattcacaaggataaggatgctgagccaactgaatttgaggaatcagttggacaggcattgtttgatctagaaaataccaacaatgagctgaaaagtgatctgaaagatttatacataaactcagctgtccaaattgatgtttctggcaaccgaaaggctgtgattatccatgtcccctacagactaaggaaaggattccggaagattcatgtcaggcttgtgagagaacttgagaaaaagtttagtggaaaagatgtaatcttgattgccaccaggaggatagtaaggccaccaaagaaaggttctgctgttcagcgcccccgcaccagaacactcactgctgtacatgaggcaatgctggaagatattgtattgcctgctgagattgttggaaagcgtgttaggtataaaattgatggttccaagattatgaaggtctttttggaccccaaggagcgaaacaataccgagtacaagttggagacttttgctgcagtatacaggaaactttcaggcaaagatgtcgtgtttgagtatcctactaccgaggcttag

SEQ ID NO: 87343 - DNA, 1455 bp, Glycine max
  Peptide Sequence Number=SeqID_179028
atgcaaggtccatactggattactggtgttagaggtccatgtaagcagttaaccctggggtgtggtcagaaatcggtcatgtccatggtctactccgagctatgtagttggctggcaattgtgctggggtgcattgttggccagtgtttggtgtcggagacaataccacgtcaccgagactatagatcatctccaccaaggcagaaagaatcattgaaaaagaaattgttaatttctttgaatgaactggagaacttgaaaccagtggtccaacagaagatcaatgagcttaacagcaaacttgcataccaacaaaatggacagggaaaatttagttcaaataattcactggatttttctcccgtgaaaaagcaaacttcggctagttatggcctaataaaggctgtcaggcctactgctggggagtttgtttaccaaggatcaaggagccaacctttctcttatgtcaggcctgtggaagagcatgcacgaagactatctctaactcttccacctccaaaggaagaaactctctctagacattctatccttggtcccaacgggctaaaagggcagtggagaccacctatcattgataaagggatcaagtatccaagcaacatagatctgtctcctgttgaattaccaagcctacaacattccttggaagatgaatctctgaaaaagaaggataacagcattgcagaacaccataaatcagagttagattcaattctaacccaaagtgaggactgccagccccatccccaacctcagcctcagcatgatcaggagcctccttctcttatttcttttgagacaactgaaacctctgctcgaatagaagttatcagacaaccttctcctccacccgtacttgctgaagtacaagatttggtccctgcagtgtcaccttgtgttaatgaggcaggatgtaagacagagattccatcatcagatagttctgttcatgtcgaggctccaatgcaattgcacatttcaactgctttaatggagagttttatgaagcttgccaagtcaaatacaaaaaaaaatttagagacttgtggtgtccttgctggtttgcttaaaaacagaaaattttatattactgcccttataatcccaaagcaggagtcaacatcagattcttgtcagactacaaatgaagaggaaatatttgaagtgcaagataaacggtctctttttccccttgggtggatccatattatgctgccagaatctgttgcaatagttatggcgccaagagatagttcgagaaaccatggcatttttcggttgacagcccctggtggaatgtctgtgattaaacaatgtgatcaacgtggctttcatccacatagtcagcctccagatggtggtccgatttacaagacatgtacagatgtatacatgaacccagatttaaaatttgaggtaattgatcttcgatga

SEQ ID NO: 87344 - DNA, 2982 bp, Glycine max
  Peptide Sequence Number=SeqID_179029
atgattgtcaaacaaaaaagtattgctgaggacaaggttatttttccagcagtagatggaaagttttctttctttcaagaacatgctgaagaagaaagccaatttaatgagttccggtctttgattgaaagtattcaaagtgaaggagcaacatctagttcagaaactgaattttattcaacattgtgttcacatgctgatcatatattggaaacaatacagagacatttccataatgaagaagttcaggttcttcctcttgcacggaagcactttagcttcaaaaggcaacgtgaacttctctatcaaagcttatgcatgatgcctttgaaattgattgagcgtgtcctgccatggttgattcgatcattaactgaagatgaagcacagatgtttttgaaaaacatgcaatcgacagctccagcaatagattctgctttagtcacacttttctgtggttgggcttgcaaggctcgtaaagatggtttgtgtttgtcttcaagtgtatcaggttgctgtccggcccagagatttactgatattgaagaaaatactgtccattcttcctgtacacctgcttctgcattgtctggtagagtttgctcagtattagctgaatcagatgggacccaacaaagatcagtcaagagaaacatatcggaggtgcacaagaatgaagacgtctctaaaacttcagaaagtgaaagttttcagaaacaatgttgtagtgcccagtcttgttgtgtgccagctttaggagtcaacaagaataatttggggctgggttcactctctacaaccaagtccttacgctctttgtctttcacagcttctgccccatcccttaattctagtcttttcatatgggaaacagacaacagttcatgtgaagttggttctacagaaagaccaattgataccatatttaaattccataaagccatacgcaaagacttggagtatttagacattgaatctggaaagctttgtgatggtgatgaaacaattattcggcaatttagtggaagattccggcttttgtggggtttatacagagctcatagtaatgctgaagatgatatagtatttcctgccctcgaatccaaagaggcacttcataatgtgagccattcttacacgctggatcataagcaagaagaaaaattatttgaagatatttcatgcgttctttctgagctttctgtccttcatgaaaacttgcaaagggcccatatgtcagtggatttaagtgaaaatgattttggaatttctgatgccaatgatgacgataatatcaaaaagtacaatgagcttgcaactaagcttcaagggatgtgcaaatctattagagtgaccctggatcaacatatttttagggaagagctcgagctctggccattgtttggaaaacatttcactgtggaagaacaagacaagatagtgggccggataattggaactacgggtgctgaagttctccaatcaatgttaccgtgggtaacttctgcacttacacaggatgaacaaaacaaaatgatggacacatggaaacaggcaactaaaaacaccatgttcaatgaatggctaaatgaatgcttgaaagaaagtcctgtatctacatcacagacagaagcgtcagagcgtagcacttctcaaagaggtggtgattatcaagaaagcttgaacctgaatgagcagatgttcaagccaggttggaaagacatattccgtatgaatcagaatgaacttgagtcagaaatccggaaggtttatcgcgactcaactcttgatccaaggagaaaggcataccttgtgcagaatctaatgacaagtcgctggatagcttcccaacagaagttacctaaggctccatctggggagtctagtaaacaaatagaaggatgctcaccatcatttcgagacccagagaaacaaatatttggctgtgagcactataagcgaaattgcaagcttcgagctgcttgttgtggcaagttatttacttgcagattttgtcatgacaatgcaagtgatcactcaatggatagaaaagcaacattggaaatgatgtgtatgcagtgcctaactatacagccagttgggccgatatgcatgtcaccttcatgtaatggacttacaatggcaaagtattattgcaacatttgcaaattttttgatgatgaaaggaatgtttatcattgcccattttgcaatatatgccgtgttggacaagggcttgggattgattattttcattgtatgaaatgcaattgttgcctggggataaaatcagcatctcacaagtgcctggagaaaggtttagaaatgaactgcccaatttgctgcgacgacttgttcacatcaagtgcaacagtgagagctttaccttgtgggcattacatgcattcatcttgctttcagccactacacatgtccaatctgcagcaaatcactgggagatatggcggtgtgcttgagagagggagttcctttgggaaccattttgttgggagttcacttctactcttgggggctcacttagctgtttctttacctatccaggtttactttggtatgcttgatgctttattggctgctgaggagcttcctgaagagtacagggaccgctatcagctttttgagcgagaaaaagaaaagctgcaagagcagccatattgctctaaacaaaggatatactctgccatgactgtgatagaaagggcacttcacgcttccactggttatatcacaaatgtggatcttgtggctcatacaatacccggtacagagcttgtaaatatttgtatagccaatccaattttccccaaaccaggaaactggttacctttcattttatacacaatgcgagtcacttccaatgagacctctcatgagttaacctgtcttctcttgaaagttcatttaaagtgcgcactagcgttgctttacacagcaatcgttgggagaagggagactaaatga

SEQ ID NO: 87345 - DNA, 219 bp, Glycine max
  Peptide Sequence Number=SeqID_179030
atggcattagaagaggggaaggctcttggcgtgatcaaattgacattagccatgaacgtcgggttcaacatcgtaaacgagaagactactataggccatgatggagacttatttttgttgaagatcttgagatcagagaatccaacatatatgttgactaaagttgttacaactgacaagatgaggctttgcattgcctcagttagccttcgaggataa

SEQ ID NO: 87346 - DNA, 648 bp, Glycine max
  Peptide Sequence Number=SeqID_179031
atgcaggaggtaaggtggggtgagaatagcatgatagaggcagagagacgcctactagccaatgcacttgttgatttcaccaaccaacgttttgtacttctctcagagtcatgcattcctttgttcaatttctccaccatctacacttatctaatgaactcaaccaagacctttgtggaagcctatgatctgccaggtgaagtgggccatggcaggtacagtccccaaatgaggcctcaaattaggctctcccaatggagaaaagggtcccaatggttccaaatagaccgttctcttgcccttcaaatagtctctgatcaccaatatttctcagtgttcaagaagtattgcaaacctagttgctatagtgatgagcactacttgccaactttggttagtatcaaattttggaagagaaactctaataggaccttgacatgggttgattggtcaaggggtggacctcatccttcaaggtatttcagaacagatgttactattgagttttttaacaagttgaggtttggaaggtcgtgtgagtacaatggacgtaccaccaatatttgccatttgtttgcaaggaagttcacacctcatgctttggatagactgctgcgatttgctccaaagatcatgcaattcaattga

SEQ ID NO: 87347 - DNA, 2433 bp, Glycine max
  Peptide Sequence Number=SeqID_179032
atgtctcaaagtattgacaacactgtgctcaggactttggctatggtgacaaagactgccaagtctcctgaaggattgttagagaaagttatagttgatgaagtcaatcttggttttggtgatgaaatttatgaggatgctagaatggaagaacaacagttgtttgagttccatccatctcttttcaaaattcacgagtctattgtgggtgtttcaattttagcaaacaatttggttcagattcaagttcaggtctatgacagtgaatgtatgaggactcatgacaacaatttgcttgggcaatttgagtctgatgttaatgtggttaacgctttgataattatgtatgtgcaatgtggcaatatcaacactgctaggttggtgtttgacaaaatgcctaatcaggacaggactttgtggagtgccttgatttctagctattttgaatacaaggagccttttcttttgaggtatgacttaacaactccatttgctatgtttgtggctatgactagtcgaatatctttcgaaagataccaaatagccaaggtttacagaagggatcacccatccaagggaagatacaatgaattttatcaatgtgactttgatgttgcttgtacccctggtctgtctgaaattataggcctggattattccaatggagttatattagaagttgtttctcaaaaagacgctcagcttgggtcaattgctaccagtagccaatatgataaccttatagggatgattggttcaagatcagtgcctagagttggtgtgagtatgggaattgaaggagtattggtcatactggagcaactacagacagacattcactacatcatagaagaaagcaaagagaccgtggcgacttttctgttcttagagagactcaagaagaacaactatgaagttctcttcatggtgaatgcaattgttgagtatgcagttgggcaacccaaggacaacaatggaaagaaattggcttcagccacaaaggaaaggttgaagctagatgatgagaccgtggaggagaaaaagaaggtagcgaataagaagaagtcatttgacgagctttacaaaggattagtagttgagaaagttgacagaattgatactaaagagcattttgctgctaagcatttttctgttgcgggtcaactagagtttatggttgtcctctttatccccttgaaggaaccttttgatctctttgacactaggaagatgcctagcaaaatcaaactctttgttaggggtattgtggattctgaggatcttcctctcaacatttatagagcattgctgcagcagaacaagatcctgaaagccattaggaaaaacttggttaagaagggcattgaaatgttcttggaaattgctgagaacaaagagaactataaccagttttatgcagccttctctaagaatctcaaacttggtattcatgaggtttctccgaacaagacaaaactcactgaattgctcaagtatcaccccactaagagaggggtgcagatagcagctataggcccacaatcagaccagctttgccttgctattatcttgtcgagatcagaagaaggcacagggtcatggagaaagaggaaagagggtgtgttgcgcgcaagagtaacaatggattgcaaagagcatatccccaagctccgtacgttggtactcaccgtctgttggttgttgttaatcactctgccatactgtgaagccgcatacaattattcggaatgcaaagagcaaacatacaaatgcggaaatctgatcaacatatcgtatcctttctggggaaaccaccagcgagactctgaatgtggtggcggtgacctattcgagctcaaatgctatgatgatgatactacacttctaattggctctcaaaattacacggtgaaggagatcaacatcaccacttacaccatgagactggtccgaacagaccttgcccgtgatgtttgctctccgcaatttggtgacacttatctgaaccctactctgttctcgtatacccctaaagtgtacaacgtcaccatattctacgattgtcccatcacatatccaccgcctacacacagcattacgtgcgggtatgctgtccctaatattggggagggatttcaggatcaagttttagagcagtgcaagcgacgtttgcacgtgccgactgacgttcctcaagttgattatggtggtggtgaaaattctcttgataaagggtttgaggtcaagtatactgtttctcaagattgcacaacatgcctgggaagtgaaggaaattgctcgagacatgatgctcatttttaccaaaatttatgccattattgccctgatggatctcacgccctgcactgttctaaaagtatgtcttctatcctatcctcgctcctcttttctcctaccaacttactgttgtag

SEQ ID NO: 87348 - DNA, 195 bp, Glycine max
  Peptide Sequence Number=SeqID_179033
atggacacagcaagactaggaaaaatgtgcagtcaattatctagtttttctcaatgtcaagtcaacaaactgtatgattcctacttccttacgggaaccagatgcaaatttaagagcaaagagatggcaaagtatgaagaggattttgctacaacagtaagttggttagagaaaagaggagcgaggataggatag

SEQ ID NO: 87349 - DNA, 434 bp, Glycine max
  Peptide Sequence Number=SeqID_179034
atgaatcttcctcttcttcaacctctttcttcattcatcaacacccttttcttcttctcactcttcttcccaacatatgtatctagtgattctgaagggtactcagcatgtgaaccttttagctgtggtcagatcgacaacattagctacccattttggaatagtgatcatcaaccaagttattgtgggcatccaaagttcaagcttgattgccaacaagacagcgtgacaattggcatggtgtcacagagattccatgttattgagattgatcaaacatataaggttttgaagattgcaaggttggatttatggattgacccttgtactgatgagtatagcgatgtcaagttggattctgatttcttcaactacacttccaatgatgatgagtatactttgttatatgattgtggtcgtcctgttttaaacac

SEQ ID NO: 87350 - DNA, 237 bp, Glycine max
  Peptide Sequence Number=SeqID_179035
gccaaagaagagaaggttaaagaagctgatgactcgcttagcgaggtagattcgctcagcgagatgcatccgcttagcaaggcatccagctcgcttagcggatgggaaactctagaagaggacaagtcaaagatctgcacgcccagcgcacagccagccagtccagcgaggatgctgtctcttcacgcgctcaacatgcccactctcgctaagtggaaattcactaactctcgctga

SEQ ID NO: 87351 - DNA, 891 bp, Glycine max
  Peptide Sequence Number=SeqID_179036
atggcctctaggaagagaaaatcatccacctccttacctcaagaaccttacgatactacaagattcgttttcgaggtcgcctgggaacgttatgagcaaaatgtacatgccaaaaatatcctcctagaaaggaatgttgatttatacatgacccagtacaacgagttccgaaaggagctcgagatgaggaggtggcacaaggccttgaccaggcagcttgatggttgcattgatgtggccctggtcaaggaattctatgcttatttgttcgatccagaagataagtccctgaggcaggtcagagtgaggggcaaattgattaagtttgatgatgagaccctcaacacattcctggagacccttgtggttttggagccaggggagaggtactccatatattccaggttctgccattcacatacgaacccacaggagcttgcatccaagctctgcattccaggggcgaggttggtatacggacttgtcatgaagatggacatggatgtgggctcgatcatctgtagtcagatctcgcagatggcccaatccaactcttccagagcattcatgatttggctcagcatcgacccatcatcaacatggaggatttcatggcctaggtggcctggccaggagtccagccttatcttgcagggggaggtgaggctcctaccgcagccagggccagaggtgacaccagaggacacgcttgtcgccacgcctttggaggccactaacgagggagataccactgtagatgttgattatgttgcagacatgacaacaacacagattacctgggacccctggcccacatcagcacaggattccattcctacaccagcccaggatgccccatccacacctcaggatgatctagcactggcatag

SEQ ID NO: 87352 - DNA, 318 bp, Glycine max
  Peptide Sequence Number=SeqID_179037
atggatcttcattgtaatattcttctcttgaagagagaattcttcttccattcttcttattcaatgaaattggctaagagacttagcttgcttcttgtatctacttgtagaagaaacaacgcagcaaagaaaagaagagagctacaagataggacagctaacctcaatagcgagagaattttttcatctgaatcttcttcatcattccctactaagttgagagaaatcgacgttcatgcatctaaggcaaacataatggcagaggatcaacaacaaagggtgactcttgaagattactcaagctctactatgccatag

SEQ ID NO: 87353 - DNA, 513 bp, Glycine max
  Peptide Sequence Number=SeqID_179038
atggatattggtattgggatcccttggtggtgggtccaagcagcatgtctctcagatggaacgacagtgcaagtatcgaaagagaggctatcatatggaagagactcacacttgaaagggaaattattagagtacaagtgtgaggatgagaagttctgccccaagatatctggttttgggctagcaaagctttgtcctataaatgaaagtattacttccaggtcagatgccagaggaacatcaggctgtgaaataatgttgttagaaatggtgggaggaaggaagaatattaatattgaagctagtaaggcaagtgaaatatactttgcacattggatatacggcaggctagagcatggtagagatttaagacctgatgaggtgatagccgtagaagaaaatgagatatatagcaaggagaatgacggtagtgggtctattgatacgaatgtgcaagcatacaaacaagtgcagaagcaggaggcacaacagcaaaacaggaggtgcgggtag

SEQ ID NO: 87354 - DNA, 855 bp, Glycine max
  Peptide Sequence Number=SeqID_179039
atggagaaagaggaaagagagtggtggtttcgtaggaggagttttgcttttattgattcatatggtggtgagaatcgtggccatcattttcaaagaacatgcatttatgtgtggaaacggcatgatttatgtgtgaatggtgttgcgggcaagagtaagaatggattgcaaagagcatatccccatgctctgtacgatgttctatcttccaatccaaaatttgagccctgtacaccaagaaattgtggaaatggtccacccattaagtatcctttctggattccttatgaacaagaatcattttgtggctactctaacttctcatttactgtggccaacatagatgtctatgaggacaagtgtcctgttcccttagataattacaccttttatcaaactccatttacctaccgttcagaaaattggaatctctccttcttctacaactgttccatagaacctaaaaattaccccactttcgaagtagattgtgctaaaaatgctacacattattctttggcggtttttcataaggaggcactggagcacaaaacctattccttgaatgagtgccagtttatggttaatgtgccattgaacatgaatgctgctattaatttcacaagcttattgagaatgaattaccctgagattttgaagatggggtctcttttgaattggattgcacctgattgccaggaccgtgagaaaagtggtggacgttgtggatctgatggcaatcagttcctctgcaactgcaaggataagtcatacttaaaaagttgtggtagtgtacgtggaaagcgcaaaccaacaaaccttaggctagcaccgcatcttctggaagatgtgtag

SEQ ID NO: 87355 - DNA, 388 bp, Glycine max
  Peptide Sequence Number=SeqID_179040
gcctaccgaaacctttgcggtcaatactgagatgaagcccaaaaaggagtgcaaggtaattttaattgaggaagatgtggaagaagaaaagaaggaggagatagaaagaaatgaggagaaaacacaacaatgggagaagtactcacaagtagaaattcaacaagaaagtattctccaaatcaacaaccctcctcatcaactgatcgtcaaggaagaaagacatgaaaaacatgagaaagccttaagtatcattccttccttgatcaccagcacttcccttgcaacaatatggaaggtgtttccgacatacatgagtttcatggtatctctagctaagaggcgaaaatgcaaggaagatgtgtgctacgtgaccttcatgccaccttga

SEQ ID NO: 87356 - DNA, 486 bp, Glycine max
  Peptide Sequence Number=SeqID_179041
atggctctgacgatgattcggatggcaattagggtagtgaaggaccagaccaacataggaatagccaaggtcgcgagcaacatggcgcgaaagatggaggtcacgattttgaaggcgatgagccacgacgacaaccctgccagtgacaagcaaaaaggtgtaaatttggaaagtgttgcagctggtgtctcgctaagcctaggacatgcgcttagcgagtatcgtccgctaagcgagacattagcctgcttagcaagtaagaggaatcttgaagggaattttccatgcaagcatgtgctcggcacgtcatcagctcgcccaaaaaaggcagtaccagttctagaggagccttgttcatcagagtcatcttctactttcccacaaacgagggaatctcatacaggtgcatctgaagctcacaggatggctgaagatcaacctcgcagagtcacccttgaggactattctagttctactatgccataa

SEQ ID NO: 87357 - DNA, 1545 bp, Glycine max
  Peptide Sequence Number=SeqID_179042
atgtcaaaacccttttgcgccctctttgcactgtccatcatccttgtgacatgtcatgctcaaacccttaatacatcaacaacatgtgaaccttctaaatgtggtaacctcaacattagctaccctttttggaagaaatccaacaccaacgttcaagaattttgcggttaccctgaatttggccttgaatgtttggatgaccaagccatcatgatttttccaactgacagataccaagtcacggatataaactatgatattcattcaatcacacttcttgacatagatgtgttgggacaaccatgtcctagggctcgacacaacgtttccctacacaatctccctttatctttcagctcattagattttaacctcagtttctatttcaactgcagttcttacccttcatctattcagcacatagggtgcatggaacatgataagtatcagtcttacgtgtttaagaccggggatgaagctgaaagtaatggctttgattggcttaggcactgtgaggagcatgttgtggtgacagtgaagcaggatgagattgaaattagtagtttgatcactggttttggtgatgctatgcagaaaggattcgtgcttgattggatgagagctcaggattgtgcagtgtgcgaggagtctaatggctattgcagattcgaccaagccactaagcaatcgaggtgcttatgctcagatggcagaactgaagccaaaagttgcaaaaaagggtactcagcatgtgaaccttttagctgtggtcagatcgacaacattagctacccattttggaatagtgatcatcaaccaagttattgtgggcatccaaagttcaagcttgattgccaacaagacagcgtgacaattggcatggtgtcacagagattccatgttattgagattgatcaaacatataaggttttgaagattgcaaggttggatttatggattgacccttgtactgatgagtatagcgatgtcaagttggattctgatttcttcaactacacttccaatgatgatgagtatactttgttatatgattgtggtcgtcctgttttaaacacgtctagagtgaacattgaaggaacaataccattcacttgtcccataggtggtggttttccaaatgcattttgtctgttaagtaaagatgtgggtaatttgaagggtctggggtgcaagaatagaatcaatgtttctgttctaagagaggctatgaaagatgctttgcttgtgcaaaaagttttggaaggaggatttgaggtagggtggagtggtgtggatgaagaccgatgtgatggttgcataaaatctggtgggagatgtgggcacaatgaatctaaggatgcatttatgtgcctctgtcttaatcagcaatctagtgatgaggtttgtagcaaaagcctagcaaggtctccattagcagcacaaacacctagaccaacgacagcaaagtcgctgataccccctaattctccaatatttccaaaacagtctccacatgctccgagtatgtattcttccttgatttag

SEQ ID NO: 87358 - DNA, 871 bp, Glycine max
  Peptide Sequence Number=SeqID_179043
atgaacacactgtggcacagcgagagtgtgggtcgaaatcgtaaggaaatgagcctgcgggtcgagatcggagttctcaaaacctctgaaaaaagaccccgagagagaggagtgagtacccgcaaagagaagagtgttactggtatggagaaaggacagaaaggagtggagtcagcgcagatgatagagaaaggagaagaagtgagtattagcaccaacaaagttgttgagtacaagtgtgaggtgaagtcccacatcgggtctccttatgtggtggctcgtggtccacaggtggccagaatggctagcggcacagcgcgccccgtaggtgaagcggggctacgatgtggaagagactcacacttgagggggagatgtgttgagtacaagtgtgaggtctccttatgtggtggctcgtggtccacaggtgtacccctcgaatctcccaacaaaagcctccatgacactcgtatcaaaggttcaatgagcctcaatcgtgcttcatgtggcaatttgttcacattcgcacccatgctcttggaacaactgcttcccctttatgccaagcttggctcaccaactgcgagtagtcttcatggttgcaccaggccacttggaaccaaaatggcctattctgtatgtttgaaactggattgttgcagcgaatcaacaagggattatggtgagaacgtcgactattccaccagaacaccgcttatgtcatgtaaacttactcccaaagaactccatgcccaacaaagctcagttgctcgtgtcaccgaaaaggggtcagtttttggagggattttcgccagtggagttggcgagttagacacgtggcagcagctgggggaactcgccagtggagatg

SEQ ID NO: 87359 - DNA, 189 bp, Glycine max
  Peptide Sequence Number=SeqID_179044
atggaagcactcgatcgatgtgggagcgggcgtgatcgacgcggattgcaggggtcccgtagggtaaaagttggtgacagggttgcacagatgataatccagcagatcgtgatgccggaggttgttgaggttcaggatttggattctacactcagagctgaaggtggcttcggatccactggagtttag

SEQ ID NO: 87360 - DNA, 339 bp, Glycine max
  Peptide Sequence Number=SeqID_179045
atgcagcagggccgatggataaggagtgtagttgattatgataacatagtaagaggaaatggaagtactcaggctccaattttggtttatccaaatgacatggatggcggtgtgccaaagatttccttaccgacattcgcaatggcttcctacaagttaaagggatcgatctatttggatacaaaatggactgaaaagatgagctcttctcaagtgaaaaatgaaatagagattgctaaaaaaaactgtcacataagtggaagggcccttatgggaaagggaggaaaagctaaacatacagcgaaagagattcaccaggaagaatatatgtgggattaa

SEQ ID NO: 87361 - DNA, 291 bp, Glycine max
  Peptide Sequence Number=SeqID_179046
atggcgcagagggctcaaccagtattggccaccacagatgtttttcaaaagggagatattcattggaagcaattcaatgttgaaacctccactgcttcctcatcacctccaaaaccattgcttatttttacaccagcggtgcctggctcataccctgggtttcaacctctacttcttgagaacgttaaagccaaattggagaaactagttctatcaggccacggtggaaaaactgcatttgctgtggcactagatcatgccaaacaaacctcaaattttcagcactcatag

SEQ ID NO: 87362 - DNA, 261 bp, Glycine max
  Peptide Sequence Number=SeqID_179047
atggcgactccactagggaccattagagagttaagccatttgatcaaggttgctctattcacacatgacacttacacctacactttttgcacacaatttgagatattaggccatatacccaggtctccgacttgcttgatgacagtgaaccctcatctagagtttttctctttaggtaaggcattgccactggtagtccctatcaccacagtgttgttacctaagaggatgatatctctagaggctagtgaggttacatga

SEQ ID NO: 87363 - DNA, 207 bp, Glycine max
  Peptide Sequence Number=SeqID_179048
atgggagcaatgacattagaagaagggaaggtgaagatcgagaaggagaagaagttgtatcagcccttatcaggggttaagctagacgacatgaagcaagaagaatggaacttgctggatcgacaagctcttggcgtgattagattgacatttagcccagaacgtcgcgttcaacatcgtaaacgagaagactactgcaggctttaa

SEQ ID NO: 87364 - DNA, 375 bp, Glycine max
  Peptide Sequence Number=SeqID_179049
atgaatgcaaaccttctcagaaacttgtccttccacgcgcgccgtcttcgcttctctcccactcctacagttacagcacccacctgcttctcttctcgctcccatgccccagacaaaccccactccctcgttgaagacattagcgacgaagagttgaagaggcgtgtggcaaagcttcaagagggtgatgctgaggcaattccttctgtgtttgaggctatattgcagaggtatttagcagggaagcctatagaagctgaccaggagttgatgaggggaattctagggaagtggacattgtccgaagatgaagaggatgagtccgattctcattgggaagaaatagatgacactgataatgaagatggagtttga

SEQ ID NO: 87365 - DNA, 669 bp, Glycine max
  Peptide Sequence Number=SeqID_179050
atgaagcttgtatatgatatcgaggaagaggagggtgaccttgtaagccgtgacgtgagaggatgggtgatgaaatccatcgaaagatcctcccatatcccagaaggaatcgtcaatggttgtaacaagccggccgattttccagggaagggggttatcatcattgatctagacactccccttgtagaagatcaaaccattatggagaaagaagtcagggaaatcagtgggactagcttgaccaaacatgtggagtcaggtgcaggagtaatgcgcaatagggcatccgctatgacacttgagttcattaagtcttacaagctccggtggtcggtgagaatgatgaatgcgtgtccgaggagatattggcgccacttgttgactgcggcggcaattggcttggcattctacatcaacacggtgcccatggcaacgccggaggcgtccatttcaatcacaaatggtatagtgaagtctagaggggtcaacacaggggcgaatgtcatagactggccactgtgtcatggcggaaattttggaagggtcaagtttaatgctgttaccggagatgacatgacccagatattccaggtgacattccctgaagaaacatttggaccgcttgaggaagaactgatgacggaggagagtatccagcacttgttctaa

SEQ ID NO: 87366 - DNA, 1023 bp, Glycine max
  Peptide Sequence Number=SeqID_179051
atgttgattgtgtcgttgaggaagggggattgtgcaaaacggtgcaatgggcgagcaaaggtgtttcaagaatcggcttccaaaggaggcggtggactttctctcatctcctcacccttactctctgtgttgtcactcttgtctgccgccgatgttgaacccattgtcatcgtcaaaatcaccattgtcgaacgttcttgctctggctctgatcccatccctgaaaggggagttccagtggatgttcgaattccgcctcaaggccttcgacaaattccagtccatgaaggaacccacgtgaacatctgctactactctaagtcgaagaataagcccttactccaatccctcgacgacgccaacctaaagcttccccgctacttcgacaagcttagcatccctctcaatgagcaaaagagcctcgccaatgtcatcatcgatgtagtcctcaacagtgtcttcatcgccacaacgcactgcaaaaccctagaaaaagttgacatcattttctgctccatcttcgaggccattaagaatttgttgaaggagcaaaatgaggaaagtggacttgtcaaaagaagcattgcttcaaggactttgtttctattatgttttggactcaaacatagagtgtttgaggtctccttggttgatcttcaaggagatgaggatcatgcattcaagaagattaggttgagagctgaagatgtgcaagggaaaaatgttctgacaaatttatggacaactgataactacacattgaggatgttttgcattggagttaccaagagaataactaaccaagtgaagagaacctactatgcacaatcaagccagattagacagatttataggaagatgagggagatcatgaccaaccagacaacatcctatgatttgaaggagttggtccgcaagtttattcttcagatcattagaaaagagattgagaaggcaacatctagtatttaccctcagcagaatgtgtttgattgtaaagtcaagatcctgaaacactgctaa

SEQ ID NO: 87367 - DNA, 285 bp, Glycine max
  Peptide Sequence Number=SeqID_179052
atggctaagcctattgtggggcaaaacctagcgtcaccactgtcactccttcctgttgccattgaaggggaaaagggaaggattatagtgacaaggataggctctttgtctacaggagtagtagaaggccttaccttctcgcggggttcagagctgccctcaccaacatggtgcgagtccatcaacctctcgaaggagaaggacccattgttggaagatttatggcatacctccttcgatgaggaatcacctattgaaatgacctctcgttctactaggatttga

SEQ ID NO: 87368 - DNA, 312 bp, Glycine max
  Peptide Sequence Number=SeqID_179053
atgccgactactattggtcgacactcaaggttgacgctctcgacttcacaaggaggtgtcaagcaccttgtgactttttccgaacatccccagacaactggccaagtagaggcaacaaacaagtttatccttaaagcgctccgcacgagattttacaagtccaagggcacaacagaacgaagaaaatatacgggtggaattagagataaaggacgaagtttaagagatggtcagaatcaaggaagaggccaccaagctctgagcatgatgaaaattcaataccaaggtctaacctcaagcttttcaacctag

SEQ ID NO: 87369 - DNA, 501 bp, Glycine max
  Peptide Sequence Number=SeqID_179054
atggggttgaaccaagcacatgcttttaagaaaaggttttcatcaagtcaaggtaaaaaatggaggaaagaacgtgctttacgacgcccttaccgaacgcgtgttagagttagagtaatgagtgaaatagaggaggtgcatgagcagatgaaggttgacatggaggccatgaaagaacaaattaccacaatgatggaagccatgatgagtatgagaaggatgatggaggttaatgctactacatttgttgctgcaagtaccgccatagaagtggacctgactcacccatctggcctcaatcaagtaaatcatctagtctcggatatggtaggtcaaggatgtgaggcattgggaagtacgagtggcccccattttgtgcaggcccagagcaagcattctttcccaccatatggcttgcctcccaactatacaccacctaatgttgcacacgctcttgacgagaacgtcgataactttgatcccatacccattgaaagctga

SEQ ID NO: 87370 - DNA, 222 bp, Glycine max
  Peptide Sequence Number=SeqID_179055
atggcaccccttgactttgttgcacttgaagacttgcacaattcagcaaacaaccttctccattctccaatggttcaacaagctattttccatcaaatagaagaaaaatggttagataatgtgttagagtcatctctaaggatgttggagagaagtgagaatgaccagcatttgcattgtggaatcacttttgtcccttgtttcctcaccttggttggataa

SEQ ID NO: 87371 - DNA, 651 bp, Glycine max
  Peptide Sequence Number=SeqID_179056
atgtctcatgcaaaagcaaatattgtaccaattgtagttgccattaacaaatgtgataaagcaggtgcaaattctgaaaaagttaaactgcagcttgcttcagagggcttgcttctagaggagatgggtggggatgttcaagttgttgaggtttcagcaactgaaaaaattggtctggataacctagaagaagctttactacttcaggctgatatgatggatcttaaagcacgaattcatgggcttgctcaagcaaatgtgatggaagcgagacttgacaaaggacggggtccattagttcttgaagtgctagtggaagtggtcgaaggtgatgctaggaacgtgttgtgtgatgttgtagacaggcaccgtgcatctatattggttttgggaagccacagctacggagctatcaaaaggttttcaaactcttgcatgtttgagtccttgaaggatgaaatatttactagcatcatttccatcatcttcttgttagtatttaaaatccaagttttggtgctccataacaagcctaaggataatgattctgatcataatgtggattttgctgctgggaatgtgaaacttattaccaccaaagaagcgtgggaccaatatttggaagaagcaaggagggatggcaaaatttag

SEQ ID NO: 87372 - DNA, 354 bp, Glycine max
  Peptide Sequence Number=SeqID_179057
atgaagaagaagaaggttgaagcagctggtgtctcgctaagcgaggcatatgcacttagcgagcagaccaataaccctgctggcaagcgcttggaagtgagaaaggtaatccacgacagacccccgttgggtgagcttgaacaggtcgcctgtgggatcgggttggatggggttgcggttgcatttgcagtgggattaggtaaggtcgaagaggaagaagaggaaagttcatcaatcaatgatagttggttggaggtcagcttggtgatggaatcctcgatgcaatcccaattagacttggaacgagttgattcaaccatgggaggacaaggactcaatgaaagcaccagttga

SEQ ID NO: 87373 - DNA, 237 bp, Glycine max
  Peptide Sequence Number=SeqID_179058
atggtcttaccgttttatatactacttgtgcgaatcggtgctctcaatgaaacacactttgtgggaaatgttgatgaagagtctcgccaactaataaaatgcacatatgagtgcctggagaaggcaatatccattgttaaacttggggtacgattccgtgaaattggtgaagctattaatcgtcatgcttcaatgtttggcttttcaatggtaatgatttacttctttgttctttga

SEQ ID NO: 87374 - DNA, 666 bp, Glycine max
  Peptide Sequence Number=SeqID_179059
atggcatccttaggacttcatccagctgatgtttatcgccagtttcatcatccaccacccttaccttctctggcttctcactcggaaccgcaaagagatgtaagcaatttacatgatgatgaagatgatgatgatgattatgttgtgtctaactcatacgttgaagagtctatagatgaagacaacagtgttgatggtatatctaatatcgatgatgaagtcaccgatatgattcaactagttacaattgttcacccaagagaaggtgtagaaggaattcaaaatccattttggaatgatgctttgcattataacaatatcaattggagtcatcctgatgaggaggacatttgcggtttggagatgctatcgagttttaatgttgggcaagaattatatgttggcatgaattttgatagtaaggatgcggtaaaaaatgcattgaaacaatacgttatgaagcggcaattcctccttccgatgactcatggacatgtccctgatccaactacaatctgtgcgaaaggtcggccaaaatcaacgaggaaaaggaacgagatggattggctcgaatcatctgagcaccgaaaaaaatgtagtagatgtggagcagaaggacacaacaggcgtcgatgtccaatgcaatcagaacgtggaagttgttaa

SEQ ID NO: 87375 - DNA, 66 bp, Glycine max
  Peptide Sequence Number=SeqID_179060
gtggaggaggagcggcgttttggcttcaacctgaaccaggtccaggagaaagcctaggtggaggag

SEQ ID NO: 87376 - DNA, 186 bp, Glycine max
  Peptide Sequence Number=SeqID_179061
atggctcggaccagtctttcttctttatcaataccttttcttattctgctgataataacctttactttctttgcacagcttgctccagttagtgcagatctgaagatgagaaaattgggtcccatgcaaaatccacctccttcacctagtcattctcatggacctggacctggacatggacgttga

SEQ ID NO: 87377 - DNA, 300 bp, Glycine max
  Peptide Sequence Number=SeqID_179062
atgcaacatccaacttgcgatagaactgggcatagaatagagaaggaggaacataccaaagttgatcatgttttggacttgactcaaatgaaacccacagaatgtagagtttacttgaggacgaagagggtattacatgtaaaggagagggtaaagggtcagacaacatttaggaccaaggccaaggagtatcatgctgatcagaaccaggataatatattggctactgaggcaaagttcaaggaagtgttgacttcatacgaggccataaaacaagaaagaaggaaccatcatatgtag

SEQ ID NO: 87378 - DNA, 423 bp, Glycine max
  Peptide Sequence Number=SeqID_179063
atgacttggaaactggaatggaacagtgagacgattgaattagctgatatagaatgggacaaccttgggtttgggcttcaacccactgattatatgtatatcatgaaatgcacacgaggtggaaccttttccaaagttagcacatgcactgaatctacacaagcattgaatcttgtgctggaaagaaaagattgtattgatttgatactcatcgaggttcatatgccaaccatgaatggctatgaattccttcaccgtgccagcaaggaaattgatgttccagttattgcttggaagatgatgagtgaagcagaaaacggggcaaggataattctgaatttggttcttcttctgttgttagagaccaaagcaatagcagttccaaggaagttgatgaatcagagcattgtgtttcctcaatga

SEQ ID NO: 87379 - DNA, 306 bp, Glycine max
  Peptide Sequence Number=SeqID_179064
atggctgtggctgagaaaaatgaattggggagtaagggagcacacggtagctcatcatgtgcaatgttctgcgtaattgatacagcaataacagaaatggaaaaagatgaatgctctatgaaagatcaattagaagaagatgataatttcgtaaaaagagttgaggactcctttgactgcatgcaagttgaaagggttgaagactccttcgacaacattcaagatgaagctgactcatgcttgcaagaggacaaaatgcaagttgggagttctgaagttgatcaagatatggctcctctttggtga

SEQ ID NO: 87380 - DNA, 330 bp, Glycine max
  Peptide Sequence Number=SeqID_179065
atggggatccctggattgagcaatcagaataatgggcagcaaagattaggcataactgagcccatttcattggctggaccaactgatgatgatgcgatcaagacgcttgaacttgagaagtacttgcaaggtgttggattgtacgagagtcaggaggaggctgtagtaagggaggaagtgcttggcaggctggaccagattgtgaagatttgggttaagaacatcagccgggcaaaggggttcaatgaacaactggtgcatgaagcaaacgccaagattttcacctccggctcttatcggttaggggtttgtagtttggccagagaataa

SEQ ID NO: 87381 - DNA, 315 bp, Glycine max
  Peptide Sequence Number=SeqID_179066
atggtgtctctgactccgttatgtttcttttttaccgtgttgatcgctggggggtcagtgatccggtgtgccgcgggtgcagatgcggccgcggagcccgaaacggtgcgttttgacaccgggggtttgagcagagagacttttccgaaaggcttcttattcggaacggcgacgtctgcgtaccaagtggagggtatggcccacaaagacggtcgcggcccaagcatttgggacctcttcatcaaaaaacccgcattcacttcttacacgtacggcttttctggtgaaaagcaagatgcgaatgcgatgagatga

SEQ ID NO: 87382 - DNA, 1089 bp, Glycine max
  Peptide Sequence Number=SeqID_179067
atgtcactgacacttttcctgaagacccttttcctcttcttcccttgctacctgtgcctccttgactcagcaacaacaacaacaacccttaagcccattttgctaaccccatccaagcctgcaacgacaatccctgcattcccagaacaatctgatgtctcagggtgccctctcaccctctcagatgagctctttgatgggatcaagagtgcatgtagtggtgccaaaagtggtgctgacatggagctccaccacagcaggtgctgtccagtgcttgcagcatggttgtattctgcatattctgccactgcactaggcagcatggcaggccatagccatagccatagcaacaatgctcatggtcatggccatgccacatcagcatatgacatgatgcctttgctcccagatgactccgaaacatgtgtgaatgagctgggaaaggccttggtagtgagaggggttgagctgacaaagcctaatgagacttgtgatgtggtgtattgcttctgtggcattaggctgcaccacttgacatgccctgattcattttctgttggccaaagtggggaacttgttggggatgcaattgtgagaaggttggagaagaattgcttgagtagcagcactaatgtcaatggcttaccaggtcttggagggtgctctaagtgcttaaataccctctatttgttcattattgtgacttggaatttgatggatcttattgaaaaattgaagaagatcaagatgcttaacaagaagacttcaaattcaagcaaagcagaagacaggaccaccaagatccacaacaaagattgtgagcttatgggcttgacatggcttctggctaaaaataggacagcttatatgcacacggtttctgcggttctccgtgctttgatgttgaacactgatggctcttaccctcagtcctgctctctaaacagtgatggaatgcctcttgcagtggattcatcggaaatctctgatcactcttcatcaaacaacctccaaccacccatctctctttctttgttattcctttgtttgttactactgcctatgcatttaacaatgttatcctcatag

SEQ ID NO: 87383 - DNA, 958 bp, Glycine max
  Peptide Sequence Number=SeqID_179068
atgtggatgatgggttatgaaggtggtgagttcaacatggttgaacattcactcattactggaaggaaactcaagcctctcatgccaaggccaatgacgacttctctcaacaatgcaccaacaacaaccactcctagcttatctcagatccatgggaatgacttcctttcacaatatcattatcaccatcttgaacaaaacaagagagagttcaatggtgcagcaccagttgttgtgagctcaaggtggaatccaaccccagagcaactaagagcccttgaagagttatatagaagaggaacaaggacaccatctgccgagcaaatccaacacatcactgcacagcttagaaggtttggtaacattgaagggaagaatgtgttctattggtttcagaatcacaaagccagggagaggcaaaagcgtcgccgccaaatggaatcagatgctgaaactccagagaagaaagatttagctgcaagtaggacagtgtttgaagttgaacggaccaagaactggacaccctcaacaaattgcagtactattgcagaggaatctgtttcaacacaaaggacagcaaaagcagtggctgcagagagtagaacagatggatggctcctattagatgaaggggaattacaacaaagaaggaacgtttttgaaaggaatgcaaggtggcatgtgatgcagttaccttgtccttctccttcttctgcacctgtcacccacctcataaacacccctcccaatgcttctgtagctagtagcatggccactactacaaccacagtaacaacaagaaaaatggacccaaacctcattaagacacatgatctcagcttttttatttcaccccagagagaaaacagtgctatctactttagtggtagcagtagtactagtgaagaggataattgtgtggagtctcaaacccttcaacttttcccattgaggagtg

SEQ ID NO: 87384 - DNA, 219 bp, Glycine max
  Peptide Sequence Number=SeqID_179069
atgggaggaaataccggggagattcctaatgtgggacttcacctcacacttgtacttcaacacatctcccactcaagtagccttcatgctctagctacctgcggtacttgcaccgccgctccatctgcgggacacgttgcctggactcaccgccaggaagaatttcgatacatgggatccccaaagctgagatccatcaccgccatcttactcgtctga

SEQ ID NO: 87385 - DNA, 456 bp, Glycine max
  Peptide Sequence Number=SeqID_179070
atgggaagaaagaaggggtatgttgagttcgaggagtcgccgccggacgatttcgatccggcgaatccgtacaaggacccggtggcgatgctggagatgagggagcacatcgtgagagagaagtggatccaaatcgagaaggccaagatcattagggagaagctccgctggtgctaccgcatcgaaggcgtcaaccacctccagaagtgccgccacctcgtcaaccagtatctcgagtccacccgcggcatcggttggggcaaggacggtcgccacccatctctccacggtcacccttctctcttccaatttcaatctactaggctcccaaggttgaccctgttgagtctgaatgaccttcctgtggacaataataacaaaaaaaagggttttgataagttttatattggttggattgggaatggctatgaaatcataggtggagttagttcttaa

SEQ ID NO: 87386 - DNA, 840 bp, Glycine max
  Peptide Sequence Number=SeqID_179071
atgttaaaggagaagctactctctgtagcttcagattatcacgtatttgatccatgtttttggaggttggacgtgaatccaaacacactaatagtcctctaccctcaagcgaataatgcaaagaggcttgaggtcttactcagtcggctgataaccaagaaggatacacaaccctccagcctcaaacgcataatacgaggaggcttgaggtcctgctcaatcgaaaaacgaccaaaaaggcaatttcgtagcttgagcacaaagcacgaatgccttgaggaaaagggtgcattattgacaattttagaagcttctaacaatggattccctgaaaacttggtcaaagtttctccaagtaatagaaaagtgaaagatgcaagtgttccatgggcttcactcccgtcatctattgcaaagcttgggagggcaaatctcctgaaaacactttttttccttccacttttagcttttttgactctttgttgtcaagaagtgatgaagcaaagagatgccgcacatatggctgcaaccgaggctatacaagaagctgctgctgctgagagtttgctgcaatgtctaagaaagaaaggaaagaggagagatgggaagagaggaagaaggggcggttgcgttccaagtctaaggtggaaagggagagtcccaagggaaccagcttcaagttcttcatcgtacatttggcaggagcttagtaattctgctaaggaacaaaacccgcagcttgcagtagaggagttcctaactcttcatgctagcctaaatactgcagccagaggtgttgttgaatctgtggaatttagggatgagtttggtttttgctga

SEQ ID NO: 87387 - DNA, 102 bp, Glycine max
  Peptide Sequence Number=SeqID_179072
atggaaatgacagaacttcacatacaagtttggttctcttaccatgatgttcatgatcaagcaaaggtgggaaggctatggctaagggggttaatggactag

SEQ ID NO: 87388 - DNA, 339 bp, Glycine max
  Peptide Sequence Number=SeqID_179073
tccggcggatgcagccgctgccgtgggtacagagtatgtgcagccgctgaaactgtgccggttgatgctgcggctgctctggggcctagagctcgtggacgaccgaagaaatacgctgatgagatggttgctgcaggccgaggtaggggacgaggccgtggacgtggtggcggcggcggaagaggacgagggagaggacgcggtcaattgcctgcgcagctcagaaaatcaggggcaagacccgtgggtcgtccgaagaagatcctctttgcctgttgttatattacttaccgtggaaacattgtggccgtgtgccaaaaatatatatgcactttgtaa

SEQ ID NO: 87389 - DNA, 348 bp, Glycine max
  Peptide Sequence Number=SeqID_179074
atgtcgtcaccgcctttttcctcctcctcttccaaccgaaacttgcatagcgaacatgaggtgtggagtttgagccatcagcgtgatgcaatcgaagtggtttccaatctcgggcgggatgtcgtcggagtaggtgttgtagtagccgacgtagagctcgcggagggcgaagaggttttcgagctcgggtgcgatgttgccggtgacctcgttgctggagagggcgaggtactggaggtgctgtactcgggagggatctggccggagaagaagttgccccgaggtgaaggtggcagaggaggggcatggcagcgacaaagagagaaatttccaaattcactcccttga

SEQ ID NO: 87390 - DNA, 292 bp, Glycine max
  Peptide Sequence Number=SeqID_179075
cgattctcctcatgtttcagccagcccgcatcaattagactttgcaccttacgcttcgaagtcatacagtgctcaatggaatgtcccgaaactaatccatgatatgcacatgctgcgttcaagtcgtatcctcagaaaatggaggttgaggaaacctatcaggggttatggctaccatagcattatgggagcaaggatggcctttgtggataattgggtggtgggtaaggagaagggttgttattggctgagtaatgacattattgggttggtgggaaacttggccgtatag

SEQ ID NO: 87391 - DNA, 276 bp, Glycine max
  Peptide Sequence Number=SeqID_179076
atggtggtcatcgtgcccaaggaacacctagttgtctggttttgttcattgcataacaggccagacaactaccttaaggagataattaatagtgctttaaaaggtcttgatgatgctccacaacctaaatcaaaggctcctgctaggtggattgtcgtcaagtgtaatagacaaaaaggaatatttaacgatcctagaccattggagccagagagattaaaggccctgcggatccagtgggcacagtattatcttcgagttagagctcaaagctaa

SEQ ID NO: 87392 - DNA, 909 bp, Glycine max
  Peptide Sequence Number=SeqID_179077
ccagcagcaaccctaacgcgaagctcgtcgtccctcccaaggcctctgccgtcttcattgcgcaagagagagagaggcggtgatttcttccagaagaaaaacgatggtgacgatgacggtgtgaagagaagtggcggcaacaatgggaacaagaatgcgcgaacatgcttggcttgcgatatggatgctatgttctcttttgtgttttctggagatcgtgcaccttatagccccgctaagtttttatacaggtctgtatatggtgatggcgtcacgctgcaaaccttgccacttatgaacaacaggatgcacatgattttttcatttccatgcttgatggaatccattagaaggtggagaaggtatcagagagaagaagcaaaaatccaagcttgggtaaacctcgaaaatgctaaagcagaggccaggtatcagagagaagaagcaaaaattcaagcttgggtaaacctcgaaaatgctaaagcagagaccaggcgtggtagccgtgctgcttttgtttcacttgaagggcaaatagacgctcatgtcttggataactactactttcctaaagaaggctttacataccaggatctcttggaagccacaagaaatttttcggaagctacagttctaggaagaggagcttgtggaattgtttacaaggctgctatgagtgatcttcagattaaaatgcgcattaaaatggactttttcaaaaaatatgcttacaccatgaaggtgactgagaagtgtagctttggggtagttttgctggagctagttactgggaggtcacctgttcaacctttggaacaaggtggtgatttagtgacttgtgtgagaagagcaattcaggcatcagaatctccattggatgaggatgatggcatttcttccaaaggttag

SEQ ID NO: 87393 - DNA, 910 bp, Glycine max
  Peptide Sequence Number=SeqID_179078
atgaattgtgatttagctggaggagagcatcacaaggacaattgttatttttattctataaataactttgaccggagacaggaattggtcatgtacgactaccatgagaaagaaagagcccctgatcttgaaagtattttggcaaacttcatgacattccaagctagctctaaaggttactgttattctatgcaacaacagggaactcaatttgaaaggaaccagtcttttgaaagttatcaatgggagtcataccggcaaccctattatcacaataaagcagaaggagttcttaatctggatgatttgttaatgcaattcaaagatacggtaaagtcaatgcaacaggcctttagaaggactgaaactcagattagtaagttggtggatgaaatgactaacgctgcagccagaaaagaggaagagcatgcagagattgaaatacatcaagaaagcattcatcaagttacctcaatccatcatcaattgaccaatgaagaggaaaagcctgaagtctccagtactccagaatatccctacttggccactgttggctatgttggagggaaagataaaggtagattagaactcagtgtggaggatcaaaagatctcttttgacctctttgaggccatgaaacacttagatatgggtgatgcccattttgaagaagaagaggtggagcgggaaatagcattatcaacttcaaccatggtggtttttgaagaattgaaaaaattgagaccagcagaaaatcccaaagcagaattaaaaacccttctggcacatttaaagtatgtattcttggaagaagatgagaccaaacctgttataattagcaactctttgaagaaagaagaagaagaagatcaactagtgcatatttcaaaacgtcttaaagcggctattg

SEQ ID NO: 87394 - DNA, 327 bp, Glycine max
  Peptide Sequence Number=SeqID_179079
atgatgagtatggtggaaaaagaagccatggggaaaggtggatcatctaacaatagcaatgacagtcatgtgtgtaatgttgaatgctattataggttgaaggttgtaataagaacatccaaaatctctaaaagtccaaaatcaatccttttgatgagaggtgaatatggaaagactgagagtgaggatgaatgccttgcaaatagagttgaagataatcaaatactctgtttttcttttgcttttagtcatggtcgatttaaaggtggtaaaagggtgatggaacatgtcgtatactttttacttataatggttcaaatcctctaa

SEQ ID NO: 87395 - DNA, 210 bp, Glycine max
  Peptide Sequence Number=SeqID_179080
atgcgtggagtcgccaccaacgtttattcgaggaaaacgtcgaaaaatccggaaaagacgtggtctacgaactttaagtgtgaaaggtttgggagttgtatttatgcacagggaaggggaaaagagggaggtggttgccgcccagctcgcccaggcgagctgggttgcttccatcagaagacaccgccttctgttggaacgccctggaag

SEQ ID NO: 87396 - DNA, 813 bp, Glycine max
  Peptide Sequence Number=SeqID_179081
atggtgcaaaataaggaccaggaactcagaggcagtagcaacgggcccatcggcggctgccataggtggttgaaagcctacacgcaaggtctggattggctcccgaatttgagaaccactaagggggtggaagttgaagttacgaaggaggacgaagaggtgcaggccctcaggacagaacttgagaaagcccaaacagtcaaagaaaagttcaaatcaatagctcttaggatccgaaaggagaatgccgaactgagagacgtaaatatagccaccaccaaggccttggaacaagagaccaaaagggcccgtagggaagaacatggccggaacaagttccgaggggctctgtggggcagtaacagtgagcttaagctccggagagaggaaagggaccaatcacgagtagacagtttgatctggaaggatgaattgaggatttgcctaaggtccaagagaagcttgtctcagcggttatgtgagaccgagaccaacatgttagccatcattagaaagtaccaagaagaattaaatctagccacggcccacgagcacaaagtggcggacaaatatgcccgagtgtacgcggaaaaggaggctagaggaagggtgattgactcgttacatcaagaggcaacgatgtgggtggaccgatttgctcttactttgaacaggagtcaagaacttccccaattgctggccaaggtcaaagcgatggcggacgcctactccacccccgaggagatccacagactcctcagctattgtcagcatatgatagacttaatggcccatataattaggaaccgctag

SEQ ID NO: 87397 - DNA, 285 bp, Glycine max
  Peptide Sequence Number=SeqID_179082
atggcaggagaaagtggtggtggtgatgagtatcatcagttggacggagctcagcatatgttactggacgcgatgaatgcacaaatgcaacgtttgctggaccgtaacaatgaggaggtctttggacgactagaattattggagaaccaagcgaatcagaatgctagacgaaatacaggtggaaacagaggcagaagtgattcagatgcctacctggactgggaaatgaagatgagcatgtatttgcctgcaatgactacattgaagaacagaaagtcaagctag

SEQ ID NO: 87398 - DNA, 447 bp, Glycine max
  Peptide Sequence Number=SeqID_179083
atgacttccaagattattttgataatgccaaagattcaagagttaagcaagttccaaagaatcaagagtaaaaaagcttcaagaatcaagtctcgaagaatcaagattcaagaacaattaagtttcaagattcaagattcaagaactatcaagatcaagattcaagactcaagattcaagattcaagagaagttgatttcaagattcaagagaagaaatcgagaagcaacagtcaagacttcacaggggaaagggtacatctacttgggttgtagtactgagaacaagagagagtacatctcttgtggatcagttcaagtggagggtacatccacttggttgttcaaagagaacaagggagggtacatcccttgtggatctttgacttgtaaaggattttacaaggttgaaagaaatctcaagaaccgttggttgcttggggactag

SEQ ID NO: 87399 - DNA, 237 bp, Glycine max
  Peptide Sequence Number=SeqID_179084
atggaggccataaaagagcaaatggccacaatgatgaaggccatgatgagcatgaagaagataatggaagccaatgcggttatagttgccgctattagcgctgtcgctaagccgacttcgagccttggctcggatataccactgaagggcaagcagttggtggtataccctacaaaaccctttggagggccctcagtatcacccacaactgcacctcttgcgttccacagcggttaa

SEQ ID NO: 87400 - DNA, 261 bp, Glycine max
  Peptide Sequence Number=SeqID_179085
atgaagaacggtgaagaacaacagaaaaccttcacggattcgctcacggaaacatctcggaagcgttacggaagaaaaggggggaggaggttgccgcccagttcgcccaggcgagctgggttgcttctagaagcaatccagcttcgaaaaataccctggaagacccacttcaaaatttcaaaattgctattcgcaccccccattttgatatgttcactccccttctttcgtaatttacgggaaagttacggaagcctatag

SEQ ID NO: 87401 - DNA, 312 bp, Glycine max
  Peptide Sequence Number=SeqID_179086
atcatggttaggaccagaggattaggtcatgccttaggtcatgttactggcagaggagattgtgatgattccgatgatgctccgcagttgcacgatgagccagttctccctgcgccaaatgtagaggctgacgtatttccagatgacccgatggtactagctgatgtagaggacactggggcagacattcctgcagacacaggcgcccaggctgctaaggatgagcatgagggatttccgggtggtccgagcgacccatccgtgcttacccagtatgcggatcacgtagcttgcagcgtatggacgggagag

SEQ ID NO: 87402 - DNA, 400 bp, Glycine max
  Peptide Sequence Number=SeqID_179087
gcccagccctacagtggagctaagcgcgagtcaggcgctaagcgagcaaccaaatgtagacgctaagcatggcattaagcacgaaggagcagaaaccggcgcgctgagcgcgcgatccgaacgcgctaagcgcgagtcccaagtgtcgcaacgtgcccttcgcgggcgagcgagggcgaggctcacgggtgcgctttccaaaggaggaaaggtgcgcggagtcgccaccaacgtttatctgtggaaacgtcgggaaaccaaaggaaccggtcaaaatgagattctaagttcgggagtcgacaaaagcggggcttttgctcctacgtaccctcctttggagaggaaatcagacctacgtagttcttccttatacatggatcaagtgattctctttacttga

SEQ ID NO: 87403 - DNA, 96 bp, Glycine max
  Peptide Sequence Number=SeqID_179088
atggcgattataagcccaacaaagatttctcaacctccgtttcctagaggatacaaccccaacatgacatgtacttatcatgggggagctggctga

SEQ ID NO: 87404 - DNA, 311 bp, Glycine max
  Peptide Sequence Number=SeqID_179089
cttcggtattcaatttcgagcgtctcgacatattacgtgactcaatccgacatccgagtaaaaagttattgtcgtttgaatttgctcagaacttcgagcttcggtattcaattttgagcgtctcgagatattacgtgactcaatccgacatccgagtaaaaagagcttcggtattcaatttcgagcgtctcgacatattacgtgactcaatccgacatccgagtaaaaagttattgtcgtttgaatttgctcagaacttcggtattctttcgagcgtctccacatattacgggactcaatccgacatccga

SEQ ID NO: 87405 - DNA, 276 bp, Glycine max
  Peptide Sequence Number=SeqID_179090
atgccttatgccgacctactgccatctttgctcagcaaccaaatggttgtggtgagcccagggaaagtctatcaacctcattttccccgatggtacgatcccagtgcaacctgcgcctatcatggtggtgtaccggggtactctatcgagcattgtgtagccttcaagcacaagaggctcggtggtgaatgtagtggaagaatgggagtcttgggggctgaagcagatagggaatgtgttaacttccaggcaattcatattggaagcattgtgtga

SEQ ID NO: 87406 - DNA, 360 bp, Glycine max
  Peptide Sequence Number=SeqID_179091
gctcatgagaaccctaaggccttctcttgcatctctggcccaatcttcgtggagtcttctatccaatgcccttgcaaggtaggattgcatcattccctcccccttgaaaaggattttgatgcaagctccattggagcttgtaggcctaggatcttcttcatcaatggattcctttgcttcttgaaagatgaatggcagcggaatggagaaaggaagagagagaggagacaccacttcaaggagaagatgagtctagaagaagctcaccaccataggaggccatggataagagcttggaggaagaaggagatgaatgaagggagagggagagaagagcacgaatttttgtgctctaaatga

SEQ ID NO: 87407 - DNA, 87 bp, Glycine max
  Peptide Sequence Number=SeqID_179092
atgaacatatgtaattttgggcacaataccttgagcacgcgtgaatggccccaaggaaacttgcctcaagagatccaggaaggataa

SEQ ID NO: 87408 - DNA, 645 bp, Glycine max
  Peptide Sequence Number=SeqID_179093
ctacacgccctcgccttcagaaggctacacgtccttgccttcagagggcaacacatcctcgccttcagagggctatacatccttgccttcagagggctacacgtccttgccttcagaggactacacgtcctcgcctttagaggactacacgtcctcgccttcagaggactacacgtcctcgccttcagagggctccacgccctcgcctttagaaggctagacatcctcacctttagaggacaagacgtcctcgccttcagaggaccacacgccctcgccttcagagggcaacacggcatcgcctttagaggactacatgcccttgctacatgtcctcgccttcagagggctacacgccctcgccataagagggctacacgtcctcaccttcagaggagggctgcatgccctcatcttcatagggccgcacgtcctcgccttcaaaggactacacgtcctcgccttcagagggctacacgccctcgccttcagagggctgcacgccctcgccttcataaggctgcatccctcgccttcatagggctacacaccgtcaccttcaaaggactacatgccctcacctttaaaggactggacgtcctcgcctttagagggctacacgccctcgccttcagaggactacac

SEQ ID NO: 87409 - DNA, 486 bp, Glycine max
  Peptide Sequence Number=SeqID_179094
atggaaaaaggattttcccatggttcagttccaattattttaggcaagccatttatgaaaatagctcgaaccaagatagatgtttatgctggcacattgtctatggaatttggtgatattgttgttcattttaacattcttgatgccatgagacatccatctgaggatcattctgtttttcgtgatgagataattgatcaaattgttgatgattatatgtttgattttgattctattcttcatggtaggaaacatccatttttatctgatctgcatacttgtcattccttatgcattgaatctgaatctgagtttgaatttgatccttcagaatgcactaaccatgttgcagaaagtacatatacttctgacttgctttatgaggaaaaatttctagtgatcatctctgcctcccttgatgctgagcaagaggagaagttgttgctagtgctcaagaagcacaagaaggccattggatggacttaa

SEQ ID NO: 87410 - DNA, 636 bp, Glycine max
  Peptide Sequence Number=SeqID_179095
atggccccgaggaagcttgcctcaaagagatcctggaaggataaagcggctgaaggaaccagttccgctcccgaatatgacagccatcattttaggagtgctgagcaccagcagcgcttcgaggccattaagggatggtcatttctccgggagcgacgcgtccagcttagggacgacgagtataccgacttccaggaggagatagttcgctggcggtgggcatcactggttacccccatggccaagttcgacccagacatagtcctcgaattttatgccaatgcttggcctacagaggagggcgtgcgagatatgcgatcctgggtgaggggtcagtggatcccgttcgatgcggatgctctcagccagttcctgggataccctttagtgctggaggagggccaggaatgcaagtatggccagaggaggaaccggtctgatgggtttgatgaggaggccatcgcccagttgctatgtataccggggcaggattttgcccggactgctgctggaagacgggtgcggatcatgcacaccaacatgaccaccctgacccagatctggatgactttgctgctcagcaacatccagcccagcgatcatcattccgacctccccctgccgaagtgtcagctg

SEQ ID NO: 87411 - DNA, 561 bp, Glycine max
  Peptide Sequence Number=SeqID_179096
atggcatccttcagccagcttcagtcacagatgcaatctcaggcacctcctgagcctctagttggtcctggtccctctggtcctcgggtgagcacaaaggggagttgtgttgatccctcaggaaacgatcctgagacaggtgactctgacaggtgtggcttgtacatagaagcagatcctgcccgcctggttgccgtggggagagtttatgagggatccattcttgttcataacactcctttgttgcctggccaagtaaaggtgagtgtggacgaggttaaagatgcagatgctccagttcctgtacccactgctaaggtagctgtgtctccgccaaaaccacctccgaagcccgatccggaggtcgatgatctgctttatctgatgacattgaccatcccagagcttttcttgaggccttatcaggttagatgggatgtcaccgtgttcggggtcgttattccagatttctccctgtacataatgcacgaagacctctccgaaatcgaacacgatggtcaatgtctcagcatattagtgttacaattgtggattctgtaa

SEQ ID NO: 87412 - DNA, 456 bp, Glycine max
  Peptide Sequence Number=SeqID_179097
atggtcaatgtctcagcatctctgttatacaattatggattctgtaagtcactttcattatggcatgtgactaagacaagtatgcgagtggggaatgccgatgtgtatgaattccttaagccacagttcataccgagatctaggcaatcacaatttgaagcagaaagttatattaagaattggatgcaaaattcaaagagggatgtatacttaggagcctacttgaatgggctagacaactacctgaaagaaattattaacaagttagttgtgtttttcaatacatttacattagcattagttgagaacatcaatatgttaattgtacaatacacatccatgtttgtattgaacaatgctttgaaaagatttgacgatactccacaaagtaaatccaaggctgctgctaggtggattgttgttaaaactaatttctacttaacattaaatgtctaa

SEQ ID NO: 87413 - DNA, 168 bp, Glycine max
  Peptide Sequence Number=SeqID_179098
atggagaatgaccttaaaagtcatgtttgctgcagtgtttatggtctcctttatctgtcagagagagaataccgggagacgatcaagtgctatcgaaatgcactgagaattgatcccgacaatattgaaattgtttctgacctatcacacctacaggtagcatcttaa

SEQ ID NO: 87414 - DNA, 219 bp, Glycine max
  Peptide Sequence Number=SeqID_179099
atggcttcttacattattcaactttactatatgccatataagctaatagaaacaacattctacatcggttatttaggaccaacaacatcgattgacgaccatcgtcataggggacgtcgtcaaaaggggtcgcctattctacgtcggttgccaaggaccgtcttagaatcgtcagtattctacatcggtccttcagttgtgaccgatgtagaatgctga

SEQ ID NO: 87415 - DNA, 207 bp, Glycine max
  Peptide Sequence Number=SeqID_179100
atggctgtgttggttaatggggttattactagtgcatctttttctggctcttctagttcttctactgagagtgaaagtcaatgtgatgtacaacccttgaaagaagcgtttgagaagcttgatttcaaagaagggagtggaagcactactagaaatataagtttctatgacacctatcctatgatggttctaagtggactgccttag

SEQ ID NO: 87416 - DNA, 171 bp, Glycine max
  Peptide Sequence Number=SeqID_179101
atgttgtcgttaatgtcagggtatttacaaaaatgccaccgctacagattcaacaacattggcatagcaccgatgctgttatcaaacctcccaaagatacctaatcctgcaaagttcataactgagacgtccatctcccgacttgcaggggtgacatcaactaactggtag

SEQ ID NO: 87417 - DNA, 564 bp, Glycine max
  Peptide Sequence Number=SeqID_179102
atgccgcaggatctgctcattgttggagaaagagagacagtgttttcaaggacactggtttccttggctaaggtgctgcctcaagccaaggctgtagttatgaatttctttgaggaattggacccacctttgtttgttcaagacatgagatccaaattgcagtctttgctttatgttgttccacttccctcctctttgttcccaccatctgacacagattctagtggatgcctttcatggaccaagatgcgagggaaagttgtgtcttgggctccacaatccaaagttttggcacatgattcgtcaggagtttttgtttctaactgtggagctaactcagtgactgaaagtgtttttggtgaggttcctatgatctgcaggccattctttggtgatcaaggggtggctggaagattgatagatgtttgggagattggggtggtaatggaaggaaaggtgttcacagaaaatggattgcttaaaagcttgaatctgattctggcgcaggaagagggaaagaagattagagacaatggtgaagcagactgtgcaagatgcaactag

SEQ ID NO: 87418 - DNA, 102 bp, Glycine max
  Peptide Sequence Number=SeqID_179103
atgactacaggtgatccaccccaacagaagacaagtcaaggaaatgagaaaaagaaagaagatgagaatattactcaagaggagaactcagatactacaaag

SEQ ID NO: 87419 - DNA, 144 bp, Glycine max
  Peptide Sequence Number=SeqID_179104
atgtggaccactacgggggaggaggttgccgcccagctcgcccaggcgagccagttgcttcctccagaagcaaccgccttctggaggaatcttctggagggcccaagtgggcctgggtgctatttgcacccccatttttactaa

SEQ ID NO: 87420 - DNA, 275 bp, Glycine max
  Peptide Sequence Number=SeqID_179105
atgttgctaagtagcaatgtcatctatatctgtgtaagagtggtcatgttggtgcgcatgatccgcactcgtctctttgcagcggcacgggtgaaatcttgccccggtatgcatagtagctgtgtgatagcctccctctctggtagtgctcgcacagttttacttcgtccaatatcagggggtggcccaggaaccgtgtggatatggggccccctgagagcgaggacgcgtagtcctctaaaagcgagggcgtgtagccctctgaagttcaggac

SEQ ID NO: 87421 - DNA, 672 bp, Glycine max
  Peptide Sequence Number=SeqID_179106
atggctgaaagtttatacacggggtttagattggctcgccaagaaaaacgagacttgctaaagaaaaattcaagcttggtcgctacagacgtccggaaagagtgtgccgggttacgagaagaaaatgcagctaccgcaaaagcccttgaacaagaaactaagagggctcgcaaggaagagcatggccgtgacaaattccgtggagcattgtggggaagcaacagtgagctcaagcttcgaagggaagagaaagaccgatcacgagcacatagcatggtcgtaaaagaagagttagccgcttgctcaaggtccaaaaggaacttgactcagcatttgtgtgagacagagaccaacatgttagctatcatcaccaagtaccaagaagaactaagtctagccacggcccatgagcatagggtggcggacgagtatgcccaagtgtacgcgaaaaaggaggctagacgaagggtgatcgactcattacaccaagaggcaaccatgtggatggaccgatttgctcttaccttgaacgggagtcaagaacttccccgattgctagccaaggccaaagcaatggcgaacacctactctgcccccgaggagatccacaaacttctcgactattgtcagcatatgatagatctaatggcccatataattagaaactgctag

SEQ ID NO: 87422 - DNA, 305 bp, Glycine max
  Peptide Sequence Number=SeqID_179107
atgtccaaatcttttgaatttgggaggaccggctctctcaatgagtcgatctcttactttctcataaggatggaccctcgggtactagtaccctggtcttcagaggactacacgtcctcgccaacagagggctgcacgccctcactttcagaggactgcatgtcctcaccttcagagggctacacgccctcaccatcagaggactgcatgtcctcaccttcagagggctacacgccctcacctttagaggaccacatgtcctcaccttcagagggctacacgccctcactatcagaggactgcat

SEQ ID NO: 87423 - DNA, 195 bp, Glycine max
  Peptide Sequence Number=SeqID_179108
atggggtcccttgacggtcattcatcgactggagagggtttttttgttgaagaaatggatgctagatggatgcagtttggtgactacattgcacctgtagggaaaatttgtgtagtgcctagccagtattcgttagattacatggagtggttctacatcattttgcatcaatttaatgtagaagtaaagctttaa

SEQ ID NO: 87424 - DNA, 294 bp, Glycine max
  Peptide Sequence Number=SeqID_179109
atgtccaaatcttgtggatttgggatgaccggccctctcgatgagtcgatctcttgctttctcataagggtggacccttgggtacttgtacctatcacttttagaggactacacgtcctcgccaacagagggctgcacgccctcaccttcagaggactacatgtcctcgccttgagaggactacacgtcctcaccatcagagggctgcacgccctcacctccagaggactacatgtcctcgccttgagagggctacatgccctcaccttgggtactagttaccctcaccgttga

SEQ ID NO: 87425 - DNA, 156 bp, Glycine max
  Peptide Sequence Number=SeqID_179110
atgggagtggattttgtggttgattcagggatggcctttgtggataactgggtggtgtttggccatgtaggaatggcagtcgcagcatggtttctccttcattctcaccctcttcatttgccccagttttctcagtcgtctaagcaggatggttaa

SEQ ID NO: 87426 - DNA, 471 bp, Glycine max
  Peptide Sequence Number=SeqID_179111
atgtttcgggaagaaactggtcaaaaacatgaaattgggagtgtatttagcaaagtgggcaattcgaatctacgcccttctggaacaatttggaagttgggttgcttaaggaagaagcaactgggtgacaagctcctccatgttttgttgaaaaatggtttccggggcttccgtggcttccgtaatccttccataaaatttccaaaaaccttgggtaagcatatttcacttaacattggtgaaagggaagagaaaaaagatgaaaatcaaatccgaaacacttccataaggcaagcacctaccgtgaagtacgaaaaggggggtgaacttagtcattggggtgcacttagaaatcttcctcaagaagcctctgggcggaaagcacctacctttttcccaataaataggggaggggtgctgtttcaaaatatttcagaccccttggctatgcatttcagctgttttgggtga

SEQ ID NO: 87427 - DNA, 411 bp, Glycine max
  Peptide Sequence Number=SeqID_179112
atgcatagtagttgcacgatagcctccctctctggttatgcttgcacagttggtcgccctccaatatcagggggtggccccggaactgataaaagaaaactactggcccctcacccaggagcgcaggccttgattaagcatcaagggcggaggaccttgagttctctgaaggcacagatgtggagtcctatgaaggcgagagcatgcaaccctatgaaggtgagggcatgcagccctcagaaggcgaggacttgtagtcctctgaaggcgagggcatgtagccctctgaaggtgaggatgtgtagtcctcaaaaggtgagggcgtgtagccctacgaaggcgagggcatgtagccctctaaaggggaggacgtgtagtcctctaaaggtgaggatatgtgatgcaatctag

SEQ ID NO: 87428 - DNA, 96 bp, Glycine max
  Peptide Sequence Number=SeqID_179113
atggagctggtagaggtagaggcattagtgaggatacacatcgaggctgatgttcctctacgtcgcagacatactgcttcagcacgtaggcaacgg

SEQ ID NO: 87429 - DNA, 342 bp, Glycine max
  Peptide Sequence Number=SeqID_179114
atgacaacattagaaaaagcgaaactttggttaagtgaaacgtttgatcaggaaacgagagatgctgtgaaattattaattgatagtaattctcctgatctggaagattctttttacagggaactggaatttgggaccggaggtatgagaggaattatgggggttggaacgaatcgtttaaataagtacactttaggtcaagctacacaaggacttgcgaactatatgttaaagcaatttcccaatgaggaaattaaagtagctatcgcttatgacgttcgtcataattccaaagaatttggaaaactggtggctgatgttttaacggctaatggaattaag

SEQ ID NO: 87430 - DNA, 513 bp, Glycine max
  Peptide Sequence Number=SeqID_179115
atggaccacgtcatggccaaggtgctcatcgataacggcgaggaagacatcttggtgaattgcccgtcctctatgccatatgtggaagccgcggaggagtcattagaaatagctttccagtcttttgaggtggcaagcattgccttcgtagattccttctctgggcaaccttgcctgttcgatatggctgtaatggtggcccgggtgatgttggggaatggttacgagcccagaatgggtttaggcaaggacagcggcggcagaaccatcctgataagcgccagaggaaatcgtgggaaatttgggttaggctataaacccacacaagcgggcataaggaaaagcattgcgggaaggaagagcggagctcaaggctcgcgattgggacgagaagtcgaagggggcccgccctgccacatcagtaggagctttataagcgcgggtctaggacacgaaggccaagtcgttgcgatatgcgaagatgattctccgagtgggtcggatttggtatga

SEQ ID NO: 87431 - DNA, 459 bp, Glycine max
  Peptide Sequence Number=SeqID_179116
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatggggatcctctag

SEQ ID NO: 87432 - DNA, 708 bp, Glycine max
  Peptide Sequence Number=SeqID_179117
atggcacaacctccaccccgtgagaggactctaagggaaatggctgcacttgatttcacctacgaaagcttgtgcattcaataccctaatgaggatgtcccatatgttcttaaaactggactgatccatttgcttctaaagtttcatggccttgcagagggagtggcaaaggactggttgtattaccttgctccaaggtccatcacgagctgggatgacctcaagagagtattcttagaaaaaaatttccttacttccaggaccacgaccatcagaaaagatatttcagttgaaaccaagaagcttgaaggtaaactagatgccttagttaacctagtaacccagctagccttgaatcagaaatctgtacctgtcgcaagagtctgtggtttatgctcctctgccgaccaccacacagacctttgcccttccatgcagcaacctagagcaattgagcagcctgaagcttatgctgcaaacatttacaacagacctcctcaacctcagcagcaaaatcgaccacaacagaacaattatgacctctccagcaacagatacaatcccacatggaggaatcaccctaatctcagatggtctagccctcaacaacaacaacagcagcctgctccttccttccaaaatgttgcttgcccaagcaaaccatacattcctccaccaatccaacaacagcaacagccccagaaatag

SEQ ID NO: 87433 - DNA, 561 bp, Glycine max
  Peptide Sequence Number=SeqID_179118
atggttagccgcccagctcgtccaggcgagctcagctcgcctagcatgtctcggaatttcacaaattgcctaatgatgggtgccaagcaccttacaaggaccaaacaaaggtcgcatgtcatcgagcaaaggtccccggacaaaattaggaggtccaagagatcagtagttaaggctactaagaaaaggaaagggaaggagaagatcatcccagatgcaaatgttggagggtggctattaaatgagaagggcaccctccaacatttgttggagtgtagcatggttgcctcctcttggaacaagaatccaagccatggtctaatggaacactatgaaatggacttcataaacgagaagtatgatattctctcaagctccaacaaagttcacgaatctgttcttcatcatatgtgcctagttgaaaaagatggtcattggttcttgatgatggtttggcaagtgtaccaagttttcagagtagataatcataagtgggttgtcatatccacagggattggtagatattacaataatttctattattttaatgaaaactcctaa

SEQ ID NO: 87434 - DNA, 567 bp, Glycine max
  Peptide Sequence Number=SeqID_179119
atggcagaaacaattgatgaggatgctcagagtataaataatccctttttattagaattgtttaaagaaggaaatagcagtggggtaatgctagatcttgacaagggaacttggaatgttgttaaaatggaagatttcaagtctaaaaatataggaaatagatctaattatgcaactagtcatgcattggatattcaaagtgaaagaaaattgtcatccttagcagttcagaactctgacccaatgaaaacatctcagttgggttatctcacggtcaaaactggtaaagagaagggtaggagaagaaaaaggaagagtcttggtgtcaaattagcagcattgtgtgaagtttcaagtagtcaaggaagaagtggttcaacaattccaaagagggttgctacatcctttccttactcaagctatcaaaagttgaagagaaaatcatacaaaacttacagaatcaaaaatgtcaaatggaacaatgaactcgcgaacccacaaactcaccaacccaccaaccaggagccaagactatggctaaaacctatgaaacaacgaactcactaa

SEQ ID NO: 87435 - DNA, 420 bp, Glycine max
  Peptide Sequence Number=SeqID_179120
atggttaacgaatctaaacgaagaggattttttggaggtatgaggttaggaaaaactctgtggaatttgaatgaatcttgtgcaaaggttctgcctctactctgtttttcattgtgtaagcttggaggggttgatggggacccagtgctgagaggaacgaggataagagctacgcaggagtactggtacctggagatatgtcgcgggggtcaggagaccttggggatgtcagatggggtgctattgcccaaaaccaagcttggccaatcccgacccaacccgggcatagtcagtcaaggagaacctgtgacgtacctaagtaggcgagctcctggcagtcaaccaataaaagaacaaagtccacgaagcaaggaggcttgtgtggcggctggccaactatttatcttgggtgttatctga

SEQ ID NO: 87436 - DNA, 336 bp, Glycine max
  Peptide Sequence Number=SeqID_179121
atgtgcatgatcagtttagggttgttggctctcaatgggtatagaagtggagttattgacattcttattgggagtgtacgccacattgggtggcgtatagttgagaggcaagccatatggcgggaaggcgtgctcgttttgaatttgcacatcatgggggccgcccacgggggcatcgggtccaccttagcatctgctttacccattactctagctctagcacaggctctaggagctatgatgcaatcctataccgcaagggcattgggtagaagactccaagtagattgggctagagatccaagggaaggccctagggttctcatgagccttagg

SEQ ID NO: 87437 - DNA, 534 bp, Glycine max
  Peptide Sequence Number=SeqID_179122
atggcatctgagtctctctttgatgcctgggatagctataaagctttaattaggagttgtcctcgccacgattactatgattacacccaaatctcaatggttataaaaggaacaattgatgaatatagaagaatgataaacgcttcagcaagaggataccatgccaatggaaccgggaccaaagtaaagaaaattatagaagaagtagcatttagtgaacgaggtcgtgattgcaaccgcacctctccaaatggcattcacaaagaagacatcaaagatgaatcccttaaacaacaaacacaaatgaaagctatgatggagaacgaagtagccaaggaagccaaattcatgagacaaagcactacaaaattagaagaagccgtagtcaaccttagcaccacatcctactccaacctcgagaataccatggagggtgaggatgagaaaccaaccatcattagtagcatattgcacaaagaggaagaaaagagactaatggaggtactaaagaagcacaatcaagccttaggatga

SEQ ID NO: 87438 - DNA, 479 bp, Glycine max
  Peptide Sequence Number=SeqID_179123
ttggaaacataaaaggagcaatgaaactgcaagatgaaatgaaaacacttggtatcagctcccacaatgttgctatgagcgctattgttagagggcttgcaaattcaaagaagattgaaaatgctatttgggttcttgatttgatgcttgagatgcaaatcattccaactgttgctaccttcactactttaatgcacgtttattgcaaagaagctaatgtcgcaaaagctttagaattgaggagcataatggaacattgtcatgtgaagcttgatgttgttgcatacaatgttcttatatccggcctttgtgctaatggtgatattgaagctgcttttaaactttatgaagaaatgaaacaaagagatctttggcctaatacctctatatacatagttcttattgattctttctgtgctggaaattatcaaattgaaaatgaggctgaaccaacagttctgttactcatcaagatgtga

SEQ ID NO: 87439 - DNA, 108 bp, Glycine max
  Peptide Sequence Number=SeqID_179124
atggagtcgccaactgtcgcaacctaccctttggcggagggtgatgctggaatcacgggaaaggtattagcaccccacacgtccatcacaagggacgacaaagcttga

SEQ ID NO: 87440 - DNA, 175 bp, Glycine max
  Peptide Sequence Number=SeqID_179125
gagttagtatggacagaggttgtctgcactgaagacgacgtaaatctccgcgtggcaacgagcttgttggccgtgattgacaaagggtgcagaagacgatatagcaaaagaaagtttgcgggttaccgtcgggtgtctccgcctgccaccgagctcttgggtcacgataacaaag

SEQ ID NO: 87441 - DNA, 1064 bp, Glycine max
  Peptide Sequence Number=SeqID_179126
gactacacgtcctcgccgtcagagggctacatgtcctcacctttagaggactgcacatccaaaccttcaaagggctacaagcccttgccttcatagggctacacgccccaaccttcagaggactacacgccctcacattcagtggactacacgtcctcgcgttcagaaggctacatgtcctcaccattgaaggactacacatcctccccttcagagggcaacaagccctcaccttcgtagagttacacgaccttgccttcagagggctgcacgtcctcgcctttagagggatgcacgcccttgccttcagagggctacacatccacatcttcaaagggctgcatgccctcgcctttagagggctacacgccttcaacttcagagggcaacacctcctcgtctttagaggactattcgtcctcgcctttagaggactgcacgtcctcgtcattagaggagtgcatatcttcccctttagaggacatcacgtccacatcttcagagggctgcatgccctcgcctttagagggttgcacgccctcgccttcagagggctacacgtcctcgccttcagagaactacaactcctcaccttaagagggcagcacgtcctcaccttcaaaggactacacgccctcactttcagaggactacacgtcctctccttcagagggatacacgtcctcacctttagaggactacacgtcctcccctttagagggctacaagccctcacctttgtagggctacacgccctgaccttcagaggactacacgtcctcgccgttagagggctacacgtcctcaccttcagagggctacacctcctcgcctttagaggactgttcgtccatgccttcagaggactgcacatcctcgcctttagaggactgcatgtcctcccctttagaggacttcacatccacatctttagagggctgcatgccctcaccttcataaggctgtgtcgcaacctacccttcggcgggagggcgacgcgtgactcgcgggatgcgtgttccacgaaaggaatacgcgcggagtcgccaccaacgtttatttga

SEQ ID NO: 87442 - DNA, 603 bp, Glycine max
  Peptide Sequence Number=SeqID_179127
atggaagaatcgtcgaagaagcgaaatggatcatcctccaccaccactgctattggccatcgccgccacggaccatctgaagcacccacaacacctatccatccttccttatcatctctaagatcatccagtctattttcttccgatgatcaacgtctacggtacctttctcaattttcttcaaggatcattttagaccctaagtacctagacatagatttcttcaatgatgagacatttgattgttatcaagatgacattatttcttctgaggtgcatggtatttccatgatcattgatcaatcattgttcttttctttgacaaaattacccagtcaaggtgcaccttttgagggcaccattgttgatgactggaaatttgattattctagtcatgatgctcgccatatggtttgtaatgaccagactgaaatgaccggtagattgctgaccggatcgttgacctttgataatcgcatgatgcgctacattattgttagaattttgcttccccggtcttcaaatttggctcaagcctctgaggaggacttgattttgatgtgggctttccttaccggtcgtcagatcgactgggctcacttg

SEQ ID NO: 87443 - DNA, 165 bp, Glycine max
  Peptide Sequence Number=SeqID_179128
atgtccccagtggagtcgccaactgtcgcaacctacccttcggcaggagggagacacagggctcacaggtgcgtcttccaagggaggaaaatgagcggagtcgccaccaacgtttattcgaggaaagcgtcagaaaaatcggaacgtgttgtctacgaactttaa

SEQ ID NO: 87444 - DNA, 1134 bp, Glycine max
  Peptide Sequence Number=SeqID_179129
atgatacttaattctgctaacgataccgacaaacaactttccccgttattacgccagtatcgagccctttccgggctggcgagcattcgttatcagggtgatagccatctatttgatatcgcatggtggggcagtgagaaaggtattagcgcgcagcaacagttggttattttacacgatgatgagggctggcgactggcgcaaaacgaagaagcggtggtacagccgcgcagcgacgaaaaaatcgtcctcagtaatttgcgcgtgctggaaggggcccccgcgctttccgaatactggacgctgttcgaaaccaatgatgccgtctttgaagccggtcgtaccgcacaatcggccaccttgctattttccatcacccagaacgaacaaatagagcagctcggccgctatatccataccctgcgtcgccagcgcggcagcgccctaaaaatcgtggtacgtgaacaaacgccgagcctgcgcgccactgatgaacgcttgctgctaagcagcggcgccaacatggtgatcccctgcagcgccgggctttcacgctgcctgacgctcattgaaagcgtgcaaaagcagaaatttactcgtcacgttccggaagacttcaacacgttgttgacctggagccggccgcttaaacttcgcggctatcaaaagtgggacgccttctgtgaagcagtcggtaatatcatggccaacacgctgctgccgccggatagcaaaggggtgatggtggcgttacgccctgcgccggggctacgcgttgaacaggcattaaccctgtgtaaacctaaccgcatgggcgatatcgtgacgatcggcaataatcgattagtgctgttcttatcgttttgccgggtaaatgacctcgacactgcattaaaccatatcttcccattaccgaccggagacattttctctaaccgtatgatttggtttgaagacaagcaaatttcagcggaaatcctgttgatgcgaggcctctccccggacaactggaacacgccgctgccacttaccataggcaaaaacgaagcccttaacgttaagcacgatgggcgccagtggcggcgaatcccggaaccctggcggctctccaccgacggagaaccgcggtcatga

SEQ ID NO: 87445 - DNA, 235 bp, Glycine max
  Peptide Sequence Number=SeqID_179130
atgacgaacgatagttcgaagatgacaaacaagtttgcgaagttggacaagtttgaagggcaggatttcaggagatggcaaaagaagatgtgctttctcttgacaacattgaaggtggtgtatgtgctgagtacaccgatgtcggtgtttatggaagacgaaactctggatcaaacaaggaagcattcgaaatgggagaacgacgattacatttgtcatggacacattctgaacg

SEQ ID NO: 87446 - DNA, 1122 bp, Glycine max
  Peptide Sequence Number=SeqID_179131
atgaggatgatgctttcctctactaaaggatcacaatgttatgaagatattagaatagtagaaaatgttgtctatcatacattcagagaagcatgctttgcaaaaggttttctaggaagtgatcaagaatttgttggtgccttacgagaagcaaacacttggggaactccacactatcttaggaagttatttgtgaaactgctatttatgaataccatggataggcctgaatatgtgtggaaacaaacttggcaatggatggcagatgatattgtatttaatcataaaagacaaggcatccaactaacagacaaagaaaaaatgcatctttgtttgacggaaattgaaaacctcttgcaagccaacaggaaaaggctacgtgattttccttcaatgccatacccactaggatatgccgccaagacgcaccaaaataatctcatctacaatgaattggcttacgacagggagatattggccgccgaatttgacaaatgctaccagtcgctaacagatgagcaggcttctatttttaataagattatgcatgtggttgcaactcaatcaggtggagtttattttctatatgaatatggtggcacatgcaagacatttgtgtggaaaactttatcatctgctatacgctctactggcggaattgttttaatagtagcttcaagtgggattgcctcaatactattgcctggtggtagaacaacacattctaagtttgctattcctgtccctgcaacaaaaaattcgacatgcaatatccatcaagggagtgatttggctgaattgttgcatatcacaaaactcatcatatgggatgaagctccaatgtgtcacagatacagtattgaggcccttgacaaaagtttacaggacatcatgcacaacatcaatccttttggaggaaaggtcattgtttttggtggtaatttccgtcaaattctacctgttgtgccaagaggtaatcgttctgacattgtctatgcaactttaaattcatcttacatttggaaccattgtcaaattctaaagctgactaaaaatatgcggttgcaatcaaatcctactgaccattccaacttggatgaactaaaacaattttctgagtga

SEQ ID NO: 87447 - DNA, 348 bp, Glycine max
  Peptide Sequence Number=SeqID_179132
atgattatgaggggccaagacatttataatagtcaagatgaagctactacttcaccttcctctagtgaaagtgaagaagtaaaaggggaagaatctagtgaagaaatctacccccaagaaggacaacctttaatggttaaggaggagtgtaaggaggtaagtgtctcctccaagagttatcaaggggctcctacggaccctaagagaataaaggtcattcctgattggcccactccaccaagtgttgagggaaggagcccagagtatgaagaacctcgggatttgaggtcaaatcctttccaaggtggaggggataatgcaatcctaccccccaagggtattggatag

SEQ ID NO: 87448 - DNA, 213 bp, Glycine max
  Peptide Sequence Number=SeqID_179133
atgattcctttcacctcttcggagcttgagcttactattgctgcctataaagcccctcaaaactttgctgccgccgatgatcccattactgcttcccctaagctctctgtcctttcttcacgccgcatcccatgccttgcgaactccttggagtaccctcgcgttgtggtcactgaaaccccgtgcgatgaaaggcgtgatgctttcgtctga

SEQ ID NO: 87449 - DNA, 535 bp, Glycine max
  Peptide Sequence Number=SeqID_179134
gcaccctctggacccagataagtccaacagggccctgggatttcccgccttgatcacaagactctgccagtcgttcggcgtccccgtcacacctagcaaggtgattcggccgcccatcacccgagcttttattgagaagtactgcacgcagagacaggtccagggtgatgcaccacaggccgcggacgcgccgctacctcatcaggctggtccagccgaatcatttgacacggagcagtatttgcggcatttggttcgccagcaagtggccaaccaccgggcacatgtacagacccatgattgtctttatcagatgagtctcagcctgcagagccagggctttacttcttttccgtgccctactccggaccagttcagggcagaggtcgcatggcctggagattggcctgaggcccaggcaggagaggcaccagtaggggcaccagcagaggctcccgacgaggcagatgaggcctgcgaggatgaagagatgaccgatttacttgatttcttaggaggtagcggggccacatga

SEQ ID NO: 87450 - DNA, 593 bp, Glycine max
  Peptide Sequence Number=SeqID_179135
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccaaagaagtgtaagctaagaagctacgatgctacacatactcgcagcttgtccagtggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 87451 - DNA, 1605 bp, Glycine max
  Peptide Sequence Number=SeqID_179136
atgtcttgctggtgccgctcggcgatcgctttgatcgcaaaaagctggtggtcacgcactgctgctgtcggtgctggccctgatcgcggcggcgttagcagagagtttgctggcgctgctggtggcgatgctgctggtggggctgatggcggtggtgacgcaaaccgtggtggcgtgggccgctatcctgtcggcaccggctcagcgtggcaaggtggttggcagcgtcaccagtggcatcgtcatgggaatactattggcgcggctggtctctggcatcattgccgatatcgccggctggcgggcggtgtatatgacctcagccgcgctgatgctgctgattaccgtgctgctgccacttccgtggccgggctgctggggtctgtcccgcgtctttttgtcaccgagcctttgctgcgtcagcgtggcgcgctggctctgctgatttttgccgcgttcagcatgttgtggagttccatggttttgccgctcacggccatgtcgctttcccatacgcaaacagggctgtttggtctggctggaatagccggagcgctggcggcttccagaagtggcgcctgggctgacaggggaaccgggcagcgcgccagcggatgcgcactggttttattaacgctctcgtggctcccgatcgccttcgcgcaggcctcattattgttgctggttattggtgtgatcatgctggatttcgccgtgcagacggtgcatgtcatcaaccagagcatgctgattgccggcaaacccgctatcaccagccggcttatcggtgcctatatgtgtttttatgcggcaggcagcgcgctgggcgctattgctgccacccaactctatgcgcactggggatggtatgccgtgtgcggcggcggggcactggtcagtgcctgcgcacttattctctggtatggaacacggctgcacgccatcgatccgtttattctggcagggctgcgttttacgctgtgtgccatcccggcgctcttctttattaaaaaacctgacgtcccgtggctctaccttattggctacggactggtattcggcattggcttgtggggcctggtgaatctggggataaaaaccgggctgtcggcggggatcgcctcgctggtgctgcagttcagtgcctttttcactctgctgctcggcagttatgtgttcaaagaacagctcagccgctatcagatcgctggctttgtgctggcgtgcagcggattgatgagcattgtgtttattaccgacggctcggtgacgtttcccgggttgctgctggtgctggcaggcgccatagcctggagcattgccaatatcatcatgaaaaaagccggcacgaagcaggtctaccccaatacgttattaggctactggatctggaattcattgcttaagcagtatcctgtctccaccgtcgcgccattatcgctgatggtgccggtattcggcattctcggttcgatgatgatatttggtgaagttatttctccgatgaaaatcgtggcgctggtactgattattaccgggctggcggttgggttatatggacaacgcatcaaacgttatttcattccgcagtcggattcgctgtga

SEQ ID NO: 87452 - DNA, 60 bp, Glycine max
  Peptide Sequence Number=SeqID_179137
atggttcaaggcaaatttgtcctaaatttgggggaggtattatcaaggtatgaaagctaa

SEQ ID NO: 87453 - DNA, 723 bp, Glycine max
  Peptide Sequence Number=SeqID_179138
atggaccctcgggtactagtaccctggcttcagaggaccacacgtcctcgccctcgccatcagaggactgcatgtcctcaccttcgtagggctacacgccctcaccagagggctgacacgccctcaccttcaaaggactgcatgtcctcacctttgagggctacacgccctcaccttgaggactcacacgtcctcaccttcagagggctacacgccctcgccatcataggactgcgtgtcctcaccttcgtagggctacacgccgtcgcctttagaggactacacgtcctcgccttcgtagggctacacgccctcacctttaaaggactgcatgtcctcaccttcgtagggctacacaccctcacctttagaggaccacacgtcctcactttcagagggctacatgccctcgccatcagaggactgcatgtcctcaccttcgtagggctacacaccttcgcctttagaggactacatgtcctcgccttcgtagggctacacgccctcacctttagaggactacacgtcctcgccaacgtagggctacacgccctcacctttagaggactacacatcctcgccaacagagggctgcacaccctcacctttagtggactacacgtcctcgccaacagagggctgcacgccctcacctttagaggactacacttcctcgccaacagagggctgcacgccctcaccttgagaggactacacgtcctc

SEQ ID NO: 87454 - DNA, 255 bp, Glycine max
  Peptide Sequence Number=SeqID_179139
atgggtgccaaatacctcgaagtggtcaaacgagggtcgcatcccaacaacgaatggtccccagacgaaattaggaatgaccataatttgtctctgcgttttgttggacaatatcaatcctgggcggcgagacacagaatgaccataatttgtctctgcgtgccatcggacacgatcgcctttggatggcgaaaaggtgcgcggaatgaccataatttgtctccgcccacctctcaacttactgtccccgaatga

SEQ ID NO: 87455 - DNA, 462 bp, Glycine max
  Peptide Sequence Number=SeqID_179140
atggcagaatcgtcaaagaaacgaaagggtttttccgcctccgcttcggcttcaagagctcatcgttccggagccattagcgcatccacagcaccaattccaccctcattgtcttcttccccattgttttcttccgaagaacagcagaaacggtattcaaatattttctcatctcgttccattatcgaccctaagtttattgatatggaattcttctctgatgaaacctttgattgcattcaagcctttcgaaacttaggtcttatacctttcatgtcattacaattgcctatttatcctgaattggtcaaagctttttattgtaatcttgaaattcaagacaacactctgatttctgagcgttttgggacaaaaatggtcattgaccagtccattttccatgacttaactaaattaaccagtgacggtgtaccatttgaaggtaccctgaatgacgactag

SEQ ID NO: 87456 - DNA, 349 bp, Glycine max
  Peptide Sequence Number=SeqID_179141
atggagcttacatcagcatgttcagtggacactagcgatcggggacttatattcgtttttgtggagaggtggcataaggaaactagcaatttccatcttcctgttggagaggtgaccatcaccctggatgatgtggcctctctacttcatcttcatattataggcacattcaacagctttgagacttcgcatgtcgacaaagcggtgttgatgttggtggagttacttgaagtccccaaagaggaagctagagctaaaatagcacaatgtcatggggcatacgtatgcctatcacggctacgagatatttatcagaataaatgggaggccgaacattggactattgcag

SEQ ID NO: 87457 - DNA, 207 bp, Glycine max
  Peptide Sequence Number=SeqID_179142
atggtgatgagcttcttcttgactcagcttctcctcgaagtggcgtctccaatcatctttcttccttccccattccgcttccatgatcttcaagaagcaaaggactccattgatgaagaagatccaaggcctacaagctccacatggagctacatcatgtggtatcaagagcatcttcatctaggttctatcatttttcagtcataa

SEQ ID NO: 87458 - DNA, 972 bp, Glycine max
  Peptide Sequence Number=SeqID_179143
atggcgcagcagctgggcgggccgaccgacgtgcgggttgaggttaacaaaaactcgccggtggtctggctgaaaacctgggctgtcgccggatatctgggtgcgcgtaccgctgaccgaaatccatcagggcgacttctcgccgctgttccgctataccctggcgattatgctgctggcgattggcggcgcctggctgtggggaaaggcattattccgccaccgctgcgcgaatacggtgcttcggaagtgcgttcggtgacgcgtgctttcaaccagatggcggcgggcgtgaagcaactggccgatgaccgtacgctgctgatggccggcgtcagccatgatctacgcacgcctctgacgcgcatccgtctcgccaccgagatgatgggcgaggaagatggctacctggccgagtcgatcaacaaagacatcgaagagtgtaacgccatcatcgagcagttcatcgattacctgcgcaccgggcaggagatgcaaaccgagcgcgccgatctgaatagcgtgctgggcgaagtggtggcggcggagagcggctacgagcgcgagattgagaatgcggtgatggacgcggagctgatgctggatattaatccgctgtcgattaaacgcgcggtagcgaatctggtagttaacgcggcgcgctacgggaacggctggatcaaggtcagcagcggtcaggaattgaatcgcgcgtggttccaggtggaggatgatggtccgggtattaagccggatcagttacagcatctgttccagccgtttgtgcgtggcgatagcgcgcgcagcactagcggcaccggtctgggcctggcgattgtgcagcgtattatcgatgcgcatgacggatcgctggagattggcgacagtgaacgcggcggattacgtatccgtgcgtggttaccgattccggaaaacagcgccacgacggcagttagcagtaacgttagttaa

SEQ ID NO: 87459 - DNA, 567 bp, Glycine max
  Peptide Sequence Number=SeqID_179144
atgaccactcccctgaaaaaacctgacatcctcaacgtggaagcggtggcccgctcccgcctgtttaccatcgaagcggttgatctcgccttcagcaacggtgcgcgtcgcgtctatgagcgcatgaagccctccgatcgtgaagcggtgatgattgtgccgatcattggcgatgacgtgatcctgatccaggagtacgccgtcggactggaaacctatgagctgggcttcccgaaaggcttaatcgaccctggtgaaagcgtttttgaagccgctaaccgtgagctgaaagaagaagtgggctttggcgcgcaccagctggaagcgctgggcaaactcaccatggcgccatcctatttctccagcaagatgaatatcgtggtagctgaagggttgtacgaagagaagctggaaggggatgagccggagccgctgattgtacgccgctggccgctcagcaatctgctggcgctgctggaagagccggattttcgcgaggcgcgtaacgtcagcgcgctttttatggtgcgtgagtggctggtgaagcaggggcggttgagttattga

SEQ ID NO: 87460 - DNA, 291 bp, Glycine max
  Peptide Sequence Number=SeqID_179145
atgtgtgtacggataatccttaggtgtctccgcatgctacctgacttgatcatctctggaaaggtgcgggcgaccatatgttgtctccgtgcgtcatcggacttttcatctctagatgacgaaggtgcggataaccatgaggtatctccagatgctatcggaccctcgagtcacgatagcagaattgaggctttttcgtggtctcggccggaagacgctgacttctctaggaagggtgcagatgaccatattggtcactgcgtgtcaacgggctcgcttgcctctagttga

SEQ ID NO: 87461 - DNA, 669 bp, Glycine max
  Peptide Sequence Number=SeqID_179146
gtgagtgtggacgaggttaaagatgcagatgctccagttcctgtacccactgctgaggtagttgtgtctccgccaaaaccacctccgaagcccgatccggaggtcgatgatccgctttatctgatgacattgaccatcccagagcttttcttgaggccttatcaagttagatgggatgccaccgtgttcggggtcgttaatccagatttccccctgcatctcactgaaacatgtatgcgagcggggaattctgatatctatggattccttgagcctcagtccattcagaggttccactgcagcggacacttgcagatggtggtcatcctgcccaaggaacacttagttgtctggttttgttcattgcataacaggccagacaactaccttaaggagattattaatagtgctatcaagggtcttgatgatgctccacagcctaaatcaaaggctcctgctaggtggattgttgtcaagtgtaatagacaaaaaggaactactgagtgcggttactatgtcatgcactggatgtccaccatcattttaggaacttttagaaataattgggaagcgtattttaacgatcctagaccattggagcctgagagattaaaagcattgtggatccagtgggcacagttttatctccgagttagagatcagggctag

SEQ ID NO: 87462 - DNA, 729 bp, Glycine max
  Peptide Sequence Number=SeqID_179147
atgagacttcattcttcatctagtgttaatggtgagggttctactcctaaggaccccttgtataagatattagatgagttgagatcccttaagttgtggaaagaaaaccaagagagaaaagaaaaaggaaaaaaaagagtggaagaaataagtcaagatgaaaaagagaaaataagggaagaagaaagaaggaaaatactaaaagagttaagaaaagaaaaacatgcctcttataatagtcacaactcttgcaagagcctaagtgaagaacttcgtgattactatgaaggaaggcataggtcacatcttagacctcactcccataggcgagaaaaggaaagaaagcctcaagaggctaacattaacctcccatacttccatgggaaggacaatgtagaggctaacttagattgggaaacaagggtagaacaacaacttaaacgaaagtctacttcaaaatcttatggctctcactcttatccaaagaaagaccaaggtcaaggcatcttaggggtgacaccttctaagcccaaagataataaggggaagacaatagaaaaccaaccccttaaggctagtatgcaagagaatactagctctataaagtgctttaaatgtcttggaagaggacacatttcttctcaatgccccactaagaaaaccatgattatgaggggccaagacatttatagtagccaagatgaggctacttcttcacctttcctctag

SEQ ID NO: 87463 - DNA, 546 bp, Glycine max
  Peptide Sequence Number=SeqID_179148
atggaggtttccttcgttccttcctctctactacagctatggcgaaacctaggcgaggtcgtggctccccctccggttccgtttctagctcctcctttggttcctctttcccctccgactcccgttcctccagtcgctcacgctccttttctcagtcttgttctccctcgtgctccaaatcctgtttcccctcctcctcctcttcctcccgaagctcccgcagcctcagccgtcccccgcaaaggagccactgtaagggggttttggagcgccgccagaaccatcgtgttttgcggatctcgacgaggctgtggacggcggggagtggcccaagagggatttgacggcggcgaaaggggagagaaagagagagatggaggctttgcagctgcactaattgatgatcctatgtgggtgatgaacactgtccttgttgaggctaagctaaaatttaagggtggagacacttttacttgtgcactttttctgaaagctcattttagaggattttttttcttgaattgtcaaggagtgccacctaagtaa

SEQ ID NO: 87464 - DNA, 732 bp, Glycine max
  Peptide Sequence Number=SeqID_179149
atggctcaatcatttatcttcagcatcgctgagtctctcataacaaaacttgcttctcatgctttccaagaagcttctcgggttgtcggtttgtatgaccatctccgagaccttaaaaagactctctcattagtcaaggcagtgctgttagatgccgatcaaaagcaggagcataaccatgagctgcaggaatggctcaggcagctcaaaagtgtcttctatgatgcccaagatgtgttggatgaatttgagtgccaaaccctgcgaaagcaagtgctcaaagctcatggtaccatcaaagacgaggtaagccacttcttctcaagttctaatccacttgtttttcgttccaagatggctcaacaaatcaaagatgtcagcaagcggctagacaaggttgcagcagataggcataagtttggtctccgaataattgatgttgacacacgtgttgtgcataggagagacacgagtctcatgacacactcccgtgtgagtgactcagatgtgataggaagggaacatgataaagaaaagatcatagagcttttgatgcagcagaaccccaatgatgatgataaaagtctctccgttatcgccattgtgggcattggaggcttgggaaaaactacacttgcaaagtttaatgataagaggatagatgagtgtttctcattgaagatgtggatgagttctgaggcaaatgagtggggaatatgtgagagacaatga

SEQ ID NO: 87465 - DNA, 2049 bp, Glycine max
  Peptide Sequence Number=SeqID_179150
atggtgaatattctagaaatttataacaatttcaacaaaaagacactctcattagtcaaggcagtgctattagatgctgagcaaaagcaggaacataaccatgagctgcaggaatggctgaggcagctcaaaagtgtcttctatgatgcccaagatgtgctcgatgaatttgagtgccaaacactgcgaaagcaagtgctcaaagctcatggaaccatcaaagacaagatagctcggaaaatccaagacgtcaacaagaggctagacaaggttgctgctgataggcataagtttggtctccgaataattgatgttgacacacgtgttgtgcataggagagacacgagtcgcatgacacactcccgtgtgagtgactcagatgtgataggaagggaacatgataaagaaaagatcatagagcttttgatgcagcagaaccccaatgatgatgataaaagtatctctgttatcgccattgtgggcattggaggcttgggaaaaactacacttgcaaagtttaatgataagaggatagatgagtgtttctcattgaagatgtggatgagtgtttctcacaagttacaaagcctttctccggagaattcattgtctctttttgtcaaatgggcatttaaagaaggcaaggaggaaaaacatcctcatttggtaaatatcgggaaagaaattgtgaaaaaaatgcagaggggttccattggctgtgagaacattggggagtttactattttcaaagtctggcaaatgagtgggaatatgcaatgttttgcattattttcgctttacccaaaggattatgaatttcttagtcttgaggtaattaggctttggggggcacttggtgtccttgcatcacctagaaagaatgagacaccggaagatgttgtcaaacaggatggtggcactttttatcgatttaaaattcatgatttggtgcatgatcttgctgtatttgttgcaaaagaggagtgtctacttgtaaattcccacattcaaaatattcctgagaatattcggcatctgtcttttgctgaatacagttgtcttggaaattcattcatctcaaaatcggcagccgtgagaaccataatgtttccaaatggcgcagaaggaggcagcgttcaatctttgctaaatacttgtgtctcaaagttcaaattattgcgagttttggatttaagtgattcgacaagcaagactttgccacgttccactggtaagttgaaacacttgagatatttcagcattcagaataatcgcaacatcaagagactccccaattctatttgcaagctccaaaatttgcaattcttgaatgtttcgggatgggaggagctggaagcattgcccaaaggattaagaaaattgattagtcttcggtgtttggagataactacaaagcaacctgttttgccttacagtgagattaccaacttgatctcgcttgcacatctgtctattttgtcaagccataatatggagtctatctttgtaggggtgaagttacctgctcttaaaacattgagtgttgatgactgtcacagtctgaagtctttgccactggatgttaaaaactttcctgaattagaaactctggttgttgataactgtgttaatcttgacttggatcagtggaaggaccaccatgaagaacaaagccccatgttgaagttaaaagttgttggattctggaatttaccacagctgccggccttacctcaatggcttcaagaaactgccaactccttacagaccttgaatattttagactgcgacaatcttgaaatgcttccggagtggctgtcaactctgactaatctgaaatcacttgttatatcagattgtccaaagcttatatctctcccggataacatccatcacctcactgcacttgaaaggttgagaattgccgattgtcctgaactatgtagaaaatgccagccccatgtcggtgagttttggtccaaaatatcacatatcaaatacgtcttcattgaagaaccagaaaagctggaggaagaagaagacgaatag

SEQ ID NO: 87466 - DNA, 294 bp, Glycine max
  Peptide Sequence Number=SeqID_179151
atggtcgtacaaacccaccacccgagaagcttcttggaaagcatgagaatttacgtgaaagttatcaatatcaacagagaatcagttagtgccgccttgaaagcgtcacctacattatcaacggttgaaaaactcccattatccatgaggtcagatggccgcaatacatatgagaagtatccggcaaaaaactcccatcaacataggtacagactcgtgaaattggccatgaagtttcctctaccgctcaaattggctgcaaatttgatatatactatacattgctgcaattaa

SEQ ID NO: 87467 - DNA, 222 bp, Glycine max
  Peptide Sequence Number=SeqID_179152
atggtatttgattttaagtgtatgttgcaattaaaaattaatgcatgggagaacttacaaaaggtcaaagctgaggcatggagttgttgtcctcttcttcataagaatagaattagtgacaagaggctaacggcgatgctaaaggttaggatgctttgtccatgcaagggttgcaataataggattcacagctacagtaacaacaacggtgttgaagattaa

SEQ ID NO: 87468 - DNA, 483 bp, Glycine max
  Peptide Sequence Number=SeqID_179153
gacaaaatcttatctgttgaaggaacaaagagatctaacatgcttcgtcagaatctcggcggtaagggaggcagccgaaagcctctctctgatggcagggattgctccggctccgaaagcctctctctgatggcagggattgctccggctccggtgttggcaccagagggggccgatgacttcggacacaagagatctgctcccttgcgattcagatctgaaaatcctcctcttccaaacgacaccaaaatcaatgatgtctttgtcgcaaaggctgagaatcccgaagaggagctgagcagccttggcaaaattgagtttttcggggtcgacggtggccatgtggtcgccgagcttattagagaggcggagggcatggatgcagtgctggaggagcttgatggtgcagtggaggttggagagctgggcagttttggcggcgacggagcaatgacggtcggagagctcgaagtggaggactaa

SEQ ID NO: 87469 - DNA, 126 bp, Glycine max
  Peptide Sequence Number=SeqID_179154
atggttcaagttgatgaccggctcagacgagtatgcaagtaccgcaggtggccagaatggctagcggtacagcgtgccccgcaggtgtacccctcgaatctccccaacagaggttactggatttaa

SEQ ID NO: 87470 - DNA, 114 bp, Glycine max
  Peptide Sequence Number=SeqID_179155
atgaagaacaaaggggaggatctaaataacacaagaagggaagtggagagtgaaaagagagaaggacatcatattaacgttgttgttgctgaatgggttgggacactagaatag

SEQ ID NO: 87471 - DNA, 634 bp, Glycine max
  Peptide Sequence Number=SeqID_179156
atggcattttcttcaattatgagttcaggaatcgatgttttgctatggacagagagagtgttggggagaggtgccttgagctgtgtgtttagaggaagagttgggatttggaggactgctattgctattaaaaggttggataaggaagacaaggagtgtgccaaggcgttttgcagagaattgatgattgctagttctctgaatgacacaaatgttattcctcttgtggggttttgtattgactcggaggagggtttgttttttgtgtacaagtatgtgtcaggaggaagcttagagcatcacttacatgggaggaagaagggtgtgaagggtagttcaccacttccatggtctgtgaggtatgaagttgcaattgggattgcagaagctgtggcttatgtgcgtaatgttgacgaaggttggagaggagcaattcaagtgagatctaagtgttttagcacgactgatatcattgatgaacattttcgatttgcaaatttggacgaactcaggtatagtcttcgttttgtagatttggacaaactcagatctcgttgcgggtcctctagttgccttcactccgatctcgaaggtgtcgaagtcgtcgcgcatctcaacctcaacctcaagtggg

SEQ ID NO: 87472 - DNA, 558 bp, Glycine max
  Peptide Sequence Number=SeqID_179157
atggcatattcttcttccggagcttctcaaataaaatatgttgttcttcttctttgtgatctcatgcttatctcgggattgacgggtgaaatatcagataatagtcctcaaataaagtatgatgtttttgttagcttcaggggggaggacatccgtcacggttttcttggttatttgactgaggcttttcatcaaaagcagatacatgccttcatagatgataaacttgagaagggagatgaaatatggccatcacttgttggagcaattcaaggatcattgatttccttgaccatattctctggaaactactcctcttcgcgttggtgtctagaagaacttgtgaaaataattgagtgcagggagacatatggacaaactgtgatacctgttttctaccatgtaaatcccacagatgtacgacatcaaaaggggagttatgaaaaagctcttgctgaacatgaaaagaaatataatttgacaacagtgcaaaactggagacatgctttgaagaaagctgctgatttatcaggaataaagtcttttgattacaagtaa

SEQ ID NO: 87473 - DNA, 378 bp, Glycine max
  Peptide Sequence Number=SeqID_179158
atgggatcaattgcgcgcgaatctctcagcaaatcttctcgttctcaatggaaagaactgggatcggtggcacactttgagaagattgcaggcgctgcaacttcacaagaagcgtggaagatcctggagaaatgcaatgaaggcgcagagcaattgaagaagattctgagaacactcaatcctaaattcggccacattgtcgtagccattgaagaatccaagaagctcgaggaactaaaggtagaagaacgtcaaggttctctcgaggcacatgagcagagactatttgaaagaggttcagagaagcctgatgatcatcaagaactacaggctcatacatcaagaagaggaggccacaaccccaaaggaaatttctga

SEQ ID NO: 87474 - DNA, 795 bp, Glycine max
  Peptide Sequence Number=SeqID_179159
atgaactactacccgatcttggtgctgcactggggtgttggtgattcagagcaagacccctcttccttggtggttggacaaagtgtctataagggagatggaagtgccttttgtttgcaagttttgggatccacgaggtggttagtgcttttctttgttgtggtggtcccttatgtctttgttggtggggtggtcccaattttatcttccacgaggccaaccgaagaacaaacaaggaggttaaaaattcaccatggtgggatgtttatttataagttatttattgtgtatatcaatggtccaattgttgaagaagaatggggttggcatgtggatattatgtcttatattgacttcacgaaggtgattaactttctcgggtataaatcattcaaatgcttatggtatagggaccctcgaaaagcactcagtagagggttgaagccacttaattatgagtctgatattttgcaattggttgaagatatttctagctttgatgtggttgaagtgtatgtggatcagggggtgtttgacaaatatgcaaaaaagttgaatgatgataagggagatgaggttgttgtaattgatggagtgggggctgaagcagtggtggagggtgaagatgaggctgaggggcaggtggaggctgaggttcaggttgatgaacaaggtgagatagaggttgttgttgagggtgtggtggaggatgatgttgaggctgaggaagatgatgatgatagcaataattgtagtgaagtttcatatagtgactttgaagaaagatgggattag

SEQ ID NO: 87475 - DNA, 267 bp, Glycine max
  Peptide Sequence Number=SeqID_179160
atggagtctctacgttatacaaacacatcacgcgacttcggggctctaagacgacgacgaggcaaaaagcttacgggtttgcgatttccacaacctagaatgttaacgatttgcctcgaagaaatgaaccagatagcgaagaacaagaaacgaacccataagggtgctgcaggggttgcgattgcccgtgaaatcatgcgacaacttacaggtcacctcgaagaatccataagcttcgtggttgccattggccgcaaaacgttttag

SEQ ID NO: 87476 - DNA, 228 bp, Glycine max
  Peptide Sequence Number=SeqID_179161
atgacgactcacactacttctggttttgcatccccatgtttcggtggtggaagtctcgcttgttttagggatttcgtaagggacaacggtggttgccgcgaaaccaaggtcagtgatggcagtggtgatgcatgggaattgaagaaaaggaaggatgagaatgaagggttttgtgtggaaacagttgaggtggatcgaagagagaaagtgttgtataaaacattttag

SEQ ID NO: 87477 - DNA, 456 bp, Glycine max
  Peptide Sequence Number=SeqID_179162
atgatcagcaaagttgtgagttgctatagttggtctgctattttttttttcccgttactttctgtaggagtaaacaattataatatcttggcttcctctgcatatgcattttggggaatatacaaaaatagacccaaggatggggaatatactttgccattgatccatgtttatggattctccaaagcacgagatccagaatttgattttcacgagagaataagaactgcgttgctagaagttgcagtcaacgtagacatgcgacggctagtatgtactttgtttggaggcttagttgtgatgctggctatcatatctatggcattggtgatccttgtttgctcatacagaaaacgtgattctcagtcatcatcatctgaagttaatgaagatgtgaaatcacaagcaatggccaagaatttagagacaaactcagagcctctggttaacagatag

SEQ ID NO: 87478 - DNA, 98 bp, Glycine max
  Peptide Sequence Number=SeqID_179163
atggctggacggaatgatcgtgcgatagtggatgcacttcaagccttagctcaggctatagggaatttgaatagaggagaagctggtggagctgttga

SEQ ID NO: 87479 - DNA, 159 bp, Glycine max
  Peptide Sequence Number=SeqID_179164
atgtgttttcgtgaagaaaatccaagtcgaggtgcttccgtaacgcttccaagacgtttccataagcgattctgtggaaattcttcatcgttcttcattgttcttcgttcgttcttcatcattcttcggtcttcaaccgtttttcttcttctgctttaa

SEQ ID NO: 87480 - DNA, 498 bp, Glycine max
  Peptide Sequence Number=SeqID_179165
atgaagagggtgagaatgaaggagaaacccatgatgcgattatcgttcctacatggaaacttcccgccaggcaaacaatgtcattactcagccaatattagcccttctcactacccaccacccagtcatccacaaaggtcatccctaaatcaaccacaaagtctatctaccacacttccactcacgaacaccacctttagcacgaaccaaaacaccaacgaaggaaggaatttcgcagcgaaaaagcctatagaattcactctaattatggtgtcctatgatgacttgctcccatatccactcgataattcaatgatagccataaccccaaccaaggttcctcaacctccatttttccgaggatacgatttgaatgcaacgtgtgcttgtcgtggagaagccccggggcattccatcgagcattgtatgacctcgaagcgtgaggtgcaaagtctaattgatgcgggctggctgaaatttgaggagaatcgcttgtga

SEQ ID NO: 87481 - DNA, 361 bp, Glycine max
  Peptide Sequence Number=SeqID_179166
atgtcctcgccatcagagggcacacgtcctcacctagtcctcgccttgagagggctgcacgccctcacctctagaggactacatgtcctcgccttgagagggctacacgccctcaccttggttaccctcaccgttgagaggactacacgtcctcgccttgagaggactacacgtcctcaccatcagagggctgcacgccctcacctcagaggactacatgtcctcgccttgagagggctacacgccctcaccttgggtactagttaccctcaccgtcagaggactacacgtcctcgccttgagaggactacacgtcctcaccaccagagggctgcacgccctcacctccagaggactacat

SEQ ID NO: 87482 - DNA, 591 bp, Glycine max
  Peptide Sequence Number=SeqID_179167
atggggacaatcatgtttgaagcacaatggcacactaaatattccaaagcaagtgcacaaatactaatgtgtgcacctctctcaacgggaattggaacctcaactagtaagtggacagaggcagaacctgtagtggcacacgagttcgagggaggccccggcgatgccgtcgaggagggcaccacggcgggagtcggcggcggccttgggcggttggtccccctagaggcggacgacatagacttcgaggacggtgacgacgaggttggggagggagccgacgtggtggcgagggcgggagggccactcggcgtcgatgtcgtcgggctggagaaggacgaagtgagagcgagagtgggtgaggaacccggtggcacaattgtcgatgtcggtggggcactgcatcatcttgtacgccgcgaaactcatggtggaagaaacagtgtttcttgtagttcaatctcagcggtgaaagagaagagagagtatgagagcgtgagagtgagagggaggctgagtggaggccagcttcaagaattagggttcgcaaaaggaaggacaacttataggcctaaaagactttttgaatag

SEQ ID NO: 87483 - DNA, 765 bp, Glycine max
  Peptide Sequence Number=SeqID_179168
atgaatcatcattcatctagtgttaatggcgagggtactagtcataaggaccctctatctagaatcttagatgagttgagtctcctcaagttatggaaagaaaaactagaaagaaaagaaaaaggaaaagagagggaaataagggtagagcaacaacttaaaaggaagtctacttcaaaatcttatggctctcactcttatccaaagaaagaccaaggtcaaggcatcttaggggtgacaccttctaagcccaaatatgataaggggaagacaatagaaaagcaaccccttaaggctagtatgcaagagaagactagctccatgaagtgctttaaatgtcttggaataggacacattacttctcaatgcccaaccaagaaaaccatgactatgaggggccaagacatttatagtagccaagatgaggctactactccaccttcctctagtgaaagtgaagaagcaaaagcggaagaatctagtgaagagatttgcccccaagaagaaagacaacctttaatggttaaggaggaatgtaaggagacacctgctagcattgccacacctattaggcttgagtttaatcctcaagtaaaggagttgttggatgagggtttggttcacaagagcttaaatccttgtgctttgttggtgcccaaaataggtattattaggcaccaaatccctaaaataggtgatatgatgaatgttttgagtggtgcaaccctctttgtaaaatcactcgtgcacccaacatcttcatga

SEQ ID NO: 87484 - DNA, 339 bp, Glycine max
  Peptide Sequence Number=SeqID_179169
atggcgattcaagcagaggaaagtagagctgatcaaaaggtggagggatttaaacaacagctggttgatgagggggcgctggaaccggttgatgatttagttgaacttgaagaaattgttgaggaagcagaaggtgatgaagaaggagaggcaccaataagaaactgtcaagagagaataaagaagaaggaagaaagagaaaaagaaaaagaagaagaaacaaaagaaaaagaagaaaaagaaaaaaagttgaaaaatgaaaaacaaaaagagaaggttgttgagactgaaaagaagaagggcaagagttgttggaacacgtggcctcggaataattaa

SEQ ID NO: 87485 - DNA, 189 bp, Glycine max
  Peptide Sequence Number=SeqID_179170
cagcaacaattcttgaagaacctcagcctagctccaaagtcatcttctagttttccagggacaagggaatcagatacaacattgcttgaagccaacacaatggctgatgagcaacctagacgagtaacccttgaagactactcaagtacaagtgtgccacaatttttcactagtattgcacgatcggag

SEQ ID NO: 87486 - DNA, 120 bp, Glycine max
  Peptide Sequence Number=SeqID_179171
atggctagctacctcacaagggatgtcaactctatgaatggcagtggaatgaagaaggaagagagagaggagacgccacttcaaggagaagatgagtctagaagaagctcaccaccatag

SEQ ID NO: 87487 - DNA, 404 bp, Glycine max
  Peptide Sequence Number=SeqID_179172
atggtgtatgccacatgctctattttgccttctgaaaacaccggacaggttaaggaatttcttaaaaacaacccggacttcaaacttattaaagacgaaaaagtaatgcctagcgaaggatatgacggattctatatggctcttatagaaagtgaaaactttatccttaataactccatcagggaacaaaagagtgaatatccgtttgaaattacaaaaattgaaaaaccttcaaatacaattgtatcatacgcgtttttaaagcctgatgagattatttctactgccgataaagaatcagtagccaaacagacctttgaattaaccaatgaaacaaaaaaaattctcggctacacctgccggaaggctgtcactaaaatcaactccaataccatagaaatctg

SEQ ID NO: 87488 - DNA, 537 bp, Glycine max
  Peptide Sequence Number=SeqID_179173
atgaaggccaacatagaggctatgaaagaccaaatgaccaccatgatggaggccatgatgagtatgagaaaaatgatggaggtcaacgcggctgcagtcgttgccacaggtactgccactaaggtggacccgactcacccatctggtatcaatcaagtaaatcgtctagtcctagatatggtaggtcaggaaggcaaaacattgggaagtacgggcagcccccattttatgcaagtccaaagcaagcgccccttcccaccatatggcttgcctcccaactatgcaccacccaatgttgcacatgtgtccgatgagaatgtcgataactctgctcccatacccattgagagccaacaactccagtctggtcatgcacacgtctctcaacccatgggagagacgccaaaagtacctcgagaccacgttctagctgacttcgagcctcacctcagatatgctactgagggagggcctcctgccatgatggaaagagaaaaattcgatcatatagaagtgaggctgagggccattgaatga

SEQ ID NO: 87489 - DNA, 117 bp, Glycine max
  Peptide Sequence Number=SeqID_179174
gttagtgtggataagttgatgaatataacggagatgggatatgtcattgcatcaaggtataatgtttatttgaaagaccgttggtcctttactgcctttagcattgttgtggtctag

SEQ ID NO: 87490 - DNA, 606 bp, Glycine max
  Peptide Sequence Number=SeqID_179175
atgactaggggcaatccaggtgatttacaaccctttgatcctgaaatagatagaaccattcatagattagttaggcatagtgtgcatcctgatatttttgtgcattttgaccattctgagtattctgttgttggtgactctgaatattctgattttgagcattcgactactaattttcatactgagaacatggctcaacctccacctcgtgagacgaatcttagggaaatggttgcacctaatttcacttatgaaagcttgtgcattcaatatcctgataagggtgttccatatgttctcaagactggactaatacatttgcagcccaagtttcatggtcttgcaggtgaagatcctcataagcatcttaaggagttccatattgtttgttccaccatgaagccccctaatgtccaagaagatcatatctttctgttgcaacctacccttttgcgggcgagtgaggcgaggctcacgggtgcgtattccatggaaggaaaatgcacggagtcgccaccaacgtttattgaaaggaaaacattagaaaaaccaaaggaaatcggtcataaagaatattccagattcgagagttatctttacgcttga

SEQ ID NO: 87491 - DNA, 915 bp, Glycine max
  Peptide Sequence Number=SeqID_179176
atcctgggcatcgaaaaacctgttattcagggaccgctatcctggctcactgacgcccgcttagtcgctgcagtcagcaatgccggcgggcttggcgtgctggggcccaacgccggcttaaccgccgacaccgcggtctccacgccggaagagaccgccgaaaaaatgcgggaagaaattcgtaaaacgaagcgactgaccgaaaagccctttggcgtgaacctgatccccacggccgttaacgacgtctggacaggccctatccttcaggtggtgaaagaggaaggcgtcagggccgttgtgtatacgggctatggggaaggcagcattattccggcgctgttcagcgagctaaaagaggcgggtatcgccattatctaccgcgacatcaaccccaccccggaaaacacccgcctcgcagaagacgcgggggcagacattatcgttgccaccggttttgatgagggcggaacgttacccgccacggcgcttggcaccttttccatcgtgccgctgattgccgatgccgtgaagcatattccggtgatggcggcgggcggcattaccgataatcgcaccgccagagcggcgcacaccttaggcgctgaaggcgtatttgccggctcggtgtttatcagtacggaagaaagccgcgtgccgcagggggtcaaagataaaattgttgccgccaacggtctcgatttactgcttttccgcaccgtcccccattactaccgctctcttcccggcaggctggcggaaaaactggcagcgatggataaagctggcgcaagcaacgaagcgctgggcaaggcgatgggaggttacggggcctgcgcctgggcatgctggaaaataacaccgatgagggctatatcgcgctcggcacgggaattggaaatattcacagcgtga

SEQ ID NO: 87492 - DNA, 306 bp, Glycine max
  Peptide Sequence Number=SeqID_179177
atgaagctgctaagggtccaggacaaaagaaacaaaatcagggtgacaactgtttcttttgcaataagtctggacataaacacttggtggttagattctggtgtcactactaacatcagtgtttcaatgcagggttgcctaagctatcggaagccaattgattttgaaagatggatctatgttggagatggtaaatcggtagaagtggaagctcttcctatggtgaatcctttaatgcagaattgcgtggtactaagcgtagaattgataatacaaactcaggagcattatggcataagcgcttag

SEQ ID NO: 87493 - DNA, 471 bp, Glycine max
  Peptide Sequence Number=SeqID_179178
atggtggaatctgaaagacttagctatatcagaaacaaccaaaagaagcttagagttgataagtattctagcttacaaacttcattggatactagaacagctaaaggcttaaccaagggaaaaagagtcatcttaccctcaacgtttgttgggagcccacgttatatggatcaactttactttgacgacttaacaaagggtcaattactgggaaaagtggttgcatatatgcatactatagagtttcaaaagcgagcactccctcacgtgcatttattactatttctacatccagacaataaatatacatcttcaactgacattgataagataatatcagctgaaataccttcccatcaagatgacccagaactctacagattggtggagaaccatatgatacatggcccatgcggaattttacaacccaactctccatgtatgaaagaaggcaaatgcagtcgtttttaa

SEQ ID NO: 87494 - DNA, 1014 bp, Glycine max
  Peptide Sequence Number=SeqID_179179
atggttgtggcccaggcacgagaccgccgcgccgccggagccatccaggtaggcgcggccctgctggtcatagagccacacgccctggccacggaccgcgaccgggggcgtgctgcgcagggaacgatgaaggactcgggtgctggtcatggcgaggaactccggggcgggaacgttggcaaggggcgtgaaatggaccggagcgcggtcgcggccgcgccgcggcggcggctcctgccaataggcgccttcgtcccgcaatcgtgtttcgatctcggccagtcgttgcagcacctcgtcgccgccacgggccgcgagccgcgcgatcaggtgttcggccaggcccagcaggcccgcggtgctgtggaagaacgaggcggggccgcgcggcgccgatgcgtccgcgccggcctcggcggggcgggcaaaatgcaatacatggcgggcggcccgggccatcgggctggcgaggctgtcggtcagcgccagcacggtgacaccgcgggcggcgatctgggccgtcaggcgcacggtggcgccgggatagggggcttgcgacaccactaccagcacatcgcccgcctgcaggctgtcggcatcttcggccgacgcgccgcccaggccatcgatcaggatgccgttgcggcgcagcaggtggtaggcatagcgcatctggaaggcgatgccgaaagcggagcgcgtgcccaggaagccgactggcgggcccgcagcagggcatcgacggcggcgtccaaagcggcgtcgtcgttgacctgcaggatcgaggccagggctgctgtctgccattgcgtcagcgcgtcctgcccgcggccgccggactgccgggcgcctcatagctgtcgtggcccgcggcgcgcgccagccgcagcatggtggcgggcgacacgcccaccgcctgcgcctgccggcgcatcgaccaaagccccacttcggccgggttggccagcacccattgggcggcgcgctgcagctcggcgggcagcgtggcgctga

SEQ ID NO: 87495 - DNA, 822 bp, Glycine max
  Peptide Sequence Number=SeqID_179180
atggattctgtaggaataagatcggctaacccttatttggcgactcctggagcaacggttcatggccattatggggaaatactttctgaaggagatatattagttacatttatctatgaaaaatcgagatcgggtgatataacacaaggtcttccaaaagtagaacagaaagagagtgatacttggaatgggcgtataacaaaaatcttggcatccttggggatcttgattggtgctgagctaacgatagcgcaaagtcgtatttctttggttaataaaattcaaaaagtttatcgatcccagggagttcacattcataatagacatatagaaattattgtgcgtcaaataacatcaaaagtcttggtttccgaagatggaatgtctaatgtttttttgcccggtgaactaattggattgttgcgagccgaacgagcagggcgttccttagaagaggcgatttgctatcgagttctattattggggataacaaaaacatctctgaatactcaaagtttcatatctgaagcaagttttcaagaaactgctagagttttatcaaaagccgctctccgggggcgcatagattggttgaaaggtctgaaagagaacgttgttttagggggaatgatacctgttggtaccggattcaaaagaataatgaaccgttcaaagcaaaggcaatataacaagatgacctcggaaacaaaaaaaaagaatttatttgagggcgaaatgagagatattttgtttcaccacagagaattctttttttttgtttcaaagaatttatgcgatacatcgcagcaatctagtatttaa

SEQ ID NO: 87496 - DNA, 204 bp, Glycine max
  Peptide Sequence Number=SeqID_179181
atggcaggagctagtgacaatggtggtgtatatcatcaactagacggatttcagcgcttattactggacgcgatgactacaaaaatgcaatgtttgttgaaacgtaacaatgaagagctctacaggcgaatagaaggactagagcaccaaatgaatccaaatgctaggagaccttatggtggcatcagaagggtcaatgattga

SEQ ID NO: 87497 - DNA, 513 bp, Glycine max
  Peptide Sequence Number=SeqID_179182
cctatccctcttaagattattattgaggccacaaggtccaacacccagaaatccagggctagaagatctgaggccccaccatcttctactcctgcccctactcatgcttctacctcacctccctctgcatctgccccatctacttctacaactccagttccttcagttcttatagagcctgcatcagggccagctcctgatcatgtagagtttgtaggatgtggtccaccagcggagcctcagcctgcagaggaggatgtttttgctgacatgtcaaagccctctacatcaaagccttttattgttgaggctggtccagctactccactggaggacactgtagcagttaccccacagaagcaatctgcaccagtgccgaacttgcctgatgtagctccatgtggagcttgtaggccttggatcttcttcatcaatggattcctttgcttcttgaggtctaattgcagcggaatggagaaggagaaagatgaatggagatgccacttcaagtag

SEQ ID NO: 87498 - DNA, 806 bp, Glycine max
  Peptide Sequence Number=SeqID_179183
cctatggtaagatttgggacctagctagggtagaagtctccatggaaccgattgcatccctttcccagtattatgaccagcccctaaggtgcttcacatttgaggacttccagctagtgccgactgtgaaagagttggaagaaatcctgggatgccaactgggaggaaggaagccatatcttttctttgggttctatccctccacgataagagttgccaaggtagtgaaaatctcagcacaagagttggaacgtctaaagcaaaacagaaatggagtagtcggagtaccaaggaagtttgtcctctttccgaatatggaagggttagtggacctagcagcgattgacgctttcctcgcctttcatcatggcaaggaaagcccggtcgtcgccattttggccatgtatgacacgttcgaccggggatgtgaaaagagcgacgcaagaattttttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctagcatggaggggcgtctgttaattggttccctcgctagaaggaaggaagaatcaggattctatcttcatgcgaaggatgacagagagcttaggggaagtagtaatgggatcatcggcggctatcataagtggctgagagtccaaacacaaggattggattggctcccaaatctaaagactgtgagagacgatgaggttaaagcttcggaagaaagtgatgag

SEQ ID NO: 87499 - DNA, 243 bp, Glycine max
  Peptide Sequence Number=SeqID_179184
atggggaaagggtggttacggtggtgccttccagaagatccgtttcgggttcttctggaagttccggaagaaggtgttccggaagatttccggaagaaggaaactttccagaagagtagttctcctggaaagtttccggaagaagggttcttccggatgacctttcagtggttccggaagcactttccagagaaccactttttccggaaagtttccggaagaagtaattcttccggaagttag

SEQ ID NO: 87500 - DNA, 384 bp, Glycine max
  Peptide Sequence Number=SeqID_179185
atgtcgggaataaggggggacatactggacgtaaccactcccttgggggcggctgtgccgccctgcctttcgatcgatacacagttgagtaggccgatcacgaacgctacaggtgtgggagcgatcctgacatgggttctctctcctcgaagggtccagcatcctatcctattgggcaagcccaggaacgagaagaagagtgcccggaaccacgttacatactgcttacctagaataagtagccaggaaagagaaaagaagcacctctttccgacactaagcgcaaaaaggacaacacagaagtcagattcgtctttcctcaagtttaaccaaattcaagcctttacttcctccactccgtgttttgcttcctgcaccctatag

SEQ ID NO: 87501 - DNA, 840 bp, Glycine max
  Peptide Sequence Number=SeqID_179186
atgggagcttcaagccacgtaagcaaatctgcacttgaatgtgggggtgtcggctggtctgtcgctgactacggcggggctggaggtgacgggggagtcggaggggacataggggcaggaggagaatcgataggggagttagaaggagaggaagcggtggggccaaaggaggaggaggaggaaggagtgggggatggaggagaagaggccagagtggtttttgaaacgggagcgggagcgggtggtggtgcctgtggtggggatgacgacgaagaggagcctgtggtgggaaagtggcaagggaagagaagtgaaggaggatcaaggtacaacatggctggctcaaacagtatcattcaaggatctttatcggtttttgatggaaaactgtttgatgattggaaggtcaagatgctggcaatttttggcttccaagatgtatttgaagtggcgacatttaggtttgaagatcctgggaggaaagccactgaagaacaacaattggctttcaaacagaagcaaaaacttgactgcaaagctcgatttctcatctaccaatgtgtgaactcaaagattttcaacaagatctcgaaggcctctacctctaaggaagcatgggagattctgatgaaaacatatggtgatggagaaaagaacatgaaaatccccgatgaactagtggtagacaagatcttgagaactttgccaccacgatttgatcatgtggctgttgcaattgaagagtcaaggaacttagatgacatggagattgaagaattgcagcactccctaaaggcacatgaaatgaggatcaatgagagaagatccaatcaagaatag

SEQ ID NO: 87502 - DNA, 84 bp, Glycine max
  Peptide Sequence Number=SeqID_179187
atgaggaaggtggtgtatgggtttcaagtcaccgatgaagaggtcgagagcttgaataaaagaaaaactttttatctaaagtaa

SEQ ID NO: 87503 - DNA, 858 bp, Glycine max
  Peptide Sequence Number=SeqID_179188
aggttggggagaggaggggatggtgatgatattgatgatgctccccagtgccaaaggccgaccgcactggcacgcaggcgacgggtaccagtcattcttgatgatgatgtgtctgtggtacctgcagactcacctgcggtaccagaggcagaggctgttgtagctggggatgagcccatggacaccggtgcagagattgacgcacaagataccgatgcagagactgacggggacgagcctgtgggatttcctggtggacccagggacccatcagtgcttacagagtatgctgaccatgttgcgggcagcgaacgttctgagttgaagttatgctctcatgggaggaaggtgcataacttgggcaggcctgttcctgcaattgaggacatggttgttgggacaggattaagtcctttgatcgcgtgttcgatagacaccagcaatcagggacttatatcctcctttgtggagaggtgggaccgggagacttctagtttccatctttttgtgggggaggtgttgatcacgctggacgacgtcgcgtatcttctccatttgcctatcgttggcgcattccatgacttccagcctctgtgcatcgatgagacggtggtgctgttggttgagttactgatggtctcaacagagacgcaacactgggcagttatcgctcacgcttatcttctacatcttttgggttgcactctttttgctaataagagtgcaacccatgttcatgtctcacacttacaggctctgcatgaccttaatcttgttgggcggtatgcatggggagctgttggtctcatccatatgtacgatcaacttaatgatgccagtctcagtgtgacatcctag

SEQ ID NO: 87504 - DNA, 396 bp, Glycine max
  Peptide Sequence Number=SeqID_179189
atggcagcgcagttgatccatgatcgcgtggtgatggagggcctagagggtgtttgggagaccctcgaaggcaatgagaagtgccgattccggggcacaattcgactcactgttacttcactacctgtggagtggatactacctacacctactccatatcgattagttgagcccgttcaagtgatagaggtgtcatcctctgaagaatatcttgaagaggacccagaggagttacctcctgaacctgctgtggatgcccttgacttcccagaggatgatgaggacccactccctaatgttgattctccagaggatgttatgtcagcatctgaggcagactctaaagaggagagcggccctggagggacagcgaatagcgacgactcctcatcgtag

SEQ ID NO: 87505 - DNA, 1185 bp, Glycine max
  Peptide Sequence Number=SeqID_179190
atggctgagaatttggacgacggcgagttctggctgccgccgcagttcctcgccgacgacgacgtcgtcgtatttccgacaccctttgaagcaaagtttccgcctttgtccgacgacgccgttttgttcccgtacggttctcccgttgattccaccgttggtggctccagcgagaccgagagcgacgaggaagagcaactcgttgccgagttaactcgccacttaactcgctcctctcttcaacctgacaccgagtctgtgggtcggtttgtgtctggttctcctcaatccacgctttgcgcgtttggaagtgggtgtagttgcggcaaagggtcgagccagggtagcccagatggtgtttgcaagttgtcctctgcgaagaccacttgggatctgctgcatgcggctgcaggggaagttgagaggatgaggttgaagcaagaaggttatgctctcaaccatcacaatggaaactttgttccccaaagaaaaccctctccagtcaccactttaccctccaaaaacaccaccgcaaatccaaaccctgatgtgggtggtttctacacccaacaacaatcactctctcaccagcaattgcagatagcacaattgttgaggcagcaacagctggcaaagcagcagaactcggtctggaatgtgcagaagcaatgtgatggggtttactctcagaggcagcaacaaagcaaccaaatggttcccaatagagggaggaacattgatgttaatggaagaaacattagacctttgggtttgtctgcatctgcatggcctactctgcagcacgcgaagcagcagaaccagcaatatggctctggcatgagagctgtgtttctcggaaacccttctgggagaagggaatgtgctggcactggcgtattccttcctcggcgagttgatatcccagagtcacgaaagaagccagcgtgttcaacagtgctggttccaactagagtggcgcaggccctaaatctgaatctcgatgatatgatagttggtcagccgcaacacttgcaacgatttaatgcttgtcccaacattgaaaatggtgcagctgtttccaggctgaggggtaattatgtcctttctcaacagaagcgcaacctcaacaagcctcagccagcagggtaccatgagattaggttgccacaggagtggacatattga

SEQ ID NO: 87506 - DNA, 297 bp, Glycine max
  Peptide Sequence Number=SeqID_179191
atgggaggaactaaaaggcttttagtgataactcccaaggtggtcatatctctcttgatggtttctagaggtatcatccccttcgaaaaacatattgcggcagtagggactaccagcaataatatgttatcaaagagaaaaactctagatgagggttcattgttatcaagcaagttggagacccagcatgaccacaaattcacctccactccttatgttcccatggacccgggtatagggccctttttcaactcactgtgtgcacaaatagtgttggtgtttttgttcatcaaatga

SEQ ID NO: 87507 - DNA, 603 bp, Glycine max
  Peptide Sequence Number=SeqID_179192
aattgctggaacctagatgacccttcggtcactttttggggaacccgcaaatctagggctagaggatctgaggcaccatctacttcagctccccctaccttagctccttctacatcagctccttctacctctcctctccctccagctccaacaactccagttcttccggatccttcttctcagagctctgagccattcttttctatgctgcagagcctgcatcagggccagctcctgatcatgcagagcttgcagaatgtggtccaccagcggccggtagtgagcgttgaagaatttattcagcaggtggcctggctaggagtccagccttctcctttaggagggggtgaggcctccgcagcccaagagtctcagcaagatcaacaggaggacattccagaggttgcggagcctacacctcctaagccattcactttagagtctgatctagttgttgtacaggctgatccagctatatctcctcatcctgagccatctgcaccaatgccggacctgcctctttctcaggatccatcatctgcaccagcattggacctgaatgagcatgcacaggatcaggatttttatttccctgcattttga

SEQ ID NO: 87508 - DNA, 438 bp, Glycine max
  Peptide Sequence Number=SeqID_179193
atgccgatctccccttacgaaaggatcgcgcccacaagacacctagtggaccgaaggagcccaacagggccctggggtttccagctctggttacgggcctctgtcagtcctatagggtgcccgtcccccccagcaaggtcatgccatcgtgacatagggatcgcgcccgcaagacacccagtggacccggagaagtccaacaaggcaagcgcagggcgagacaccacatcagcttggggatggccgatagcgggcaacagacgcaccgccgccacctcgaaagcccctcagctcatctgcaaaagctggagcgttgcctacaacccgtggtcgaccagcaggcgaccaagtccaaagccaaagttaagcaaaagtactaggtccgtgaccgacaagtcatcacgcgtccagctcaagacgttaaagaagcgctactag

SEQ ID NO: 87509 - DNA, 280 bp, Glycine max
  Peptide Sequence Number=SeqID_179194
tgaagccgatattgaggaggaggaactaatagatttgaggtcaaatcttcttcaagggggaggggatgatgcaatcctccctaggaagggaccagtcactagagccatgagcaagaggctccaaaaggattgggctagagctacggaagaaggccctagggttctcatgagtttcaggcgagcatccgctaagcacaacactcctgggctaaccgtgaggaagaatccagaagaagatgagccatacaggtttgctaagcgcactacttcatctctctaa

SEQ ID NO: 87510 - DNA, 321 bp, Glycine max
  Peptide Sequence Number=SeqID_179195
atgccaaacaggttacttgatgagcatggattgaatcaagtcaaaagaacaagatcaagtaaatctaagataagaactgtcgcaacctaccctacggagggagggcgacgcgagactcgcgggatgagtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 87511 - DNA, 606 bp, Glycine max
  Peptide Sequence Number=SeqID_179196
atgtgtttccttgcgcattgtctccttcttttctcccttcgatcggtgctccccgcttggtcatttcttgcgattggtttggttcgatgccgcgaaggtgaagttgaaggtgaaggtgaaggtgttgcggtggtcatcggcggtatagtatacgagatggacgaagatcagtggatgtataaaggtataatgtctggagaagtggatatgaattatgaaaatgaagaagaatgtggtgtgaatgaaccacatgttgattgttcggatgcgttcaatacttctcaaccgagagaatgttctgcgatggtgaagttgatttgtgggattcatgatcatgtggattggtttgtaaggtctgacacaaacacaagtagtagaggaaggactttgtttgtgttaattgggtgtgaaaggagtggcgagtataggtgtaggaagaaagaattcgttagaagagacactgggactaggaaatgtgagtgtccctttcaagcttcgtggcaagccagtggttgcaggacatactggatagtgaagttgatttgtgggattcataatcatgaattggccaagtcattagtggacatccatatgtcggacgatgaa

SEQ ID NO: 87512 - DNA, 372 bp, Glycine max
  Peptide Sequence Number=SeqID_179197
cgcaaggccagcgacgcgctggagctggaagtggtcgacacctggcaggcggatgcggtgcgcgatacccgtaccctctccggcggcgagagcttcctggtcagtctggcgctggcgctggcgctttccgatctggtgagtcataaaacgcggatcgattcgctgttcctggatgaagggtttggcacgctcgacagcgaaacgctggataccgcgctggatgcgcttgatgcgctaaacgccaccgggaaaaccatcggcgtgatcagccatgttgaggcgatgaaagagcgtattccggtgcagatcaaggtgaagaaaattaacgggctggggtatagcaggctggataaggtgtttgcggtgcagtaa

SEQ ID NO: 87513 - DNA, 780 bp, Glycine max
  Peptide Sequence Number=SeqID_179198
atgtttgtctctttgctaaagcatgtttgcatttttagtggagaaaacaacgagactttttcaagtctcacaagttatccagaactatgtaggtctgagttcctcattggaggatacgtaggagcaagagcctcgcttttgtcgaccataccgccttttgttgccatgactcaagagctggtagcccgcgtagacaccttacggttatccgcacctcgtcattcagtgaccccaagtgtgattgacgagcagagaccaatatggtcatctgcgccctttccggagatgtcatcattttccgatggagacttttcaagtctcacaagttatccagaactacgtagaggcggcgggcccgatgatacgcggagataccttacggttatccgcacccttttgtcatccagaggcggcgggcccgatgacaagcagagaccaagtttggtcattctgcacccgatgatacgcggagataccttacggttatccgcacccctttgtcatccagaggcggcgggcccgatgacaagcagagaccaagtttggtcattctgcacccatgatacgcggagataccttatggggctgacacagtcttctgcaccttttgttcctccgggaacaacaaagtcatttacatgcggaaatttcatggtcgcccgcgactctcgtcaaccgagaggagcgaaattagtgtcatacactgattttcggggacctttgcttgatgacatgcgaccattctttggtccttgtgaggtgcttggcacccatcattag

SEQ ID NO: 87514 - DNA, 281 bp, Glycine max
  Peptide Sequence Number=SeqID_179199
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtgggggtgctgacgattggttcctgtgttgcctacctaccacacggtattcgtgtggctagtcagacccattccatccaggcctctttgttggggacgctggaggatttcaaagtcccacacgtgaaccac

SEQ ID NO: 87515 - DNA, 210 bp, Glycine max
  Peptide Sequence Number=SeqID_179200
atgggggcatacgcaaaagatgagaaattgatgatacattccttccaagaaagtcttactggggacacattaccagtattctactatgaaaatggtgggttacacaccttccagctttacggatatggtctttgtcggaaaaaggatcgaagtgggtctgaaaagaggcaaatttggtcatcctgctttgataaaaactggggcaaatga

SEQ ID NO: 87516 - DNA, 243 bp, Glycine max
  misc_feature (4)..(4): n is a, c, g, or t
  Peptide Sequence Number=SeqID_179201
atgncattctctgtggaaataacgaacaaggccaaaggaaaaggcaaggaggtcgccggaaaaggttctgctggcaagcgcaagggcgccttcgacgatgacaagaccggtggcggccacaagagaaacaagcgaggtgtccttcacttttacctctgtcgactcttccacgcaaggtttgatgaaataagcagttctgtgaactggatttcacgttacacaatagttactgtcgtgacatga

SEQ ID NO: 87517 - DNA, 606 bp, Glycine max
  Peptide Sequence Number=SeqID_179202
atggctccgaggaagcttgcctcaaagaggtccaggaaggataaggcggccgaaggaactagttccgctcctgagtatgacagtcaccgctttaggagcgccgtacaccagcagcgcttcaaggccatcaagggatggtcatttctccgggagcgacgcatccagctcagggacgacgagtatacggatttccaggaggagataggtcgccggcggtgggcatcactagttacccccatggccaagttcgatccagaaatagtcctcgaattttatgccaatgcttggccaacagagaagggcgtgcgtgacatgaggtcctgggtaaggggtcagtggatcccatttgatgccgatgctattggccagctcctgggatatccgttagtgctggaagagggccaggagtgtgagtatggccagagaaggaatcggtctgatgggttcgatgaggaggccatcgcccagttactatgtataccggggcaagattttgcccggactgctgccgggaggcgagtgcggatcatgcgcaccaacatgaccaccctgactcagatatggatgactttgctgctcagcaacatccctgcccagcgatcataa

SEQ ID NO: 87518 - DNA, 180 bp, Glycine max
  Peptide Sequence Number=SeqID_179203
atggctcattcccctcctcttgggctctgtcctttgtacactatgggcatagcccttcccatgacaaaaagcaaagtgaggcctttcactactagaaaatacactttcaacatcggttatttagaacattctacatcggttctaaaaccgatgttgaaagtgacgatgttgaatgtatga

SEQ ID NO: 87519 - DNA, 672 bp, Glycine max
  Peptide Sequence Number=SeqID_179204
atgggtcgttcttgcaacaaatcccaacaacaacatgttgaaggccctatcattataggtgctggtccttcgggcttagccgtggctgcgtgtctctcagaagataaagttccttttgtgattcttgagagacacaactgcatagcctccctttggcaaaacaaaacctacgaccgtctcaaactccacctccctaaacagttctgcgagcttcccttgaagggctttccccacactttcccaaaataccccacaaagtaccagtttatctcctacatggagtcctatgcttcacacttcaacattcaccccatcttcaaccaaactgtgaaaagtgctgagtttgataaagggtcaaatgtttgggttgttagaactgaagagttcgagtattcttctcgctggctagtggtggccactggagaaaatgctgaacctgttgtgcctaggattcatgggatggagctttttggtggtgctgttgctcacactagtgtgtataagtctggctctgagtataggaacaagaaggttttggtcattgggtgtggcaattcgggtatggaagtttgcttggacctttgtagacacaatgccaaaccttacatggttgctagaaatacaggagatgttaggcttctcaacgtttgggatagctatggcgctctataa

SEQ ID NO: 87520 - DNA, 342 bp, Glycine max
  Peptide Sequence Number=SeqID_179205
atgcgtgccaaagctagagtaatgagtgaaatagaggaggtgcaagagcagatgaagaccgacatggaggccatgaaagagcaaatggccataatgatgagtatgagaagaatgatggaggtcaaagaggcaaagagttgggaagtgcaggcggcccccattttgtgtaagttcagaacaagcattccttcccaccatatggcttgcctcccaactatacaccacccaacgttttacacactctcgatgggaatgtcgacaactccgcacctatacccattgagagccaaaaaccccaatctgatcatgcacaatctctcaacccatggggaagacacatga

SEQ ID NO: 87521 - DNA, 318 bp, Glycine max
  Peptide Sequence Number=SeqID_179206
atgaatttaagaggaagacaagtggagatagctgatccattgtgcccattctacaacaatttggatgaagatgctgcgcaccttttcttcaactgcagcaaggtacttcccttgtggtgggagacagtctcatgggtcaaatcagtgggtgctttcctaaaagaaccgaaagaccacttcatgcatcatagcagatcgaatgctacacgaacaaggctttttgtatcactagaggatgatagcaacacactaacagcagtaccagatatcacacagataacagcatcagacaataattccaaccaagagaaatcatga

SEQ ID NO: 87522 - DNA, 309 bp, Glycine max
  Peptide Sequence Number=SeqID_179207
atgtacaagatgtgtcgaccaagcaaggaaggaatgcaagcatcaacgtctaaaacttggttagcaaccaccttcaccagatcaattcccaaagtgatcgtctgctccagctcgtccctgatattctatgtcaactcctccttaatattttgtttgagtcgatccagcttttttgggatgatcgacatatatgtgcgagagcctgctaaagctggtccaaagtattgcttaattgtcacactggctccaacaacatggacatggccaagatgctctggtcacccaaaggcaacagtcagtacatcttga

SEQ ID NO: 87523 - DNA, 195 bp, Glycine max
  Peptide Sequence Number=SeqID_179208
atgaagaggactctgccatggagtaacaatgatgagtcatcgtcttcacatttagattctgaatgtgatagtgaaactggagggggaaactccaaaggctttagaatttggattgatgctcatcctaactatcgaactttggcattggtagttgctttggcctttgggtgttacaactattttcttcatgattaa

SEQ ID NO: 87524 - DNA, 87 bp, Glycine max
  Peptide Sequence Number=SeqID_179209
atgagcaagaggctccaagaggattgggctagagccgatgaaaaaggccctaggattctcatgaacctcaggggctacataatgtag

SEQ ID NO: 87525 - DNA, 1445 bp, Glycine max
  Peptide Sequence Number=SeqID_179210
gcaaagttttaggaagagccttagggaggcaagttagtggtgatgcggaagaagtccttcagcatcgaaggccaacaatatctacacatagacaactagaagctacaattgttgctaaggatgttgaccatgtcaatcatgctgctgaagagaaatgtactgagttgaagttggcctctcatgggaggaaggtagagaaatttggaaggcctacacctgagattgaaggcatagtggctgctacagggttaagttctctaattacaagttcgttagacactggtgagaagggaatcttatctgcttttgctgagaggtggcacaaggaaactagtagttttcatctatcagtaggagaggtgactataaccctcgatgatgtggcgttgttgttacatctgcccattacaggtgccttccataccttcaatgctcttgatgtagaccaagttgtggagtttttatttgagttgcttgaagtgagtacagaagaagcaaaagatgagacatttcaatgcagaggggcatatagtgctacacacatcagtgtggtattcttggacgtatttcacgacctcagtcaatctggaagctattcatggggagcggctgcactgcattttcctataattgcttccattgttgttgatgaggattaccatgagaggaaaccatgtgattgtcaatggaagtttcggaagacattaccaatgttgacgtatcataagcgcctggatagattgacgttagatgttgtgtgttggattccttatggtgaccaccattcatttagacaatttgagctcatctcattaatttctggacatatcagatggggttcatgtattgtcagataccaacaagagagggtagtgcgacagtttgattatctgcagaccattcctccacaccctgctactccatccttatcagtagaagagattgacgatagatggcttcagtttttagaataccttgcaccgattgcacagatttgtagtgctcctagacaatgtgcagcaaactacatggagtggttctataggatatctcacccattcatgagtttgaaacaaccaagggagcctcctagacatccacctgtggtgcatgatgatacatttattgtaccaaatcctcctcagcagcccgtccacacagcagttatgctagaactacctgcacctgcaactgctgatgtagacatgcctcgacatacagtggatgcttggcaaaggatagcaaaaattttggaacacatgatcaacatgaggatggtcactgctggaactgaatcatacactctgaccgagcactgcctaatattagtcaggagtgtcactgagcagcaacatgtttatgttcggtccagacgaaggagggatgttagagatagggggagcaacatgagaaatatggtgaacaaccaaaaggctaaagcttga

SEQ ID NO: 87526 - DNA, 285 bp, Glycine max
  Peptide Sequence Number=SeqID_179211
atgaaacctgagaataaactcccatcaactattgatatctctctgtcagctcctctctgtgctgcttggaggtctctcacgttcatgtctgttagtccaatcacaaagttctatataccaaatcgaaggcaatttagtatagatttcaaaaataagggttacctcgaagaaaccatcaaagaaaggttgagatcttccgctccaattaaagcattcctctccatgcgatggtctggtggcaagcaacggcggcttatggtggccactggtggtcgtgggaggtag

SEQ ID NO: 87527 - DNA, 162 bp, Glycine max
  Peptide Sequence Number=SeqID_179212
atgaaacaaccgagagaagagatgatgacaaaggtgatgaacaaaaagctcaaaagatcaaagaacaactcaagtgaatcaaagagcatctcaagtaaatcaagaacaagtcaagatctcaagaatcaagatcaagattcaagactcaagattcaagaatga

SEQ ID NO: 87528 - DNA, 174 bp, Glycine max
  Peptide Sequence Number=SeqID_179213
cgggcaatagacgcactgccgccacctccagagcccctcggctcatatacaaaggctggagcgttgcctacgacccgtggtcgaccagcaggcgaccaagtccaaagccaaaggaaagcaaaggtagcttgcttgtggggcttctatggaggctggatctttgagcttcaatga

SEQ ID NO: 87529 - DNA, 700 bp, Glycine max
  Peptide Sequence Number=SeqID_179214
gtggacccttgggtactagtacctatcacctttagaggactatatgtcctcgcctgtagagggctgcacgccctcgcctttagagggctacgcatcctcattttcattcctgggccaccccctgatattagagggcgaccaactgtgcgagcacatccagagagggaggctatcacgcatctactatgcataccggggcaatttcacccgtgccgctgcaaaaagacgagtgcggatcatgcgcaccaacatgaccactcttacatggatatggatgacggatcgcgcccacaagacgacccagtggacccgaagaagtccaacaggggcctggggtttccagctctggttacgggcctctgtcagtcctacagggtgcccattcccccagcaagggaatcgcacccacaaagacacccagtggacccgggagaagtccaacagggccctggggtttccagctctggttacgggcctctgtatcaatcctacagggtgcccgttccccccggcaaggtcacggatcggcttgcaagacacccagtggacccgaagaagtccaacagggtcttggagttgtcaagctctaattacgggcaggcgcagggcgaaacaccacagcagcctggggatggccggcagcgggcaacagacgcaccgccatcacctctagagttcacctcagctcatccacaaaaag

SEQ ID NO: 87530 - DNA, 652 bp, Glycine max
  Peptide Sequence Number=SeqID_179215
atgaaggttatgcagaaatcctctttagcgggaagacaatcacaaaatctggagataggggacaacaacaaacattatcgccttaactggaggaacaatgccgacattacctccttttatttcacccatttccccgacgaagctaatgaagagttgctatggaggcacttcaaaaactggggtgacgtacgtgaagtatacatcgctaaaaggctcaacaagcatggcaggagatacaggttcatgcggttcaagggagtctcggatgcaaaaggattggaggtgagactggacaacatcttcatcaacgattgtaaactatttgtcaaccttcctaggttcgacagaccagttcggaatacagaggaccgccgacgattggaccgggctcgagtattggtgcggacaccgcttctgccgttgataaggtcggaggtcatcgtccgtgtgggggagcttgagtatcgggtatggattgtggaagagacagggttcgaaggtgggtcgaaccggaaaggaagctcgtcgtccgatgggtggtcggagatgataacatcggacgacggtggggaggttggcgatgttcttgacgacactaataccaatttctccttctcgtcggagctgcccaaccagaaattgtctccgtctc

SEQ ID NO: 87531 - DNA, 159 bp, Glycine max
  Peptide Sequence Number=SeqID_179216
ttcagggaacttacccttatgtctgaggttatccctaatagtgtaagattgggagctttgagtattgctagtgagttgctaggagagatcagagaaggccagaagtctaacccttttctgagaactcagttagaagccatagcgtcaaggagagatgat

SEQ ID NO: 87532 - DNA, 939 bp, Glycine max
  Peptide Sequence Number=SeqID_179217
aggactacacgtcctcgccaacgtagggctacatgccctcacctttacacgactacacgtcctcgccttcagaggactgcacgtcctcacctttagaggactaaacgtcctcgccttcagaggactcacatgtcctcaccatcagagggctgcacgctctcacctccagaggactacacggctgcacgccctcacctccagaggactacacgtcctcgccttgagagggctactcgcccttgccttggggctacacgccctcacctttagaggaccacacgtcctcaccttcagagggctacatgtcctcaccatcagaggactgcatgtcctcaccttcgtaaggctacacgccctcacctttagaggactacacgtcctcgccaacagagggctacacgccttcacctttagaggactacacgtcctcaccatcagagggctgcacgccctcacctccagaggactacacgtcctcgcctccagaggactatacatcctcgccttgagagggctccacgccctcacctttagagggctacgtgtcctcattttcaggaccagtagtttccttttaacggttcctgggccaccccctgatattggaggagggccaactgtgcgagcacaaccagagagggaggctatcacacggctactatgcataccggggcaagatttcacccgtgccgctgcaaagagacgacaacattctgcccagcgaccgcaataccgatctccccctgcggaagtatcagttggtctgtgtcgtcccgacatagggatcgcacccacaaagacacctagtggacctgaagaagtccaacagggccctggggtttccagctctggttacgggcctctggatcctgcccgcaagacacctagtggacccgaagaaggccaacaaggtcttggagttgccagctctaaatacgg

SEQ ID NO: 87533 - DNA, 360 bp, Glycine max
  Peptide Sequence Number=SeqID_179218
atgtctaatgtccagatcagaccagcatgggagatcaaagaaaatgaaccttttcttccatatgcaagtgttgaactcgctggtatacctactcaccagtcaacggtatcggtgcaatatcatgctgttgacttccatgaaatgcttttttcattcgtctcttgtgttttcttcacagatggggcatgcatgatgacccttaacattataactactgagattcccatatgctggaaagtcattaatgatacaaaaaagcattgcaccactattagaaaatacactttcaacatcggttatttagaacaatctacatcggttctaaaatcgatgttgaaagtgccaatgttgaatttatga

SEQ ID NO: 87534 - DNA, 171 bp, Glycine max
  Peptide Sequence Number=SeqID_179219
cacaaaatttcgtgctcttctctccctctcccctcattcatctccttcttcctccaagctcttatccatggcctcctatggtgcaaaggaatccattgatgaagaagatcctaaggcctacaagctccaatggagcttacatcatgtggtatcaagagcatcttcatctag

SEQ ID NO: 87535 - DNA, 213 bp, Glycine max
  Peptide Sequence Number=SeqID_179220
atgtttgtcatcgcaggaaatggctccgagaaagcttcctgcaaagagatccaggaaggacaaagcggtgaaggacccagtgccgctcctgagtatgacagccatcgcttccagagtgctgagcaccagcagcgtttcgaggccatcaaaggatggtcattccaccgggagagacgcatccagctcagggacaatgagtataccgacttctag

SEQ ID NO: 87536 - DNA, 777 bp, Glycine max
  Peptide Sequence Number=SeqID_179221
atggctaccgcaccaaaagaaacttcagctcctggttcaccctctgtaccatcatctccatcatccaccgaaaccccatcacaccaggaacgacctgaattcactatccaacccatacaaatgattcctggtcaagcccctgtccctgagaaactggttcccaaacgacaacagggagtgaagacttctgaaaaccctagccttgcaacaagtcctagggaagtagacttggagatggataagaagattcgcagtattgtgagtagcattttgaaagatgcctctgttcctgatgctgataaagatgtcccaacatcttccaccccaaatgtttctgtgcctgatgctaataaagatgttccaacatcttccactccaaatgctgaagtcctcccttcacccagtgaagaggaatcaacagaggaagaggatcaagccacagaggagacccctgcaccaagggcaccagaacctgctccaggtgacctcattgacctagaagaagtagaatctgatgaggaacccattgccaacaagttggcacctggcattgcagaaaggttacaaagcagaaaagggaaaacccccattactaggtctggacgaatcaaaactagggcacagaagaagagcacaccaatcactcctaccacatccagatggagcaaagttgcaattccttccaagaagaggaaagaaatttcctcatctgattctgatgatgatgtcgaactagatgttctcgacatcaagagggccaagaaatcagggaaaaag

SEQ ID NO: 87537 - DNA, 129 bp, Glycine max
  Peptide Sequence Number=SeqID_179222
atggctcaactaaattcggagttctacggagtgcctgtcacctccagcaagggcatcaggccccctactaatcgagctttcatcaagaagtactgcgtccccaggcaggcgcagggcgaaacaccatag

SEQ ID NO: 87538 - DNA, 361 bp, Glycine max
  Peptide Sequence Number=SeqID_179223
gtttccggtaattgattatatagttattgtcgcaacctacccttcggcgggagggcgacgcgtgactcgcgggatgcgtgttccacgaaaggaatacgcgcggagtcgccagcaacgtttatttaaggaaaacgtcggaaaaaccggaaaagacgcgatctacgaacttttaagtgaaaggttcgggagttgtatttacgcacggggaagggtgtttccctttgctcctacgtattcctcaattgcgatgaggaaatcagacctacgtagttctttcttatgcgtgaatcaagtgattcttttttacttgaaaggtgatcattttaaggcgttggaccttaaaaatgatccatttacttag

SEQ ID NO: 87539 - DNA, 645 bp, Glycine max
  Peptide Sequence Number=SeqID_179224
atgtcgttctcaacttgcgtcagtatggctgtcaataatggtgcctgtgtctatccgtacccctggaaagatgcttctgctattgaatatggtttgaaaatgggagccagcacagcgagtccggacagacgattcagcggtgaaggttacagcctatcgccggcttcgctaagaaacataagcgagggtgaaaaactggtccttccatcgcctaacggttcagccgtttcattcaaagcaagggatgcaggaatagcagtgttgagcggctgtttcagaaacatatctgcgaccgcgaatgcctgccgttccttcggccgtgttctggtaattccctgcggagaacgctggcccgatgggagccttcgccccagtattgaggattatgtagctgctggcggaattatcgctgcaatggggcgtcaaaattgctcaccagaagcagaggctgcggtggctgtctggcagcattaccaaaagcaaaacctggtgcttctacgggagtgttcgtctgcaatagagctgatgcaacgtggattcgccggggatgtcgatctctgtcttgaagtagacaagtccagcctggaatgtcggctttggggtgatgcctatatgtcagcattgcccgggcaaaatagtttctaa

SEQ ID NO: 87540 - DNA, 216 bp, Glycine max
  Peptide Sequence Number=SeqID_179225
atgggtgcatctttcaaggaaggaaaacgcgcggagtcgccaccaacgtttattcgaggaaaacgtcggaaaaaccgaaaaaggcgtggtctacgaactttaagtgtgaagggttcgggagttgttcttacgcacgggaaagggcgtttcccttgctcctacgtattcctcaattgtgataaggaaatcagacctatgcagttctttgagaactga

SEQ ID NO: 87541 - DNA, 506 bp, Glycine max
  Peptide Sequence Number=SeqID_179226
atggcagaatcatcaaagaagcgaaaaggatcatcctccaccaccgctgttgctgccgatcgccgccacggaccatccgaagcacctacagcaccaatccatccttccttatcatctccaagatcatctactctattttcttcagatgatcaacgtctacgatacctttctcaattttcttctaggatcattctagaccctaagtacctagacatagatttctttaatgatgagacatttgactgttatcaagtgtttcaaaactctggattgattgatttcatgtctttaaaattgccttactatcctgaacttgttaaagtcttttacaacaatttaaaaattcaggatggtattatttcttctgaggtgcatggtatttctatgatgattgatcaatctttgttcttttcattgacaaaattacccagtcaaggtgcaccttctgaggcaccattgttgatgactggaaattcgattatcctagtcatgatgctcgtcgtatg

SEQ ID NO: 87542 - DNA, 336 bp, Glycine max
  Peptide Sequence Number=SeqID_179227
atggcatctaagaaaaggaagactccttctacacctacccaggctagatatgacagatccaagttcacatctcaagaggcttgggagaggaatgtggtagtttattacactaagtttgacgagttcaaggaggaactcgagagaagacactgggatgagaagttgactgattttgctgacagcagcataaacattgctactgtgaaggaattttacgctaacctctatgaccccgaggataaatcacctaagcttgtgagggtgaaaggtcatctagagaaatttgatgacgataccttgaacacatttctgaagacctcagtgattctagaatag

SEQ ID NO: 87543 - DNA, 65 bp, Glycine max
  Peptide Sequence Number=SeqID_179228
atgcttgcgggttaccgtcgggtgtctccgcatgccaccggactcttgggtcacggtaacaaaag

SEQ ID NO: 87544 - DNA, 594 bp, Glycine max
  Peptide Sequence Number=SeqID_179229
atggctgagcgctggccggtgggcatgctgtttgtgcgcaaccatcgcggtatcagccatcatccggcggaatcggtgcaggtggccgatgtggcgctcggcgtgcaggcctatctgcaggcggcgagcaccgcgcaggcgcagacggcgattgcccactgcgtggcgattcccgcctggcagcaggcgctggtggcggcgcggccgttcgccagcctgacggcgctgtacaccacggcgcaacagctggcgctggcgtggcagggcgacgccttgcaacaggcgctgagcgcccatccgcgcatcggcgaaaaagcgcagggcgcgggtaaagaggccgcgctgtcacagcaggaacaggcagcgatgcagcaggctaacggtgcgctgcagctggcgatgctggccggtaatgagcgctatgagcagcgcttcggccgggtgtttctgattcgcgccaaagggcgcagcggtgaacagatgctggcggaattgcagcgcaggctcaacaatgatgaagagaccgagcagcaggaagcgctggcgcagctgcgggaaattaccctgttacggcttaaggagagcattacatga

SEQ ID NO: 87545 - DNA, 726 bp, Glycine max
  Peptide Sequence Number=SeqID_179230
atgtcctcaccttcagaggactacacgtccttaccttcagaggagtacacgttctccccttcagaggattacacatccttgccattagaggactacacgtcctcaccttcagaggactacacgtccttgccttcagaggcccacatgccctctccttcagaggaccacacgtcctcaccttcagaggactacacgtcctcaccttcagagggctgcacgccttcgcctgcagagggctacacgtcctcgacttcagagggatgcacgccctcaccttcagaggactacacatccttgccttcagaggactacacgtcctcgccttcagagggctgcacgccgtcaccatcaaaggactacacattctcgccttcagaggactacacgtcctcgtctttagagggctacatgtcctcaccatcagagggctgcacgccctcaccttcagagggatacacgtcgtcgccttcaaagggcgacacatcctcaacttcagaggattgcacaggaatgcacgccctcgcctttaaaggactgctcgtcctcatcttcatagggctacacgccctcgcctttagagggctgcacgccctcgccttcagagggttgcatgccctcgccttcaaagggcgacacgtcctcaacttcagaggactgcacgttacgtccttgccttcaaagggctgcacgccctcaccttcaaagggatgcacgccctcaccttga

SEQ ID NO: 87546 - DNA, 426 bp, Glycine max
  Peptide Sequence Number=SeqID_179231
atgtcctggacattgtatccgacatcgtggatccagcacaatctgttaacagatttatgtgtccagtattttcgggcaggatgtcctggacattccaatcttttaaactcagtaaagctaagcactaacaaggaagtcatgatattccacgagattagaaggcctaactctctaaaaacagtccctagtggattcgccaactgtcagaacctacccttcggcgggagggcgacgcgtgactcgtgggtgcgtcttccaagaaaggaaaatgcacggagtcgccaccaacgtttattcgaggaaaacgtcggaaaaacaaaaatgtgtggtctacgaactttaatcgtgaaaggtttggggttgtttttatgcacggggaagatattagcaccccacgcgtccgtcacaagggacgacagcctttaa

SEQ ID NO: 87547 - DNA, 501 bp, Glycine max
  Peptide Sequence Number=SeqID_179232
atggccaggcgatcagcgccagcgcgttcagcagctgcaacagcctgtgcatggcgtttatcaggcctggtcgcgcatcagctggtcgacggcgtcaaccacgtcctgtacggtgcgcaccgcgcggaaggcttctggcttgatcttacgcccggtgcgtttttgcagatgcaccaccatgtcaaccgcatcaatactgtcgagttcgagatcttcatacaggcgagcgtccgggcggatctcgtccggatcaatttcgaacagcgtagcttgctgttgttcaacaaaagcggccagcgtggccacggaaaaaaagtgcgcccgcagcgtttcgctctcggcggagagctgcacgccgaagcggtttttcaccgccagtcccagctccagcgcatcgatcgagtcgagccccagcccttcgccaaacagcggtgcatcgctatcgatatcatccggactgatatcttccagattcagcgtgtcgatcatcatgggttttaa

SEQ ID NO: 87548 - DNA, 894 bp, Glycine max
  Peptide Sequence Number=SeqID_179233
atggggtctccgttcggtttgctggcgcagcctgctgctgttgctcagtcagattatgtcgcgcctggcgccagtatcgttataagccagcacgttggcctgcagcgtggccacggtttgcagctgactgctgctctgcgcgctgagcaggccgctgtccgcctgctggctgcgaaacagcgcgctgtactggctgaggcgatccaccacattgggatcgagcagcgacagctgatcgcccagcaggctggagtgatatttttcgcgccacgtctggaaggtgccgagaatggcggagccaatcagcccgccaagattctggctcatgccaaacagcacgacaaaactcaccagatttttcggctgagtcaccacgccgccgatgccaagcagcatcgctggcccaaggaaaaaagcactgctgaaaccgagcagaaactggctgaagtagagattgctggcgcgcgttaccgggctggattgcgcatccatcagcgaggcgacaatcattacggccagcgagaccacgattggccagctcagatggttgggtttgatggtcagcgcgctggcaatcatgccgcagatcacgcccgcaatgatcgccagcgccagcccgcgcatctgatcgttgagcaggcccagctgctgcagaaagcccaccgcaccggtattctgctcggccagcacgatgcgcatcatgatcatcacgatgccgagccgcacgatcatgccattgctcagccagcgggtgttaatcagcgggttagcgcggttatgctccagcaccaccgccgcgacaatcagcaccagcgccagcgccagacagacaccaagccagggtgtgctgaaccaccactcaatgcgcccgagcgacagcacgccgcacaataa

SEQ ID NO: 87549 - DNA, 765 bp, Glycine max
  Peptide Sequence Number=SeqID_179234
atggtaaccattcgtgcagatgaaattagtaaaattatccgtgaacgcattgagcaatataatacggaagtaaaaattgtaaatacgggtaccgtacttcaagtaggcgacggtattgctcgtatttatggtcttgatgaagtaatggcgggtgaattagtggaatttgaagagggtactataggcattgctttgaatttggaatccaaaaatgttggtgttgtattaatgggtgatggtttgatgatacaagagggaagttcagtaaaagcaacaggaagaattgctcagatacctgtaagtgaggcttatttgggtcgtgttataaatgccctggctaaaccaattgatggtcgaggagaaatttcagcttcggaatctcgattaatcgaatctcctgctcccggtattatttcgagacgttccgtatatgagcctctccaaacaggacttattgctattgattcgatgatccccataggacgtggccaacgagaattaattattggagacagacaaacggctattggtcaaaaagcatcttctgtggctcaagtggtgaataccttacaagaaagaggagcaatggaatacactattgtagtagctgaaacagcggattctccagctacattacaatacctcgccccttatacaggagcagctctggctgaatattctatgtaccgtgaacgtcacactttaatcatttatgacgatctctccaaacaagcacaggcttatcgccaaatgtctcttctatga

SEQ ID NO: 87550 - DNA, 351 bp, Glycine max
  Peptide Sequence Number=SeqID_179235
atgacagaaaccgtttgtacggataaccgcttgggtatctccgcacgccacctgacttcacgggtcaggatgatagaaaccgtttgtacggataaccgcttgggtatctccgtacgttacctgacttcacgggtcaggatgacagaaaccgtttgcacagataaccgcttgggtatctccgtacgtcacctgacttcacgggtcaggatgacagaaaatgcggaagacgacgtcacgattgcagaaggtggggtggtcgacaaaagcgaggcttttgctcctacgtatccttcatttgtggtgaggaactcagacctacatagttctttcttttgtgatgttcgagactaa

SEQ ID NO: 87551 - DNA, 438 bp, Glycine max
  Peptide Sequence Number=SeqID_179236
atggctctgacaaagctttccgcgaagagatctaggagggacgccgcgactgaagggaccagtgccgcccccgagtttgatagccaccgtttcaggaatgccaagcaccagcagcgctttgatgccatcaaaggatggtcgttccaccgagagagacgcgtccagctcagggacgatgagtacaccgattttcaagaacaaatagctcgccgacattggacatcgctggtcactcccatggctaagtttgatccaaatatagtcctggagatttatgctaatgcttggcccacagaggggggagtgcgggacatgcggtcatggttgaggggatttcgctcggaccactgcagggaggcgggtgcggatcatgcgcaccagcatgaccaccttgacccagatgtggatgacattgctgctcagcaatgtcttgcctag

SEQ ID NO: 87552 - DNA, 805 bp, Glycine max
  Peptide Sequence Number=SeqID_179237
tacactcgccttcagaggactactgccctcaccatcaaaggactacacgtcctcgccatcaaagagggctgcacgcccttgccttcagaggactacacgtcctcgcctcagagggctacacgccctagcctatcagaggactattcgtcctctccttcagagggctacccgcactctcgccttcagaactgacacgtcctcaccttcagagagacaacacgccctcgccttcagaggactacacgtcctcaccattagaaggctgcacgccctcgcctttaaaggactacacgtcctcaacttcagagggctacccgccctcgccttcagaggagctacatgtcctcgccttcagaggactacgccctccatcagagggctactcgtccccaccttgagagggctacacgccctcgccttcagaagactacgtcctcaccttcagaggactacacgtcctcgccttcagaggactacacatcctaaccttcacagggttacgcgccctgacctttggaggactacaagtcctcggcttcagagggctgcacgccctaaccttcagaaggctacaggccctcaccttcagagggctacatgccctcaccttcagaggactacacgtcctcgccttcagagggctacacgcccttgccttcagaggactacaagtcctcgccttcagagggctacatgccctagccttcagaggattaaacatcctcaccttcagagggcagcacactctcgccttcagtggcctacacgtcctcaccttgagagagctaaatgccctcgcctttag

SEQ ID NO: 87553 - DNA, 348 bp, Glycine max
  Peptide Sequence Number=SeqID_179238
atggccgcgttgctggcgttttccataggctccgcccccctgacgagcatcacaaaaatcgacgctcaagtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 87554 - DNA, 384 bp, Glycine max
  Peptide Sequence Number=SeqID_179239
attcaaaggactaaccgcctgagaattctttgtcttaacacattggagggtacatccattgtggtacaagtaaagggtacatctacttgggttgttgtaactgagaacaagagagggtacatctcttgtggatcagttcaagtggaggatacatccacttggttgttcaacgagaacaagggagggtacatcccttgtggatctttgcttgtaaaggtttttacaaggttgaaagaaatctcaagaaccagtggttgcatggggactggatgtaggcacgggttgttaccgaaccagtataaaattcttgtgtttgtcttcttcttccctacactctttaatttcctttgtgcacttttaattatcgcttttacttttggttaa

SEQ ID NO: 87555 - DNA, 1842 bp, Glycine max
  Peptide Sequence Number=SeqID_179240
atggtggaatggcgtggcaaattttttgccaaccgccgtaggcaatctgtgaagggaggcctgctatggcagcgtcgtaggccgcaatggcttgtttatatggcagaattttggccttccaccatggcccctgtcactgttggacagttgcacctgtcactgttagacagccaaagtcagaaatttctgcagttcctttctaacaaagatcatgatctagggttagagaaccctgcatatcgagcctgggaacttctagatcaaccgaactcctcaacgtcagaaaagaatattgaacgatttctgcttcttcgaatcaatgccattgccgctggcttgaaatccattgcatatgagacgggcttagccttggccatgttggttttggctaagagatctctgatgtatttgcctgacctggactacttcagtgttctctctaagcctctgtttggaagggaggaatttgcgccgaaattggagttaggtttagggttgttaacaaagggggaaattacacaaacacctttggaagttgaagcaacattattctcaggctgcaagggagttcctgtgtttcctgctagtgtcaaaacagcagtgaaggagttgaagagttcagggttttcgaagcaccaagataagccatcggcaatgcaacgtgatgaagattgctcatgggatgaacggaactcagcattaaggggttctcctttctcgcaaagagagtttagaggacaccatggtagccctgaattgcattattctgataaatccaagctgagtgataaaaatccagaacccagtgaggttctttggattgggttcccagctcagttgaaggtggacgaatctattttaagaaaggctttttctccatttggtgagatagtgaagattactacatttccaggtcgtagttatgcctttgttcgctttaggagcctgacatctgcctgcagagcaagagacgatctgaaggggaagttatttgggaatccccgggtgcatatttgttttgccaagagtgaaacaggttcatcaaacagtgagaggagatcatttaatggccctcgttccccaatttacaagtcaagtgggcgtgatggatcttctgagaacctcagacaggatcggagcttcaatgcagatcgcaacattggttctccaaaccatttcgggatttgggattctgatccttatgatcaaaggggttcttcatggactggcggaactaacacatttgaacaaaggaaagtcggagagaaggggagaacactaggagtatcacaagaaatctatgaacatatgaatagtccatcaagagaaagacatcatgtgggtaatgttccacagagattttctcaaaagggtgaattctttgaagatccgcgggccttgccagatttttcctatctacatgaggctaaaaggatgaaggctggttctccacctcttgaaagagagattccagagtatcctttcactgagtatgaaaggcagagacgtgttttcccgagattatcggatttacccccacacgagccttttgataaaggctttgatgctggaaattttacttatgaccagactcttgatcatccaccaaattcacctttgcctcgtttagatagacatgaaggctggaaaccttatgatagtttccaaatgggtcctagcgctctgcagtcaacatatgttgagaagaaaggattcacgcctgaacaagatagttcatctttaactgagtggaaatgggaaggaaccattgctaaaggtggaacccctgtttgtcgtgcacgctgcttccctgtggggaaagtcctagatatgatgttgtaa

SEQ ID NO: 87556 - DNA, 204 bp, Glycine max
  Peptide Sequence Number=SeqID_179241
atggatgtgcacataataacaagggggacccctaaagttgtagctcgcccaagcgagctaaaacttaacccaaaagcaatgagcttgcccagacgagttggtttcatcaccatgaagctatttgggggcccaagtgagccagaggctagcctagatttagtagaatctcttgtgatagaaccttcttcttccatgaatcattaa

SEQ ID NO: 87557 - DNA, 1497 bp, Glycine max
  Peptide Sequence Number=SeqID_179242
atggtaccatacaatccatacttattgttgaaatatcaagcttacctcaacatagaatggtgcaatcaatcaatgtccatcaacttgctggagaatattttcattccggattcacaaagatcacctgctgttgaaaggttctactttcattttcctggtgaaaattcagtaatatttgaagatcgtgatgacattaatgctttgttatccaagccaaccgttaaagagtccatatttacctcttggctgcaagctaacagcattttccaacaagcaaaaggtcttacatatctacaattcataacaaaatttacatacgtcgccaaaaaagatgttggaagccacgtaaatgaggctatacaattggaaggcttaactccaagtactggagaattgtattatcttaggatgatgttggttgtggttaaaggaccaaccacttatgaacaaattcgtacagtcaaaggtcgattgtattctacatttagagaagcttgctttgagaaggataagaaacatactagatatatatatgctgagcagaattatgacaaggctcaattacaaaatgatttcgaaacatactttgcttctctaacaggtactgggaagacctttatatggaagacattagcatttgcattctattcaaaaggtgatattgtgttaattgtttcctcaagtggcatagcctcattgttattaccaaatggcagaactacatattcgaaatttgctattcatatgcctacattagaaaactcaacctataatatccaccaagataaaacattgaatgacatcatgtgtatgtctaattccgacaatgttccatttggtggaaaggttgttgtatttggaggctatttcaggaaaattcttcatgtcatacctaaaggaagtagatcatacatagtgcatgctactataaatgcctcatatcttccaacctacctcacattgacaaatgcacaagaaatcaagagcttttcccaatggctgataaatgttggagatgagaaactaggcaaaggtgatgatgaacgttatgagatagaattttcacctaatattttaataacaaacttcattgatcctattgaagcaattgtaaggcgtatctacccaaatatccagaagaagtataaagatgaggaatttctcaaatctagagctgcaacaaatgaggtggtataccaaattaatgactatatattaaacatcatcccaggtgaagagaaagaatatttcagttgtgactcaattgacatgacagatgttgcaacaactgaatgttatgaagcagttgtcgcaacctgcccttcggcgggagggcgacgcgagactcgcgggaggcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 87558 - DNA, 433 bp, Glycine max
  Peptide Sequence Number=SeqID_179243
atggccaccattgtcacattagtcctcgcactagcatgttgtggcatgtctgccccgacctcagtgccgaaaaccactgcagcggccccggccccggagagcaatggctgcttgatggcactagcaaacatgtcagattgtctgacctatgttgaggatgggagtaagttgtcaaagcccgacaaagggtgctgccctgagttggcagggttggttgatagcaaccccatttgcttgtgtgagatgctaggcaaacctgactctattggcatcaaaattgatttgaacaaagccctcaagcttccttctgtttgtggagtgaccactccccctgttagcacctgttccggtattgcaccgggagccttcagtccttcaaatgcagatgctgcgaatcctgcttcaagtcctaactctgcttctagtcctgcag

SEQ ID NO: 87559 - DNA, 423 bp, Glycine max
  Peptide Sequence Number=SeqID_179244
atgaagcaacaaaggctacctccattcctccaaccaccttcacaaccaccaaccactattgtgcaacctcatcatgaggttcttgcacctatggttcttgcatcaaaggctacaataactattggtcttatgcatgcgcctttgcccttaccaccaaagccactatcttgttttattgttaaagttgtctctagaatatttccattgaatttaatgatgaaatatgtgcaatttcagtgggctaagcgcgcatccactgctaagcgcaacttcagcatgcttagtgcgacagaagaatttggcagagcattaatatcaaggtcgcgcgctaagtgcgagatcaatgcgctaagtgcagcagttgtcttctgccaggctcagcgcatgactagcgctatgctcaaatccacttatgcgcactaa

SEQ ID NO: 87560 - DNA, 376 bp, Glycine max
  Peptide Sequence Number=SeqID_179245
atgactagaggcaatccaggtgacttacaaccctttgatcatgaaatagatagaacatttcatagattagttaggcagagtgtgcatcttgattaccctgaacattttgtgccttttgagcatcctgagcattctgttactggtgagtctgagcattctgttattggtaattttgaacatcctgattttgaacattctgattttgagcattctgaaaatatggctcaacctccaccctgtgagaggactctaagggaaatggctgcacctgatttcacttatgaaagcttgtgcattcaataccctgatgaggatgtcccatatgttcttaaaactggactgatccccttattgcccaagtttcatggtcttgcag

SEQ ID NO: 87561 - DNA, 222 bp, Glycine max
  Peptide Sequence Number=SeqID_179246
atggagagcacaagtgtacaagatgtggcggtagtggtcacaataaccgatcttgcacttctgcttaaaggaatgatggacaacatacaaaagtcgatgatcctgaaccaaatgctgaaatgtctattgcaacctacccttcggcgggagggcgacgtgaggctcacgagtgtgtcttccaagaaaggaaaatgcacggagtcgccaccgacgtttatttga

SEQ ID NO: 87562 - DNA, 926 bp, Glycine max
  Peptide Sequence Number=SeqID_179247
atgctgaatttatacgacagcaacggccgtattcccctggaaaaggaccaacaggcggtcgaagcatttatccataatcacgtgcgtcccaacagcgtaccgttcgccgggctggaggagaaactgcaatggctgagcgacgaaggttattacgatccggcagtgctggcccgctatgagcgacgtttcgtactggccctcttcgcccacgcgcatcaacacggttttcgcttccgtactttcctcggcgcgtggaagttctacaccagctatgccttacgtactttcgacggcaaacgctacctggagcatttcgccgaccgcgcctgcatggtggcgctaaccctggcccagggtgatgaaaccctggcgcgacagctggccgatgagatcctcgccgggcgctttcagccagcgacgccgaccttcctcaacgccggtaaacagcagcgcggcgagctggtctcctgcttcctgctgcgtatcgaagataatatggagtcgatcggtcgggcggtgaactccgccctgcagctgtcaaaacgcggcggcggcgtggcgttcctgctctccaacctgcgcgaagcgggcgcgccgattaaacgtatcgaaaaccaatcctccggggtggtgccggtgatgaaaatgctggaagacgccttctcatacgccaaccagctgggagcgcgtcagggagccggcgcggtttacctgcatgctcatcaccccgatattttgcgtttcctcgataccaagcgggaaaacgcggatgagaagatccgcatcaaaaccctgtcgctgggggtagtcattccggatatcaccttccagctggcgaaagaagacgcgcagatggcgctgttctcgccctatgacgttgagcgactgtacggcaaagcctttggcgatatcgccgtcagcgagat

SEQ ID NO: 87563 - DNA, 794 bp, Glycine max
  Peptide Sequence Number=SeqID_179248
gacggggaggagtatacagcatacaccagatacctcagcactcaccccgatcctgacaccatcgcagccacactgtgcactccaggggggcgctttgtccttaatgctgatggtctcccctggaagctcctgaggaaggacatgacgacacttgctcagacatggagtgtcctttcttattacgatcttgcgcccacttctcacacttctgatgttaatcttgacagggcccgcttgatctacggtttggtgagccgcatggacatggacgtggacagctttatatcacagcagatcagccagattgcccagtccagtacctcgaggctcgggttcccggcgttgattacagcgctgtgtgacattcagggggtggtttctgataccctgatctttgagtcactcagccctgcgatcaacctagcctatgtgaagaagaactgctggaaccccgccgacccatcgatcactttccctgggcctcgccgcacacgtaccagagcttcagcatcagcatccgaggcccctctccctacccagtctccgtctcagccatcccagcgaccgcgacatccacctgcttccacctcagcatctatggacatgcatgggcagatgctgaggtcccttcacgttggacagcagctcatcatggagaatatgcacaggctgggggaagcgccttctggagccgccgaggatcctgcagtcgatgaggacctcattgctgacttagccactgctgactggggcccatgggcagacttgggcggaggcagtattaaaaagaagta

SEQ ID NO: 87564 - DNA, 494 bp, Glycine max
  Peptide Sequence Number=SeqID_179249
gtattcgccttactgtaaaggaaacaatccatttatgcttgactgagattgagaatatgttacaagccaacagaaggagcttgcgagattttccatccatgccatacccaataggatatgcacgcaaccaacaacataataatctgatccataatgaaatggcatatgacaaagaaatgctagcagaacaatacaacacatcataccaattgctcacagatgagcaaaaaactattgtcgataccattatgcgtgtagttaacactcaattagctgcagtttactttctctatggatatggtggaactggcaaaaaatttgtttggacaaccttatcatctgctatacgctccaatggtggaattgtttatacagttgcttcgagtggaattgtttcattactcttgcctggtggtcggactgcacattccaaaatttgctataccagtccctgcaacacaaaatataacatgcaatattcatcaaggcagtga

SEQ ID NO: 87565 - DNA, 732 bp, Glycine max
  Peptide Sequence Number=SeqID_179250
atggatttcttttctgatgagagtttcgaatgcattcaagcatttcaaaactcaaatctcattccctttatgtctttaaaactgcctgtgtattctgaattggtaaaagctttttattctaaccttgaaattcaagaaagtaccttgatttctgaggtctatgggataaagatggtcattgaccaatccctcttctatgatttgacccaattgtctagcaaaggtgtgccatttgaaggaacactggatgatgattggatatttgatttttctgtgcatgatgcctgccggttggtttgcaccaacaaagcggatatgaccggaaggctgcttgccggttcattggctcttgaaagccaaatccttcattatctaattgttcatatcctactccctagatcttcaaaccttgcacagatatttcttgatcggtgttgctatggttgcctcctttgcttacgcaaaaagcgtgatggctcttgggtaaaaaagggtgctcaaccaaatgataataaaggacacttaccggttgaaggggactattctctccttcagagtattttggacaggtttgatggacttcaaacctatgttggtgagaggtttgactccttggaacgtcaagtggacacacgatttaaggagataaactcaaggactgcaaaggttgaagaagatgttaccattattcgcgactactttgatttacctccaccaccaccatcagtttag

SEQ ID NO: 87566 - DNA, 183 bp, Glycine max
  misc_feature (14)..(14): n is a, c, g, or t
  Peptide Sequence Number=SeqID_179251
atggcaaaggggtncggaatgaccaaattttgtctccgtatgtcatcgggcccgccgcctctggatgacaaaagggctaccagctcttgggacatggcaacagaaagcggtgtggtcgacaaaagcgaggcttttgctcctacgtatcctccaatgaggaactcagacctacgtagttcttga

SEQ ID NO: 87567 - DNA, 156 bp, Glycine max
  Peptide Sequence Number=SeqID_179252
atggaccctaagagaataaaggtcattcttgagtggcctactccaccaagtgtggaggaaaaaatccatgagtttcaagaacctctggatttgaggtcaaatccttttcaagggggagggaatgatgcaatgctaccccccaagggcattggatag

SEQ ID NO: 87568 - DNA, 462 bp, Glycine max
  Peptide Sequence Number=SeqID_179253
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctcaaaccaagaaagacggaatgatgaggacatag

SEQ ID NO: 87569 - DNA, 498 bp, Glycine max
  Peptide Sequence Number=SeqID_179254
atgcctatctccatctgtggaagtgccagttgggatcgcgcccataagacacccaatggacccggagaagtccaacagggccctggggtttccagctctggttatgagtctctgtcagtcttaccgggtgcccgtccccccagcaaggtcatgccatcatgcatagggatcgcgcccgcaagacacccagtggacccgaagaagtcaaatagggtcctggggtttccagctttgattacgggcctctgtcagttctatggagtgcccatcgcccccagcaaagtcatcaggccccctactaaccgagcttccatcaagaagtattgcgcatccaggcagccgcagggcaagacaccacaacagcctggggatggccggcagcaggcaatagacgcaccaccgccacctctagagccccttagctcatctacaaaggctggagctttgcctacgacccatggccgaccagcaggcgaccaagtccaaagccaaaggtaa

SEQ ID NO: 87570 - DNA, 198 bp, Glycine max
  Peptide Sequence Number=SeqID_179255
atggataagagcttaaaggtaggagaagatgagtggagggagagggagagaaggagcacgaaattttgtacctcaaatgagcccaccaatccaagatcaaatcaaagattcacactaagtgtgcttaggtgccctaaaatacaagtgctgaaaaatcctacattacaagggtaccctccctacactatggagccctaa

SEQ ID NO: 87571 - DNA, 909 bp, Glycine max
  Peptide Sequence Number=SeqID_179256
atgcccggccagcctttgttccgtcaattccttcgcctgctggcgatgatcgccctgctgtcggcgagcgccgcggcattggccgatgatcgccagtacaccgccgtcgcgccggatggcgtgacgcttgccatccaggagtccggcgatccggccggccccgccatcgtcttcatccacggcctgctgggcagccgcctcagctgggaggcgcagttgtccagccccctgttgcagcgctatcgcctgatcgcctacgacctgcgcggccacggccagtcgggcaaaccgaccgcgccgcaggcctacaccgatggtcggcgctgggccgatgacctggcggccgtgattgccgcgtcgggcgcgcgccagccggtgctggtgggctggtcgctgggcgccgccgtgacgaccaactacctggccgcgtacggcgacggcgatgtcgccggcgcggtctacgtgggcggcgtgatcgaactggacgccagccagatcgcgccgcatcccgaggtgtatcgcggcatggcgtcgaccgacctgaagacgcacctggacgccgaacgcgccttcctggcgctgtgtttcgagacgcagccggacacggccacgttcgagcggctgctggccaacgccgccctggcgtcgcccgggatgcaggccgcggtgccgcggatgacgatcgcggcccgccagggcctgggcgcgatgcgcaagccgctatggctgatctatggcgcgcgcgatgcgctggtgcgcgccgagccgtcgctggaacgcgccaggcagttgaatccgcgcgtgcgcggctcggtatatgcggcgtcgggacacgcgccgttcgtggaagaggccgagcggttcaaccgcgatctggcggccttcgtcgacgcggcggcggggcgctga

SEQ ID NO: 87572 - DNA, 210 bp, Glycine max
  Peptide Sequence Number=SeqID_179257
atgaagatgctcttgataccacatgatgtaagctccattggagcttgtaggcctaagatgatcttggaagatgaatggcagtggtgtgtgatgcaatcctaccccgcaagggcattggatagaagactccaagtagattgggccagagatccaagggaaggccctagggttcttatgagccttagggtagattttgagctcatgggctaa

SEQ ID NO: 87573 - DNA, 360 bp, Glycine max
  Peptide Sequence Number=SeqID_179258
atggaaagaaaaactagaagaaaagaaaaaggaagagagagggtggaaataagtgaagatgagagggagcttataaggaaagaagaaagaaggaaaatactacaagagttaagaaaagaaaaacatgtctcctatagtagtcatgactcctgtaagagcctaagtgaagaatttagtgactattatggaggaaggcataggtcctcacatcctagacctcacttccataggagagaaaaggaaaggaagcctaaagaggctaacattaacctcctatacttccatgggaaggacaatgtagaggcttatttaggttgggaaatgaaggttgagcaactctttgctaagcctcaaagatga

SEQ ID NO: 87574 - DNA, 315 bp, Glycine max
  Peptide Sequence Number=SeqID_179259
atgacggagaaagagatgatcacaatattagtagacacattaccagtgttttactatgaaaaaaatggaaaatttgatcatcctgcttggacgaatgagaaaactggggcaaatgaagaggatgaggatgaggaaggaacccatgttgaggctgttattcctacatggccaaactttccaccagcccaacaatgtcattactcagccaatatcagctcttctcattacccaccacccaatcatccacaaaagtcatccctaaaatcaaccacgaagcctatctgccgcacttccaataacgaacaccacctttag

SEQ ID NO: 87575 - DNA, 439 bp, Glycine max
  Peptide Sequence Number=SeqID_179260
gattgatggggacccggtgttgagagaaacgaggatatgggctacgtgggcgtacgtgagctcagttggaggtgggcagcaggggatggtgggtttatgcgcgatttgtggatgtggaaaactgttgtgcaccatcgcccgaccgccacctagtaccacatgtgatggagtggtacctggagatatgtcgcgggggtcaggagaccttggggacgtcagctgtgaatcttgtgtgatatatgggatatggcctctggtaatcgattaccaagggcttgaaaacgaggttgtggaggcctctggtaatcgattaccagtctgtgtaatcgattacacagaggaatgggtcactggtaatcgattaccagggatgaaaagccttgagttaccccttttacttgcatgtagtgggtatgagacgaattgtgttgcggcatag

SEQ ID NO: 87576 - DNA, 989 bp, Glycine max
  Peptide Sequence Number=SeqID_179261
atgcttcaagaaaaaggaaaagcacaacttctaggccccaacctgactatgatacaaagaggtttacctcagaagaagcctggaacagatacgccgacaacgtcctcggctggaacatccttccgaagaggaatgtcaaagtctatatcatggagtttgacgagtttaaaagggagttggagaggcgcaacctgcacaaccgtctcaccaacttagctgatagcagtattgatgttgcggtggtcaaagagttctacgaaaacctctatgaccctgaagataactcaccaaagcaggtgagagtgagagggcacttgataaagttcgatgtggacaccctcaacacatttctagagaccccagtggtattggaacgtagggagaccatccccacatattctagattttgcagactgaggatggatcctcaagagatagcgactcgcctctgtattccagggactcgcaaggctagggctagagcagctgagatcctttcctcatccactcctcaggaccctcctgttcccacttctgctccaccaccagctccaactcatcaaggaccttccacagaccttatcatggcgatgctcaagagcttataccagggacggtacctgttgatgcaaaattttcaaaacttagctcagcatcattcgttcatatccttggaggagttcactcggcaggtggcctgtccaggagcccaaccttctcctattggagggtcagagaccgtaccaccagagccattcatctatgaggcagatccaggcaccacattggaggagactcaagaggttgctacaccagagattaccccacagcaagcagtagaaccttccacaccagttctggatttgtcttcaccacaaccatcccaaaagccatctacacctgtcctgggcttgtcatcccccactacttcaccagcaggcaccctagtgcttcacctcacagatgaagaggaggatatcatggactag

SEQ ID NO: 87577 - DNA, 707 bp, Glycine max
  Peptide Sequence Number=SeqID_179262
ggcattccgcaggattcgcgcatcgccagcggcagcaaattcctcaacgaaaaccagctgacgccagagaagatggcaaaggtgcagcaactgcaggcgctggcacagcagcgcggtcaaaagctggcgcaaatggcgctgcgctgggtgctgcgcgacacgcgcgtcacgtcggtgctgattggtgccagtaaaaccgcgcagattgatgatgccgtcgacatgctgagccagcctgaattaacggcggacgagatcgccgccattgagcaaattctgactaaatctcaaggcgtgtctggtccgatatggcacactagcgccacgctgaagccagtagcgctaccatcaatctggcccctggcgtcacgctgcatctcggcgatcgcgatcgtcgcggctactactgggacggcggtcgctggcgtgaaccgcgctggtggcacgatcgctatcagtacaacgatcatcgctggtggcgtcacgaagagtggaaacgccatcgagcctgggagcgtgaacgtgagcgccgctggcacgagcgcgaacgtcgcgaacactggcgtcacgatcaccgacacgatcggcatgaccgccacgaccatcatcaccattaaaaaaatcccggcgcagacgcagccgggatttttttattcagtcatttgcttaccagccgagcgcttcgcccaccagcagatagatattca

SEQ ID NO: 87578 - DNA, 270 bp, Glycine max
  Peptide Sequence Number=SeqID_179263
atgtggggacaagttcaagttttgggtggacagctggatgggaggggaggttccactgattacaaggtggaggaggccattattcataatgaaatagacatggcggcagcatttctaagagagattaaagatcacagaattcagcctcagcatcacgatcaatgggtgtggaaggcggatccaagcgggcagtacacagctaaatcttcatatgatgtactacggggggaggcgattcatgagcagcaggacggagcttttgaggagtag

SEQ ID NO: 87579 - DNA, 105 bp, Glycine max
  Peptide Sequence Number=SeqID_179264
atggagaggaggttgccgcccagcttgcccagattgcgcaacaatgcttgttttgactttcagaatgttgcgatgctttacggattacacaacaatgggtgttaa

SEQ ID NO: 87580 - DNA, 78 bp, Glycine max
  Peptide Sequence Number=SeqID_179265
atggcgatgaacgcactaagcgtgtcttgctgcgctaaatttccagatgaactcgctaagccggccctgtcctgctaa

SEQ ID NO: 87581 - DNA, 516 bp, Glycine max
  Peptide Sequence Number=SeqID_179266
atggttattaaacagcagcaacaaagcataacctcgttgaacatacacatgcagtgcgcaggaggagcttgtggagtgcggcgtcagcaaggagcatctctaacaaggatcttgcaaggaaatcttaatgatagggatagtagtgcaggaagtaaagggtctgcaagaagcaagaattataaggcccaaacgggaaggcaacaacctcagcccaatatagttggctgtgacccatgcattcatgcatcacaaagctttctttctcccttttcctctggaggcactggcaccctcgaaaccagcttatcttctccttcttcctccttgtttctggaggtgttgacccttgaagttcagcaacaagcgcaacacatagactttttttttccaagacaaaagagaaagaataccattaatcagaaaagagataatcacacgaaaaaagataataacaagaggcccaagttacaagtggagaagcttcggattgtcaattacaccatgtttcacgaatag

SEQ ID NO: 87582 - DNA, 234 bp, Glycine max
  Peptide Sequence Number=SeqID_179267
atgggtgatggggttagggcttctaggtggaaatgttggtgggtgacagtgacttggactatttggcagcaaagaaataagatgatattctccaatgaatcatttcacagcaacaaattgattgatgaggcagctttcctgttgtggacatggctgaggcatttggagaaggatttctcaatacattttaaccaatggtctagtaaccttagagcaaggattttgtatcagtaa

SEQ ID NO: 87583 - DNA, 479 bp, Glycine max
  Peptide Sequence Number=SeqID_179268
atggctgatatggactcaggagagcccgacgagacggtcggaagcaaacgcgctcgtttccgacaaggggagggcggcgcgtggtggtcacgcgccggcgtttggcgcgcacggagatggcgcgtggggaagctcctggcccagcggttagttgggctgggttgcgctcctcgaggcgcacagaaccctgtagtcaccaaatcatcgtctgattctgaggccatttctgcccaagtgtttttggccaattttggtactctggtgaggcctatatcttctaaggccaggagagtttatattgaccaggcatattcagccacggttgatgacccagtctgggtaggtgacccagaagatgatgtagttacctttttggttattggctctggtagagccagtagaacatcttttccttttgtactggatcttcctcctctgccggaggagctagacaccttaggaggcatcgggaattttct

SEQ ID NO: 87584 - DNA, 276 bp, Glycine max
  Peptide Sequence Number=SeqID_179269
atggggctgaaggaattactgcaggcattcttagacttcagatgctctgttgttgagagacgtgcaaggtttaagttatcacaagcacaagagagaagacatattgttgaggttttgatagtacaattcggagctggttcacaaacaggcactgtgattacgaaacctgaaagagaccccaaaaagataatagtacaggaatgtagcctagattcctatacatcgtcgtcagcatccaccaaatcaccaacaccagagactatctgtttaatgtga

SEQ ID NO: 87585 - DNA, 711 bp, Glycine max
  Peptide Sequence Number=SeqID_179270
atgggctacgcgggagtacgtgagctcagttggaggtgggcaacagtggatggtgggtttatgcgcgctttgtggatgtggaaaacttgttgtgcaccatcgcccgaccgccacctagtaccacatgtgatggtggtacctggagatatgtcgcgggggtcaggagaccttggggacgtcaggcgagctcctggcagtcaacagataaaaggaacaaagaccacaaagcaaggaggcttgtggtggctggccagctatgaattttgtgtgatatatgggttgtggcctctggtaatcgattaccaagggcttgaaaacgaggttgtggaggcctctggtaatagattaccagtctgtgtaatcaattacacagaggaatggggcactggtaatcgattaccaatcgtgatggcggcacagctaatccatgatcgagtggagatggagtgcctagagggagcttgggggaccctcgaaggcaacacgaggtgccgatttcggggcaccattcgattcacggctacttctttggtgcatccagatgaacctgcacggacgcttcagcgcacggtggagtggatactacccacgcctacaccatatcgtctagtggcccgggggagatggcgatcagcgtcggcatctgaggcagactctacggaggatagtggcccgggggagatggtttacccttttgttttgtatgggtag

SEQ ID NO: 87586 - DNA, 1122 bp, Glycine max
  Peptide Sequence Number=SeqID_179271
atgagagagggagagacagagcgagacagtgagagagacagcgggtgggaaagagtgaggtcgagaagggagagaagagagaatgagaggacgagaggtatgaagggtccgtgtctgtctatcgtcagggaaaggaaaggaggtcaacaacgccgcatgcgagtcaactggagagatcatcggaatatatcatcgttttacttcacacgttttcctgaagacgcaacagaggatgagctatggaagatattcagaagagcgggtgatgtcagggaggtgtttatctccaacaagaggaataggaacggaagaaggtatggatttgtgagattcattggagtggataacgtccaacagttggaaaggagattggataacatagttctggggggattaaagttatatgttaacatccctaaatatgaaagaggtaggggtcgagtgcaaccacaatcaacagggggacgagaccataccagacatgtcgaacaggggcgcagagaaacttaccaggcacagaagcacacagcgatgccgggccagatacgcggatcctttgcagatgtggtagctaggagagaaccacgtatacagcaaaggaggacatcaatagttcagaatgctaaaaccaacacttcgagatcaaaagtacatcttgacagtcctatgacagcaccgaagtggctacaggatgcatgggtgggaatgctaaaaaatcttgcactccttgacagagtagaggagaatatgctctgggactggggattagacgtagtgccgaaatacatcggcgacaacatggtacttctccccagccttaccgaagacaaggcaaaacaaatggtggaggatgggactgcaggaagggaggtgatgttttatttggtggaaaggtggaacaggaagatgcgtgctggttctagacttacatgggtgcaatgttggggagtgccgttggtagcatgggactcaacacacataagggagatcgtgacggccataggcgaggtagtggaagtagacgaggagatggaggatttgaggaagatggacagggcaaggctccttaggaaagtggaagcagtcccaattggtgccatgccggcggagcgcgatgcttag

SEQ ID NO: 87587 - DNA, 621 bp, Glycine max
  Peptide Sequence Number=SeqID_179272
atgacaagcagagaccaagtttggtcattctgcacccatgatacgcggagataccttacggttatccgcacccctttgccattcagacacagtcgtgtccgatggcacgcagaaccaagtttggtcattctgcaccctgggatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatga

SEQ ID NO: 87588 - DNA, 435 bp, Glycine max
  Peptide Sequence Number=SeqID_179273
atggctccgagaaagctttccgcaaagagatctaggaaggacgccgcgactgaagggactagtgccgctcccgagttcgacagccatcgtttcaggagcgctgagcaccagcagcgtttcgaggccataaagggatggtcattccaccgagagagacgcgtccaactcagggacgatgagtacacagacttccaggaagagatagctcgccggcgttggacgtcgttggtcactcccatggccaagtttgacccagatgtagtcctagagttttatgccaatgcttggcccacggaggagggcgtgcgggacatacgatcatgggaaaggggccagtggattccttttgatgcagatgccctcggccagttcctgggagacccgctagtgttagaggagggccaggagtgcgagtatagtcagagaaggaactga

SEQ ID NO: 87589 - DNA, 513 bp, Glycine max
  Peptide Sequence Number=SeqID_179274
atggccgaaataggtgtagttgcccaacaggcccagcgacaccacgccaccgacgatcaccgcagtcaacagggtgcccgagaagcgatgctcgaaacgaccgctgagctcctcgatggcgaagacgatgccggccagcggcgtgttgaacgccgccgcgatacccgccgcaccaccggccagcaggaagtgcgagagctcgcggggatccttgaaaccgaaccagcggccgaacagatacatcaggcttgcgcctacgtgcacggtgggcccctcgcgcccgaccgatgcgccccccagcagcgacagcgaggtcagcagcagcttgccggccgaaaccgctggggaaaggttggttttccggaacggctcatcggccttgtccagcgcagcgatgacctgcggaatgccgctgccccgcgtgggcttcagcacgccggaagtgagccacgcccagcagcgcgaagatgcccggcgtcagcagcagggcccaccacggcgagtgcgacgtga

SEQ ID NO: 87590 - DNA, 1594 bp, Glycine max
  Peptide Sequence Number=SeqID_179275
atgcaggatcgagctgccgccggccgcgaccgtgtggatgctcatcatcggtgcgcgcatgcgcacgccggccaccagggtctcgaattcgcgttcgaattcgccggcgtagtgcgacacgtcggtggaggtgccgcccatgtcgaagccgatgatcttgtcaaaacccgcttgttcgctggtgcgcaccatgccgacgatgccgccggccgggccggacaggatggcatccttgccgcggaagcggtgcgcgtcggtcaggccgccgctcgattgcatgaacatcaggcggatgccaggcagctcgctggccacctggtcgacgtagcgcttgaggatgggcgacaggtaggcatcgaccaccgtggtatcgccgcgcgagacgtacttgatcagcgggctgacctcgtgcgaagccgatacctgggtgaaaccgatctcgcgcgcgatgcgggcggcgcgctgctcgtggccggtggcgtgccaggcgtgcatgaagacgatggcgacggtgcggatgccgctgtcgtacgccgcctgcatgtcgcggcgcagcgccgcttcgtccaggtcgcggatcacttcgccatcggcggcgacgcgctcgtcggcctcgaccacggcctcgtagagcatttccggcagcagcacgttgcggtcgaacaggcgcgggcggttctggtaggcgatgcgcaggccgtcgcggaacccgcgggtggtgaccagcagcgtgcgttcgcccttgcgttcgagcagcgcgttggtggcgaccgtggtgcccatcttgacgcattcgacctgctcggccggcaccggctggccgggcgcgatgcccagcagcttgcggatgcccgccaccgccgcgtcgcggtactgctcggggttctccgacagcatcttcgcggtggtggtggtgccgtcggggcggcgcgccacgatgtcggtgaaggtgcccccacgatcaatccagaattgccacttcatattcatcctcgggtacaagaagccgccacggcgctgccggccgcggcgtgcgggtggtggtacgggaaggatcccgcgtatcggttacagggaggtcgcggcgcgcgcggcctggtcgtacaggccggacagggcgcgcagcgtgtgcgccaactggcggctgaattccaggccgcccccgcccggcgcgtcgaggccggcggtgaggcattgctcgcggatttcgccgtagcgcttgatgatcgccgcgccctcgggcgtgacgctgtagaacacttccttgctggcgcgctcgcccttgaccacgcccaggcggtcgagctttttcagcgcgtagttgacgatgtgcgtgtcctcgacattcagcgtgaagcagatgtcggccagcttcttggggcgctggcggtggaacacgtggtggaacaccatgacgtcggtgggcgtcaggtcgggcaggcccgccgccgccatgcagcgcacggtccagcgatcgaaggcgtggctggcgatcatcaggccgaattcgacttcggacaggtccggcgcgctgccgccggccaggtgggccgacgaagcgatcaacgtggaggtcataagggccgggcaacaa

SEQ ID NO: 87591 - DNA, 330 bp, Glycine max
  Peptide Sequence Number=SeqID_179276
atgatcacccacctcaaactccaggtatttcctcctcttgtcctgatagcttttctacctactctgagcagtcctcatcctctcttggatcaacttgaccttcgcagtgatgatgacaaaaagctcaaaagtcaagatcacttcatgataacaaagatgatgacattcaagaataaattcaagattgagtcaagaacacttcaaagatcaagaggaaatttgatttcaagaatcaagaatcaagattcaagattcaagaataatcaagatcaagaatcaagactcaaagattcaagaatcaagagaagacttaatcaagataagtattaa

SEQ ID NO: 87592 - DNA, 919 bp, Glycine max
  Peptide Sequence Number=SeqID_179277
atttcctacatctaatgtccaatcttgtgaatttgggataaccggcaatcttgatgagtcgatctcttgctttcccaaaagggtggacccttgggtactagtacctatctcctttagagggctgcacgccctcaccttcagaggactacacgtcctcatcatcagagggtggcacgccctcacctttagaggactacacgtcctcgccatcagaggactgcacgccctcaccttcagaagactacacgtcctcaccattaaagggctgcacaccctcacctttagaggactacacatcctcaccttcaaagggctgcacgccctcaccttcaaagggctacacgccctcaccttcagaggactacacgtcctcatcttaagagggctccacacactcgcattaagagggatgctcgccctcgcctttagaggactacacgtcatcgccttcaaagtactggacgtcctcacctttagaggactgcacatactcaccttcagaggactacacatcctcgccatcagagggctgcacaccctcacctttagaggactacacgtcctcgcaatcagaggactgcatgtcctcatcgttagggggctccacgccctcacctcaagagggctgctcgccctcgcctttagaggactacatgtcctcgccttcagaggactgcacctcctcactttcagaggactgcacctcctcgccatcagagagctgcatggcctcaccttcagaggactgcacgccctcaccttcagaggactgcacgtcctcaccttcagaggactgcacatcctcaccttcagaggactgcacgtcctcaccttcagaggactgctcgtcctcaccttcaaaggactacacctcctcgccattaaagggctgcacgccctcaccttcaaaggacttcac

SEQ ID NO: 87593 - DNA, 267 bp, Glycine max
  Peptide Sequence Number=SeqID_179278
atggaaattgaaattcccccaaaagctgcagttttcacttggaggcttcttaaagacaggctccctactagagctaatctcataagaggaaatgtgatcatccaggacactgtttgtcccctctgtggcctagaacaggaggaggatagtaggcctgtggtgggagtcgatgacataggtacaagctcagggaactctcccagcttctccagtggatcattttcctgtggtgggtttttggagggcagcaccagaggtgctttgtaa

SEQ ID NO: 87594 - DNA, 438 bp, Glycine max
  Peptide Sequence Number=SeqID_179279
atggtgctgaggggtcacctgctgatcatgctgagggattccctggtgggccacgaacgacctgagttgaagttggtctcccatggtaggaaggttgataaatttgggaggtcagcgcctgagatagaaggcctagtggcggccaccgaattaagtccattgatcgggtgttctgtagtcaccggcgatcctggacttatatccgcatttgtcgagaagtggcataaggagaccagcaccttccaccttgtagtaggagagttgacgatcaccctggacgatatggcggcactcctccatcttcccatcacaggtgcgttacacagctttgagcctctgcttgtggacgaggcgatcttcttgttgatggagctgcttgaggtctccggtgagaaggctagagctgagaccgtacgggcgcatgtggcatacgtatga

SEQ ID NO: 87595 - DNA, 411 bp, Glycine max
  Peptide Sequence Number=SeqID_179280
atgccatccactatttgcaagggtcgcgtccacaagacacccagtggacccggagttgtccaacagggccctagggttgctagctctggttatgggtctctatcagtcctacagggtgcatgtccctcccagcaagggatcgcgcccgcaagacacccagtggacccggagaagtccagcagggtcttagggtttccagctctgattacgggcttctgtcagttctacagagtgcctgtcacccccaacaaggtcattaggcccccattaaccgggctttcatcaagaagtattgcacccccaggcaggcatagggcgagacaccacagcagcctgaggatggccggcagtgggcaacagacgcactgccgccacctcaagagcacctcagctcattcacaaaaaggttag

SEQ ID NO: 87596 - DNA, 151 bp, Glycine max
  Peptide Sequence Number=SeqID_179281
atgtcttcagtcttttacgctttacaagactacaatgtcttcagtcatttacattcaaagactacaatgtcttccgtcatttacattaacaagactacaatgtctttaacagttatgcttccggggcctctagatcgaccgcagtttcaaa

SEQ ID NO: 87597 - DNA, 231 bp, Glycine max
  Peptide Sequence Number=SeqID_179282
atggcagtgcagttgatccatgatcacgttgtgatggagtgcctagaggttgagccggttcaagtgatagaggtgtcatcctctgaagaggatcttgaagaggacccagaggagttacctcctaaacctgctgcagatgtccctgacttcccaaaggatgatgaggacccactccctgatgttgattctccaaaggatattatgttagcatctgaggcagactctacatag

SEQ ID NO: 87598 - DNA, 234 bp, Glycine max
  Peptide Sequence Number=SeqID_179283
atggcgagggcatgtagccctataaatgcgaagacgtgcagccctctgaaggtaagggcgtgtagccctacaaaggcgaggttgtgcatccctctgaaggtgaagacgtgtagccctctaaagattgactgtccttttgaaagaggtgataattcatgcaaacttatcctatcttttgcaaatctctccgggaactccctcagagtgtatgttctgtttgatttagccacttga

SEQ ID NO: 87599 - DNA, 342 bp, Glycine max
  Peptide Sequence Number=SeqID_179284
atgatggagataagaaaaataaccacggtaaatttcctcaaaaaagaagaggagcatttactaatcgtggtaaaaggagcgaaaagcaatggagtaataatgcttcaagctcctattgcaaattatgcaagaaaaataatcatgatacaaatgattgtcggtacaaatgcaaaaagtgcaaaaggcacctacactatgaaaaagattgtttttaccgacaaaaagaagaagcaaattttctggaaaataaagaatcccttgatcatactttgtactccgctttatcttctcaagaatcaagggatgtatggtatgttgatagtggttgttcaaaccacatga

SEQ ID NO: 87600 - DNA, 214 bp, Glycine max
  Peptide Sequence Number=SeqID_179285
atgagtatgaggtcgtgggggttggacctgaatcaggaaggagaggccctgacggactcttcggagtgtaggccttgggggtcaccgggtttgagtgctactttaagcctatgccgatcccatatggttggagcattctcgcaaaacatcgtgaccctgactggtctccctatgatcttacttagtgagagtgacctgacaaacccattgtgtg

SEQ ID NO: 87601 - DNA, 270 bp, Glycine max
  Peptide Sequence Number=SeqID_179286
atgactcgattagtatcacgaggacatcttagagttggaccgttacgatttcttgaagcaagacttatgagtcaagtatacgaaagtgagaaagatcatgttgaaggaagaggcttagactcaaggaggagtcttgtgatcggagtaacggaaaaagagtttcaactagatacacaacttgatattgagaatcatatgcgagatatctttttctcgatctttcagcaagtttcggggacgaaacttattttaagaggggtggaattataa

SEQ ID NO: 87602 - DNA, 669 bp, Glycine max
  misc_feature (9)..(9): n is a, c, g, or t
  Peptide Sequence Number=SeqID_179287
ttaaaggtngtcagcgaagagagtttcgaagcaccggaagaggacgaagaagtccaagctctcaaaaacgagttaggaaaggcgagacttgccaaggagaagttcaagttagccgctacagacatccggaaagagtgttccgggttacgtgaagagaatgcaactaccgcaagagcccttgaacaagagaccaagagggctcgcaaggaagagtatggtcgtaacaaatttcgcggagctttgtggggtagcaacagtgaactcaagttgcgaagggaagaaagagaccagtcacgagcacatggcatggtcttgaaagaggagttagttgcctgttcaaggtccaaaagaaacttgtctcagcgtttgtgcgagacggagaccaacatgctagctatcatcgccaagtaccaagaagagctaagtctagccatggcccacgagcatagggtcgcggacgagtatgcccgagtatacgcggaaaaagaggctagaggaagggtgatcgactctttacaccaagaggcaaccatgtggatggaccggtttgctcttaccttgaacgggagtcaagaacttccccgattgctagccaaggccaaggcaatggcggacacctactccgcccccgaagaaatccacgggcttctcggctattgtcagatatga

SEQ ID NO: 87603 - DNA, 438 bp, Glycine max
  Peptide Sequence Number=SeqID_179288
gaggcagaacaatcaactggtttcctcgatggaaggaaggaaaggagggagttctcttctcatggtaccccatcgacggaagagagcctccctcctttccttgtgagagatttcggctcgcaaagtttcaaggttatacaaagagttcgcaaggcgtgggaaagcccgttaaggaaaaataaagaacgtaggggcatccgtaatggcatcatcggtggttatcatgaatggctgaaagatcgtacacgagggttagattggctctctaaattgaaagttatcaacgaggagaacttcgaagccccgaaagaggatgaagatctccgaaagttatctctagcatgcattcatttttctttacctactcctcacgaacagatgaaagtcgacatctcagctttgaaagagcaaatgacttccatgatggatgccatgtaa

SEQ ID NO: 87604 - DNA, 315 bp, Glycine max
  Peptide Sequence Number=SeqID_179289
atgacctgggtcgcaacatcagtcgtgatggtgatggtgacaacattgagagttgtcaggtgtgtgaaacattgcggtggagatggactgttagtctctcacactactagtgcaaaaggttgtgatgctgatcatggttacaggaagtaccttatattcatcaattgtatgatgtcagacaaatgggtttgtggggccgtgcaaaacttggcaacaaaacagtggattttcattggcgagttcgccctagctgcgacacgtggcgaaaatgccactgccattggcagaatgcagtggtgtcgccagtgccattag

SEQ ID NO: 87605 - DNA, 630 bp, Glycine max
  Peptide Sequence Number=SeqID_179290
atggctgctagtgaccacgcaattttgcgtgatagagcacacatcccaaccaaaagaagcctgctagagctttcatcacaggatgcattgttggcacaaaacaagttgttgtccaagcaacttgaggcaatgacagaaacattgagttgtgctatatgtggtggagctcacgaatctggctgttgtatttccactaaagatacaacacatgaagtgaactatatgggaaaccagccaagatcaaactttaatgccgatgggccacaacaacaagggcctagtctctatgatagaacaacaaagttggaagagactcttgctcagttcatgcaagtatccatgtccaatcaaaagagcaccgagtcaaccatcaagaatctagaagtccaggtgggacaattggcaaaacaactggcagacttaccgtcaagaagctttggagccaacacagagaagaatcctaaggaggagtgcaaggctgttatgactagaagtaaaatgcgtgcatccaccgctaagcacagcttcaacgcacttagcgtgacaaaggaatctggaagagcacaagaatcaaggccgcatgctaagcgcaagatcagctcgctaaaagagacgcttgtctcttgctag

SEQ ID NO: 87606 - DNA, 651 bp, Glycine max
  Peptide Sequence Number=SeqID_179291
atggcatctaagaaaagaaaggctccttctacaccttcccaagttagatatgattggtctaggaaactactaccagagagaaatgtagtagtatattacaccgagtttgatgagttcaagaaggaactcgagagaagacactgggatgaggagttgactgattttgctgacggcagcatagatgttgccattgtgaaggaattttacgcgaacctctatgacctcgaggataaatcacctaagcaggtgagggtgaggggtcatttggtgaaatttgatgaagatactctaaatacctttctgaagaccccagtgattctggaagagggggagaatctctgtgcttattctagatttgcactcctgaggcctgatcctcaggagttagttgctaagctttgtatcccagggaggggattcgagctaaacactgatggtcagcccttgaagatattaaggaagaacatgaccactttagctcagacatggagtgttatttccttctctaacttgattcctacctcccacacatctgatgtcacattagacagagacaagttaatctatggcatcattatgaagatggatatgaatgtggggtacctcatctcccaccaaatctttattactgcacaacatggttcatcctga

SEQ ID NO: 87607 - DNA, 1195 bp, Glycine max
  Peptide Sequence Number=SeqID_179292
atgaccaacttgtacacgtgcctcgatggatttgcttacagcaaaggacgcgtgagggacagaatcgagaagaagctgcttgagatatcgcaccacgtgagcaactcgttggccatgctgaacaaagtgcctggagtgaagaaattaacaacttcggaatctgtggttttccccgaatatggaaacatgaaaaagggtttcccctcgtgggtgtcctccaaagaccgaaagcttcttcaagctaaagtgaaagagaccaagttcgatcttcttgtagcgaaagatggcactggcaacttcaccactataggggaagcactcgctgtggctcccaactccagcacaaccaggtttgtgatacacataaaagagggggcatacttcgagaatgtggaagtgataaggaagaagacgaatctgatgtttgttggagacgggattggaaagacagtagtgaaaggcagtaggaatgttgtggatgggtggaccacttttcaatctgctactgttgctgtagtaggagcaggattcatagcaaagggtataacatttgagaactcagcagggcctgacaaacaccaagctgtggcacttagaagtggtgctgacttctcagctttctaccaatgcagtttcgttggctaccaagacactctctacgtgcattccctacgccaattctaccgtgaatgcgacatttacggtactgtagacttcattttcggcaatgcagctgtggtattccaaaactgcaacttatacgcacgcaagccaaacgaaaaccagaagaacttgttcaccgcacaaggcagagaggaccctaaccaaaacactggcatatccatcttgaactgcaagattgcagctgcagcagatttgatccctgtgaaatcctccttcaagagctacctaggacgtccttggaaaatgtactctaggactgttgtcctaaaatctttcgtggaggatctgattgacccagcagggtggttggaatggaatgaaacatttgcattggatacgttgtattatggggagtacatgaatagaggtccaggtgcaaacacaaatggtagggtaacgtggccaggttatagggtaattaacagctccactgaggcaacccaattcacagttgggcagtttattcaaggcaatgattggttgaacagtactggcattccattcttctctg

SEQ ID NO: 87608 - DNA, 1593 bp, Glycine max
  Peptide Sequence Number=SeqID_179293
atgactttctccctttcattcaccactctgctttcccttctctctgtcattctgcttcatgtcaatgccttccccgttcatttcaatcaccccatacaccatcgccaccctcgctttgccgctcataactacagagacgctctcaccaaatccattctcttctttgaaggccagaggtcagggaagctccctcctaaccagagaatgtcttggaggagagactctggcctctctgatggctctgccatgcatgttgatttggttggagggtactatgatgctggggacaatgtgaaatttggttttcccatggcattcaccaccaccatgctttcatggagcgttattgagtttggtggcctaatgaaaggtgagttgcagaatgccagagaggccattcgctggggcactgattatcttctcaaagccactgcacatccaaacaccatttatgttcaggtgggggatgctaagaaggaccatgcttgttgggagagaccagaggacatggatactccaagaagcgtgtttaaaatagatgcaaacacacctggttcagaagttgccgcagaaactgctgcagctcttgcagctgcttctctggtttttagaagaagtgaccccacatactccaaaattttagtcaggagagccatcagggttttccagtttgctgataagtacaggggatcctacagcaatgccttgaaaccttatgtgtgccccttctactgctcttactctggatatcaggatgagctgttgtggggtgctgcctggctgcacaaggctaccaagaatccaatgtacctaaactacatcaaagttaatggccagatccttggggctgcagagtttgacaacacctttgggtgggataacaagcatgctggagcaagaatacttctttccaaggaattcctggttcaaagggtacaatccctccatgactacaaggggcatgcggacaatttcgtctgttccctaatttctgggacctctttgtcttccacccaatataccccaggtggccttcttttcaagatgagtgatagcaacatgcagtatgtcacatccacctccttcctactgctaacatatgccaaatacttgacccaatcccatatgcttgttaactgtggcggaatcaccgtaaccccaaggagactccggacaatagctaagaaacaggtggattacttgcttggagacaacccattgaagatgtcatacatggtggggtatggtccacggtacccacgaaggatacaccataggggctcatctctaccgtcgattgctgtacacccgggaaagatccagtgttccgcagggttcagtgtgatgaattcgcaatcccccaacccaaacattctcgtgggggccattgttggtggaccagatcggcatgataggttcccagatcaacggttaaaggaaagaaataaaaagagcatgttaaaatttttccgaagtgtgaaagtgagggcgatggggaaagacgatttcatttgtgagaggcatgtgaagcagggcagaaagagctggtttaagttaagagtctatgacaagtgtcagggatgtcagaagtag

SEQ ID NO: 87609 - DNA, 1602 bp, Glycine max
  Peptide Sequence Number=SeqID_179294
atgaagtgcggagctggcattttcctttatagccgtcgctttctactacctccccccgtttgtttttattgtttccagtacttgcttggcattatatacgaaatagctcttgctctcttcctcttgtgctgtccttatgttcttcttctagttcttctaccctcttcttcactcttgttccatcactgctttcagagcttcctatttctctttgaagaagaggggcacagacccatgaagaggctcgtaactgtgcttttactcataatattaagcactgctctggaaggcaatggagaagatgatcatgaaccgtgtaaagaaaaagtgttggatcctaggcctcacagcgtgtcaatcttagagtttggggcagttggagatggaaaaacactgaacacagttgcattccaaaatgcagttttttatgccaagtcatttgctgacaaaggtggggctaaactatatgttccatctggcaagtggctcactggaagttttaaccttaccagccacctcactctctttcttgaaagaggcgcaaccatcatcgcatcacaggattatgcacactggactgcaatggatcccctaccctcctatggtcgaggtgataatggaattattgatgggcagggttctgtttggtgggacctaatcagtactcattccttaaattatagccgaccacatattatagaacttgttggttctgataatatcataatctcaaatttgacatttttaaactctcctgcttggagcatccatcccgtatattgcagtaacattcaaatccagaagataacagttcaggcaccaaccaagttcccttacacaagcggtatagttccagtaagagttctcaatatgattgaagaaagggtattgttcccagttctcatatttggtgtattccctttcacagattcttctgagcatgtttgcattgacaactgcaatattagcactggtcatgatgcaattgtgctgaagagtggttgggatgaatatggagttgcctatggcaaaccaacctcaaacgtccacatcaggggtgtttatctacaatcgtcatctggtgctggcctagcgtttggaagtgagatgtctggaggcatatctgatataattgcagagcagctccatattaccaactcaacttttggcattgaactgaagacaactaggggtagaggtggctacatgaaaaacattttcatttctgacgcaaaattggaaaatatttacttgggtatcagcatgacgggaagttctggctcccatccagatgacaagtatgatcctaatgcagttccggatgttggtaatgttacttttgagaatgtgattggtgcaaatattgctattgctgggaatttttcaggaatagttgattcgcctttcactcctatctgtctttcaaacgtgactttttctaccagttccgagtcatctccttcatggttttgttctaacgtaatgggaatctccaaggaggtgtttcctgagccatgtcctgatctgcagaacacgtattcaaacttttcctcttgcttttcttccctacatccgtcatctagttttgtctcaagcgcatga

SEQ ID NO: 87610 - DNA, 126 bp, Glycine max
  Peptide Sequence Number=SeqID_179295
atgggctctcaacctaatgttctgatccagaaagtcactgctatgatgaatagggtaggtaacaatcttcttatattctggggtcatgttatggatcatggccaaaaggtgcagtgcaaggattga

SEQ ID NO: 87611 - DNA, 138 bp, Glycine max
  Peptide Sequence Number=SeqID_179296
gctgattcagatgaatgaagaacttcttcaatattgtcaaaaggaaatcaaggatttgcttgacaaaggcctaatcagaaagagcaaaagcccttggtcttgtgcggctttttatgtcaacaaacaaccagagcttga

SEQ ID NO: 87612 - DNA, 529 bp, Glycine max
  Peptide Sequence Number=SeqID_179297
atgaatgtcggagctcttatctctggacagatcacatcaatggcccagtctaactcctctagaattgggttccttgctcttatcacaactttatgtaggtccagaggagttgctttcgacagcttagtctttgaacgtttgagcccgctggtagcgcctccagactccatctcgacggtagagcaatttaatgaatggctagcctggccagggactcagcctcctcttcacagggaagatgaagatcccgccactcaggtaccccatcagccgaaggatgagtcatcagagtcttccactcctgagcccttgatcaagaagaggagggtagttgtaacccaggaagctgcaaccacctctgaaaagtctcttgaagccactctagagcttccggcaccagtgacagattccacttctccacaacaggcagtagacccttccacccctgaggatcaaaccaccccagtcctgtctccgaacacctttcctgtagctactcctgtacttcatttgtcggaagaggaggagg

SEQ ID NO: 87613 - DNA, 1151 bp, Glycine max
  Peptide Sequence Number=SeqID_179298
gtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtgatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactgg

SEQ ID NO: 87614 - DNA, 318 bp, Glycine max
  Peptide Sequence Number=SeqID_179299
atgacatccgccattttccgctacgccatccgtcatatttttatggcagatttttggcttttcgccatgaaccgccatccgccattaacaatattgcaacaaaatgtcatagggcatacacgcttttcgagacttgagtcagagtggaagctacacaaggggagttgccgccctagttcatattgttggatgtatgagcattttccctctgttgctgagtctttaagtgatcttgactatgatgagatgtcaccacatgcctaccggtggattgctacgaaggtttctttgaagtcattaccagcatcgacatactga

SEQ ID NO: 87615 - DNA, 218 bp, Glycine max
  Peptide Sequence Number=SeqID_179300
aagttgtcatcatcaaaaagggggatattgtagaagcaaagcttcatgatgaatcaagattgattcaaagatgttttgatgataacaaaggtgatgacaaaaagctcaaagaatcaagaatcaacattcaaggttcaagcttacaagaatcaagatcaagattcaagactcaagatttaagaatcaagagaagacttaatcaagataagtatgaaaag

SEQ ID NO: 87616 - DNA, 415 bp, Glycine max
  Peptide Sequence Number=SeqID_179301
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaatccggaggaccgagtgcctcccacgcccggtcgtactcataaccgcatcagtctccaaggtgacagcctctggtcgatggaacaatgtaggcaagggaagtcggcaaaatggatccgtaacctcgggaaaaggattggctctgagggctgggcacgggggtcccagtcccgaacccgtcggctgtcgtggactgctcgagctgcttccgcggcgagagcggtcgtcgcgtgccg

SEQ ID NO: 87617 - DNA, 568 bp, Glycine max
  Peptide Sequence Number=SeqID_179302
tgaagctttagaacgattccgtagcttgctgtggaagacccccacacgtggattctctgagcctatacaattgaacatcttcattgatgggttaaggccacagtcgaagcagttactagatgcttctgtaggaggtaaaattaaattgaagactcctgaagaagcaatggagttaattgagaatatggctgctagtgaccatgcaatcttgcgtgacagaacacatatccccaccaaaaggagtttattggagctgtcatcacaagatgctttgttggctcagaataagttgctgttgcatgttgtgctatttgtggtggtgctcatgagtcaggctgctgtattcccactgaggatcatgcacatgaaagctcatcctggtaatcaattcaacaaagaccagggagggccatctaataggctgcaacaacaagggcataatctctacgagaggacaacaaagctggaagagactcttgcttattggccaagcaaattgctaacacttcttccaacaaatttggagcaaacacagagaacaatcccaaggaagagtgtaaagctgtga

SEQ ID NO: 87618 - DNA, 519 bp, Glycine max
  Peptide Sequence Number=SeqID_179303
gaaagaacacgctttatggtgcccttaccgaacccgtgatagagttagagtaatgggtgaagtagaggaggtgcaagagcagatgaaggctgacacggaggtgttgaaagagcaaatggccacaatgatggaggccataatgagcataaaggagataatgaaggtcaatgcggctgcaatagccgctaccaacaccattgctgaggtggacctgatccccctatatggcctcaaccaaataaatcatccaacctcagatatagtaggtctggaaggcaaagagttgggaggggagacacatgaaattccccaccacaatctagccgacttcaagccttgtctcggatatgccactgaagggcaagcagttggtggtttggtcttcaccgaagaaaggatcaaagtgggactggaaaaaggcaaatctgatcatcctactttgatgaatgcgaaaactggggcaaatgaagaggatgagaatgacggagaaacccttgctatgactaccattcctacacg

SEQ ID NO: 87619 - DNA, 1477 bp, Glycine max
  Peptide Sequence Number=SeqID_179304
catgtgtacgccgcaccagaagctgttcgcgctggatgccgccaccgagataaagaaaagtggaaatttgatccgcagctgaagtacaacccgaccttccagcacatcacctgccgcggcgtgtcttaccacgaaaccgctgcagccgcgggcgccgccggcgatgccgcaccggcgatgtgcgcgcgccgcatcattctgccggtcaacgacggccgcctgttcgcgctggacgccgacaccggcaaaccgtgcccggacttcgccaacaacggcgagttgaacctgcagagcaacatgccgtatgcgacgccgggccactacgagccgacttcgccgccggtgatcaccgataaagtgatcgtcatcgccggcgccgtgaccgacaactactccaaccgcgagccttccggcgtcattcgcggcttcgacgtcaacagcggcaagctgctgtgggccttcgatccgggcgcgaaagatccgaacgccatcccggcggacgagcatcacttcgtgccgaactcgccgaactcctgggcgccggccgcctatgacgccaagctggatatcgtctatctgccgatgggcgtttccacgccggacatctggggcggcgatcgcaccccggaaatggagcgctacgccagcggcctgctggcgctgaacgcctcaaccggcaagctggcctggttctatcagacggtacaccacgacctgtgggatatggacgtgccggcgcagccgaccctggcggacattaccgacaagagcggtaaaaaagtgccggtcatctacgtgccgaccaaaaccggcaacatcttcgtgctgaaccgcaccaacggcgagttggtggtgccggcgccggagaaaccggtaccgcagggcccggccaaaggcgaccgcctgtcgccgacccagccgttctccgagctgaccttccgtcctgagaagaaactgaccggtgcggacatgtggggcgcgaccatctatgaccagctggtctgccgcgtgatgttccacagcctgcgttacgaaggcaccttcaccccgccgtccgagcagggcacgctggtgttcccgggtaacctcggcatgttcgagtggggcggcctggccgtcgataccgatcgcgaaatcgccatcgccaacccgatcgcgctgccgttcgtgtccaagctgatcccacgcggcccaggcaacccgattgagccgccggaaggcgacaagggcggcagcggcaccgagtccggcgtacagccgcagtatggcgtgccgttcggcgtgaacctgaacccgttcctgtcaccgttcggtctgccgtgcaaacagccggcctggggttacatttccgccgtggatctgaaaaccaacgacatcgtgtggaaaaaacgcatcggcaccgtgcgcgacagctccccgctgccgctgccgttcaaaatgggcatgccgatgctgggcggcccggtgaccaccgccg

SEQ ID NO: 87620 - DNA, 132 bp, Glycine max
  Peptide Sequence Number=SeqID_179305
atggctatggtgaaccccgggaagatttatcaatctcccttcccccgatggtacaatcccaacgcaacttgtgcctatcacggtggtgttctggggcattctatagagcagtgcgtggccttcaagcacaag

SEQ ID NO: 87621 - DNA, 591 bp, Glycine max
  Peptide Sequence Number=SeqID_179306
atgattatgaagggccaagacatttatagtagccaagatgaggctactacttcaccttcctctagtgaaagtgaagaagcaaaaggggaagaatctagtgaagaaatctacctccaagaagatggacaaccattagtggttaaagagaagagtaaggaggtaagtgtctcctccaagaggttagctaagaaggaaactcattttacaataaagacaaacattaaagaaactttccctcttagacaacctccacattttctcttttgtaaaaagacacttgctagcattgccacacctcttgggcttgagtttatttctcaagtaaagaagttgttggatgagggtttggttcgcaagagcttaaatccttgtgcttttttgatgcctaaaataggggttcccatgaatcctaagagaataaaggtcattcctgagtggcccactccaccaagtataagaaaaatttggggcttccatgacttaacaaacttttacaaaaggtttgtcccatatttttctatacttgtagcaccactcattgagttggtgttgagggaaggagcccagagtatgaagaacctcgggatttga

SEQ ID NO: 87622 - DNA, 270 bp, Glycine max
  Peptide Sequence Number=SeqID_179307
atggtgggttacacaccttcaagttttacggatttggtcttcgccagcgaaaggatcgaagtggatctaaaaataggcaaatttaatcatcctgcttggacgaatcagaaaactgaggcaaatgaagagggtgagaatgaaggagaaacccatgctgcgactgccgttcctacatggaaaatcccccaccagctcaacaacatcattactcatccaatatcagcccttctcattacccaccacccagtcatccacaaaggtcatccctaa

SEQ ID NO: 87623 - DNA, 287 bp, Glycine max
  Peptide Sequence Number=SeqID_179308
agaacgaggatttgggctacatgggagtacgtgagctcagttggaggtgggcaacaggggatgtggtacctggagatatgtcgcgggggtcaggagaccttggggacgtcaggcaagctcctggcagtcaacagataaggaacaaagaccacaaagcaaggaggcttgtgtggtggctggccagctgtgaatcttgtgtgatatacgggcttgaaaacgaggtcaggaagctatgggggcttctggtaatcgattaccaagggggtgtaatcgattaccaagcttag

SEQ ID NO: 87624 - DNA, 441 bp, Glycine max
  Peptide Sequence Number=SeqID_179309
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccggtaactatcgtcttgagtccaaccggaaagacatgcaaagcaccactggcagcagccactg

SEQ ID NO: 87625 - DNA, 660 bp, Glycine max
  Peptide Sequence Number=SeqID_179310
atggggtacgtgatatctatgagccccgatgccaagcaggtcattggacaactgtggctcgcacgtatcttcttcatctttttggtttgcactctgtttgctaacaagagtgcaatcaatgttcatgttgtgtatttggaggcccttcgtgacctcagtcagaccgagaggtacgcctggggagtagctgcgctggtgcatatgtacgaccacctgaacgatgcttctatcagcagcaaccgacagcttgacagttacatcacactactacagtgctggatatacgagcactttccctcagtcgcggagtccattgctgattcggactacgacgaggattcaccgcgttcctgtaggtggattgctacgaagaagaccgtgaagaacatacgtacaccgacgtacagggagcgcctggaccgactccggatttcggatgtctgttggatcccatatggggagcaccgaccggtccgggacttccatatgatttcatgctattctggtctcctgcgctgggtgcccgttgttatgtattacgatcagagagggtcatgcggcagtttggatacactcagatcattcctactccgcctgtggattcatgggtgtcgtatgatgatatacacgacaggtggatgcactattcggatcatatga

SEQ ID NO: 87626 - DNA, 177 bp, Glycine max
  Peptide Sequence Number=SeqID_179311
atgttcagcccttctggtattgaggattctctcgaaattagtgaaaaaaattgttttcgtgaagaaaatccaagtagaggtgcttccgtaatgcttctgagacgtttccatgggcgatttcgtggagattcttcaccattctttgttcggtcttcatcgttcttcggtcttcaaccg

SEQ ID NO: 87627 - DNA, 69 bp, Glycine max
  Peptide Sequence Number=SeqID_179312
atgtactttgcgtggtggcgcggtggtggaccgagactgtgccgctgtgatatgaaaaggataggttaa

SEQ ID NO: 87628 - DNA, 261 bp, Glycine max
  Peptide Sequence Number=SeqID_179313
atgacaattgaggaatcaatacatgttacttttgatgaaactaatattacctccccgagaaaggagtttgttgatgatattgcagatactttggaagatactcaaaatgaagaaagaaaactaaaaagaaagagagatgatgaagacaaggatgatcaagatgacacatcacaagaaaatgataatttttcccaaagaatgggaaaacttcaagaaatcatcctcttgacaacatcatcggtgatatctcaaaaggggtaa

SEQ ID NO: 87629 - DNA, 342 bp, Glycine max
  Peptide Sequence Number=SeqID_179314
atggggtggcagggataccaaggaagcactggaggagaaggcggaagctttggccagcaaaggagaatgggcaacattcatcaacatattagctctgctaatgggttggtggatctagcggtgatcgatgtctttcttgcttatcaccacagcaaggaaagcccggtcatcactattttggcggatgcatatgatacatttgacttgaggtgcaagaggagcagtgcaagaactgcctattgtatgcctgctctttatgtatatccgtttgtcccccacaaagtcattgcatgtgctccgaaaagggtaaagaaagttgggaagaactcttggcaggcatga

SEQ ID NO: 87630 - DNA, 825 bp, Glycine max
  Peptide Sequence Number=SeqID_179315
atggcagctcgcctaggaaagctgagacttactccagaagtaactgtctcacccaggcgagctggttccttcacccttaagtcttttgagggcctaggcgagctagaggctagcctggccgagctagggtccaggaaactcaatgaaaagacccttttgcccctctattttggtatctttcgcattcttgatcaaaacattgaacggtctttcgtcttgtgcgataaccgcgaccttgctatccgaccgacaactggcgaaaaccaaggaagtgaaacctgtaataaagaacaaacgattatcgacatggaagtatcagacgagcatcagaagaaacactgggtccagccgaatagtggaaaactgcacaaaggtcctggtcgagaggctcagtctcctcaaaggaagaaatccatcacatttttcatatctccatccttctcagctccgtcttcatatccttgggcccctgccacgggtatgggttggggtcctggcgctgctggtgccatgtatactggtagaagctgttgttcaactgcacctggcccctatggtttgtcgcctgctagtcagccaaatgctacatgtacgtgtgcatatggagctccatcctctacatgtgagctgagatggactctagaaatggtggctgatgtggaggcggtgggggtgcatatgccgtcagctgctgctgcacttctcaatgaaggtcctgttaatagggggctgaatgagctttgtgggcatgatcgataccccgtagaactgacagaggcctatgatcaatgctggaaatcccagtgccctgttgagcttctctga

SEQ ID NO: 87631 - DNA, 184 bp, Glycine max
  Peptide Sequence Number=SeqID_179316
atggcccgcacgaacaaaacaggggagatgacgactgaggccgcaaaggaaatcgctgagaagatcgattcctttaaggagcaggcgacacatggatccttcatcccccatggacatcaggatgttctcaccgctgctattggacgtccagagcaccttgaacgtgtccgtgctactagagccg

SEQ ID NO: 87632 - DNA, 886 bp, Glycine max
  Peptide Sequence Number=SeqID_179317
aagctcctggctgagaagacgaagaagaagctggatgaaactgcacagtcaggaagcgttgatggcatcatcgaccctccatcccccgtcagacgccacgtgaagtggaagatggcccgcacgaacaaaacaggggagatgacgactgaggccgcaaaggaaatcgctgagaagatcgattcctttaaggagcaggcgacacatggatccttcatcccccatggacatcaggatgttctcaccgctgctattggacgtccagagcaccttgaacgtgtccgtgctactagagccggtgtcaccatcaagcaatacttcggatcggctccacggacgtcccgcagctcttccttgctgcctcttgaagaattgcagcagctgacccaacaaatcagggaccagttagaggagtcgatcatagaaaaaggacttgcacttcctccagaacctctggttggtccctcagatcctcgagtaagcacaaaggggagttgtattgatccctcaggaaacgatcctgagatgggtgactcagataggtgcggcttgtacatcgaagaaaatcctgcccacttggttgccctggggagagtttatgagggatccattgttgttcataacactcctttgttgcctggccaagtaaaggtgggtgtggaggaggttaaagatccagatgctctagttcctatacccattgatgaggtttccttagtggggcagaaaattcacaccttccttgcttggccgacacatctggtcaagtctttatcacagcagacagttgtgtctctggcaaaaccacctcaaaagtcggatctggaggtcgatgatccgctttatctgatggcattgaccatcccagagattttcttgagccttacca

SEQ ID NO: 87633 - DNA, 354 bp, Glycine max
  Peptide Sequence Number=SeqID_179318
atgacgacaggtttggagaaagcgatgaaggaagcattcacaacggagaatggtcgtgggagtttgactcaaggacactctaaaaccggttctgattccgtgctacgacttattgagtacggtgccgtttttgttctcacaaatcttcgaccaacttcgactgcttccaagagtccaaagcaagcatcaaagcttgttggcaaaaactttggtgacgaaggacaagaaattgtaaccgacacgctcgaagaggtaccacaatgcggtggcataaacgagtactgcaaccgctccactccaattcatccacaacaccacatcaacagagaacacgatgaaaggatgagaaactaa

SEQ ID NO: 87634 - DNA, 505 bp, Glycine max
  Peptide Sequence Number=SeqID_179319
tggttcttccggaaaggtcttccggaaatttgaaagttcttccggaagatcgcgtcttccggaattcttccggatgaaccacttcttccggaaagttcccggaagaggttttccgggagtcttccggaagaagtgttcttccggaagacgtttcggttacttccagaagaacacttcttccggaaactttccggaaaatgttcttccggaacttccggaagaacccctaacgggtcttccggaaggctccgccgtgaacctcctttccccatttttttcggcgtcctctcctctcgtcttctaccctaaggttactatcctaaggttccactgctacaacaatgttgtatcatacaagcaaaggggagttagggagactaacctcgttcgcggagaagaagaagacgaggttcgcgcttgccttgcggagaagaagaagcagttcgcggagaagggagaagaagcagttcgcggagagggagaagaagcttcgcggaaggaatga

SEQ ID NO: 87635 - DNA, 318 bp, Glycine max
  Peptide Sequence Number=SeqID_179320
atggcattagaagaggggaaggtgaagatcgagaagttcgatggcagagatttcagctttttgaagatgcagatagaggattatctatatcagaagaagctgtatcagcccttatcaggggttaagccagaagacatgaagcaagaagaatggaacttgctagatcgacaggctcttggcgtgatcagattgacattagccaagaacgtcgcgttcatattaatgaaggcattatcagatatgtacgagaagtcgtcagcagccaacaaagtatacttgatgcgccggttgttcaacctcaagatgggagaagattaa

SEQ ID NO: 87636 - DNA, 246 bp, Glycine max
  Peptide Sequence Number=SeqID_179321
atgaaacaccctcaagatctccactatgtagatcccgttcttgggggaagaactaggggaaaggggcatcacaacagagaggaagggggaggggaggtcgtggcagatgggaaagggggtgtcacgacggagggagaagatggaagtggggaagaaggagcggcaccgagaagagagaagaaaaaaaaaagtggaaagaagaagaaaagtgaggagagagaaaaattgaacgttggaagtgggtga

SEQ ID NO: 87637 - DNA, 666 bp, Glycine max
  Peptide Sequence Number=SeqID_179322
atggcttccaaaaataatactgggatcccaaggcagctggtggagcttgtatgcggccatggcaatcccataaagaggaataatgttgatgagcttgttgaaggaaatggtggtgcgaatgagactgagattgggcagatgaagagcaggcataggaagcgggcccgacaatggtggaaggaatggttgcacgagtgtaggacatggaggcgtagtcggcatgggaagcagagggtgtggtgcgtggctgcacgagtgcaggaagtggagatggagtcgacatgggcagcggaggtggcggtggtgactgcacaaaggaagaaaggtagtggtggctggttctcggaggtagttttagaagaagggcacccaatgtggattcgaggcggtgttgagctgcagcaatgtggaaaggaagcaatgaggaaaggtggttcagcgggtggtgtgggttgcggtagtcgaagctgcatcccttatatagaggcactagctaaggttgctgctacgaaaacaaaaggtgctagaatgccaaaagaaaataacagaaaagtggaaaatggcaacaatgcagtgttgcacgatgggaagcaacatgccaacaacatattccctatgaaccagtatcctcctgacagttcaacaccttctaacaaattctgttaa

SEQ ID NO: 87638 - DNA, 546 bp, Glycine max
  Peptide Sequence Number=SeqID_179323
atgccaaactttgcaagcctgaaatctcatgctgttacactctatgaagcggggaaattgggttatggcagcattgctgatctttgcaaggatcttagtaccttggagtgtgcaacatatgagggagaattacaggaatttgctaaccatttatttagtctacattgtgtcttagagtgtctacaatcaggtgaaatagttaccaacataaaagaagagggaagttctgataagctgagtatgattacctcaagtaatgatgggcaaagttctgagatagctgaaagttctttggcttctatttacaccgaccatgtttctagtggaatggatgatgagacttctcactctccttttcctcttgtttctcactcaccctctcctctcccgtttctcactctccactactccttctccgctgtcgtcgcctctgaggactacggcagcaaaatgctcacaacaacaacaacaatgatgttcacgcgtgatgttcatggcgaaggagatgaagaggctcctcgttctcaccaaggaggagtccgttag

SEQ ID NO: 87639 - DNA, 282 bp, Glycine max
  Peptide Sequence Number=SeqID_179324
atgtatcaaccatgtctaacccaaaatcaagctttacagcacagcaacacagaatataggtgtccaacacccctcaattcaatgggttttctaggtttgaaaagtgaaattgagaatgagccacgcacttcacgactccaaaaacgccctcctttcacgatttggggcagaaatgatggccaaaggttggagctttgttggggtttcaatggagaatggaggagaaggaaaaagcaacgtgaggaagagagagaactgtctgaaaagtgtggggctgagtga

SEQ ID NO: 87640 - DNA, 162 bp, Glycine max
  Peptide Sequence Number=SeqID_179325
atggagttcttagagctcaagcagggaaacatgattgtggctgagtatgcagccaagtttgaggagctggtgagggtgtttgttaatttccactcttggttaacatgtgccggatttgggatgaagactctcgagataggacaagctattataagaatatag

SEQ ID NO: 87641 - DNA, 216 bp, Glycine max
  Peptide Sequence Number=SeqID_179326
atgcggagatgccttacggttatctacacctcgtcatttggagaccctagtctgattgacaagcggagaccaatgtggtcgcctgcgcccttttcggagatgtcagcatcttttggccacgactcttttggtctcacaacatgtgttgatcctgaccgcgttaggtggaaggcagatataccaagtgattatccgtacaaagacaacatctactga

SEQ ID NO: 87642 - DNA, 201 bp, Glycine max
  Peptide Sequence Number=SeqID_179327
atggcggtttccaaacttagaaatgatgcaaagaaccatggttacctcaaaggaaaacgaaaggtcagattagggtttcgttctctaccgaaatcacgagccatgttggaagattccgcttcgaatgaagggttcctctcagtgtggggtttcaacggagaacaatggcggtttttggtggctactggtggctgtgggtga

SEQ ID NO: 87643 - DNA, 455 bp, Glycine max
  Peptide Sequence Number=SeqID_179328
cgacgaaatgcttcggggagtgaaaataagcgtagatccggggattcccgatataggtcaacctttcgaactgctgctgaatccacgggcaggcaagagacaacctgagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 87644 - DNA, 1266 bp, Glycine max
  Peptide Sequence Number=SeqID_179329
atggtcaccgcggcggccggttccgtcgcgctggtgatcgggccgatggtgcacgcgcatggcgtggagtacattctgccggcagtaatcctcggcggtgttattcagatcattttcggccttgccgggctgtcgcgcatgatgcgctatattccgcgctcggtgatgatcggcttcgttaacgcgctgggtatactgattttctttgcgcaggtgccgcacgtctggggccagtcgggtctggtgtggctgctgttcgccgccacgctggccatcgtgctgctgctgcccaaagtgcttaaaagcgtgccttcgccgctggtggctatcgtggctgtcaccgctgtcgcgctgctgctgggctatcgcgtgcccaacgtcggcgatgaagggccaatgcgcgccggcctgccggatttcaataccctgctggtgccgcttaatctgcacacgctacagattgtctggcccaccgcgctgtcggtcgccttcgtcggcctgatggaatccctgctgaccgccaaactggtggatgacatgaccgatacgccttccggcaagcggcgtgaatcctgggcgctgggcgtcggcaatattctggcagggttttacggtggtatcgccggctgcgcgatgatcggccagaccattgttaacgttgagctgggcaaggcgcgtacccgggtgtccaccgtggccgcggcgctggtgctgctgttgctggtcaccggtctgagccagatcatggcgcagattccgatggtggtgctggcgggcattatgatggtagtcgcggtgaaaaccgtgaactggcacagcctgcagccggccacgctgaaacgcatgccgtggtcggaaacgctggtgatggtgctgaccgtcgccgtcacggtgtggaccggtaacctcgcgcttggcgtgctggtgggcgtgatgctcgccatgatgctgtttgcccgccgcatcgctcatgtgattcatgccgaacgtcagctgagtgacgatggccagcaggtgcactacacggtgcgcggaccgctgtttttcgccagcagcaacgatctgtttgagcattttgactacggccacgatccgcagcgcgtcaccatcgatttgacccacgcgcagatttgggatgcctccagcgtggcggcgctcgacgccattgagtaccgctaccagcggcacggcgccagcgtcaccttcaccggtctggataaccgcagcagcgatttccgcgatcgcctgagcggtaatctcggctaa

SEQ ID NO: 87645 - DNA, 217 bp, Glycine max
  Peptide Sequence Number=SeqID_179330
atgacctccaatttcaagcaagcagccctggactatcatgaacatcccacgccagggaaaatccgtatcgaactgagtaagccggccaataccgccaacgatcttgccttggcttacagcccaggcgtcgccgagccagtacgggctatcgctgcctgcccagatgatgcgtaccgctataccagcaagggcaacttggtcgccgttatcagcaacg

SEQ ID NO: 87646 - DNA, 351 bp, Glycine max
  Peptide Sequence Number=SeqID_179331
atgataggaagagccaacaccgaaggatcaaaaagcaatgtcactatgaacacttggatgccacaagccatttatccctgtgaggtaccaccccagctaaactccctacatgacaatgtcttccgcccggatcaatcgagtgaagaagaccctgggtccaaaaagaggggcagtgcctcgcttccgattcacggaataactcctacatatcctaaacttctcaagtcatttcacaaagtcgaactagagtcaagctcaacaggatcttcttttcccactgattctgccaagcccgttcccttggctatggtttcactggatagtaggcagggacagtggaaatcttgttga

SEQ ID NO: 87647 - DNA, 726 bp, Glycine max
  Peptide Sequence Number=SeqID_179332
atggtagaagtctccacagaggccattgcctccctcacccagtattatgatcaaccattgaggtgcttcacctttggggacttccagctatcacccatggtagaagaatttgaaaagatactaggatgtcctctagggggaaggagaccatacctcttctcagggttctatccctcattagctagaatttataagatagtccaaatctcggcgcaggaattagaccagagaaagcaagtcgaaaatggggtggttggaataccgagaaaatatttggaggcaaaagcaagaatcttggcaacgatcgatgcttttctcgcatatcataaccacaaggaaagcccggttgtcgctatgctagccgacctatatgacaccttcgaccgaagatgtgaaaagagcggtacgaggattgtttgctgtactccagctctttatgtatggttggtttcgcacctttttcgccaagaggtgaggcatgcttgcccactagaaagccaccgttcatgcacagagaaaggaggggaaaattgggaccaactcttagcaaacaaagaaggagcgtctgtcaactggttccctcgatggaaagaaggaagaaccggagttcttattccgtgcggaggatttctgaatgttcccttgatggggacgaggggttgcatcagttacaatcccgttcttgctataaggcaacttggcttctatatgagagggcaccactag

SEQ ID NO: 87648 - DNA, 279 bp, Glycine max
  misc_feature (258)..(258): n is a, c, g, or t
  Peptide Sequence Number=SeqID_179333
atgaattttgcagcgagaaagcctatagaattcaccccaattccagtatcctatgctgacttgctcccatatctacttgataattcaatggtagccataaccccaaccaagatgtctctaatgactcatcataattttcaagtgcaagccattggtctgtttgctcaagcgacctgtgctcctgagtttggacttccaagaccgttcaatcagagattacttgtcttgcacgttggtgggggtgctgtaaaacaacgnagtttacttcaaaacggataa

SEQ ID NO: 87649 - DNA, 330 bp, Glycine max
  Peptide Sequence Number=SeqID_179334
atgtcttactttggtgtcattcaagaaatttgggaggttgattatacatcatttagagtgcctgtttttaagtgtcagtgggtgaacgggacaacaggaagaccaagtggaatgaattaccataatgatgagtcaacccttgacattggtcaaatgtctagtttttcaaaacaattgccttcaatgaatgaagctgatgaagtggatgatggacatgcaaatcgtgtagatcatgatgaaggatcatggccacagatccgacgtctcctccacagtccgatggtcaatcagaggcgacttccaagaggagtagaacaacgacacgggtga

SEQ ID NO: 87650 - DNA, 261 bp, Glycine max
  Peptide Sequence Number=SeqID_179335
atgaattcattgcctagcgctgttcatgtgtcctccattatcaagcgtggagcctctgaaaaaaagagagaaggagtagagacgagagtcgtcatcaaggaaagggcaggacggacgaaatcagtgtcttatctttgctttcctcttatctccgatgagagatacttggcaccctttgttgcacgatatgtgaagtcccgagacatgccgaaaatcaaaaggaagcaggcttacgcgatccgtgaaaattctgtaaggtga

SEQ ID NO: 87651 - DNA, 612 bp, Glycine max
  Peptide Sequence Number=SeqID_179336
atggataatgaagagggcgtgcaggaacagatgaaggccgatctatcgaccttaaaagatcaaatggcttccatctcggaggtcatgttaaaactccagaaaaccatagaggataaagccaccgcaaccgcctccagtacagttagggaagcggagccggtgctgcagcccgccttgaatccgagcctagacagaaacacggccgtgttcggtcgaaggtatagtccgcaagcttatccttatggcctgcctccggacttcaccccccgtgccactccggaagatttaagccaagctcctacttttgaagggcagctcccaccttatgaagactatcccggacaagacgatggggaaggagatacccatcttggccccctgctccacctcaaagatccatccccgcatgaactaccccagccgaacatagtccgccatatcccagcctcacccgcacccgtaaaagaatctgttccctttgcggaagataagggaaagattgaggcgcttgaagagaggttaagagcagttgaggacctcggtaattacctattctcggatttggcagatttatgtcttgtgcccaacatcgtcatctctcccaaattcaaa

SEQ ID NO: 87652 - DNA, 356 bp, Glycine max
  Peptide Sequence Number=SeqID_179337
atggggatcgcacccacaaagacacccagtggacctgaagaagtccaacagggccctagggtttccagctctggttacgggcctctgtcggccctacagggcgcccgttccccccagcaaggattgtgcccgcaagacacccagtggacccgaagaagtccaacaggttctacggagtgcctgtcacctccagcaagggcatcaggcccccctactaatcgagctttcatcaagaagtactgtgtcccccaggcaggcgcagggcgaaacaccacagcagcttgggatggccggcagcgggcaatagacgcaccgcccctcacctctagagttcccctcagctcatccataaaaag

SEQ ID NO: 87653 - DNA, 447 bp, Glycine max
  Peptide Sequence Number=SeqID_179338
atggtggggtatgcaccttcaagctttgcggatttggtcttcgccgacaaaaggatcgaagcgggtctgaaaagaggcaaatttgatcatcctactttgatgagtgagaaagctagggcaaatgaagaggatgacaatgaggaaggaacccatgttgtggctgccattcctacatggccaaacttcccaccagcccaacaatgtcatcgctcagccaatattggcccttctcattacccaccacccagtcatccacaaagtttgttggccacacatccaatgccaagcgcaaaccaaaacaccaaccaagaaatgaattttgcagcgaaaaagcctatagaattcaccccaattccggtttcctatgctgacttgctcccatatctgctcgacaaatcaatggttgctataaccccagccaaggttcctcaacctccttttttctga

SEQ ID NO: 87654 - DNA, 387 bp, Glycine max
  Peptide Sequence Number=SeqID_179339
atgacgtggatgccgccattgttgccggcgggaaagcttgtaccgccattgacaactgcgggaacaaggatcccgccattggcaactgcggcactcagcttaacccgccagtacgaacggcgggacgcggagagagagagctgtaccgctgatagcaacggcgggacgaggagagagagagttgtaccgctgatagcaacggcgggacgaggagagagagagcctatgccgccattcctcctggcgggacatgccaacgtggcagtcccgccactgcctcctgcggaacaccttgacgggacaagggccagcgttcacatgcatgctgaatcatttttatgcaggctaggcatgctgaatcatttttatgcagtttatgcaggctag

SEQ ID NO: 87655 - DNA, 237 bp, Glycine max
  Peptide Sequence Number=SeqID_179340
atgtttcattggcttctgctactcttgccagaagaaaggaaggtggcatcgataactggtggagcaagtggtataggtgaatgcgtagcaagacttttctccaagcatggagccaaagtggtgattgcaaatatcgaagatgagttaggccactcaatatgcaaagacttagattcatcttccgccacttacgttcattgtgatgtcataaaagaggaacacatggtgtacgactaa

SEQ ID NO: 87656 - DNA, 600 bp, Glycine max
  Peptide Sequence Number=SeqID_179341
atgaatcaagaagcaggacattcaggctctgctccatcgtcatcacggttaagcaccctcaacaaagaactggaaatggttcttacaactctgcctaaattaacaaatgaagagcacgaacagtgctgtgaaatggccaagatcatgctaaatgtcacggttgcatcagagactattttaaacaccgttaacgccaaggaccagatttacgatgaagttaataggtcatttgttgtgaggtggaaagacgtacttgaccgtttctggcatttgcttgacaaggatggaaatttccataccgttctttacaaccaaaatttggacagaccaacaattgtagcagggtggacaacactaagagatttctatcacatgaccgaagatcatcaagtgtcgttaacccattatggtaagagtgtattttttctcaccgtattcaagagcagtagccatccaaaatctttctcaagatggtactcattataccatcaagttccaaattctgtcactttcaacgtgtttttcactcagcacaaaattacctgcagcagcctggacgttccaagcaccatgtattattttcttaaacacaaaggctga

SEQ ID NO: 87657 - DNA, 387 bp, Glycine max
  Peptide Sequence Number=SeqID_179342
atgcgatttgatgctgagacgattaatgacttcctcgacaccccggtcatcctggcaaagggagaggattatccaacatactcccagtacctccgcaggcctccagaccatgacgccatcctatccgcattgtgtactccaggggggcgatttgttctgaatgttgatgggcccccctggaagctgttgagaaaggatttgacgacactcgctcagacatggagtatggatccgccactcacgactccagaagcctatcatccgcaggtcgcctggccaggagaccagccttccactgacagggggaaagagctttctggagccgccgctactgaggatcctgcagtcgatgaagacctcatagctgacttggctggcgctgattga

SEQ ID NO: 87658 - DNA, 234 bp, Glycine max
  Peptide Sequence Number=SeqID_179343
atggagacgatgagaaatatttatgcttttcaggaagatggtgtccgatggacataccacgttccgaagaaagcattcagaagggttgaaaatcttcatcatgcatgtatgatgacgaagaaggaaaaattaagtagcagcggaatttggaagagagaagggtgtgtctcacctcagttctggatgaggaagctaaaaaatgaatgggttgtcgaagaggagaggggggtttaa

SEQ ID NO: 87659 - DNA, 135 bp, Glycine max
  Peptide Sequence Number=SeqID_179344
atgtaccttaaatattttggaccaacatttgtccatgatgcaagcaagatggctatatcacctccacaatatttagacccttacgcactcctagaagatgaaaggatatctaagatagcaccacgactaaactaa

SEQ ID NO: 87660 - DNA, 312 bp, Glycine max
  Peptide Sequence Number=SeqID_179345
atggtgtttacttccaagcttccactccagttcccattcgagtacctaacgggtaatcaatttcggtttcaatgtatgactctgaaagatgatgctgatgttaacacaatgttaatgtgtaatcatgaattttcatttgttggtccgattgagttattatgtagcattgctagaaccccaaatggtattttaaacttacttgaaactactatgacccctactcatgatgccctgctatattacaatgggaggtggaaaatgtcacgccaaaatgagtttgttggttactcgttcacaggaaaaaatccctga

SEQ ID NO: 87661 - DNA, 316 bp, Glycine max
  Peptide Sequence Number=SeqID_179346
atggcagacacggctaataaatcacacattatcttgctttcaaatagtctcccaattgatacacaaagtatgacatttttaggagaaactagcagtcagacgattgtcaactcaaggttggctttcatttttccaaatggatcaattattcacaatgatactagcgtttacttccaaacttcaactccggtgcccattcgagtaccaaatagctgtgattttgcaagcctaaaaaccagaatacacaatacccttcagttatccggcaaacaatttttggatgaaatgcactactggaagccattcaccgatacag

SEQ ID NO: 87662 - DNA, 156 bp, Glycine max
  Peptide Sequence Number=SeqID_179347
atggtgagcaaaggttggagctttgatggagcttcaatggtgaggaagaagaaaggaatagcaacaagttgtgccacatgtcttcttttgagtggagtaaaaagggtccatactcagtcacaagaagagaaaaatctgacctttttgaaatgctaa

SEQ ID NO: 87663 - DNA, 727 bp, Glycine max
  Peptide Sequence Number=SeqID_179348
atgtacatgtcgtgcacctggaggctttcagggacctggccccaggcagggggattcgcctggggagcggctttattagtccacatgtacgagcatctgaacgacgcgtcgcagacctctacgcggcagcgttgggcgtgctggatatacgagcactttcctacaatgcatacatccgtcattcatgatgcttatgatgaagggagcccacgggcctgcaggtggcttacgggtaaggctcatatgacggggatcaagggagccccgtatcggagacgtcgggatgccctgactgtgactgacgtgtgttggatgctctatgctgagcaccggggagtcaggggctttgacttgatatcgccgtatatcggccaactcagatggggtcagattgtggtgtacgttcgacctgagcgggtggcaccagactacaaagagtggtttttccggatatcgcactcattcgtcacgcggaccgaggagactgctgagccgagacatccgcttccccctcatgatgaggagctcgtcgagccacccatccccgagttttcagtcgcaaccaatctccctacgcattcagtggttcactgcgaaggatgtcagggaatggctgaggatttaggagcgattgctgaggatttggagcgggtcatcaacctcaagatggtcactgaaggcactgacttacatgacatcatgactcgttgtctgaggagagctagag

SEQ ID NO: 87664 - DNA, 771 bp, Glycine max
  Peptide Sequence Number=SeqID_179349
atgacgttcttccagaaagagtttctgagtacttccggaatcactaattcttcttctggaagaaggttcttccggaaagtttccggaaaaagactcttccagaatgatttcgaaaaaaggttcttccgaaaatggttttctcataagggcatttttgccacttcactatttgctgggtgccccaacaataatgctggggaagcaacaagaaaagatgcaaaggaagaaaaatacttgaacaaatgcatgccatcattgcaccaacgaagaggggaagaccctagagaggggaagagaaaaaagaggaaaggggagaggaatagtcgtgtggggggagaggaaaaagagaaaagggagataggaagaggcgtgcaaaagttcaagggtcatttcaaccaagcgatatcattgaagaaaagcagttgcttggataatgatgtgatgcttaatacatatgtcatttggaaggaagacgaaggaagcgattttagtttggaacatgcatattcatcatcatctaatctagaaacaccgattgaaaatgttgaagttgacacaccgtctccaattgtccatccaatagggcaaaaagaagagcaagagaaaaggaataggaacatctacaatccttgggacttgattggcgtggaggaagcaataagggaaataaatattctcaacaccaaactagtagccttaacggagatagaattggaaaatgagtattacgacattctaataaaggacacatctacaatgtctgaaacttaa

SEQ ID NO: 87665 - DNA, 249 bp, Glycine max
  Peptide Sequence Number=SeqID_179350
atggcttctccacctgtcttgcctcctcctcctcctcctcctccttcagacgcatcagcttcgccaccacctggtgctgacaaaccagtggttcatgttaatcctactaccggcaaggccgacggtccctacaagaagaaattaagaacacatttggggattgtggcgcgtgataaggtggacgtcacgtacgagaactggaagaaggtccctactgctcagaaggacttgatttgggaggatattcag

SEQ ID NO: 87666 - DNA, 501 bp, Glycine max
  Peptide Sequence Number=SeqID_179351
atgtcaaactccaccaccggcaccaccgcggccttaccaccaaagcccacttgggtacttccataccgaatcgagaatctccgcgagcactccaacgtcgttcgcatccacgacacctacgaggacaccgccttcatggaggcttgccactggcttggggtcatgcatagggacctcaagcctaagaactttctctttgatactgttgaggagggtgctaaggtcaaaactactgattttgggctctccgtgttttataagccaggatgccgaggggagggcttggtcgtgggttttggtggaggtggggattccgatgatgtctttgagttttccttggcggaggagctcgccgatgcagtcgacgacatgcttggcagtggagctggtgttgaggaccatgccggacttgacatactcaacaaccttgtaggcggcaattttcttgaggtcgtcttgggtgaggatgacgaaggagggggggggggtggatactattga

SEQ ID NO: 87667 - DNA, 354 bp, Glycine max
  Peptide Sequence Number=SeqID_179352
atgaaacccgatcatggtaaaatattctacatcggttgtcctaataaccgatgtagaatgtccgaaattctacatcggtcgttgatgcaattctatcccgcaagggtattgggtagaagactccaagtagattgggctagagatccaagggaaggccctagggttctcatgagccttaggagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 87668 - DNA, 312 bp, Glycine max
  Peptide Sequence Number=SeqID_179353
atgattttaatactgaaaaatgattgggacccgctcctccacgccagagactcgaccattcccactgccactgactccgacgacaaccaagacaacctcgagtgtctcaagagagtgcggagcctctaccagcctttgtccgttattttgccgctggctgccgtgtccgacaatgacgatgacagcgtggacaacctcgagacagtgcgagcgattatgaaaaggtttagtacctatggcgaagttaatggatttgaatgggtaatattaaataggtatggagaggaaggattatttcctatgaaagcttga

SEQ ID NO: 87669 - DNA, 858 bp, Glycine max
  Peptide Sequence Number=SeqID_179354
atgaagggtggtgatgggatgaaaaaggctaactttgaggctctgaacattgttgttggtggtggtggtgttgatttgggtggtggagatggtgggggtgtcaaagttcaaaattttgaggggatcaagggtactcgattgcggaaaagtgaagaagaggaaaaatcccatgtgaagagtaatgaaggtgaagaagaagatgatggccctgagggagagaaagaagatgaagaaaatgttgcttgtagtggtactgctgctggggctcaaagaggacaacaaggtgttgttgttcttggtgaaaatttctttgaagttgaagctatacgtcgtaagagggtgcgcaagggtcaagttcaatacttaatcaaatggaatgggtggcctgagacaaccaacacttgggagcctccagaaaatctagagtatattcctgatattgttgaagcttttgaggagagcttgatgtcaagaaaacatcgtaagcggaaacgcaagcatatggtgcatgatactcaacacaaaaagtgcaagcatacacactcttctcctcctcttaatgatcatagccttcctgatattcccgacttccctcaaactgcgttgttttgtggtggtgctgaaggcagcaatcttggaaaagccacaccggccagtaatgctaacaagtctgcaaatggttcaaaacaaaatattgaaaggaatgaggaaaatgattatgaatctaaagctatgactatcaatgggaatgatacagacaagcttgcaatacaaattccagaagctaagaataaattgaaagatatatatggatatattaaaacttttctaatcaaagtatctcaatttgttaaatga

SEQ ID NO: 87670 - DNA, 1146 bp, Glycine max
  Peptide Sequence Number=SeqID_179355
atgactgccacttggttgaaggtcttgccagctagtctggtggtagttcatcttgtggaacctggacctttgacgatggtcgtcgtagttgctgcgagtaagcaaaccaaaggagcaccttggggtggaccttgggtttctgtatcgggggtggacctcggggtagaccttgcgtaccttgagttcttgtggaaatggaacttagcaaaagtgaggctgaccaaggactatccaagggtggaccttgggactgccaagtttggtgtgcatagcgcacatgctcttacattagagttgttcacaggtataggtcacccacaaactcaaactgatccgaacaatttgggttgggtcatttatgttcttggggtgttggctactaggctcccaacagagaaggttttagcctctcattgtcatgagaggctttacactttagaggctaatgtggatagaagaatagggatggatagaggagagaaggggataagggacatagaaaaagggtttcccctatttgagatactcaagcttaggatgtattcattagagagctttgagtctcgcgcatctttgggcttcttcgtgggccttcttcacgctaagtatgagctagccgctaagcgaggagacgcttatcaccagcttagagaacaagtatgctctagtgttgttctccctaggtatgtagtacatttcaaagcattcaaaattgtcaatgagagtctttgcgacgtgatagtacttgagcaacactatttccttggtctggctttgaagttgagactgagggcttgctctagagtgacatggtcagggcctttgaggatgattcctgccccacttccctttacattggacgcattgtctattgaattctgccagaaagtcaaccttgaattgtgtcttcgtgtggccgcaaggttcataatgatggttgagctaacgacttcgtcagctactaagagatacaagagtagaggtactcctggcctgggtcagctcaagactggtggtgcgacaatggtcttcttgaaagctaggaatgcttattcgcaggaacttgcatccgccgaccccaaaagtacatttttccgtgttgaggcacatgttgtatttgtggagttctctgaagacctcttctag

SEQ ID NO: 87671 - DNA, 975 bp, Glycine max
  Peptide Sequence Number=SeqID_179356
atggttaggactagaggcttaggtcgtgccttaggtagggttattggcagaggtcgggggagagaggatcgtgatgattctgatgatgctccccagcggcgaaggcctatcgcatcaacacacaggcaacgagtatctgtcactattgtcgatgatgagttagtggtacctacggactcgcctgtggtacctgtggtacctgtggctgagcctgtcgtagctaccgatgagccgatggtagatggagacactagtgcagacaccggtgcagaggctgctgcaaatgagcctgagggatttccaagtggatcgaccaacctatccttgcttaccaagtatgctgagcatgttgcagccagcgtatggacgggaaatgagcgtcctgaattgaatttatcctcccatgggaggaaggtgcagaaattaggtagtagacacggacgatcagggacttatatcatcatttgtggagaggtggcaccaggagatagtagtttccatcttcctgtgggggaggttaccatcacgctagacgatgtggcgtctcttattcatgtgcccatcgttggcgacttccataccttccagcctctgcacgtcgacgaggcggtgctgatgttggttgacttactaatggtacgagatacatatcagcgcagatgtcaggccggacattggacaactgcagctcatgcctatcttcttcatcttttgggttgcactctttttgctaacaagagtgcaactcatgttcatgttgtcttcttagacgctctgcgtgacctaagtcagacaaggaggtatgcgtggggagctgctgccctgtgttggatatatgagcactttttgtcaattgcggagtgtaacgctgatccgaactatgacgaggtgtcaccacgtgcatgtcggtggattgctacgaagaagactgtgaagagcatatctatagagacgtataggcagcgcctgaattga

SEQ ID NO: 87672 - DNA, 1068 bp, Glycine max
  Peptide Sequence Number=SeqID_179357
atggtgatgattggagtcccggaaaagaagaaaacaggcctgaaacgtgctcagggactgacgacgaagctgacgggaccaaacggatcagctttcgacggaagcgcggtggcgcgtgggcttcacatgaagaaaatcgcacgagacaaaggcggcatgtgggagctcctttggcggtgcgacttccagggaacccgctctgatgccaacttgaagactgagggtggtggggggaagagaaaggcttccttggaggcttcgagtggtggtgttggtgatggtggtgcttctattccttctgatggtgttgatttgtgtggtggagatggtggggaagaagatgatggcattgaggaagagcaagatgaagaagaaaatgttgctggcgatggtgttgttgttggggctcaaggaggacaacaaggtgttgttcttggtgaaaatttctttgaagttgaagctataccttataagagggtgcgcaaggatgtgacaaatgatgttgtaaaaaataacgagagattcaaagaaaatgggtgcaaatgggttgaaagaggatgtggatgtatggatatcattactcaaacagaaaagggcctaatgaatgggtggcctgggacaaccaacacttgggaacctccagaaaatcttgagtctattcctgatattgttgaagcttttgaggagagtgtcattgtcgccgaacgcgaaccaccgcacgcccgtctcgttgcgatccatggcacacggatcgcggaccacagcccgccgcggaacgaatgcgagggggtgggtggtggtgggggagtaccagaggttgatgtaggggagacggcggggccaggaggtggaggaggaggcgacagagaagaggaggtggcagcgcgtggggggggagaggcgggagatgaaggcagagtagatgaggccgagaactatgaacgcgaggcatacaaaggtggggtattttcacgtcgggaactacgaggtacaaagcttattagtagagagcatgagttcaatagctacgggatggtgtatgtgcaaattaaacctaattatgactaa

SEQ ID NO: 87673 - DNA, 176 bp, Glycine max
  Peptide Sequence Number=SeqID_179358
atgtctgaagaagttgatatggattatcaaaatgaagaagaatgtggtgtgagtgaaccacatgttgattgtttgaatgcgtttaatacttctcaggtgtttgacagtcgagaggatgttttgtggtgggctcgatccgtcgctcatgaaaatggatttgtgacagtgattataag

SEQ ID NO: 87674 - DNA, 527 bp, Glycine max
  Peptide Sequence Number=SeqID_179359
atgaacaagctttgaatgagggtgaagaagctgctgctcatgttcaacaagatccgatggagattaatttatctcaacctcatttgtcacaagatagtgacatggagttgatggtccctgcaactattgttccaccaatagcaaggaataagctaaccataacaagagcaaaacaaagaaaggttactgataaagatgatgcagttgctgagtttgaagttcgaatagctgcacgtcatccatggtggcattgccgaatgaaactaccagaaaatgcacaacaactgccacttgcagacatggagaaatcaagtgaacaagaagcagcgactgagcctcagaggagaagaagaagaagcgactcagcttgggaaaccagcagcttcgtaaaccctaatttatttggggaagaagaagaagcaaccttgcgtgagagagaatttatagatgcagacctcagtgccacgttggacaatctacgtggcactgaattgccacctatgcacctcactaacgtcgtcacctga

SEQ ID NO: 87675 - DNA, 204 bp, Glycine max
  Peptide Sequence Number=SeqID_179360
atgtggttggacatgtttttaaagttaccttatacaagaggcttcttggcatggtttcaagaatccttcttcttggcatgggccgctgctattgctggtgccactaggacctcagggatatgtggctccacatatggaacatcttgcgtcacaggtggatgtctagccagatcagcaggctatgccgatgtcatgaatggatga

SEQ ID NO: 87676 - DNA, 744 bp, Glycine max
  Peptide Sequence Number=SeqID_179361
atgcactatatactccatgtgcaactattggtggaaaagaataaaaatctagattttaagaaggccctagaacttgctgcagatgcccagtccattaaagtagatcctcatgtaacagatgataacatgtgccctaaacatcttgctgtatttgtgcatatactattatactctgatcctattttaataatgctttgtaatgttttttatgacatgatattatactttgatcctaagagtggtcaggttgacaagggggtgaatgcagaatttgttcgatcgatccttgtagaaagagcaaattttccctgtcttgcagcaaaatcagcgtataaagaaacctcatttacagaatttctctccctctctctttgtatatggaagaattatctaaaggaaccttttcctaaagttgttgaagcatactcctggccaacaagaattgtccgtgggaaagaagatgaacttcatatggaggtggacgagactgcttttgtgacaaatgaagagagtgttttatgcggcacatttttgtcagtcaaaaagagtatcaatcctggttttggcatcgatgattttgcagaaatttcatgtcagttaatacagccgcttgaggatttcttcaataatgtctttataatggtggacgatgacaagatcagagtaaacaggttagctctgctaaaaggaattgctgaactccctaaaggaatagcagaccttactgttctgccaggattttaa

SEQ ID NO: 87677 - DNA, 496 bp, Glycine max
  Peptide Sequence Number=SeqID_179362
atggcgaaacacatatttcaccaagaggaacagcaaaataggtgcatatttcgccaagaggaactgcgaaatagctgtaggtcaggtggtgcagagtgcaacctttgtgcaatggatttcaccatcctcattggcgaaacaggtggtgcaagtgcagcttttgccattttcactggcaaaataggaacaacccacccctctcccccttccctttatacaacactcttcaccggaaaatatgttgcgttgcaaatttgcgatgacgaagatgttgaaactatggtcgaaagttttcaacaacaggaacaaatgtcagttatagaaatgtacatagaaaaggatgttgctggtggttctacgtttcattctgcaaattctgttacatcatgtggaaataagtctttagatgaagatgataatgttgatggtatatctgatacagatgatgaagtcatccacatgattgaaccagttacaattgttcacccaagagaag

SEQ ID NO: 87678 - DNA, 357 bp, Glycine max
  Peptide Sequence Number=SeqID_179363
atgtgggatgtagctggagatgattttggatcacttgatgattatggtattcttgaaattgctagtttgtctttagatgaaccagagttagaggaaaaggaggttgaagttcgtggtcctcttgttccaaaagcaattgatcatgaaggaaatccaacaaaggccattgagggcttttctcgtagatactctgttccacttgatttggtatacagactggttaatggtgagtatccagaagcggaacacttgttgagtggtcctttagtaggtacttcaatgcagtttcctgatgttgcagggaaaatggaatatgtttatgcacatataaaggagtcttcaagacatgctttggag

SEQ ID NO: 87679 - DNA, 465 bp, Glycine max
  Peptide Sequence Number=SeqID_179364
atggggaagaagataaagaattacacattagacgagttgttcccacgtatcaagcgccttgataaaaagttggaggccagaaacacatacttttcacatgagatgcaaagcactattactcctcaagaggtctctgttttattaggtctccttgtggatgggccaacccaattaagacatcttgacccattcattagaggtgtcttatttgttgacaaaggcagtagcaaagtttcgctaaggtggctgcgacgtgtaaatcaacatatcgacaatgatgatttgattgttttttgtcacaaattagatattatgaaacgacatgagtttgtgtgggagccttacacaacaaatgttatgtcagtgttgtcttcaatttgtttagttggaagggtagtgtggtgcgcggtggtgccactaatttgtttccaagttattgagtggcaccacctgatagagtgttga

SEQ ID NO: 87680 - DNA, 918 bp, Glycine max
  Peptide Sequence Number=SeqID_179365
atgcatgctggcgacatacatggtacgcggacacgtggcaatttcgccactaacactggcggaacaggtgtagtgcagcaggttttgcaagcactactggcgaaacagagccatgtatatgaagagaatgatagtgtaatatttgaaggcagtaaaaaagcggttcagattaaacgaaaatatgttgcgttgcaaatttgtgatgacgaagatgttgaaactatgattgaaagttttcaacaacaagaacaaatgtcagctatagaattgtacatagaaaaagatgttggtggtggttctacgtttcattctgtaaattatgttaataatttatctaataatgagtcggaactgccaagaaatgtaagtgctttagatgatgatgatgattatcttgtgtctaactcatacgttgaagactctttagatgaagatgatagtgttgatggtatatctgatacagatgatgaagtcacccacatgattcaacccattacaattgttcacccaagagaaggtgtagaaggaattcaaaatccattttggaatgatgttttgcattataataatgtcaattggagtcatcctgatgaggaggacatttgcggtttggagatgtcatcgagttttaatgttgggcaagaattatatgttggtatggattttgatagtaaagatgcggttgttaaagaacatcgaaaaaatcaagaacaagcttgttcgcacattgtccgcgtctatgatatccactcgacaaggtttgaagtagaggagaccttcaatcctataacgcaacgtgacggacaaaagtggacagttaacttgaatgaccattattgtcaatgcggaaagtattctgcacttcactatccatgttcacacattattgctgcttgtggttacgtgagcatgaactag

SEQ ID NO: 87681 - DNA, 2241 bp, Glycine max
  Peptide Sequence Number=SeqID_179366
atgaggcttgttattagaatagcttcaatccaaccacgtgcatcatcttcaatttcccaacccaaccctactttttcatcatctgaatcaaatgcaaactcacaattcaacaaatctttgctctcatggaaccgactcaagcctccctcaaccaaatgcaacttccccaaactccgccacaagtggaagcaataccaaggaatcaaccactgggaaggcttgctggatcctcttgacgatgacctacgctgggaaatcctaagatatggccactttgtggatgctacatatagctcctttgactttgacccttcttctcttacctatgccacatgtctttactcgaagaaatcgctattgaacaagtgcgggttgggaaactatggataccgattgactaaatatctacatgtcacgtgtgggattcacatgccaacatggataaataaattttttaaacaagcctgtatccggtccaactggatcggatatgtggcaatttgcgacaacaagaaagagattacgcgtcttggccgacgtgacattgtaattgccttcaggggaacggttacttgtttggagtggttggaaaacctacgcgcgaccttgacacacttgccggatcacgtggtcggagaaaatgatggtgttggtcccatggttcaaaaagggtttttgagcctttacacctccaaaagcaccacacgtgcaagtttgcaagaaatggtaagagaagagattggaagagttattcaaagatacaccaatgaaccacttagcttaaccctaacgggtcacagccttggagccgcactcgcaatcctaagcgcgtatgatataaccaccaccttcaagaacgcaccaatggtcacggttatatcttttggtgggccccgcgtgggaaacgagagttttaggaagcaattggaacaaaatggaatcaagatactaagaatagtaaactccgatgatgttgtgactaaggttccgggactcgtggtgaatttagatgatgtggcgagtaatgaagatgtccacatgggaatttggtcaagatggttgcacaagtacatagaagacatgcaattggtgtatgctgacattgggcaggagttgaggctaagtagcaaggagtttccaaatcttaacaaaggagatgttgccatgcctatagcatccgcacgtaggcaacgggaagctatccctgttgctgaggatgctcctgatatgactgaggacgtacctacacctggtgcagaagctgctgatggtggtgagggatttgctgttgatgatgctcagggattcccaggtgggtcacatgacccatcagtgctgactgagtatggtgaccatgttgcacttagcatatggaatggagaggaactccctgaattgaagttatcctcccatggaaggaaaattgagaaatttgggaggctcgctccagaaattgaaaggctagtcgctgccacaggattaactcctttgatcacatgttcagtagacactgacgatcgaggagttatatccgcttttgtcgagaggtggcacaaggaaactagcagtttccatctccctcctctgcatgtggacgaagcggtgttgatgttggtgaagttgctagaagtctcgggtgaggaagctagagctgaggctgcacaatgtcatggggcatacgcttattcgaagggattcccagcattgacgtaccagacacgtataaatgcactgacaatccctgatgtatgttggatgccttatggtgagcatcgaggagttaggaccattccttcactgcctatgggtgccagcttgtcatttgaagatattgacaacaagtggatgcattacttggaccatctagcagcagggggacaaatttgtcttgtgcctggccagtgtgcaccagattacatggactggttcttcaggatctctcatctgttcatcacacccatacaggcagttgatccacccaaacatccacttgtcccacagcatgacacatacgtggagtcagatatccctgaggtcccaatggcaccagaagctggaccttcacatgcaccttctgatgcagagcaacctagacatgcagtggatgcgtgccaagcgatcgcaaaaaggttggagcgtttgctcaacctaaggatagtcactacaggcacagagatacatgaggtcatggaagactacatcaggatcgctaggggtatcacagtagatggaaatgcttat

SEQ ID NO: 87682 - DNA, 1332 bp, Glycine max
  Peptide Sequence Number=SeqID_179367
atggagattacacaattcacctactttcagcaggctggaagtctccagttatcacctgtatctgtagaaattacttatggccttgagcgtatcctcatgttactgcagggggttgatcacttcaagaagatcaaatattctgatggaattacatatggagagttgttcttggagaatgagaaaaatgcttatggtttgatggccattatcttggctttgattgagaggggattgcaaggaaagaaggaaatgagtgcatattacttggagcatgctagtgttgatcacgttcaaaaacattttgattttttcgaggaggaagctcgtagcttactttcttctggccttgcaatacctgcgtatgatcagcttctgaaaacatctcatgcttttaatatcctagactccagaggctttgttggagtaacagagcgtgctcgatattttggtcgcatgcgtagtttagctcgccagtgtgcacaactttggttgaagacaagagagatgcttgactttccccttggttttatctctgaacctgatcattttgtattgccaaaagaagttttggaggctgcatgtgagaaggtgcatgatcattcaagagcatttgttcttgaaattgggactgaagagatgccacctcaagatgttgttgatgcaagcaagcaactgaaagatttattgctgcaactgcttgaacggcaaaggttaaaccatggtgaagtgcaagcttttggcaccccacgtagattagtggttgctgttgaaaatctttgcaccaaacaggcagaaaaggaggttgaagttagaggtcctcctgtttcaaaagcatttgatcatgagggaaatccaacaaaggccattgagggtttttctcgtagatactctgttccacttgatctggtatacagaaaggttgatgggaaaacggaatatgtttatgcacgtataaaggagtcttcaagacatgctttggaggttttgtctgaagatttgcctgctactattgctaaaatttcatttccaaagacaatgcgttggaattctcagacatggataactcttgtatctaactcccacacatgcaagagccccttgtgcttgaaacatggacactgtgcatgcccattgcccatcatacctggtggcggggtgttgctaatgaacgccctaagggtatttagtttaaaagcactgaatactctcaattactataacgaggttatgtttagcaggcctatccgttggattttggccctgcatggagatgtagtagtcccatttatgtttgctggggtgacgagacaccgtttcatcagaacttcatga

SEQ ID NO: 87683 - DNA, 1458 bp, Glycine max
  Peptide Sequence Number=SeqID_179368
atgagtgagatagagagcgagagtgatagagagagagaggagagagatgatatcacaactttctatttcacgaggttccccgaagatacaacggagaaggatctttgggctcaattcaaaaaatggggggatgtgagggagatcttcatctccaaacataggaacaaaggtggcaggaggtacggcttcgtgaggttcaaaggggtgtctgacaagcgcagattagaaagacagctagacaacatcattgttggaggactcaagttgtacgtgaatgttccaaaatatgggagaggaaaggagaggtatgaagagtccagagtcaaacccaggacacagcttgagatcccggcaggggagaagaaatggtacactaatgtatgggtgggctgcgtgaagaaatcgggaatatccgaaagagtcgaggacgaacccccttgggaggtgggaacaaacgtggtgccgaaatacctaggggatgatatgatactcctcctaggtctctcggataccaaagcggaaaagctcatcatcgaagaaaccagacatggctcatccccgtttcattcgttggagaaatggaatccaacgatgagatcgggacacagattgctctgggctcagtgttggggcatcccatcagaagcgtgggatattgggcaaattcataaaattgtcgcagcaataggggacttggtagaggtggatgacaacgttgaagagttgcgaatgctagatagggccagggttcttatcagaatcccatggagacctattttccaacatatggtcgaagttcacatcagcggggagcgaagccggaagaaagcgcatttaccattgtcggagcgccatcggtcgtcggaagagatcgattctgacgacaacgataacggcaccccgaagtcgaagatgagcagagaacctagattccattactcgcccagaagctttgctggtgaacgtatcggcgagatcgagtcccagcagcgcgcgacattatccaacggtcctcgagacactgaggacccaacgggtaacgactgcgttagctgggcacattgccccaaatacgaaacatgcgcacctgatatggaaactggaaaagtaacagaccctgtatcgcggcccgtgctagacccagaggcacttttcggtgaagacgaaatccttaaagcacaaaaacagaaaaaacaggggagtagaggcacgactcccatggtacgtgggtgctttgaaagggaaggtgctgaccctgcccacggtcaaaatggagctgaccacgagtgcctcaacgggtcacaaatgccaattaataaagaggcacgtgatatggcaatggttgttaatgggcccacaattaatttgggccttactaaccacactaccgctattttttcacaaaataactgcaacagcccacaatatcacaaattggataatggaagcacgtggaag

SEQ ID NO: 87684 - DNA, 693 bp, Glycine max
  Peptide Sequence Number=SeqID_179369
atgtcccttaagcatgtgatcagagatacgatcttcatatccaagtgcatagaagatcatcatctgttgggaaagggagctagtggcaaatcatgtgactatctgttcaagctccttctgattggagactctggtgttggtaaatcatgccttcttctaagatttgctgatgattcatacattgagagctacataagcaccatcggagttgattttaaaattcgcactgttgagcaggatgggaagacaattaaactacagatttgggatactgctggacaagaacgatttaggacaataactagtagctactatcgtggagcacatggaatcattattgtttatgacgtgacagatgaagatagcttcaataatgtgaagcaatggctcagtgaaattgaccgctatgccagtgataatgttaacaaacttttggttggaaacaagagtgatctgacagcaaatagagttgtctcatatgacacagctaaggaattcgcagatcaaattggcatacctttcatggaaacaagtgcaaaagatgctacaaatgtggaagatgctttcatggccatgtctgctgccatcaagaatagaatggctagtcagccttcagcaaacaatgcaaggcctccaacagtgcagatcagagggcaacctgttggacaaaaaagtggttgctgctcttcctaa

SEQ ID NO: 87685 - DNA, 279 bp, Glycine max
  Peptide Sequence Number=SeqID_179370
atgaatggaattgttaacgcgatcgaaaagggggaaattgaacgtactactcgggattcatatcgaggaagcggtgaattcgccggaaaagggagagttatcgccggagaaatgagaggatccggtgctgcacgaatggcaccaacggaagggaaaaggaaaagaagaaggcaatacggtgacgtattaaagtggcttctgattttgttgcgcttctccattcacacatggcaacctttgacgctgcctgctatgtgtgtgggtcagacttcctattaa

SEQ ID NO: 87686 - DNA, 321 bp, Glycine max
  Peptide Sequence Number=SeqID_179371
atgacacaaaggctgaaaacaaagaagctgaaaaaactgcaaaaatcagagagttcaaaagggaggtttaagagttgcataacttttacaaagaaccaacaagtggcgccgtctgtggggaaaatgatcaagatcaagaaagatgggaacaacaaaagaatcaagatggaagcaatcttgattcaacatggctgtgcagaagctcttaaaggagaagaaaagatgtctgaatctctaagctcaaaggagaaatcagagatgattgctaaagccaaaagtgcaatcattctatgccttggagataaagctttaagagaagtt

SEQ ID NO: 87687 - DNA, 1316 bp, Glycine max
  Peptide Sequence Number=SeqID_179372
caacccctgatggactgaaagggtatcgcgtcatactaagagaggcacctctagcctctactgaagggtgcaaccttctgtggcttccccggcgaagtggaagagacgtaagggtgtccccccgtgtgcatcgcaaccatagtgtttggtcgttgttgcctctacctgtcattgttgactttgagtgggtgatggacaatgttatcaagtataagtcctccttcacctctacaatgagtatttttgctctgcaacgccagctaaagttggcaaaccctaaggactcgtgcaaaataatcgtcgaggcttgcaggagtgatgacttttcgtttctaagggcggcgttaggcaatacgcccaccttttttatgtataagtgtctgtttgaggtcttgggtctcgttcttcccatgactacattccaacgtgctatgcttgagcacttgaacatggcgtcttccaactccacccaaacaattgggccatgtgtgtccaagaagttttttgagttcgactcaaacgtctttcatcgcttcaaagactatttcttcaaggttctgtctactgatgtcgtggctgatgagggtacatctacttgggttgttgtaagtgagaacaaaagagggtacatctcttgtggatcagttcaagtggagggtttttacaaggttgaaagaaatctcaaggaccgcaggttgcttgtggactggatgccacttgatccaacaggtgggattgtgccatcttccattgtcatccctgctgctggagaagggggtcaacctgctattgaggttggctctgttgcttgtgctgctgaggttgctcccaggatgatacctcttccgccaaccaaagttcttgctcttgaagctactgcagttgttgttactcctgttcatgcacctccttctgttgtgcctgttcaagaggtcactcctgctgctgaagttaatgcgccagttactttgcctggttcagttgtttatcccttgttgagtgttagtgtagcgactatgagttctcctgagatgttgcctcctccttctttagttccctgggttctaccctatgttgtgttggtagctgcatcacctttctcatctttttgcccctatgtctctttggatcatttgcacacctttagcaatgccgatttatcgtggggtgcaacttacaagttgaagcagaagaccccgattggctatgcgtcagcctttgataagaatctatgtccggttagctggggtgcagaacactatggattttgcaagggtcttccaccagagaagtttggcgattctagaggagaataa

SEQ ID NO: 87688 - DNA, 129 bp, Glycine max
  Peptide Sequence Number=SeqID_179373
atgtggcaagaatatgaaggagatcaatggggtcttgatctaaggagaaaaatgacggcaaatggtcatcccgtgtcaactcgcattcctactgagatggacgaagacgacaatgaacaaccaatgtaa

SEQ ID NO: 87689 - DNA, 1647 bp, Glycine max
  Peptide Sequence Number=SeqID_179374
atggcttctccacttgcctcgcctcctcatcctcctcctcctttagacgcatcagcttcgtcgtctgccctgaagcggacatgcaaagcctcacatctacgatccttgtctaccagaccacctggtgctgatagaccagtggtccacattgatcctactactggcaaggctgacggtcctcacaggaagaaattaagaacatatttagggattgtagcgcgtgataaggtggatgtcacgtacgagaactggaaggaggtccctactgctcagaaggacttgatttgggaggatattcaaactatcggtgagagatggaggcagtttaaatcagacctcacgagaaaatgggcccttgaaaccgatcaggacggtgtggacgacactgtctgtgataaatacgacataagcaaggaaaaatgggcccagttttgccagattcacagagacccttcttgggagaagctcctggctgagaagaccaagaagaagctcgaggaagctgttgatggtgtcatcgaccctcgatccctggtcagacgccgtgtgaagtggaagatggcccgcatgaagaaaacagggattcctttgaggagcaggcgacacagggatccttcatcccccatgggggttatgatgttctcaccgttgctattggacgtctggagcaccttggacgtgtccgtgttgctggagctggtgtcaccatcaagcaataatttggatcgggaccagctagaggagtccatcacagaaaaagtgacgcggcagttcatggcatcattcagccaaatgcaatctcagggacatgcattgcctcccgagcctctggttgatccctcaggtcctcaagtaagcacaaaagggagttgtgttgatccctcaggaaacgatcctgagacagatgacttaaatagattaaaggtaggtgtggaggaggttaaagatgcagatgctccagttcctgtacccattgatgaggtttccttagtggagcaggcaattcacaccttccttgcttggctgacacatctggtcaagtctttattactgcaggcaactgtgtctccggtaaaaccacctcaaaagctcgatctggaggtcgatgattcattttatctgatgacattgaccatcccagagcttttcttgaggccttaccaggttacatgggatgccatcgtgttcggggtctttaatctagacttcctgctctacataaagcacgaagacctttctgaaatcgcatatggtggtcaatgtcttagcatattagttttacagttgtgcattctgcatctgactgaaacaagtaagcgagcggggaattctgatatctgtgaattcctcgagccacagtccattcagaggtctgggcaatcgcaatttgagactgaaagttacataaagagttggatgcaaagttcaaaatgcaatgtctatcttggagcctacctgaatggacaaaaaggaagtactgagtgcggctattatgtcatgcactggatgtccaccgtcattttaggaagttttaggaataattgggaagcgtattttaacgatcctagaccattggagccagagagattaaaggcactgcggatccagtgggcacagtattatctccgagttagagatcagacctag

SEQ ID NO: 87690 - DNA, 711 bp, Glycine max
  Peptide Sequence Number=SeqID_179375
gagttttactccaacctatatgatccagaggatcgcagtccgaagttttgcagggttcgaggacaggtggtcagatttgatgttgagacgattaatgatttccttaacaccccggtcatcctggcagatggggaagagtatccagcctactcccagtacctctgcactcctcctgatcacgacgccatcctttccaccttgtccacaccaggggggcattttgtgctgaatgttgatggtgccccgtggaagctgctgcggaaggatctgacaacattcgctcagacatggagtgtcctttcgtattttaatcttgctcctacttctcacacttctgacattaatgttgacagggcccgactcatatacggcttggtgatgaagatggacttggacctgggcagccttatttctctccaaattgcccagtccaacacttccaggctcgggtttccagcgttgatcacgacgttgtgtgacattcagggggttgtctctgataccctaatttttgggtcactcagtcttgtgatcaaccttgcttatattcggaagaacagatggaaccccgcagactcctctatcacatttccaagggttcgccgtccacgcaccagagcccagggtcagcatcagaggctccttttcctccccagcccccttctcagccttcttcccagggaccgtgcccttcacttgcatccaccttag

SEQ ID NO: 87691 - DNA, 455 bp, Glycine max
  Peptide Sequence Number=SeqID_179376
atgaagatcgcaggagtgccagaagatgcaataaggttgagcttgttctcattctccttggttggtgaagctaagagatggttgcattctttcaaggggaataacttgaagacatgggaggaagtagtagaaatttttttgaagaagtactttcctgaatcaaagacagttgagggcaagacatccaagcaattgttaaatgcttctgctaaaggaaaaattaagttgaagactccagaggaagaaatggagctcattaagaatatggctactagtgaccatgctattttgcgtgatagaacacatatacccaccaaacgaagcctgttggaactctcttcacatgacgcattgttggcacagaataagctgttagccaagttggaggctacaatatttgtggagaagctcatgaatccggctgttgtataccccaagatgattcagccaaagag

SEQ ID NO: 87692 - DNA, 153 bp, Glycine max
  Peptide Sequence Number=SeqID_179377
atgtcgagcgtgacaattcacgttgagcgcaatttcctctcgggttggaattgcgctcagtgcacttctcgccctaagcaagaggctgaggaaaggcactgtgagattctaggtcaccttctatacaccgctaagctggatgtaaagcaataa

SEQ ID NO: 87693 - DNA, 333 bp, Glycine max
  Peptide Sequence Number=SeqID_179378
atggctcgtaacgaggagaaggcgcagtcgatgctcaaccgcttcatcacgatgaaggcggaggagaagaagaagccgaaggagcgccgccccttccccacctcggagtgccgcgatctctcggaggcggacaaattttccaagacaaagttctctcagattggtccatcattcacctccatgactttatccggaccattgttgtcgaggaaggtggcacgtgctgtcgaatcccccatcgtctttaccaaggacaaagtctcttcttcttcctcttctgcatccccacctacttcgacaccgaaaccagcatcggtggcggaatctcaataa

SEQ ID NO: 87694 - DNA, 1005 bp, Glycine max
  Peptide Sequence Number=SeqID_179379
atgactgaggatgttcctccgatgactatgaacgtacctgtagttggtgtagagggcttagttgctggtgatgttgttgcgggatcaattgctgatgatgttgtcgcgggaccagttgctgatgatgctgagggattctctggtgggctacgtgacacatcagtgctgacttcctttcctgatgatgtttcacacaacatatggactggagatgaacgtcctaacttgaagttggcctcccacggtaggaaggtagagaaaattgggaggcgccttgcacagcttcgaacctctagttatagaggaggcggtcgtcttgttgatggagttgctcaaggtctcggatgcgaggcccgacagtggattgtagcagctcgtgcttatctcctccacttggttggttgcactcttttcgctaacaagagtgcaacatatgtccatgtagtgcatctgagggattttcaagacctgggtgagagtgggaggtatgcctggggagctgccatgctgtactggatatatgagcattttcctagtgttcatgactgcgtcactgacgatgcgtacgatgagacatccccacgtgcctgccagtggcttacgacgaaggcttatatcaagggattgcgagcaccggcgtaccagacatgtttggatgctttgatgatcactgacatgtgttggatgccctatggtgaccatcgaggagttagggggtttgagctcatttcgtgcttccagggccaggtatcaacagattacgtggagtggttcttccagatatctcatccgttcgtcacacccacacaggcaggtgatgaacccagacatccacttgccccacaacatgaggaatacgtcgagccaggtatcccggaggatggttatgaaggttgtgaagcgatcgcagaaaggttggagcgtgtactcaacctaaggatggtcactaaaggcacaaagttacatgagatcgtggaagattgcctcaggatcgctagggggtga

SEQ ID NO: 87695 - DNA, 4464 bp, Glycine max
  Peptide Sequence Number=SeqID_179380
atggaagacacgcagcatgagccaattcttggggcagtcattaagcacctcttgggcaaactaaacttcagtacagtgttttctgagtcaatgaggaatatagaaattaatgaaagctttttagaaagtttttgtaacagattgcagttatctttattggaaaaaattgtcatcggtcttgctttatctgattctgagaatcctgatgccaggctgtgtgctcggattgaggaattgtgtgccaaccctagttctttgagttaccatgagcaaattcacaatattatcatgttcctaaagcagtctgagggtctttccaagcatgtggattcctttatgcagatattgtcacttgtccaattcaaagatacaccaccttttttcttgactcgattgcttcctgatgagatgaacgaggctgattttttaaggaatatggagttgttacatgacagtggagaaaatgattttgatgctattttagcagacatacagaaggaaattaacataggagatatcgtgaaggaactaggctatggttgcacggttgatgtctcagggtgcaaggagatactctcgctcttcttacctttaactgataatgcgctatctaaattgcttggcgctattgcttatagtaatactgggctggaggacaaccagaacacatacttaacatttcgtgcagcccatggatacaatgtgtctgagttgccgcttctgaactcttggaatattgatgtcttgatagatacagtgaagcaactagcaccacaaaccaattggatacgcgttatagaaaatcttgaccatgaagggtttttccttccttgtgaagaagcattcttttttctcatgtcagtatacaaacatgcctgtaaggaaccttttcctctccatgccatatgtggatctgtttggaagaacactgagggtcaactgtctttccttaaatatgctgtatcagcactaccagaaatgtttacctttgcacgctcaggaagacagctggcatatgttgatgcagttaattaccacaagcatcaaaatgaacatgcaaataatgcatggctgtgtcttgaccttttagatgtcctctgcctgctagctgagaagggtcacaccagcattgttcgatccatccttgattatccccttaaacactgtcctgaagtcttgcttcttgggatggcacatataaatactgcctacaacctcttgcaacgggaagtatctctgattgtgtttcccatgatagtaaaaagtcctgcaggcagtgggatcattctgcagctttggcatgttaaccccaatctggtcttgagagggcttatggattctcaaaacaatgatgcagacagcattataagaattgtggacatctgccaggagctaaagattctatcatccgtggtggaaattattccctcttattatagtataaggttagcagcttttgcatcaagaaaagaattccttgaccttgagaaatggttgagtagaaacttaaccacatacaaggatgtcttttttgaggagtgcctcgggttcttaaaggatgcccattttggtggatcacagaacctttctggaaaatcttttcatcagtctggtgctgttctgagtctctgtgttgagacaactgctacctttttgaaggttcttaaatctcatactgacttagttacctctagacaacattctgaggagttggagaggctgcatatatctataatagattgttctcagttacatagcgcagtcagcacctcctcaatgccttcgtctcgtggatttgtttgtccttcccgtggagctacttcaatcagtatatttctgttaactatacattgtgttcctttgatctgtgcatctgatgtagggtttggatctgccttgaacattgaaacgttggctgctgctgctgagaaaagagaaactcctattgaggctccagggtcagaggttcaggacaagatatcacttatgattaataatacttttgcggctaacattgattctaaagcaaaagagttcactgaaattttgaaagagcagtattatccttggtttgcacaatatatgggtatatataccgtgaagattgaagatagtgactatacttggggtttcatgaactcaatgatagaagctgacagagaacaggaagtcattaaaactcaggatctgaaggagttgcttggggaattagagatggacgcaagcattgagccaaattttcatgacttgtacctgaaattcctggataaagttaattcaaaggctttgaacaaagagattatccaggcaacttatgaaaattgcaaggttcttttaggatcagagctcataaaatcaagttcagaggaacgctctttgcttaaaaatttgggcagctggcttggaaagttaacaattggccggaatcaggttttgaaggctcgtgaaatagacccaaaatctttgattatagaggcatatgagaaggggctaatgattgctgttattccatttatatcaaagatcctcaaatcatgccaaagcagtattgcatatgaaccttctaatccttggactaagggcattttgagattgcttgttgaaatttattcaatgccaaacctgaaaatgaacctcatgtttgacatagaggttttgttaaaacatcttggtgtagatatgatggatgtcacaccaacttccctcctgctgaaggatagaaaaagagaaatggaaggaaatcctgatttctctaataaagatgtcggggcatcatcaaaaatgattattgatctaaaatgtggccctgtacctccagtaaatgaagctgaattaccacttgtagtcaccaatccatccaatacgggggctcatccacatgtagtgtctcagtatgctggtcctcttcatatttcctcgggagcattgatggaagatgaaaagtttacacctctgggattgtctgatcaactttcctctgctcaagtactgttacaagcaactcctgcctcagctcctatttctattagccggcttccaatacagatacctgatattgggactcgtgctattatcaacgaaaaacttggtggttttgggttgcaaatgtattttaatagggcgagccctggtgcagcggtaaagttgtgccttggtgatttgttggtcatgggttcgaatccggaaacagcctctttgcatatgcaaggtcaactgaggaattcacttcaaaacttaaatattactaatgaaattttggaacaagctatgcaacttgtcaccaatgataatattgatctgggatttgcagtcattgaacaggttgctgctgataaggcaaaaaacaccattgatacagagattactcaacaactctttttgagaaggaagcatcgagaaggtttcagttctacatttttttatgcaaacaaggaagaattcaaaggggtagattctgttgaaccagatccttctgggttctgcaagcaggttgccgtgttgtttaaagaatggtacaggatatgtgaatttcctggtgccaatgatacagcttcagcccacttcatcttacaattgcatcagaatgggctgcttaaaggggatgatgttacagatcactttttccgacaattgatggaactagctattgcacattgcttatccactgaggtgattaatttggggtcactgcaatctcaaccaccgacaatgtcatttcttgcaattgatatttatgcaaagcttgtcttctcaatcttgaagggatcaaacgaacttgttcttctttccaagattatggcagttactgtccgattcattataaaagatgcagaggagaagaatgccttgtttaatccaaggccagttttcagattattcatcaactggcttctagatcttggtttgctagagcctgttactgatggtgcaaatctccagattttgactgtttttgccaatgcatttcatgctttacagccgcttaaagttcctgcattcaggagcttcatgccaaaaatgttgactggtaatggtcaaaaaggttggccttatatccaaaggttgcttgtagatctgttccaatttatggagccttttctgaggcatgctgaactaggagaaccggttcgtgtcctctataaaggcacacttagggtgctcttagtgctacttcatgacttcccggagtttctctgtgattatcactttaccttttgtgatgttattccttcaagttgcatacagatgaggaatatcattctaagtgcatgtccgcgtagtatgaggctgccagacccatctactcctaaattgaagattgatttgcttcaagaaataaaccaatcgccgagcattctgtcggaggttgatgcagcacttaaagcaaagcagataaagacccatgtagatgaataccttaaggcctgtccccatccctctttgaattggtttgttattaattga

SEQ ID NO: 87696 - DNA, 837 bp, Glycine max
  Peptide Sequence Number=SeqID_179381
atgtctccgacaaggcgtatggtctcgggtgcgacatggccggctaaggaattaagggatatttgggttggggttataagggtcaaaaacgggtatattaggaagggccgggtcatccttatcagaaatgaggagaaaaaacctcgaggcgcaacgatgccctcgatggaatttctcctcacagttgaagcaaagtcccctctctctgcgggaggcaatctcctccggggacaagcgcttccaagtgtgcgatggtgggcgattaggtggtggaaggaggggggtaaggttggtgagggtggaggattagggtttttgaaagggggtgaaaggggtggggttgataatggtggtagcagagtggggggaagggcgaggccgagaaggttggcacatgtcggagaacttctcctcctggagacgtgcgaggcccgcggcctagaccagagtggctggttgatgggcctggacctcccttcgaatcttcggtatcaaaccggagatgaagcaactaaggagaaaggtagagggcaagccagcagtgcggttggcgagatcctcgaagtccgaaagatactgggccacggtgcccgtctgggaacaggttgtggaggtggtagaggtggcggggttggtggtgtcgaggagaaagcgggggagacgcgttggaggagctcatcgattttcatggcgactgagggcatcctcaagcttgtcgggggagaaggaggctcgatcggaatccgccatggaaaggagcaacgagagcaccaaattgataggagtgctcgtgctctgcaactggcttcgagggccaggacctctgagaaagggtga

SEQ ID NO: 87697 - DNA, 384 bp, Glycine max
  Peptide Sequence Number=SeqID_179382
atggtcgaccttcaaaccgtttgctgcatgtgcggtgacgttggtttccccgacaagcttttccgctgcaacaaatgccgccaccggttccaacactcgtattgtagtaactactatggggaattatcggagatagagctatgcgattggtgccaaagcgagggaagaaattactcgagatcacatagctccaattcgaagaaattagcggtggccggaaacgacgccggaaccacgacccgttcggaatattccggcgagaaaatcaagcaccatgatcgtgatcaagagatgagtggttcttcggagaaggggaagagccccgtgccttcgccgagaacctccacgcgcaggtataagcttctcaaggatgtaatgtgttaa

SEQ ID NO: 87698 - DNA, 348 bp, Glycine max
  Peptide Sequence Number=SeqID_179383
atggccattattgtcaatgcggaagcttgtggttacgtgagcatgaactactaccaatatatagatattgtttacacaaatgagcacatcttaaaagcatactccgcacagtggtggcctcttgggaatgaagcggcatttcctccttctgatgatgcatggacacttatccctgacccaactacaattcgtgcgaaaggtcggccaaaatcaacaaggataaggaatgagatggattggctggaaccatctgaccaccgacaaaaatgtagtagatgtggagcagaagggcacaataggcgccgatgtccaatgcaatctgaccgtgggagtaattcatttaattga

SEQ ID NO: 87699 - DNA, 322 bp, Glycine max
  Peptide Sequence Number=SeqID_179384
gaatttatggaggataagggcacacaccaaacttgaaggaaggaagcacaacaagcacaagaagctcacactcaagaagaaagagaaaggagagctcagcaacttgaaggagaaatgtacatccatttacgctgatgagcatttttttatagaattgtggcatcttcagaactgcactgtgcatgacgtgaaggtgtctcgcaggaagcaatggcggcattgcttacgtggaagacttctcgccattggaagtagtgacacaacatgcttctcgccagtgggagcagcaagacagcgtccacatcagctgtctcgccattga

SEQ ID NO: 87700 - DNA, 138 bp, Glycine max
  Peptide Sequence Number=SeqID_179385
atgaaattattccaatccgaaactattgaaggtagtgagacacgatggtgggtttggtgcggtgtggaggtggtgttgagtggttgcgatggtggtgtttgggtgtggcagtggtgttgggtggaggttattagctga

SEQ ID NO: 87701 - DNA, 1029 bp, Glycine max
  Peptide Sequence Number=SeqID_179386
atggaatttggagagaacaacatgttcagccttaacacccacacaaaagaggaaaatggaaacactggcggtaacagtaacaataacaatattgttaatgtttggtattcatcatgggatgctactactacaactaatgcaccacacaccaccacggccgcggagggctacgccggcggcggtcaccgcctccatcaccaccaactatacggcggcgaagggtgtcacgtgcaggcggaccctcacctcacgtgcttgcatcttggtaaaagacattactttgaggatgctactaacggtgatgatgctaacaatgttacttctctggggaaccgacacgtgtgcggtggtggtggtgcgggttttgtttttgcgggtaacgataagagagcgagggggtattatggtggaggaggaggtggggctggcggtggtggtggtggtgggaaatcggcgccgtttgcgatggttcctcgatgtcaggtagaggggtgccacgtggcgcttgtgaacgcgaaggagtaccacaggaggcacagagtttgcgataagcattccaaggcacccaaagctgtggtcttagggttggagcagagattctgtcagcagtgtagcaggtttcatgtggtgtcagagtttgatgactcaaagaggagttgtaggaggagattggcaggtcataacgagcgaagaagaaagagctctcacctttctgttactaggaattctagacaagggtgtgctctctctcttctgtcatctgggagtagtagtgaaaattggctatctcatcatgcggatttctccacaagatgcagtgcagcattgcgtgaattgatagcagaaaaccgtgctgccctaatcactagacaacaacaacttgtttatgatagagactggcctcatgttgtgccccaccatgatgctgcagtggaagaagaagaagaagactttgaagacttacaacaacaacaacaaccacctgagcccaattattttccacaacaacatatgtttccacagacataa

SEQ ID NO: 87702 - DNA, 237 bp, Glycine max
  Peptide Sequence Number=SeqID_179387
atggaggcacccttgtcagagacatcgtggaagttgcgggaacgaagcaatgttgtgaccagaaaagaaaagattaattcttttggtgaaccaaaaaggtgccaagacctcatcttgacaaagggtgttttgaaagcaattaatacactcagggacgactattcttgtgttcatgactttattgttattgatgttccactttggtttcttaaaggaattgctccacccaatttgtaa

SEQ ID NO: 87703 - DNA, 299 bp, Glycine max
  Peptide Sequence Number=SeqID_179388
acctatgtgcaaaggatagagctactggactcgaagcagaaaatgcattagatgcagatgatatcatgagcaaagaagcaaatgaagaggaagcaattcacagtgtgagtattgacttagagggatcaagttccgccacaaggaaaaacattcgtccaagtaagagtgaagagaaagaagagatgatttcttcaatgaaagaagtagccatgtcattgaaagaatttgttgaagtggctaagaagatggaaaacaaaaaaaaagatggagaaaaaagaagctcaagaagtggtacatga

SEQ ID NO: 87704 - DNA, 654 bp, Glycine max
  Peptide Sequence Number=SeqID_179389
atggccaatcttgttccagccttcacatttgtaatagcagcttgtatagggatggagatagtggatattagaagcttcagatctatagccaagatagtaggaacagtgatgcccaaacaatttgaccatcaaaaaccattgtgggctctggaggagataactggttgctggattgtctctctctcattggatccacaattgtctgtgtcaaaagagcaagggccgctgcatcgccgcccggatgtagtgaaaagtaagcaagggttcccacattttcgtgaacgggtgtgggtaaagaagctagttcatgacagaaggattcgctttggtacatggaatatagacacacttactggaaaatctatggaaatagtggatgttatggtgaggaggaagatcaattttatgtgcctacaagaaactaagtggacaggtgaaaaagcgaaaaaattagacaactcgggatttaagctgtggtatacgggaaaaattagatcaagaaatggggtagggattattgtggacaaggagtggaagaaggatgtcgtggatgtaagaagagtaggagatcgtatcatagccttaaaattggtagtgggacaggacacctttaatgttattagtgggtacgcacctcaggttgggttagcataa

SEQ ID NO: 87705 - DNA, 1032 bp, Glycine max
  Peptide Sequence Number=SeqID_179390
atggccatgttgtttaatcagtccatttatgcaggaattagtctcagcacaagagttgctttcttacaaggaatgagcccaagggtgtttgtagtgtatcgtcatgcttttgcaaccattgtgattgctccaatagcttatttctcaggcatcacgttgaatcaaaatttattttttgagggtctatatctggcctcttcttcagtcgcaagtgcaatggcaaatcttgttccagctgtaacatttataatagcagcttgtgcaggaatggagaaagtgaatattcgaagcacgagatctttagccaagataataggaacagttatatgtgtgagtggggcagtttccatggctttgttgaagggtccaaagctactaaatgctgaaattttgccatcaaaatccatcatggcctcaggaggcgatcattggttactgggttgtctatttctcactggatgctgttgtgcttggtcagtctggctcattttgatggttccagcctctacaagccaccctgatcacttatccttctcagcgtggatgtgtttcatggcaacattacaatcaacattagtgacactattgctcgagccagacccacatgcatggaagattaattctctacttgaatttggttgcaccttatattcaggagttataggatctgcagtattattatttatccaagcatggtgcatttcgctaagaggtcctctcttctgtgcaatgttcaatcctcttttcacagtcattgtgactatattggctgctttattacttcacgaggagatatactctggaagcttgataggctcaactggagtgatcattggcttatatgtggtgcattggggtaaagctgaaaaagtttctgaggcgaatgtgaaattgaccgatccaaaatcgatggttaattcaacagaggatgtgaaaatattgattaacggttcttcttctgtaaaagcatgttgtaaaaccaataatttagaagaaccccttctatctgctgattctccttcacatcgttaa

SEQ ID NO: 87706 - DNA, 471 bp, Glycine max
  Peptide Sequence Number=SeqID_179391
atgccttccgtcaccatcgcaaaatgttctgccttacaggtaacgagaactaagttctattacaacagtggatggcttctcttagatagctctggaaagctcattgggataaatataagcatatattccccatcccgtgcatcctctggtgttggattttgtattcttgtggacattgtaaatggtattgttgaccagttggtgaagtttgggaagattacaagacatattttagggattaagtttgctcctgatcagtttgtggaccagctgggagtcagtgcagtgagatggaggaagagcttaataaaaatattggggccggagaatgttggtatccatggggatatttacatcattgctcttgatatggcaggtggccaattcaattggtctgatgtctatagagaagcaaaacaagttgctgatgtgcttgccaaatttgggtttttcattgagggacagggctga

SEQ ID NO: 87707 - DNA, 642 bp, Glycine max
  Peptide Sequence Number=SeqID_179392
atgactttttacgacagtcattctatgacgactcttggtcttcaacctgcttgttttaaacccttgactcactcactcactcatgtctatcacttccctcaccatggccgagtcctgcctcctctcttctccctcctcacattccatgacaactccctcgtctaccagtccaatgctgaccctgacctcctcgccgcctttgagaccggcgacgccgagctactctacgagatccgcctccttagcgcctcgcagcgcgttgccgctgcacgcttcctcgtcgagaatcggtgcgacgggaaggaactcgtcggaacaaaggacttcgatgttgggcatggcggagacaaaggcgacgacaaatgtgattttggaggagttggaggggaagggggaggctgcgacgcgtgttccggtggtgaggctgaggattggggaggtggcgaaggtgagttcaatggtgttgttgtcggtcttcgcgacggaggagaaggagattttggaggcatgcataataagctgatggatacaaatgcacaactttggtacatcatcaaagaatatatctctaattttgaggatagaggtgttgatgcagctgaccttatctcattcatgctagaatcagttttcatgacatag

SEQ ID NO: 87708 - DNA, 900 bp, Glycine max
  Peptide Sequence Number=SeqID_179393
atgccgccagcaataacagcgacatacaccactagggcaatctcgccagtgctaacggcgagatgctccacgtatatcatgaattcaattattacagtgttgtatttcaacggaagagtatacgaagacaatgatagtgtaatatttgaaggcagtaaaaaggcgattcagattaaacacggaattagtttcaatgctttgaaaaaaaaattggagataagatttttagtttcaggaaaatatgttgcgttgcaaatttgtgatgacgaagatgttgaaactatgatcgaaagttttcaacaacaacaacaaatttcagttctagaattgtacgtagaaaaggatgttgctggtggttctatatttcatgttgcaaattctgttacgtcatgtggacgtaatgtatctcatcatgagtcagaactgccaagaaatataagcaatttacatgttgatgaagatgatgatgatgatgatgattatcttgcatctaactcatacgttgaagagtctttcgatgaagatgatagtgatgatggaatatctgatatagacgatgaagtcactgacatcgttgaaccagtttcaattgttcacccaagcgaaggtgtaccagaaattcaaaatccattttggaatgatgctatgcattataataatatcaattggagtcatccgaacgaggaggacatttgtggtctggacatgccaacgacttttaatgttggacaagaattatatgttggcatgaattttgacagtaaagatgcggtaaaaaatgcactgaaacaatatgtgatgaaggtgcatcaaagttttaaggttgttgaaacgaaatcacacaaatatatcgtttgttgccccaacaacaccgaagagtctccttgcccttttatatga

SEQ ID NO: 87709 - DNA, 1971 bp, Glycine max
  Peptide Sequence Number=SeqID_179394
atgcctcttatccaaatatcagaaaatgaccagtttatggaatttcatctacaggaaattaatcatgctggagctgggggattgtgggctgagcttgtgagcaacagagctggtggccctaacactccttcaaatattgacccttggtcaattattggaaatgaatcattgataaatattgaaactgatcgcacctcttgctttgaccgtaacaaggttgcactccgattggaggtgttatgtgacagcaaaggtgacaacatctgccccgctgatggtgttggtgtctataaccctggtttctggggcatgaatattgagcaagggaagaaatacaaagtggtcttctatgttcgttcaactgaatcacttaatctaacagtttcattaactggatcgaatggtgtaggaaacctggcttcatctgtgatcacaggttctgcacttgatttttcaaactggacaaaggtggagaagatactggttgccaaggcaacagatcataactcaagacttcaattaacaaccaccaccaaaggtgtgatatggttggaccaagtgtctgctatgccactggacacatataagggacatggtttccgaactgaccttgttgaaatgctgacagctttgaaaccaagatttatcagatttccgggagaatggttaagaaatgcatttcgatggaaagcatctgttggaccatgggaggagagacctgggcactttggtgatgtttggatgtactggactgatgatggacttggctattatgagtttctccaacagcttgcggaggacttgggtactgcaccaatatgggtatttaataatggtgtcagtcataatgatcaagttgatacatctgcggtcttacctcttgtgcaagaagcccttgatggacttgagttcgcgagaggtgatcgcacttcaaaatggggctcccttagagctgctatgggacaccctgcgccatttgacctaagatatgttgctgttgggaatgaagattgcggaaaaaagaactatcgaggaaactacctgaaattctacagtgcaataaaaagtgcttatccagatatccaaattatttcaaattgtgatggttcttctcgacctttagatcatccagctgatatgtatgattatcatgtttatacaaatgcgaatgacatgttttctagagctaatgcatttgatcatacatctcgaaatggtccaaaggcttttgtaagtgagtatgctgtgactggaaaagatgctgggacaggaagcctcttggcagccctagctgaagctgggttccttattggactggaaaagaacagtgatgttatccaaatggccagctatgctccactttttgttaatgccaatgataggaggtggaacccagatgcaattgtattcaactcctttcagctctatggaactcctagctattgggtgcaagtatttttctcagagtcgagtggagcaacacttctaagtacatcacttcaagcaccttcctcaaattcacttgttgcatcagcaattacatttcaaaattctgtagataagaaaaattacatacgaataaagggtttctgtgttctttttagactggcacctggttctcaggaccttatggttctgccagtctgcttgtaccttgtaattttagtacccctggttgtgaacttcggtaccactgccgtgaacctcaaaatctctcttgacggactagaaccaaactcattgcagttatctgggtcaacaaagactgtgcttacatctgcaaatgtaatggatgagaactccttctcacagccaaagaaggtggtgccaatccaaagtctacttcagaatgttggaaaggacatgaatgttacagtcccaccacgttcgttcacatcatttgatttggtgaaacagtccagtactctgaagatggcagggagcgattcttccacgaggtcttctatttaa

SEQ ID NO: 87710 - DNA, 585 bp, Glycine max
  Peptide Sequence Number=SeqID_179395
atgtttaataacgctcatgtgtttgataagacaccacgaaacggtccaaaggcttttgtgagtgaatatgctctaattggagacatacaagctaagcatggaacccttttgggagctgtgtccgaagctggattccttattggattagaaagaaacaggtggagcccagctgcaattgtttttaattccaatcaggtttatggaactcccagctattgggtgcagtttatgtttagagagtcaaatggagcaacatttttaaaatcacaacttcaaacgcctgaccctgattcagttgctgcatctgcaattctttggaaaaatctccaagataaaaaaacttacttaaaaataaaggttgcaaacgtggggagcaaccaaataaatttcaagatttctctaaacggatttgagagctcaaatgcaactaaggcaacaaagacagtgctcacatctaagaatgcattagatgagaatagcctcgcaaacccaacaaatatagtaccaaagcgaagtccacttcagagtgctaacaacgagataaatgacatacttcctccagtttcattgacgatcacagtctga

SEQ ID NO: 87711 - DNA, 225 bp, Glycine max
  Peptide Sequence Number=SeqID_179396
atgacatgtgtcaacagttctttgaggcttcgatggtccatgattatagtgagacaatggccaagaagatactgccgctacttcttcacggtcgccataatagcgaatagttctcgcacgactgcccccatcccaacacttgaggcatctgtctcgatggtaaaaggaagtttaaaatctgacaaggctaagataggcgcttgggatagagcatgcttgagctag

SEQ ID NO: 87712 - DNA, 60 bp, Glycine max
  Peptide Sequence Number=SeqID_179397
atggtatcgaaggtgaaggtggaggggttggagaagaggatgaggagaggatgggggtga

SEQ ID NO: 87713 - DNA, 1452 bp, Glycine max
  Peptide Sequence Number=SeqID_179398
atgtttgggcgtggtggaccaaggaggagtgataactccaaatattatgatattctcgggatttccaaaaatgccagtgaagatgaaatcaagaaggcctatagaaaggcggctatgaagaaccatccagataagggaggagatcctgaaaagtttaaggagttaggtcaagcatatgaagttttaagtgatcctgagaagaaagaactgtatgaccagtatggtgaagatgcccttaaagaagggatggggggaggaggctcgtttcataatccatttgatatatttgaatcattttttggaggagcaagctttggtggtggtggtagttcccgaggtagaagacagaagcatggtgaagatgtggtgcattctttaaaggtttccttggaggacgtttataatggcacaacaaagaaactatctctttctagaaacatattatgcccaaaatgtaaaggagcgattgtgttgcactgtaaattggactgccattccataaaatcatgggcatcactttaccccagtatgtttgaggttgaagttgaacattcaataaatgggaatagcagccatcttgttacctgctataccattagtgtgttgggattggcctgtctgagccactatttggtattgataactgtatggaaaggttcaaaaagtggaactgctggtaggtgttttggatgcaaaggcactggtatgaaaattacaagaaggcagattggactaggcatgattcaacaaatgcaacatgtctgtcctgactgcagaggatctggtgaggtcattaacgagagagataaatgtcctctgtgcaaaggaaacaaggtttcccaggaaaagaaggtgctggaagtgcatgttgagaagggcatgcagcagggtcagaagattgtttttgaaggacaagctgatgaagctcctgacacaatcacaggagacattgtttttgtattgcaagtaaaggatcacccaaagttcagaagggagcaggatgacctctatattgatcacaatctcagcttaaccgaggcactctgtggcttccagtttgctgtcaaacatcttgatggtaggcaactattgatcaaatcaaaccctggggaagtcatcaaaccaggtcaatataaagcaataaatgatgagggaatgccacaacacaataggccattcatgaagggtcgcctttacatccagtttaatgttgatttcccagactcagggtttctttcccctgaccaatgccagttactggaaaaggtgttacctcaaaagagcagcaagcatgtgtcagacatggagctggatgattgtgaggagaccactttgcatgatgtcaactttaaggaggagatgagacgaaagcagcaacagcaatatcgcgaggcatatgatgaagatgatgatgagccatctggtcaacgagtgcaatgtgctcaacagtag

SEQ ID NO: 87714 - DNA, 264 bp, Glycine max
  Peptide Sequence Number=SeqID_179399
atgagaaaattagggttaccagatgtcttcgggaaaatcgtatttgatgagttccttgttctcgtacttgtcaaggcctatgaagatggtgaaattgttcgcttcggggcgcgctttgaagtaaaacatcatcgtgtcgtgttgctttgctttcacacacacgggaagaaacaggtggggtgtgttggagcccaagaagaaggggttggttggggactggatgcggagcctctgcttctgacccttcgcgggattggagcttag

SEQ ID NO: 87715 - DNA, 372 bp, Glycine max
  Peptide Sequence Number=SeqID_179400
atgctccaaccatatgggatcaacataggcttaaaggagcactcaaacccggtgacccccaaggcctacactccgaagagtccgtcagggcctctccctcctgattcaggaaacctacgctttctctttaacattgcgcatttacacttttctcaagataacactggtcggatcaaaattactatcggtgagaatgctcggaattgggctgcgaacatagtgctcaaattgcacaacgatccaacggtgaacgagcccgagatcgtcgtttttctgagacatgttaggtggcctgcgggaaaaagagggagttttgggagaagaaagaagaaacgaaattgtgaggtagaggagaatgaggagtcagtctga

SEQ ID NO: 87716 - DNA, 282 bp, Glycine max
  Peptide Sequence Number=SeqID_179401
tcggagttgtttttggtgcggcaacttcccaatgacgtccatctttatcttccccaactgcctctagtggtacttcgcggcaggtttggagatagcggtgtgcctatggaggaactcgcggtagagtgcattggagatggcgaagacgaagaaagggctggtagtgaaggtgaagaggctatggaggaacttggcggagagcgtgagcatgtaggggaagtgtgtgaggatccacgagaagagaaggagggcgaggcaaagttcaagaatgtgaagggctaa

SEQ ID NO: 87717 - DNA, 303 bp, Glycine max
  Peptide Sequence Number=SeqID_179402
atgggattaggagctgttccttctaatacattcaggaacacaagacttcgagcttttagtctgagctcttcttcatctggtgttgcctttccatcttcaaaccaagggcaagagaaatacaaaaatttagaatcagtttttaagacctacatgataattaaggaaggaaggatccctaaagaattagctagttatttcactcctgatcaaacacatcggcatactccggcgtcaggggcagtggctgcaccggagaggacagtgtactccgccgcaggagaggatgtcggcgaagacatttag

SEQ ID NO: 87718 - DNA, 1611 bp, Glycine max
  Peptide Sequence Number=SeqID_179403
atggagaagaaaacatgcatagccatggttccatgccctggcttaagccacttgatcccactagttgaatttgccaagacattagttcatcaacaccaacacttccatgtcaaattcatcgttcccacacttggtcctcccacaccttccaccaaagccatcttaaactctctcccatcaaacataaacttcaccattctcccccaagtcaacctccaagacctccctcccaacatccacattgcaacacaaatgaaactcacggtcaaacattccctcccttttctccaccaagccttaacctccctaaattcttgcacacaccttgtggcttttgtttgtgaccttttctcaagcgacgcactccaaatagccaaggatttcaacctcatgacctacttcttctctgcctcgggtgccacttcactctcgttttgtctcactttgccccaacttgacaagagtgtcacctccgagttcatcatagacgccacaaaaagggttagtttcccagggtgtggcgtgcccttccatgtcaaagatcttcctgacccagttgtcctttgtggaagatcaagtgaaacatacaaggcatttcttcgcgtgtgtcaaagactctctttggtcgatggtgtcatcatcaacaccttcgcggatttggaagaagatgccctaagagctatggaagagaatggacgagaattggatctaacagaagagattagtttttcacaacatatacataatggtttacagtccgaatctctgtcaaaagaaatgtctatatttaatactccaccgtccatcaaacaaaatgatcatgaaaaagcgatagatattgaagaaagggagaaagcacaagcaaaagcaaatagcccttgtgtttactattaccccgttggaccaataattcaaagcgagtcaaggagtaagcaaaatgaatcaaagtgtattgcgtggctagaaaatcagcctccaaaggcggtcttgtttgtctctttcggaagtggtgggaccctttcacttgaccaactcaacgagatagcctttggcttggagctaagtggccacaagtttttgtgggttgtgagggttccaaatgacgtttcttgctccgcttattttgtgagacaaaaagatgacccattagggtacatgccatgcggtttcttagagagggttaaagccaaaggacaagggttggtggttccttcttgggccccacaagttgaagtgcttagacacgaatccacgggggggtttttgacacattgtggttggagttcggttttggagggtgtggtacatggtgtgccaatgattgcgtggcctttatatgccgagcaaaggatgaacgccacaaccataagtgatttgctcaaagtggctgtcaggcctaaggttgattgtgaaagtggcatagtgaaaagagaagaagttgcaagagtgatcaaggtggtgatgaaaggggatgatgagagcttgcaaatgcgcaaaagaatcgaaggctttagtgttgctgctgctaatgcgattagtgaacatggttcatctactatggcactctctagtctagcattcaagtggcaaagttgtagtaggaaatcctaa

SEQ ID NO: 87719 - DNA, 252 bp, Glycine max
  Peptide Sequence Number=SeqID_179404
atgtcagttccggacttgatattgctttctacatttagaacagtggaaagaaatgagctggtgagtgaaattggtttattgaagaaggaggcagaaaggtcacttgatgagctaactaggatgaagaatctcaagtatgaaaaagagatggcggtttatatatataatgtctttgatatccctccacaacacttacttgaggaagtacttcctaaagttattatgcaagtgtctaagacaaaatctttgtga

SEQ ID NO: 87720 - DNA, 1806 bp, Glycine max
  Peptide Sequence Number=SeqID_179405
atggagaaaataactcacatagcagttgttccaggtcctggatttagccatctaatcccaattcttgagttctccaaacggcttgttaaactccaccctctcttgcatgtcacagccttcattcccacacttgggtctctctcaagtgtctcaaaatcctttcttaaaacactctcaccaagcataaccccaactttccttccaccagtggaccccattgacataccacaggggcttgaaactgcaatccgaatgcaactcacagtgacttactctttgccctctttacacaatgctttaaagtccttgacttcaaggactccccttgtggccctagtggttgataacttcgcctatgaagcactagattttgccaaagagttcaacatgttgtcatatatttactttccaaaatcggcttttacactttcaatgtactttcacttgcccaagttggatgaagacacatcatgtgagttcaaagaccttccagaacctattcaaatgccaggttgtgtaccaatacacggccttgatctccaccaccaaattcaagatcgatcaagtcaaggttatgaacttttccttcaacgtgttaaacgtttttgcacagttgatgggattttcatcaatagctttattgaaatggaaaaagagcccataagagcattggctaaagagtggaatggctaccctcctgtttaccctattgggccgataattcaaacaggcattgagtccgatgggcccattgaattagactgcataaagtggttggacaaacaacaacctaagtctgttctatatgtttcttttgggagtgcacctagtagttcagctagtagtgcttatctcagtggtcaaaatgagaatccattggaatttttaccatatggattcttggagagaaccaaggggcaaggcttggtgattctatcatgggcaccccagattgaaattctcagccatagttcaattggtgggttcatgagtcattgtggttggaattcaacccttgaaagtgtcttgcaaggtgtgccattgatagcatggcctctctttgcagagcaaagaatgaacgctgttatgctaagtgatgacctcaaagtggcactaaggctaaaagggaatggcaatggagtggtggaaaaggaagaagttgctgaagtgataaagagtctaatggaaattgaaagtggaaaaatgagaaaaataatgaagaggttgaaagaagctgctattaatgcaataaaagaagatggaccctttgtgcaaaatgagtcatgcaatgatcaaggaagtgacacaaaatgtttgagatggttggacaagcaacaacataattctgtcttgtatgcgtcctttggaagtggtggcacactttctcaagagcaaataaacgagcttgcttggggtttggaattgagtggtcaaagattcttgtggacaacacaagggcgtggttgggtggttccttattgggcatatcagattcaaatccttgctcatggtgcaattggtgggttcatatgccacggtggttggaactccacaattgaaggtgttgtgcaagggattccactaatagcatggcaactctttgctgggcaaaagatgaatgctgttttgctaactgaaggtctgaaagtggctcttagggctaatgtaaatcagaatgggattgtggaaagggaagagataggtagggtcataaagaaacaaatggtgggggaagaaggtgagggaattcgccagagaatgaaaaagttgaaaggtgttgctgctgatgcatgcattgaaggatga

SEQ ID NO: 87721 - DNA, 204 bp, Glycine max
  Peptide Sequence Number=SeqID_179406
atgggtgatgcccaaggacatcaatcgtccaatggcaagagaagaatgttgcatagctttgtctatcaataccttaagttgttgcgtgaagatactccaccagcatggatatttaaggaaattcaaaatattggaaacatggatttcagatttgtggaagagcagcctccacatgatcatgctgttgagcttgcaggtaaatga

SEQ ID NO: 87722 - DNA, 384 bp, Glycine max
  Peptide Sequence Number=SeqID_179407
atgaaggacaagtatattgttctaagcttgttaaagaacttagaaaaaatcaagaacaagcttgttcgcacatcgttcgcgtgtatgatatccactcgacaagtttgtggttacgtgagcatgaactactaccaatatatagatgttgtttacacaaatgaacacatcttaaaagcatactccgcacaatggtggcctcttgggaatgaagtggcaattccaccttctgatgatgcatggacacttatccttgacccaactacaattcgtgcgaaaggtcagccaaaatcaacaaggataaggaatgagatggattggctcgaaccatctgaccaccgacaaaaatgtagtagatatggagcagaagggcacaataggcgctga

SEQ ID NO: 87723 - DNA, 441 bp, Glycine max
  Peptide Sequence Number=SeqID_179408
atgtcgggggcggggcggggaaaagccgaccccgtcggggacggggatggggtaaatatacacccccgttgggttttgggagcgggggcggggagagaaatggggagtcgggagttacacccttacaatcaatatgaagaagaaagaactcttaatcttgagagtgtgttcgcggaattcacggcataccacgctagctctacaaccaatcaaaactcaatgcaaaacgaggacatttgtgttggcgcgagctactccatggaaaattatcagtgggagaaagagttacaaccctacaatcaatatgaagaagaaagaagttctaatatggataatttgttaatgcaattcaaggaaacaactgaatctactcaacgggcatttaaaagtctagaaattgaagttggtaagctagcggaagaagtggctaaaactttgtag

SEQ ID NO: 87724 - DNA, 690 bp, Glycine max
  Peptide Sequence Number=SeqID_179409
atggtgggtgtgttatggaatatggcagctggaacattgaactcagatgaaccaagagaccttaagctgccattgaaagataggttcttccttcaaccattgtctccaactgatgctgcacaaagggcaaaggaatcagccaaggaaattgttggcgttaagaagttgattgaaaagaaggcttggccatatgttcagaatgatctgcgtctcagggccgagtatctgcgctttgatctcaacactgtcattgctgcaaagcctaaggatgagaagaaatcactcaaggaactcactggcaagctcttccaggatatcagcaatctggatcatgcagcaaaaattaagagcagcccggaagcagagaagtactatgctgctactgtatcttctctgaacgatgtccttgccaaacttgacactttattgactgatattttaagaaaatcaaatgatgagggaaaattttctataaataagatcaatatatctagaccacttctctcctgcctgtccaaaactaaaaggaacacaaggtgccgcatgaaggatgagatgaaattggagaaaattgatggaagtaacatgaaaaaaagaagcaagaagtatattaataagcttagttggaacacaagcgtccacaatgaagccaaccccgatattacaagagtgtacaacattctcaaatga

SEQ ID NO: 87725 - DNA, 1701 bp, Glycine max
  Peptide Sequence Number=SeqID_179410
atgtctctcctccgccatgtttgcacaacctcaaagctctcagcagcagcagcagcatcaacagcaacgatggcgatcccttggaagtacaagaagttcgccatatcacagggtcagaagtccctcaccgactacctccacgccacgcgcagcatcccttacgcctacgccaaccaaatcgccaagaactccctcacttccctcaccaccctcatcaccactctcggcacttcttccttctcccctctccacttcccccacaacctcaacaagttcctcatgtaccaccccatcaacgaattcgagttcttcttcgagagcattggcattcacccctccaacttccattctcttttgccccaagacaagttctttttctcccaagatgatacccttttgagtgctgcttgtgttctttacgagtttgggtttccctgggataggcttggggttttgtatgtggagagtggctgttttctcaattggggtgcttctgagttgaaggatagggtttgtgggttcaaaaggtatggtctttgcaatgagcaggttgttggggtgtgtatggcttttccctttgtgtttgatggccaaaagggtgatgatgaggttgaggctttgtttcgtgatctggggttgctgtttggggagtttggtttggctgagtgtgttgaggggaaggggaactatagtgtcgatgattggattcgggtgtgtaggaagataaggttgttttatgatttgaatggtgggaagagcttagtggagctcattggaaggaacaatggtggtggtgttggtgtcattgtggagcatggggaagaggagttggttcaagcagctgagtatttttgtaggtttggtgcgaagaaggaggatgtggcacgattgattgtagacggaccggagttgttggagcttgatttggaggcatgggtggttgatgtggtgaagctgttgaagtactttggaatgagatcggatgatgtcgaggatgttaggagggattatgctcatgtattggggacagttaagatgggtaatctgcccaatgtgatgagagcgttaggtttacgtgagtggttctttgataagatcaaggatgggaatcatcaattgttagttagttttgtcacgagctgtcccggtgaattccaagatgaaggctatctaggtcgtttgaaggcgattaaggcatcaagaaccccaactcacaacattagcaagttgaatttcttgcacgccattggctttggcgaaaatgctttgaccatgaatgtgtatgctcagatgcatggaacaagtggcaaattacaaaagagatttaattgccttctacgtcttgggattgaattttcgaagatctgtaagatgatcacaattcatcctaagattcttagccaaaaccctcaaaatttagagcaaaaggttaatttcttttgtcaggaaatgggatattcactggagcatttgatcacttttccagcattcttgtgctttgacttagagaaccgcattaagcctaggtacaggttccatatgtggattatggaaaagggtctgtcttccaaaaattattccattacaagcatggttgcaacaagcgacaagaattttgttgctcgcgctcttaaaattcacccagctgctctaaaacattggtttgagcaattctatctaagaaatttgccagtgcaatga

SEQ ID NO: 87726 - DNA, 840 bp, Glycine max
  Peptide Sequence Number=SeqID_179411
atgcagaaccctgaggccaacgacagagagaagaccgttgagaatgcactccttgagacccttgatgcactagccacttcggcttgtcttgtcgcggctccttcgtccaccgttgatgtacccttactgagtgttggtgtggcgaccacgagtgctcctacaatatcgcctcctctttcttcagctccaccggttccaccctttgctatgttggcttcagtgtccccttcctccttttcttgcccccatgtgtctttggatcacctgtacacctccaacaatgttgattcactgtggggtgaaaattacaagctgaagcagaagacctctattggcttcatctggggtggagaatgctacggattctaccaaaattttcctccagagaagtttggcgattttggaggagaatggacaatgacaccaagaggctctacgcaaggtggcatccttggagatagaggttgccaaatggaaggctactgctcgcacagtcttaagagtggagcaccccaagtaagagaaaaaggacttggcaaggtggaacatattgcagcaaagagggatgagcttgccaaggtggttgttgagttagaggcccgactaaaagagttgatgtccaagctagaggagtctgaggccaacaaggaggttgtggagcagcatgaaaaaggctttcaaaaggccgtcaggcaggctaggttcttcgccaaggaccttgacttcggtcttttttaccctttcaaggatgtgaatgatggtgttctgctttacgaggaagatattgttgctgaggaagaggctagtgaggagcaggatgctaatgatgtcgatgtttaa

SEQ ID NO: 87727 - DNA, 2106 bp, Glycine max
  Peptide Sequence Number=SeqID_179412
atggatgaggagtacgatgtgaacatgttgggtacgggtctcaaggagtgcattctcaacggtcttctctctgtcgttggcctcaggagattcaggggagatgacaagtctcttctatatttgggcactagcagagactacaacattcatatgaaccctaagtttattatggctaatggaaatttggtgcgggttcttatacatgccaatgttaccaagtatctctatttcaaagctgtggatggaagctatgtgtttaataaaggaaaggttcataaggtgcctgcaaacgacatggagaccttgaagtccctacttatggggctatttgcaaaacactggacacataagtttttcatttatgtgcaaaaatacaatgagagtgatcccaagacccatgagggcgatgatcgctacttggctgagctagcactggacattgtgaagagaataaagttatatgcagagtctcttgtacactttcaaggagggtcaccttacatatatcctttatatggtttaggagagcttccccaggcattttcacaacttagtgttgtttatggtgaaacatatatgttgaacaagcctgagtgcaaggtagaatttgacgaggaaggaaagattgttggtgtcacatctgaaggggagcttctttttttgaggtatgacttgacaattccctttgcgaggtttgtggctatgaatggtctgacatctttcaaaaggtaccaaatagccaaggtttacagagtgaataactcatccaagggaagatatcgtgaattttatcaatgtgactttgatactgctggtaatcctagcgtgtctgaaattatgggtccggactttgaggttgttaggattttgactgaactagttaatgagttggacattggggaatgtgagataaagttgaatgatagaaagttactagatggcatgctgcaaatacgtagagtacctcgtgaaaattttaggacaatatgttcaaatattgacaagttagacaaacaatcttttcaacagctaagaaaagaaatggtggcagaaaaaggattaaccgctgagacaactaatagaattgaaactgaagagcatctgcctgttaagaatttttctgttgcgggtcaccaggagtttaaggttgtcctctttatccccatgagggcaccttttaatctctttgacactaggaagaatcctaacaaaatcaaattgtatgtccttcgtgttttcatcatggacaactgcaaggagttaatgccaaaatatcttagctttgttaaggaaatgttgcaacagaacaagatcctaaaattggtcaagaaatgcattgagatgttctttgaaattgtggagaacaagaaggactataacaggttttatgaagccttccttaagtatttgaaacttggtattcatgaggtttctcataacaagacaaagcttgttgaattgctcaggtatcaccccactaagaatggtgatgagatgaccagcctcaaggactatgttaccaggatgaaggaagggcagaatgacatctactacattactggtgaaagcaagaaagttgttgagaattccccttttcttgaaaagcttaagaagaaggggtacgaggttctctacatggttgatgctattgatgagtatgttgaaggcatgaaacttgacgagagtgaagacgagaagaaaaaaaaggaagaattgaaggagaaatttgagggtctttgccatgtgatcaaggatgtgttggtgacaagcacaaacatggagaggatcatgaaggctcaggctttgagaaacagcagcatgagtggccagatgtctagcaagaagaccatggagatcaacccagacaatggtatcatggaggagttgaggaagagagttgaagctgacaagaatggtaagtctgtgaaagaccatgtgttgcttctctttgagactacccttttgacgccaagttttagccttgatgatcccaacacatttgctttggtttggaagtccctttacaacatcaagggcaaggttgtttttttccagcagagagtgttgatagcaattgcgcacaagtcaacaggcccaagaggatag

SEQ ID NO: 87728 - DNA, 1077 bp, Glycine max
  Peptide Sequence Number=SeqID_179413
atggaggtccggtgtggtctgcgtgcagtgatggcgtgcacggcaacggaggcgtttggttcgcttgcaggaaatgtgaaggagaagaagatgaagcaacttcagtctcaagcacgtaaatatgagaaagaacttgcagcatacaatcactcaaagcaacttgatttggcacactttacattagaagactctaatatcaaatccatccctatatctgatcggatgcatagaaataaagttatgaagaggaacaaaagaaaaagagttgaagagcagtgcgatatagaatcttacatgtctaaccatagtttattctcctattatgagaaaacagattgtactgctgatacatgtttgaaagatgtttgtgatgttggtataggaggtgtcaatgatagtaaccaggaattcaagctgaatgatgagtggtcttctgaagagtatggaaatgttgataaatccttggatgacatcattcagaagattgaagctatacagtcagaagttcagcaattaaaaactagaaccgacaaggtgataagtgaaagttgtggaaagttttgttctataactcaatttagcatgcgtggccgatctgatggatttaatcattttgattctactttcaccagtaatgaaaacacattaccatttagttttcctcgttcctcatctcagcttgaatctgagtttcacatgggagatctacttatgcctggaaatgcatcagctagtcgtgaagtgatgattccctgtattgtaaccactgatgggcctgagcttgatgatccattgaaagataccaaagatgaagttcttatacataatcaagtagctaaggaagagtggcatgattttattgactatgatggaaccaaggattccattgaagaaggtaaattcagttttgatgttcaagtttcagaacctgacccccatgagaatgaggttaagctgaatcctattggaatggttattcaacaagtcgaaggaattgagaatttctccaacaagttgcagtatgcttgtgtcgtacttcgtaaattctggttatttgttttatactttttttcatag

SEQ ID NO: 87729 - DNA, 1158 bp, Glycine max
  Peptide Sequence Number=SeqID_179414
atggacttttggaagcttttcattgttgcattattgccagttttgaaggtattgttgattactgctgtggggacaatcctcgcaattaatcgcttgaacatactcggggaaactgccaggaaaaacctcaatactatggtattttatgtcttttctccaactctagtttgtagcagcctagctgaaacaataactttagagaacgtgcttatattgtggttcatgcccgtgaatattcttctcacatttgtcattgggtcagttcttggattgctagttgttaaactaactagagttcctcatcatcttcaaggccttgtgttggggtgctgtgcagcaggaaatctgggaaacttgcctataattttagttccagctgtctgcaaacaaagtggcagtccttttggagatgtgaatgtttgctacaaaaatgcactagcatatgcttctctatcaatggcactaggatccgtttacatttggtcttatgcatacaaccttgttcgattatattcaccgaagatttctaatgaagtcaaagttgatgacaattccgtagtagaaaatccagtgtccacaacaaaatctgatccagaaaacccttcaacattttccacagaattaccatttgttagtgctgatgatagatcacaaaccgaagatcatgtgaagcactttgaaattcaatgtacagggcataatgggcaagtggaggaggtatcaaaaaacagaacgattatgaaccatttgataatattagtccaaaaggtcaacctgaaggtactattcactccttcaacgattggagcgattattggtttaataattggtgtagtccctcaatttcggaaactattagttggtgataatgctactctccgtgtggttgaggactcggtaatcatggtggggtatgcatgcattccagtaatgactttgttggttggagcaaatcttatcaaaggtttgaatggactaggaaagcaacttccactcattattggggttacgatggttagatgtattgtcttgccagcaattggtataggtgtagtgaaaggtgttgttcgtcttggattgatccatcctgatccattatatgagtttcttttgctgcttcaatttgcccttcctcctgcagtagccatgagtaagtaa

SEQ ID NO: 87730 - DNA, 306 bp, Glycine max
  Peptide Sequence Number=SeqID_179415
atgaatattaattggggtagaagcaagaaaggatgtgagacaactgtccatggaacagtcatttgcatttattggctggttgttgttgctctgaaaatgctgaattcaggcactgagaggacacttttgacactagctctgagagttgaagtttggcagcttcaagtcctactactcctaagctctgtctacctagtgtttcctgagccttctccaacactgcctgaaggtattttccttgagcctcaatacgtagctgcaggagtctttgcacctgaatatggggtcagatgggtttttagttag

SEQ ID NO: 87731 - DNA, 174 bp, Glycine max
  Peptide Sequence Number=SeqID_179416
atggtgccggtagatagactagatgccacgcccatcaccattgatcactttcgatactgctacattccttggagatttatgtcacgtgtgacaactggagtggtcactgagaactggagagatcacattgatatgatgctcgaggaggaggaagagtatcacaagcttctatga

SEQ ID NO: 87732 - DNA, 387 bp, Glycine max
  Peptide Sequence Number=SeqID_179417
atgatgcatatgcgaaagcgtgtccgcttcgtgcctctattcaagggacctacatgggagggagctaaagggcctttagtgataattcccaaggttgtcatatctctcttgatggtctctagaggtatcatcatcttcgaaaaacatattgcagcagtagggactactagcaaaattatgttttcaaagagactactgagggtgctctatggacgtcgccatgttcttgatgttgaggcctactgtcgcaacctacccttcggcgggaggacgacgcgtgactcgcaggtgcgtcttccaagaaaggaatacgcgtggagtcgccaccaacgtttatttgaggaaaacgtcggaaaaaccggaaaagacgtgatctacgaactttaa

SEQ ID NO: 87733 - DNA, 81 bp, Glycine max
  Peptide Sequence Number=SeqID_179418
atggatgcatggcagtgtgacatatgtggttctaaatctggaaggggatttgggatccataatgtaggtaggatatcctag

SEQ ID NO: 87734 - DNA, 351 bp, Glycine max
  Peptide Sequence Number=SeqID_179419
atgcctaggcaggcgcagggtgatgcacctcaggccgcagacgcaccgccaccacctcatcaggctgatcccactgggtcattaggcatggagcggtatctacagcacttggttcgccagcaggcggccaaccaccgggggcaggtgcagatacacgagtgtctctaccagctcagcctcaatcagcagggccaggatcagtttaggactgaggtcgcatggcccggagattggccagaggcccaggcggaggaggcgcctgcaggagctcccggcgatgcagaggaggcccacatggatgaggagatgacagacttgctcggcttcttgggaggaagcggagccacgtga

SEQ ID NO: 87735 - DNA, 390 bp, Glycine max
  Peptide Sequence Number=SeqID_179420
atggttctcttgaccaggcatgaagagtctataaaaagggtacatctacttgggttgttgactaagaacaagagagggtacatctcttgtggatcagttctagtggagggtacatccactaggttcaaagagaacaagggagggtacatcccttgtggatctttgcttttggtcgaggctatgcaagaaatggattttgtgggggaggcctttgtggttgagggggcattctctgttggatgggcgtcggactggaaggaggtccgatattggctgagtaattgtactggggcagggaatattggtaagtggggtggtgaggggtttgttgggactttggccacgtgggagctgcagttacggcatggccatctccctcctttttcttag

SEQ ID NO: 87736 - DNA, 660 bp, Glycine max
  Peptide Sequence Number=SeqID_179421
atgctgcctcagacggataagaggtctttcgagcgctggcggtataagcatagggggattcatcagacaccacttaatcctttcaaatgccacttgacaatcatcgtcccattggatggactgatttttacgcaacaatttgaaaagaggcttgaaacctcagacttgtttctcggtgtgtggcttcgacattttgaggattgtctttattttttctggatctaccatcaaccatccagcatttggactatcctcttgaaacatcaaccatccagcatcgatcaagctttgtaccttgtgcttgaaggctacacactgctcgatagagtgccccggaacaccaccatgataggcgcaggttgcattgggattgtaccattggggaaaaggaggttggtagaccttccacgggctcagcacaaccatttggttgctgagcaaagtgtagaagcaaagcttcatgatgaatcaagattgattcaaagatgttttgatgataacaaagatgatgacaaaggtgatgacaaaaagctcaaaggccaatcaaagaatgagttcaagatgttcaagatagaatcaagaacacttcaagactcaagaggaaagttgaagaacacttcaagattcaagaggaaagttaaattcaagaatcaagaataa

SEQ ID NO: 87737 - DNA, 771 bp, Glycine max
  Peptide Sequence Number=SeqID_179422
atgaagaagatcctaggcctacaagctccaatggagcttgcatcaatctctgcacatccacaagaaaagggaccgaatcacgctgcagtccctgcctgcgccattggttcacattctattggtgatgcagatgttatggtaaatggaggcacagggtccaacattgatgcattatcaattgcaggattccgcaggataggtgaaggttctagagtcttggtcttggaggaatttgagcatgcaaaaaaccgaggagccaaaatctatgcagaggtccgtggctatgggatgccaggtgatgcatatcatattactcaacctcctagtgatgggagaggagccattttggccatgactcgtgctttaagacagcaattttttcaaggtgctattggtcatctcctaggcgctgctggagctgttgaagcaatttttgcagttttggcaatacggcatggtattgctccattaactcttaatttaactaagccaaatcctatgttcggtgatggtttcatgccattgtctgctttagaagaaatgccaattagagttgctatgtcacaaagtcacgaaaaatctgtatccagtttagcttttagctatgatggacattgtttggaatcgggaggcttagatggaattattaaagtgaaatttggaagcttcagaaacgatgtagaaactccacattctgcatcggttgcgaattcaaaaatgatgtgtagaagcaagcttcatgatgaatcgattaccagtgatagtttctga

SEQ ID NO: 87738 - DNA, 630 bp, Glycine max
  Peptide Sequence Number=SeqID_179423
atggcttcaggaaagaggaaggcaaaagctttggtaccccaggccaaatatgatagatctaaattttcatcccaagaggcttgggaccgcttcacagaaaatatactcggctggaagatccttctggagagaaatgtaaagctgtatgtcactgagttagttgaattcagaagggagctagaaaggagaaactggcataaggaacttataaactttgcagatgggagcatagatgtagcaattgtcaaggagttctatgcaaatctctatgaccccgaagacaaatcacccaagcaggtaagggttagggggcatctaataaaatttgattctgatgcccttaacactttcttccgaacatcggtggtcatagaggaaggggagagcttgccagcctactccaggtttgctcagttgaggccagatctgcaagagctggcagcccgcttatgtatccctaaaaggggatttgaattgaatgcagacaggctgcctctgaagattttgagaaagaatttgactacgctagcccaaacctggagtgtactttccttttctaacttggcccctacctctcacacttcagacatcactttagaccgggcaaggttaatttatggcattatttag

SEQ ID NO: 87739 - DNA, 357 bp, Glycine max
  Peptide Sequence Number=SeqID_179424
atgagcgttaaggagtttcttttgtcggtggcttggccaggagtccaaccttctccttcaggaggaggtgaggcctatgcagcccaggagccgcaaccagaggaggaggatgacactatcattctagagcccactccacctgagccatttacttttgaggctgacacaattattgctcaggaggatgtggcatcaccagagcccttccctcaagcagagccatctccatctccttcctctgagcctgagccatctgcaccagcactagtgcctaaccagtctacttctcaggacccatcatctgcaccggtgttggatttgaacaagcatgcagaggatcattcacaggatgattga

SEQ ID NO: 87740 - DNA, 444 bp, Glycine max
  Peptide Sequence Number=SeqID_179425
atggaagaagaaattgaatacattcatcccatactaaagagaggtgttgaaaggaagaatcagctaggcaagcgcttccattatcttgcccctccttttctctctctccctctccccaaatccttactttctctctccacgcgccactgcaccttcaccgtccacgccgaatcccaaaatggggtcaacctcgtttctacccactacgacttcaacctcttcaccatcggcgcagacagcgacggggtccgagccgctcgcttggccaccaactatggcgcttctgtcgccatctgcgagtttcctttctccactatctcctctgaaaccactggaggtgtcgatggaacactagttcgtaaggttcgggctaaccaagctttcttcagttttccttgttacttcattggtaaaggtgttgctgctgcaaaagttgtcctcaag

SEQ ID NO: 87741 - DNA, 115 bp, Glycine max
  Peptide Sequence Number=SeqID_179426
atgaatttggtccctgagctcatcccttcgaattcagtcttatacaccatcaagagaaaggaagagagagcttggaagaaccaaaacaaggaactcttcatggcaatggctggag

SEQ ID NO: 87742 - DNA, 927 bp, Glycine max
  Peptide Sequence Number=SeqID_179427
atgggagagaacaacaacgagtttcacgcggtggcaacactacctctcaagtacctggcgctgcaagatctggagtgggaaggcaccctcatttgccttcctcccaacttaacgtctctgtcaaataacttcacccctaaggttcttcccctatcgatgtttccaccatcggagaccaccaccactccggttcctcctatgttgccgtcggtggaggacaccacctacgttcaactgaacctccaagatcaattgtcagcgttacaaaacatcaatagcgggaacaacactcatgattaccctcagacacaatttcttaatagggcagcgaaaaaggttgctcccgtgtggccaggctcccaaagcaatcactcgttgtcagtgaaaggcagttcttcgaagtccaatgagtgcaggagatggagtgaagaagaacacagaaatatggaaaaggagattggaaaaaaatttcaagaatcatcaaaacaagaaacccaactcaagttgcttctcatgcccaaaagtatttccttcgtcaagcctcaagtaataaaggcaaaagaagaagcatttatgacatggtcctaccagataatggtcctgtccctcaccgcatttaccagcagaatgaagtttcttttccaaatcttgatgtccctatcacgcaccacattgatcatcagaatggggttccttttcaaaatcatacaatgcaggagttatatgaaattcatctggcagtccctcactacattaatcaacaaaattgggttcttagaccaatgcgataaatatatcaaaagtactggaagagatcacattgatgattgttcattgacaaccttggaagcccatcttagaaacttttttgtgtttgaaggttgtatagcatgcttagtttactctaggaaattttcagattgttaa

SEQ ID NO: 87743 - DNA, 243 bp, Glycine max
  Peptide Sequence Number=SeqID_179428
ggtgacctcgatacttactgcctagttttcctaagtgagagtgtcgtgtggacacgcttaggctatttccttggagatggtaccacattgcatttgagagttgagcttgtaggcctaggatcttcttcatcaatggattcctttgcttcttggaagataaatggtagtggaatggagaaggaagagagagaggagatgccacttcaaggagaagatgagtctagaagaagctcaccaccatag

SEQ ID NO: 87744 - DNA, 183 bp, Glycine max
  Peptide Sequence Number=SeqID_179429
atgagccatgggcgcctgtatcaacaaaggataaagaacgcgttcgacaagaaggggcaggatcctcttaggcaacagtcagaggtcgagacaaggttaaaggcagaaaccaatcaaggtgctcagggacggacgcaaggagaggctagggtcacgacccataggtcattatcctttgcctag

SEQ ID NO: 87745 - DNA, 954 bp, Glycine max
  Peptide Sequence Number=SeqID_179430
atgcaatgcgcaacaggtttaagggagcgcgccacgatgcacgaaaaacgttaccgtattacgctgctgtttaacgccaacaaggtatatgaccgccaggtagtggagggggtcggcgagtatctgcaggcttcgcaaaccgactgggatatcttcattgaagaggatttccgctgccgcatcgacaacatccgcgaatggctgggggacggcgtcattgcggattacgacgacagctcgatcgagagcctgctcagcaatgtgccggtgccgattgtcggcgttggtggctcctatcaccgccagcaggattatccgccggtgcactacatcgccaccgacaacgctgcgctggtggagagtgcctttctgcacctgaaagagaaaggcattcatcgctttgcgttttacggcctgcccgccgccagcggcaaacgctgggcgcaggagcgcgagcaggcgtttcgccagctggtgatgcgcgagcgctaccagggtgtggtgtatcaggggatggaaaccgcgccggaaaactggcagcacgcgcaaaaccgcctcgccgactggctgcaaacgctgccgccgcagaccggcattatcgcggtgaccgacgcgcgtgcacgtcatttgctgcaggcttgtgaatacctgaaaattccggtgccggagaagctcagcgtaatcggcatcgataatgaagagctgacgcgctatctgtcccgtgtggcgctctcttcggtagcccagggcacacgccagatgggttatcaggccgccaagctgttgcatcgtctgctcgatcggcaaacgctgccgctgcaacgcattctggtgccgccggtgaaagtcattgcccgccgctctaccgattttcgctcgctgcgcgatccggcggtgattcaggcgatgcattacatccgctttaacgcctgtaaaggcatcaaggtcgaacag

SEQ ID NO: 87746 - DNA, 519 bp, Glycine max
  Peptide Sequence Number=SeqID_179431
atggaggccataaaagagcaaatggccacaatgataaaggccatgatgagcatgaagaagataatggaagccaatgcggttgcaactgccgctacccgcgttgttgctaaggtgaacctgatgtccccatccggcatcaaccaaatgaatcatccaacctcagatatggtaggcaaagatttgggaagtacgggcagcccccatgatgtgcaaattcaaaacgagcacgccttcccgtcatatggcttgcctctcaactatacgccacccaatgtggcgtacactcccaataagaatactcatgaaattccccatcacaatctagccgacttcgagccttggctcggatataccactgaagggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagggccattga

SEQ ID NO: 87747 - DNA, 303 bp, Glycine max
  Peptide Sequence Number=SeqID_179432
atgcaactagtcggccttcaggagcgatgtcaaagtgaatcttgtagtgaggggtggtatagcaccattacagttgcgtttttgtctgctgctaagggcactctgggaagattctctgctttttctcttccaacaagggatcctgttcatccactcaagcgcattggatcgttggttagccactctggtggtgagtcaaccaaaagaaagagtgacttgccagagagaggaagcacgatcttcagccgttctcttgccaaggtcaggctttcttccgggcaacaaatccattccaaaacctag

SEQ ID NO: 87748 - DNA, 549 bp, Glycine max
  Peptide Sequence Number=SeqID_179433
atggcgcctaccaggcaccctctagacccggataagtccaatagggccctgggattttccgctttgatcacaggactctgccagtcgttcagagttcccgtcgcacctagcaaggtgattcggccgcccatcacccgggcttttattgagaagtattgcacgcagagacagtcccagggtgatgctccacaggctgcagatgcgccgccacctcaccaggctggcccagctggatcatttgatacggagcagtatttacggcatttggttcgccagcaggtggccaaccaccgggcgcatgtacagacccatgactgtctttaccagttgagacttagcctgcagagccagggttttacttcttttccatgccctactccggatcagttcaaggcagaggtcgcatggcccggagattggcctgaggcccgggcaggagtggcaccagcagaggcacccgcagaggctcccgacgaggcagatgaggcccgcgaggacgaggagatgaccgatttgcttgatttcttgggagggagtggagccacatga

SEQ ID NO: 87749 - DNA, 363 bp, Glycine max
  Peptide Sequence Number=SeqID_179434
atgattcaatcttggagcaccaatgaacaattgcttgttggcaaagtctatgaatacattagaggagtcaagcctactgttagttggaaatctctccaagtttgggctcacattcgtgatttggctcatttccgcaggcgtttcacttctttacagcgcattactgactctttaattaagggcagatccacattaggtgttcaaggaaaattacgttgtctggttatagcaattacagtctactgcatctggctgtctaagaacaagctgatttttgaagattatcaattttctgtaatagaggttattagcaagattaagtttcttatgtatagacaagcgcacctgttgcatttgttttag

SEQ ID NO: 87750 - DNA, 156 bp, Glycine max
  Peptide Sequence Number=SeqID_179435
atgcagaattcacgaagatatatgtacctaggaacctacttgaatggtgctttgaaaggattcaacgacagtcaaggaagtaaatccaaggatgctgctagatggatcgtagttaaaatatcaacaatagttctaggaggtttcaaggataactga

SEQ ID NO: 87751 - DNA, 122 bp, Glycine max
  Peptide Sequence Number=SeqID_179436
atgccaacaatttgtcgcactgagccaattagtgaagacatcaaagatcgtatagaagacatgattcacaatcttggacaagactattttcagcaagcacatgcacctttgtatgaaaaaag

SEQ ID NO: 87752 - DNA, 144 bp, Glycine max
  Peptide Sequence Number=SeqID_179437
atgtgcgaaatcagaatgctcagaatcagaatgctcaagattataatgctcaagatcaggatgttcagaatcaccaataagagaatgcacagattcgccagttatggaatgctcagaatgatcaaaaggatcaaagggttgtaa

SEQ ID NO: 87753 - DNA, 829 bp, Glycine max
  Peptide Sequence Number=SeqID_179438
atgtcgaagatcgaagtttcctccgccaccatgaccccgcgcgagatcgtgcaggaactggaccggcacatcgtgggccagcacgacgccaagcgcgccgtggccatcgccctgcgcaaccgctggcgccgcatgcagctggtgccggagctgcgcaatgaagtgatgccgaagaacatcctgatgatcggcccgaccggcgtcggcaagaccgaaatcgcgcgccgcctggccacgctggccaacgcaccgttcgtgaaggtcgaagcgacccgcttcaccgaagtcggctacgtcggcaaggacgtcgagcagatcatccgtgacctggccgatacggccgtcaagctgtaccgcgaacaggccaaggtgcgcgtgcgtacccaggccgaggaacgcgccgaagaccgcatcctcgatgcgctgctgccgcgccgcagcggtggcatcggcttcgatccggaagtcgcccgcaacgaaccgtcggcgcaggacaacgagacccgcatcaagttccgcaagatgcttcgcaacggtgagctggacgagcgcgagatcgagctcgacctggccgccaatgtcagcatggacatcatgaccccaccgggcatggaggaaatgggccagcagctgaagtcgatgttcgccaacctcggcggcggcgccaaggcgcataagcgcacgctgaccatcaaggccgcgcgtccgctgctggtggaagaagaggccggcaagctggtcaacgaagacgatatccgcaccgcggcgatcgaggcctgtgagcagcacggcatcgtcttcatcgacgagatcgacaaggtcgccaagc

SEQ ID NO: 87754 - DNA, 170 bp, Glycine max
  Peptide Sequence Number=SeqID_179439
atgcatcaagctagtgacgttaaaggagcgcttactgggaggcaacccagcttttctttccctttgctatttttcattcttacctcttgcattgtagaccttgcactaagcgctcagtcttcacgcgctaagccgagcatgctcgcactaagtgcacagacccctgattg

SEQ ID NO: 87755 - DNA, 246 bp, Glycine max
  Peptide Sequence Number=SeqID_179440
atggcgaggaataccttcgcccgtgaactccgatcaagaagcagaatcgtctcaggccacgaccagaagtcaagacaagtcaatggcagaaatcaaccaaggtacatagggacggatacaagtggggatagggtcgcgaccgaccgatcgttgccccttcctggcgctaaacaagcagagaacgtcgctgcagggcagcccagtatcctttgcgttcgcagttccttttactattgtttgttttaa

SEQ ID NO: 87756 - DNA, 684 bp, Glycine max
  Peptide Sequence Number=SeqID_179441
atgattggaagtttgaccacccgcatcttcgccatcttctggctcaccctggcgctggtgttgatgctggtactgatggtgcccaaactcgattcgcgccagatgacctcgctgatggagagcgaacagcgccagggcaccatgattgagcaacacgttgaggcggagctgtcacaggatccgcccaacgacctgatgtggtggcgccggctgtttcgcgccatcgacaaatgggcaccgcccggtcagcgcctgctgctggtgaccagcgaaggacgggtgatcggtgcgcagcacaatgaaatgcaggtgatccgtaactttatcggccagtccgataatgccgatcatccgcagaagaaaaagtatggccgcgtcgagatggtcggccccttcgcggtgcgcgacggcgaagacaattaccagctgtatctgatccgtcccgccaccagttcccagctcgatttcgtcaacctgctgtttgaccgtcctctgctgctgctcatcgtcacgatgttaatcagctcaccgctgctgctgtggctggcgtggagcctggcgcgtccggcacgcaaactaaaacatgccgcggatgaagtggcgagcggaaatttgcgtcagcatccggaactggaatcgggcccgcaggaatttctcgcagccggctccagtttcaaccagatg

SEQ ID NO: 87757 - DNA, 195 bp, Glycine max
  Peptide Sequence Number=SeqID_179442
atggaaaagagagaacggaagatcttcagaccagataaattttcggcaggattgccattcaaggtcgttctcgactggaaatatcccaccccacctgaacaaagaggaaaagaccgaaacacccagcttcctctccaaaaaaacactaccctcgagaaaatcctattcgtccgtgatcgtacgtttgatctttga

SEQ ID NO: 87758 - DNA, 483 bp, Glycine max
  Peptide Sequence Number=SeqID_179443
atggtatcaaggtacactttaaatgaaattgctgctgagtatgagcgtgtagcttatgcaggcaaaacccttcacgatgtggatgtgaccataactgaggagatggaaaccatatcgaaacgctttgagcagctcgatgtttgtggtaaagtacatttgaagtcaaagctgcgagaaattgcttatcatgatatgaactccatgtttcctcctccaaaaaagatgaagaccaaggttgcattattgggtatgggtgaagaatcatggtcattggtgcgcaaccatttgcataaagaactgataagctggtccgaagagtatatcaacctggttggtggcatagagagatttgaggaattaaagcattctctacttgttgacggattatctatggttaccatggataaatggatgaatattacggatatgggatatgtcattgcttcacaatacaacgtgatcattatttctctttcacgataa

SEQ ID NO: 87759 - DNA, 216 bp, Glycine max
  Peptide Sequence Number=SeqID_179444
atgccaaagagatacaaatttaagagtgtcgcaacctacccttcggtgagagggcgacgcgagactcgcgggatgcgtgttccacgaaaggaatacgcacggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 87760 - DNA, 876 bp, Glycine max
  Peptide Sequence Number=SeqID_179445
atggagtatagatatcttgtatatgccttcttggctgttaagcaatcctttgaaaattgtatcaaatcatccatttcaactggttgggatcatgaaccagctatgtctatggttgtgcttctagttcttgatgttcatgcatgcattgcaagagatcctcacctcttccggcagcttgttgtttttctagtgcacaattttcaactagataattttcttttggagaagcatggtgctttgatagtccgtcgcctttgtgttcttttgaatgctgagagagtctaccgtgaactttccacaatattagaaggagaaactgatttggattttgcgtcaattatggttcaggctctgaatttgatcttacttacatcatcagaattatctgagattcgagatcttttgaagcaatcactggtaaatcctgctgggaaggacttgtatgtttctctgtatgcctcttggtgtcattctcctatggcaattataagtctttgctttttagctcagcttcttgaacctggaagatatatttggctattcaaggcattgtatggtcttctgatgttgcttcctcagcaaagtgccgcctttaagatactaaaaacgcgtttaaaagctgtgccatcgtattcattcaatggcgagcagttaaagagaatgccttcaggggattcctaccaatttcataatgtccctgatggatttcgaaccattcaggatggtgacatagccgaagacggtggcagctcacgtaatggaataaattttgctgcaaggctacaacagtttcggcaaatacagcaccagcatcggctgctttccaaaacaggcaaaattgtgcaattcttccacttcattgtcaaaggttgctga

SEQ ID NO: 87761 - DNA, 519 bp, Glycine max
  Peptide Sequence Number=SeqID_179446
atgttgctgcttctgctcgctcttaagtgcattagcccaactttactaaggataacttttgatattatattttcattggcaaggattaaggtcgtagtgcttcttgcaaatcagtggaatagtgaatggggagatgatggttacttcaagatccgaagagggacatacgaatgtgggattaaagaggatgtaactgctggtttgccttccaccaaaaacctcgtcagagaggtgactgatatggatgctgacgctgctgtttcattcagaatgagctggcttattgacattggaggatttgcaaagaaagtgaaaagcactactctatcttcagctacatgtttatcaatgagttcatcccaacactggaaggagaccaaggaatttgctacacacatccggaaaatcttccaggtgctaagaaagatgggagttatgtccatttgtttcacagaacaatcaatgcatatgctactggtcaacgaaagcatcgaaagattcatcatcaacagggtttga

SEQ ID NO: 87762 - DNA, 108 bp, Glycine max
  Peptide Sequence Number=SeqID_179447
atggagatgcagcagaagacaaaggagaaaagactaggtagcttccttgagaagcttgagaaaacttccttgagaagcttctttgagaaaacttccttgagaagctag

SEQ ID NO: 87763 - DNA, 789 bp, Glycine max
  Peptide Sequence Number=SeqID_179448
atgaattactcagtgttcggtgatgttgttgcttttgatgcgacatataagaaaaataagtatttatctccatttgtgattttcttggttgtcaatcaccataatcaaatgatagtgtttgtgttgttgttgtggttacaaatgagattgaagagacctatgtatggttattggaacaattttggaaggcatgaaaggtgcttgacatactttcggcatagggaagttgtatcagattattttttgaactatggcaatgttccattggagactaatcttcagtctctaattattaccatgttagtttgtttaaatttgaatgagttcctgaaatcgttgctccttgataggtggtccaagagtgcaaagcatcccattaaaggaaagtacccagatgcctcaattgaacttgaaaggctaaagcttaaaaatagtagtgcaccttctatgaacgttggtgatgaacaaattgaaactaggtttggtaatgttttttatcctactgttgtaagggcaaaaggatctagccaagtggtaaccaatcagtctagtaggcgtaagaggattcaaacatgtaggcagtgtggtggtactggccacaacaaaaggtcttgcatgtttgcatcttataatggtggcattacaggagcaacctcttttgttcacataacacagcaaatcaacaattccccaaacatggatgacaattataactatcaatgggttatagttggagtaatgaacgaatgtcagagtaatttttacatggtgctacttctgatgacttaa

SEQ ID NO: 87764 - DNA, 650 bp, Glycine max
  Peptide Sequence Number=SeqID_179449
aacctattgccattagaggactacacgtcctcaccttcaaagggctacacgccctcaccatcagagggctgcatgccctcaccttcaatggactacacgtcctcgccttcagagggttgcacacccccgccttcagagggctgcacgccctcgccttcagagggctacacgtcctcgccatcagaggactacacgtcctcgccatcagaggacttcacgtcctcgccttcagaggactacacatcctcaccttcagaggacttcacgtcttcaccttcagaggactacacatcctcgccatcaaaggactacacgtccttgccaacagagggctacatagggctacacaccctcgccttaagaggactacacgtcctcaccttcacaaggctgcacgccctcaccttcagaggactacacgtcctcgccatcagaggactacacgtccttgccatcagaggactacacgtccacgcattcagagggctgcacgccctcaccatcagaggactacacgtcctcgcttcagaggactatacgtcctcaccttcagaggactacatgtcctcacctttagagcgctacacgccctcgccttcagaggactacacgccctcgccatcagaggactacacgtcttcgcttcagag

SEQ ID NO: 87765 - DNA, 436 bp, Glycine max
  Peptide Sequence Number=SeqID_179450
cgcgtatcacggaggtactccaaggcattcgatcgagaagtgtgtgaccctcaagcataaggtccaatgcttgattgacgcgggatggttaacattccaagaagatggcccaaatgtgaaaacaaatttgctcgccaatcatgggggtcaagggtgtgaagagcaagtcgccatgatacatgatgaagccccccaagaccattcaaactgggtacagccgtgccttcctgatttccaattaggaaaatggcaagttgttgagcgacccaaagttttcgtggctggcataatattcaacgacaagttctgtgaaggtactaatatcaaggaccctgacgtcgattttgaacaagtagcaaatcgagctaaggatgaagatgatgaagatacggggtttccctcaaagctagaaatgatggtcgctcaagaagactaa

SEQ ID NO: 87766 - DNA, 795 bp, Glycine max
  Peptide Sequence Number=SeqID_179451
atggtagcggccttcgtgcagcaccaggcgcgcgcgacgcgcatccaccacttccagttcagccggcagcaggggcgtcttctcggactccagcatcagcgtgccgctggcgaacagcgccacctcgtcgccgcgcaggtcctcgctcaactcgacctcatagactttcggcagcttcgacttcggcgagatgatccggtgcagcaggccaccgtcgtcggtcagcagcagcaggccactggtctcgcggtcgaggcggcccactgtggacagcaccggatcgcggtcgcggaagcgcggcggcagcaggtcgtagatcaggcggccggtgtccttggtcgagcaggtgtagccggccggcttgtgcagcgcgatcgacaggcccaccggcgggtccagcggctcgccgtcgacgcggatcgcctcgtgcggcacctggtcgtcggcatacagcacctcgccgtcggcgtcggtgacgcggccttcgcggaacatccactgcacctgcttgcggctgccgtagcccaggttggcgatgagcttgaccagcttcacttgcccttccccttcaccgcttccaccagcttgaagccatcacgctcggcgatcacgcgcaccgcgccaaagctctcgttgagcgtgtactcgtacggcaggtggcggttggccaccacgtacaggcgtccgcccgggcgcagcgcctgcgcggccacggcgatgaagcgctggccgatgtccgggcgatcggcgcgcgagggcgtgtggaatggcggattgctgatgatgacgtcgtag

SEQ ID NO: 87767 - DNA, 765 bp, Glycine max
  Peptide Sequence Number=SeqID_179452
atggcagaagtctccacggaggccattgcatccctcgcccagtattatgaccagccgttgaggtgcttcacctttggggacttccagctatcacccatggtggaagaatttgaaaagatcctaggatgccctctagggggaaggaaaccatacctcttctcagggttctatccctttttagctagaatttctaagatagtccaaatctcggcgcaggaattagaccacagaaagcaagtcgaaaatggtgtggttggaataccgagaaaatatttggaggcaaaagcaagaatcttggcaggtagaggcgaatgggccccgttcatagacatcctagctgatctatatgacaccttcgaccgaagatgtcagaagagcagtataaggattgtgtgctgtactccggccctctatgtatggttggtttcgcacctttttcgccaagaggtgaggcatgcttgcccgctagaaagccaccgttcaagcacagagaaaagaggggaaaattgggaccgactcttagcaagcaaagaaggagcgtttgtcaactggttccctcgatggaaagaaggaagaaccgggattcttatttcgtgcggaggatttccaaatgttcccttgatggggacaaggggttgcatcagttacaatcccattcttgttataagacaacttggctaccttatgagaggggcaccactagaggaagaactcacacctactattgcaccaggtttcaataagaccaacatggaggcactttaa

SEQ ID NO: 87768 - DNA, 247 bp, Glycine max
  Peptide Sequence Number=SeqID_179453
atgttggtcggcaaggttttttcgttcgagctcaaccgaagttgtgtttcgaccgacaccagcatgttttcgtttgctaggcatggaagtgatgaggacatgaccaagagcaagggcaaggatccacttgaaggacttggaggacctatgacaagggctagagcaaggaaatccaaggaagctcttcaacaagtgctgtccatactgtttgaatacagcccaagtttcaaggagaaagtccaaggtt

SEQ ID NO: 87769 - DNA, 324 bp, Glycine max
  Peptide Sequence Number=SeqID_179454
atgcgtacacgtccgtccctgagcgacactcgcggtgatcgtgtttctttcagaccagacctctctcctcctataggcgttttgacaacacgaaccgcaagcgtgagcaccgtaaaaatgcgtacacgtccgtccctgagcgacactcgcggtgatcgtgtttctttcagaccagacctctctcctcctataggcgttttgacaacacgaaccgctgttattcccttgcgagcgctctccgccgcattctgccagtcgcaggcgcgtcggaaagtggtcggcggccgaaatttacggactttggaagacctactctggacttag

SEQ ID NO: 87770 - DNA, 306 bp, Glycine max
  Peptide Sequence Number=SeqID_179455
acttatcaaggtaatccttgtggcgtctacccagacttatcttccttcaccggaagtggcgtctacccagacttatcttccttcaccggaagtggcgtctacccagacttatcttccttcaccggaagtggcgtctaccctgacttatcttccttcaccggaagtggcgtcatccaaaaactctacagcctgtatcaagtgatccgccccgtagctgaagacgccgccagcgatgggcatgtcgacgacaaactcggtgtagcagaaggtggagaggagggcgcaaaagctggcaatggcaattaa

SEQ ID NO: 87771 - DNA, 465 bp, Glycine max
  Peptide Sequence Number=SeqID_179456
atgtcttgcctagtgatcataactccgaccttcctttgccgaagtgtcagctggtgtatgccacccaccaggcaccctctagacccggataagtctaacagggccctgggtaaggtgaaccgaccgccgatcacctgggccttcattgagaagtattgcacgcctaggcaggcgcaggccgcagacgcatcgccaccacctcatcgggctgatcccgctgggtcattaggcatggagcggtgcagatacatgagtgtctctaccagctcagcctcagttagcaggggacagggtttcgctccttttgcgtgccctactccagatcagtttagggctgaggtcgcatggcccgaggcccaggcaggggaggcacctgcaggagctcccgacgatgcagaggaggcccgcattgatgaggagatgacgaacttgctcggtttcttgggaggaagcggagccacatga

SEQ ID NO: 87772 - DNA, 995 bp, Glycine max
  Peptide Sequence Number=SeqID_179457
ataacgtcttaggaaggagcaattttccagagaggaaggtagagatataccacacagagtttgatgacttcaagacagagttggagaggcgtaatcttcacaaacacctcaccaacttggctgatgggactattggtgttgctttggtgaaagaattttatgctaatctctatagctctgaggacccttcaccaaagcaagccagagttagaggccacttggtgaggatagacaccgatagcctcaacacatttctagagactcctgtagtcctagaggagggggagacattacccacctactctaggtactgcaggttaccatcagaccacagagagattaaggctactctttgcataccagggaaggggttcattttaaatgttgagggccattcgaggaggattctcgggaaggatttgactaccttggcccaggtgtggagtgttttctcttactccaacctggcccctacatctcatacatcagaccttactatggacagagccaggttgatctttggcctggtctctcatatggacatgaacattggcgctctcatctcaggacagatgacttccattgcccagtctaactcttgcagacttgcgtttcctactttgattaccgtcttatgccgagcccgaagggttgtctctgacagcctcacatttgagtgcctgagcccggccattaacttggcctacatcaggaagaattgttgtaacattgatgatctaatagttgctttccggggggctaggagggcgagggcgaggccaactgatattccatctacttttgcagcttcagcacctactctagcatctacttctgtagctccttcagtcccagctcatgttgacactcagcgctttgaagccatgcttcaaactattcatcagggacgaattcttttgctgcatagtctacaggtggtagctcctccacgatccatcctatcaatggcgcagttcttagagagggtagcctag

SEQ ID NO: 87773 - DNA, 381 bp, Glycine max
  misc_feature (372)..(372): n is a, c, g, or t
  Peptide Sequence Number=SeqID_179458
atggcagataaaaaacaatttattgatgaattaagtgctagatatactccgaaaggagatcatattatattaggaaaaggtatgcttgatggggaggtagttaccgaagtgaatgtaaccattccattaaaaacaatcaacaggcatggtcttattgcgggagccaccggaacaggaaaaaccaaaactcttcaggtatttgcggaacagttatcacatgctgggattccatctttagttttagatattaaaggagatttctcaggaattgcagaagcaggtgaaatgaatcccattatagaagaaagatatgcaaaaacccagcttccatacaatccacaagcctttcctgttgaattaatgagtatttcncggtggtaa

SEQ ID NO: 87774 - DNA, 621 bp, Glycine max
  Peptide Sequence Number=SeqID_179459
atggcagacataggtagaagtggtggtcgtagaacatttgattgtggtataagaaatgattttagtttggaagctccaattaccaccaacccttccccctcaaccattcacatatcaacctcagagtcgatgattcatgttgttgcacagactcgaaacgcacttcctatagctcaagaccaaccaaatcctacctttgtaaaggagtcaattcccactacccttgttagagatgcttcaccttcagcaccagatgattctgttacacctgagtacccaccagatccaaattgtgaacatattgttgatgaaaggcctttcattccttcatataaaggagaggcaaaatttgatgaaccagctccaagttggtttaaggtgtcagttgaccttcgcgatatgtggtttggagagtttaagaaagagtataggtggcacccacaagaagagcgagccattagagctttttttgagacaaaagattcacgtattttaaaaagtgcaatgaacaagatcagaaatggtcaagataccggaaagtggataacagttaatgttcaagcagccttggacgaacattggggttctacaaatttcctaaacaagagctccaatgccaag

SEQ ID NO: 87775 - DNA, 84 bp, Glycine max
  Peptide Sequence Number=SeqID_179460
atggaatgtgtaacaaagggagaacaagctagcatattttggcattgtcagaacttaccatatggaggccacttcaacagataa

SEQ ID NO: 87776 - DNA, 300 bp, Glycine max
  Peptide Sequence Number=SeqID_179461
atgttagtctctacgtgctaccatactctgagtttgacggatagcaaaagagtgtgtgcgggttaccgtatagggcgtctccgcgtgctaatggactcacaagtcatgatagcgaaaggtgggtctctaccggaagatgctgacatcttcggaaagggtgtagatgaccaccttggtctctgcttatcaatcagacttggggtctccgaaggacgaggtgcggataaccgtaaggtgtctccgcatgctaccagactctcggatcgctggatagcaaagatgtgtgcgggttaccgtcgg

SEQ ID NO: 87777 - DNA, 767 bp, Glycine max
  Peptide Sequence Number=SeqID_179462
acgatgaacgacaggaatgcgatgaaagcggtggcgtacaccatcgcctggtagccgaacagcggcttgcggctgaaggtcgggatgatctcgctgaccacgccgaaggcgggcaggatcatgatgtagacctcggggtgcccgaagaaccagaagatgtgctggtacatcaccgggtcaccgccaccggcggcgttgaagaagctggtgccgaagaacttgtcggtcagcagcatggtcaccgcgccggccagcactggcatcaccgcaatcagcaggaaggcggtgatcagccaggcccagcagaagatcggcattttcagcaggtcgatgcccggcgcacgcatgttcagcacggtggcgatgatgttgatcgcacccatgatcgaactgatgccggccacgtggatcgcgaacacgctgaaggccacgttatagccgccctgcagcgacagcggcggatacagcgtccagccaccagccggcgcaccaccgggcaggaacagggtcagcagcagcaggctgaaggccaccggcagcaaccagaacgaccagttgttcatgcgcggcagcgccatgtccggcgcgccgatctgcagcgggatcatccagttggcgaggccgacgaaggccggcatcacgccaccgaagatcatcaccagcgcatgcacggtggtcatctggttgaagaactcgggcttgacgaactgcaggcccggctgcgccagctcggcgcggatcaccacgctccatcgccgcaccgatga

SEQ ID NO: 87778 - DNA, 336 bp, Glycine max
  Peptide Sequence Number=SeqID_179463
atggctccgaagaaactctccatgaagaggtctagaagagatgccccagtagaagggttcgttgccgcccccgagtttgatagtcatcgtttccgaagtgccgagcaccagcagcgcttcaaggccatcaaaggatggtcgttccacagggagaggcgtgttcagctcagagaggatgagtatacggactttcaggaggagatagctcgcagacgttgggcaccgctggtgactcccatggccaagtttgaccatgagatagtcctagtgttctatgctaatgcttggcccacagaggagggagtgcgagacatgcgttcgtgggtgaggggttag

SEQ ID NO: 87779 - DNA, 542 bp, Glycine max
  Peptide Sequence Number=SeqID_179464
gtatgccacctaccaggtaccttctagacccagataagtctaatagggccctgggtttttcgacattgatcacgggtctctgccagtcgttcagggttcctgtcacacctagtaaggtgattcgactgccgatcacccgggctttcatagagaagtattacacgcccagacaggcgcagggtggcgacccgcaggccccagatgcaccgccgccacctcctcaggctaacccagctgggtcatttgacacggagcggtatttacggaatttggtttgccagcaggcggccaaccaaagggcgcacttgcagacccatgactgcctctaccagctcaaccttagcctgcagagccagggtttccctccttttccatgccctactccggatcagttcagggcagaggtcgcatggcccagggattggcctgaggcccaggcaggggaggcacccgcagaggctcccggcgatgcagatgaggcccgcatggacgaggagatgaccgatttgctcgatttcttgggagggagcgaagccacatga

SEQ ID NO: 87780 - DNA, 327 bp, Glycine max
  Peptide Sequence Number=SeqID_179465
atgccgatctccccctgcagaaggattagttggtttgtgtcgtcccaacatagggatcgcacccacaaagacacccagtggacccgaagaagtccaacagggccctggggtttccagctctggttacgggcctttgttagtcctacagggtgcccgttccccccaacaaggtcacgccatcatgacatagggatcgtgcccgtaagatacccagtggacccgaagaagtccaacagggtcttggagttgccagctctgattacgggcctctgtaaattctacggagtgcctgtcgccccccagcaaggtcatcaggccccctactaa

SEQ ID NO: 87781 - DNA, 642 bp, Glycine max
  Peptide Sequence Number=SeqID_179466
atggctccgaaaaagctttccacgaatagatataggagggacgccgcgactgaagggactagtgccgctcccgagtttgatagccactatttcaagagcgctgagcaccagcagcgttttgaggccatcaaaggatggtcgttcgacagagagagacacgtccagctcagggacgatgagtacacagattttcaggaggagatagctcgccgacattggacgtcgctggtcactcccgtgactaagtttgacccagatatagtcctggagttttattctaatgcttggcccacagaagagggagtgcgggacatgcggtcatgggtgaggggtcagtggattccctttgatgcagatgcccttagccagttcctaggtgacccactagtgttagaggaaggccaggagtgcgagtttagtcagaggaggaacaaggccgatgggttcgacgaagatgccattgcccaactattatgcacactgggtcaggattttgctcggaccgctgcagggaggcgggtgcggatcatgcacaccagtatgacgacgttgacccagatgtggatgacattgctgctcaacaatgtcctgcctagtgatcataactccgaccttcctctgccgaagtgtcagctggtttaa

SEQ ID NO: 87782 - DNA, 561 bp, Glycine max
  Peptide Sequence Number=SeqID_179467
atggcgctaaagcgcgcgacctatacccggccgtcgggcaaggaccaagccccgatgagtaggagggcgcggcggtcgctgcaaacccagggcgcgagcccgggcggagcggtcgtcggtgcagatcttggtggtagtagcaaatattcaaatgagaactttgaaggccgaagaggggaaagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 87783 - DNA, 441 bp, Glycine max
  Peptide Sequence Number=SeqID_179468
atggagcatcactcggacaaggttcaagcagttgcttggaatcatcatgcaccacaggttcttcttagtggttcatttgatcatactgttgtcttgaaggatggaaggatgccatcacattctggctataagtggtcagtcacagctgatgtagagagcttggcatgggatctacatactgagcactcgtttgtggtgagtcttgaagaatcctgcctaggtagctttgctattcttagccggtcccaagcccggataaaaggagagggttgtgttaggctttcgacagccaacgtcgttgcccggaagcaacgtgctgtatggctcgagtacagtgtcaaaagagcaagggccgctgcatcgccgcccggatgtagtgaaaaatcaagaaatggggtagggattattgtggacaaggagtggaagaaggatgtcgtggat

SEQ ID NO: 87784 - DNA, 465 bp, Glycine max
  Peptide Sequence Number=SeqID_179469
atggtgaaagcatatacacaggatcacgtctacaagcacccttgggaacgtgtaacttgtgcatcttttgacgcaagtttgctgaccaagagaacaaacaggaaaacggcagtgatgatattgagaaacctggaggcatttgagcctattattaaagcaggatggaggttttctaagttctactgttttatacacgttaccaaaacctatctgatcgcccctgatgtgatctcaccccgttttggtaaagttgcttgtggagatattgtagtcttgctcaatcctcaacaccctaggcactttatgaccaaacgtgtggttggattggagggtgatagcgttacatacatttccaatcctgagacctatgaatatgagggtgatagttttacacgcatttcctctcctgataacggtgataagtctaagacgattgtggtatggtcaatttcttatgaaaattaa

SEQ ID NO: 87785 - DNA, 1836 bp, Glycine max
  Peptide Sequence Number=SeqID_179470
atgtatactggagtgagaaaggtaccagcacatttgggaaaactggagtatcttcaagtattaatgagttcgtttaatgttggcaaaagtagggagttcagtatccagcagctaggagaactcaatcttcatggaagtctatcaattgagaacctgcagaatgttgagaatccctctgatgcattggctgtggatttaaaaaataaaacacaccttgtcgagctagagttagaatgggattcagactggaaccccgatgattcaacaaaagaaagggatgaaattgtaatcgagaatctacagccttccaaacacttggagaagttgacgatgaggaactatgggggtaaacaatttcctagttggttatcggataattcatcattgaatgtggtgtccttaagcttgaggaactgtcaatcttgccaacgtttgcctccccttggacttttgccatttctgaaggagctttcaattgaagggcttgatgggattgtgagtattaatgctgattttttcgggagtagctcttgttcatttacatccttggaatctttgaggttctccaatatgaaggaatgggaagaatgggaatgtaaaggtgtgacaggtgcttttccacgtcttcaacgtctttctatagggtattgtcccaagctgaaaggtttgcctccccttggacttttgccatttctgaaggagctttcaattgaagggcttgatgggattgtgagtattaatgctgattttttcgggagtagctcttgttcatttacatccttggaatctttgaagttctccgatatgaaggaatgggaagaatgggaatgtaaaggtgtgacaggtgcttttccacgtcttcaacgtctttctataaggtattgtcccaagctgaaaggtttgcctccccttggacttttgccatttctgaaggagctttcaattcaaaggcttgatgggattgtgagtattaatgctgattttttcgggagtagctcttgttcatttacatccttggaatctttggatttctacgatatgaaggaatgggaagaatgggaatgtaaaggtgtgacaggtgcttttccacgtcttcaacgtctttctatatataattgtcccaagctgaaatggcacttgccagagcaactatctcatttaaatcgtctagggatttctggatgggactctctaacgaccattccgctagatatcttcccaatactcagggagcttgatatcagggagtgtcttaatctacaggggatttcacaggggcagactcataatcatctccagcgtctgagtatgagagagtgcccccaattagaatcattgcctgaaggaatgcatgtcctccttccatctcttgattatctgggcataattcgttgtccaaaagttgaaatgtttcccgaaggaggtttgccatcaaatttaaaaaatatgcatctctatggtagttacaaacttatgtcctcattgaaaagtgccttgggaggcaatcactctctagaaaccttacggattggaggagtggatgttgagtgtcttcctgaggaaggtgtactgccacactctcttgttactctagacatcagtcattgtgaagatctaaaaagactggactacaaaggtctctgccacctctcctctctcaaggaattgactctttggaactgccgcaggctccaatgcttaccagaggagggtctgcccaaatccatttcaactttgacaattcggaggtgtgggtttctcaaacaacgttgccgggaaccccaaggcgaagactggccaaagattgctcacattgaagacgtggatataaggtag

SEQ ID NO: 87786 - DNA, 1770 bp, Glycine max
  Peptide Sequence Number=SeqID_179471
atgatgtgcactgctcgcggcgagcaatatgcgcatcaaacaacaatgttgatacttgaacagctgagagattattcctgggatgcaaaagcagtgatagtactagcagcatttgctctggagtttggaaagttttggcaacttgcgcatatcccacgtgacaaacttggacaatcattggcagagttgaatggacttcaaagcatcatggaaaacatacagcacctggctaactttaacaatttggtgaagaagattgtgcaagtggttaaatgcatcactgattggaagaagatgattactgcggagtataacgtaaaggatgtgccttctttgacggacactttgcacgagattcctgttcttgcatactggacaatcagcacattggtcacttgtaccagccacattgatttcttgggtgataagggttacagatacgatttatccaaatttgactataagcttgacttcattctcaaaaatttcaaggaccaccaggacaagtgcagcacacagatagggcaaatagaagattactcgaggcgcaaggatattatcacttccattcaaactgatacacaaattgatattgtaaaatttttggaagctcttattatccccagttattcccaggattccagaccaatagtgtataatggtcttactggaccacaggttgcattaggagagtttaagaataagcatgtcttattgttcatttctggccttgaccacattgacaatgagattcagcttttaaaatcgatcaatgcgaaattgaaggaagaaccaaacgagctggagggttataggaaagaggatttcaagattttgtggatccccatagtgagtgtttgggatgaagagcaaaagaaaaagttagatgttactaaggttgagtggtatgtggtgaaggaattcaatttccaaacaggtattgatctgataaaagaggtattcaattacaaaggtaaccccattatcatgctcataagccctgagggtaaagtggaaaactctgatgcaaagcagattatttccaaatgggggattgatggcttccctttcagaacctcagatcacactcgactcactcagcaatggaactggttttggaatgaaatgatcaccctcagtcctataataagagaattgatcaaaagggactcttacatcttcatctatggaggcaccaacactaagtggatccaagatttcaccacagctgtggagaaattgaaaaagaatgaaactcttaccctagaggaagaaaccacaattgagtcctatccattgggaagggacagcccaaagattgttccgcgcttctggatcaccatagacaacttgcttgctagcaggaaactaacaaaaaagggtagtgaacaagtgcaagattctacaacaagagagattcagaaattgatgttcctcaaacaagatccacttggatgggccattcttacaaaagggtctcatgtgaagcttctaggtcatggtgatgccatgcttagaactgtcacagactttgagagttggaaagggacaatgcacaatgaagtgagctttgatgtagctttcaagaactactatgataaatgcaaggtaaagagtgttcctcccaaatgtgaacatagggaatttgccaattaccccactgacattctagctcacataccatgtccaaataagtgtggacatgaaatggaagtttcttctgttaaatacatgtgttgtcatggtcgtgaagccagtgacattgcctaa

SEQ ID NO: 87787 - DNA, 99 bp, Glycine max
  Peptide Sequence Number=SeqID_179472
atgcctgagacggtgacaaggaagaggatgaggacgccatcatcgacattcaagatcttgggttacgcaccctccttccatgcacctataccaaggtaa

SEQ ID NO: 87788 - DNA, 410 bp, Glycine max
  Peptide Sequence Number=SeqID_179473
tcacaggactctgccagtcgttcggagtccccgtcgcacctagcaaggtgatccggccgcccatcacccgagcttttgttgagaagtattgcacacagagacaggcccagggggatgtttcacaggccgcatacgcgccgccacctcatcaggctggtctagccggatcgtttgatacggagcagtatttgcggcatttgatgagcctcagcctgcagagccagggttttacttcttttccgtgccctactctggaccagttcaaggcagaggtcacatggcctggagattggcctgaggcccgggcaggagaggcgccagcagaggctctcgacgaggcagatgaggcccgcgaggacgaggagatgaccgatttacttgatttcttaggaggaagcggggccacatga

SEQ ID NO: 87789 - DNA, 494 bp, Glycine max
  Peptide Sequence Number=SeqID_179474
atgcagctccccagtggcgaagacccacaacatccgcacgttggcaacaagaagttgtcccttttcctgaggatgtttgtctcgtggatgatgcaactgacgaggtcttccaaaagcctcaagaagcagttgctgatgcccagggttttccaggcaggccacgtgacacatcaattttaactggctatgttgatcatgttgcagtcattgttgggaatagagaggaatgtcctgaattgaagttatcctctcatggaaggaaggttcaaaaattcggggttcctactgcagagatagaagggttagttgctgccacaggattaagtcctctgatcgcatgttcattggacactggcgatcggggacttatatcggcttttgcggagatgaggcataaggaaactagcagtttccatcttcttgtaggagaggtgaccatcaccctcgatggtggcctctttgcttcatttttccatcacaagcgccttccataa

SEQ ID NO: 87790 - DNA, 195 bp, Glycine max
  Peptide Sequence Number=SeqID_179475
ggttttcaagcgttagagagaaggagaagagattgtagcctccattttgtggaagcaatgccttccaagattattttgatgatgccaaagaatcaagagttaagcaagatccaaagaatcaggagtcaaaaagcttcaacaatcaagtttcaagattcaagaatcaagagaagacttaatcaagataagtactaa

SEQ ID NO: 87791 - DNA, 226 bp, Glycine max
  Peptide Sequence Number=SeqID_179476
cgctgttcatgtgtcctccaccttcgagtttggagctatgtttcatgattgcctaagtgcggaccctcaagccaatcctccattctccccccttttacggagccccgttcatgtgtcctccaccttcgagtttggagctatgtttcatgattgcctaagtgcggaccctcaaggcaatcctccactctcccccttttttcggagcctcatgaatgttattgcctag

SEQ ID NO: 87792 - DNA, 179 bp, Glycine max
  Peptide Sequence Number=SeqID_179477
atggcttcgaaaaagctttccgcgaagagatctaggagggacgccgcggctgaagggaccagtgctgcccccgagtttgatagccaccatttcaggagcgctgagcaccagcagcgcttcgaggccatcaaaggatggtcgttccacagagagagacgcgtccaactcagggacaatga

SEQ ID NO: 87793 - DNA, 393 bp, Glycine max
  Peptide Sequence Number=SeqID_179478
atgtctatcgtccatatccaaattgcactgatgttggtgacaaccaagtggtcgagaaccctaactataggcattttttggaccaacaacaacaatctgattcgcaggatgattgattcgaggtgttttgatgataacaaagatgatgacaaaaatcccaagagaatgatttcaagattgagtcaagaacaattcaagaatcaagagaaagattcaagagaaagtttcatcaagaagattcaagattcaagaataatcaagatcaagattcaagacttaaagattcaagaatcaagagaagacttaatcaagataagtattaaaaagttttttaaaacattgagtagcacaagaagttttcacaaaatcattaccaaagagttttactctctg

SEQ ID NO: 87794 - DNA, 183 bp, Glycine max
  Peptide Sequence Number=SeqID_179479
atgccaaaagatagggggacttgtcttgatttcagggattgtcatcatcaaaaagggggagattgtggacaaaggatcaagctgaatgttttgatgatgccaaagtttcacatgcgtctcaaagctttattcaagacaaagaaattaaagatattcaagatggatgatcaagacaatctctag

SEQ ID NO: 87795 - DNA, 381 bp, Glycine max
  Peptide Sequence Number=SeqID_179480
atggaatcgcccccacaaagacacccagtggacccggagaagtccaacagggccctggggtttccagctctggttacgggcctctgtagtcctacagggtgcccgttccccccggcaaggtcacgtcatcatagggatcgcgcctgcaagacacccagtggacccgaagaagtccaacagggtcttgaattctacggagtacctgtcacctccagcaagggcatcaggccccctactaatcgagctttcatcaagaattactgcgtctccaggcaggcgcagggtgaaacaccacagcagcctggggatggccggcagcgggcaacagacgcaccgccatcacctctagagttcatctcagctcatccacaaaaaggttag

SEQ ID NO: 87796 - DNA, 106 bp, Glycine max
  Peptide Sequence Number=SeqID_179481
atggctggacggaatgattgtgcgatagctgatgctctccaagccttagctcaggctatagggaatccaaataggggagaagttgctggagctgctgggtatcaag

SEQ ID NO: 87797 - DNA, 189 bp, Glycine max
  Peptide Sequence Number=SeqID_179482
atgcaaatcttcatagaggctatagatttaaacatctgggaagccattgaaatcagtccttacatccctaaaaatgacaagaaaaagaaaggaattgcacttaaagcctcatcttctattcaagaagaaagtgacaaagaggactttaatgaaatagaagaagatgatgatttcagtttcttcataaat

SEQ ID NO: 87798 - DNA, 261 bp, Glycine max
  Peptide Sequence Number=SeqID_179483
atgacttatcaaggtaatccttgtggcatctacccagacttatcttccttcattggaagtggcgtctacccagacttatcttccttcaccggaagtggcgtctaccctgacttatcttccttcaccggaagtggtgtatatcctgacttatcttccttcactggaagtggcgtctacccggacttatcttccttcaccggaagtggcctctaccctgacttatcttccttcaccggaagtggcgtcatccaacctccgtag

SEQ ID NO: 87799 - DNA, 906 bp, Glycine max
  misc_feature (7)..(7): n is a, c, g, or t
  Peptide Sequence Number=SeqID_179484
gaggggntgggtctgaatcctcgtggacgggtgcccttctatcttcggaaacgctttcaggaacgggatccgttaatcagcccgcggagggaatgcctgttcctcccgcaaatccggtcgtggagcaagccggtccggcaaatccggaagataccactgaaatcataggtggagactctattgactcgataaggaaccgcctcttacagtcatacgggaatccttcggcggagcaaatctctcgcgcctcgtatgacgccgatgatctctttcaggttaaagtggagatcataagggggatgactccacttgatcctgaaggggattggccggggcggggggctcgggcactcgataaccctcgaacgagcacgggcgaggattccctcgagaacctctatcgactaaaggacgacctgaatgagaatgggcgggactccgagacctttaaaagattgaaagacaaaatagtgccatacgtcccaccacaaccgtccgatcctctgatggagaagatcagtcgccttgaacgggcagttaataagttgagtagggacaagtatgatgttgcagatcttgagaatctctccttataccccaaagtcaggcttccgtacggatctggattgtctgcagatgatgatgtccactcctggctcgatgcgcttaacgaaagggaactccctagattaagaatgaatttccttcgtgcttctgttgcgtataatgtaaatcccgtagcggatcaattccaacgagcctttcaaacaatcagatcgttcctgcgtttcggatatgaagtctcattcgaagctttagacaaaggtgctattgagatattgggcccttatgagtgcgttatgacccgtggccgcctgcctggtcaggtggggtcctccgttgtgg

SEQ ID NO: 87800 - DNA, 255 bp, Glycine max
  Peptide Sequence Number=SeqID_179485
atggccaataaacatcttcaagctgcaacgaccatgatttctttgattaactatataagtacccatgatttctttcaagctgctcaccataattattgttggtaccaagaaatggtttatccaagtggtactagacacgaatcccttaagcatgtagtaaagggtttgaatcctgacgaatgcatatatggagaaaatcttgttgagagggagatcccacttatgagtgccaacaggtcccttggaggatattaa

SEQ ID NO: 87801 - DNA, 423 bp, Glycine max
  Peptide Sequence Number=SeqID_179486
ttggaactcttacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcatgcaacagggacaggcagatatcctcatagttaggttccctgaccctaactatggtgttaaaacg

SEQ ID NO: 87802 - DNA, 709 bp, Glycine max
  Peptide Sequence Number=SeqID_179487
atggccccaaggaagcttgcctcaaagagatccaagaaggataaagcggatgaaggaactagttccgctcccgaatatgacagccaccattttaggagcgctgagcaccagcagcgcttcgaggccatcaagggatggtcatttctccgggagcgacgcgttcagctcaaggacaacgagtataccgacttccaagaggagatagttcgccggcgatgggcgtcactggttacccccatggccaagttcgacccagacatagtcctcgaattttatgccaatgcttggcctacagaggagggcgtgcgagatatgcgatcctgggtgaggggtcagtggatcccgttcgatgccgatgctctcagccagttcctgggataccctttagtgttggaggagggccaggaatgcgagtatggccagaggaggaaccggtccgacgggtttgatgaggaggccatcgcccagttgctatgtataccggggcaggattttgcccggactgctgctggaaggcgggtgcggatcatgcgcaccaacatgaccaccctgactcagatctggatgactttgctgctcagcaacatccagcccagcgatcataattctgacctccccctgacgaagtgtcagctagtgtacgccatcctgacacggatgagcattcacgtggctcacttaatcgctgatgccatctatctatttgcag

SEQ ID NO: 87803 - DNA, 549 bp, Glycine max
  Peptide Sequence Number=SeqID_179488
atggcgcctaccaggcaccttctggacccggataagtccaacagggccctgagatttcccgccttgatcacaggactctgccagtcattcggagtccctatcgcacctagcaaggtgattcggccgcccatcacccgagcttttattgagaagtattgcacgcagagacaggtccagggggatgctccgcaggccgcagacgcgccgccacctcatcaggccggtccagccggattgtttgataaggagcagtatttgtggcatttggttcgccagcaggtggccaaccaccgggcacatgtacagacccatgattgtttttaccagatgagcctcagcctgcagagccagggttttacttcttttccgtgccctactccggaccagttcagggcagaggtcgcatggcctggagattggcctgaggcccgggcaggagaggcgccagcagaggcaccagcagaggctcccgacgagacagatgaggcccgcgaggacgaggagatgaccaatttacttgatttcttaggaggaagcggggccacatga

SEQ ID NO: 87804 - DNA, 783 bp, Glycine max
  Peptide Sequence Number=SeqID_179489
atggcgtcgttgcttcacattcccattacaggcacattttacaatcttgaacatatggataagaagacggcaattctcgtgcttgttgacttacttggagttgaatatgagattgcatttgatgagaaaaagaaaacaagagttggttgcaccttattttctaacaagagtgcaacctatgtagaggtcaaattcttagacatttttcatgacttggaaggatatgggaggtattcatggggggtagttgctctgacatatctttatgagcatcttagtgatattagtattgttggcacaaaacagattggtggctatgccattcttcttcagcacatggttgatcataagttggttattcaagacattgatgcatacgttgtgactaaaaagatattagcattgacacatggagtaattgatgatgaaaatatggatacaagaggtggacgtggtggaaatgtcaacaccagcaaaggacgggcgatcatatcctccaaagatagttgcatactcatcacacctctttatgcaaattgttatgaactagaggccaagaatcttcacccataccaagaatctttctcttgcgtgctagttgttgggatggtgtaccaagtgacttccatgaagatgaactatcacgctatgaatgtaatgcatccatatgctcacaaacgaatatcaactagcttaattaggttcaaaggatgcaatgtgatgccaaaggtacaagggagaaaggggtggggtggcaatcatgagagacaaatgggggtgtag

SEQ ID NO: 87805 - DNA, 192 bp, Glycine max
  Peptide Sequence Number=SeqID_179490
atggagctgacacgtggccttggagatgccagtagcaccagcgccttgcgttttggctacatggcgttgaagacgccagcaacaatggcgcgttctccatgggagagcaatggcgccagtcaaactggcgacttacctttgacagggagaacagctttggcaggagagcaggagcagcttttcagtgcttag

SEQ ID NO: 87806 - DNA, 249 bp, Glycine max
  Peptide Sequence Number=SeqID_179491
atgggactgttaaaacttcgtcttctccgcgtgaacttctcgctgcaggccaccgttcgtgacaggtgcgtcgctgccggaggtctcgccaccgttcgtgccggtgcgtcgctgccggaggtcatcgcggctgcgtgcgcgtgcggggtgcgggagggacgcggctgggtgcggcgggttgcgggagggacgcgactggtgcagggaggctcgcggttgggttctctcttagatggaaggttgttctga

SEQ ID NO: 87807 - DNA, 1701 bp, Glycine max
  Peptide Sequence Number=SeqID_179492
atgaggggtgcaagtgcacaccctcacagccatttgttgaccgaacgagaaaagagaaatttggcctttctgaatcggctcccgagatctattcgcagtgataggattgttcctttgtatatagcccttcacccctttgcggacttggaggagatggatgacatttttgactttcagaatatcatgttggaccaaaataatggcgttcaccatttggaatatgacgtctaccatggccgtaacgttgtggcgattcatggtggccatggtggatgcaacaggataatgtcagggacatggatatgcactgcttcctcaaaccctactagtaagaggataaacattggatggaaacattgcacgactgttagaaaaaatgacacaaatgaaatatgttgtaagcattgccacaagatcatgaaaggaggaattacaagggggaaacatcatttgattggaaagccggggaatgttgcaccttgcttagtatgcttgaaagaagttgtagatgagataagggcatctgaaaaatacccaagaagaaggatactagaaaggggcccatggatctctatactcaacttcaatctacagcttcaaagaattgggataagttgctacaagttatccttcaacatgatcaagttgcaaagctttcaagacatgctttgtgaagttaggcattttggaaagcatttgcgacctccaagctatcatgacattaaagtaatacttcaaaaagaggtggggacaatgttgatgaagtccattgatgcttctaattatgtgaagatcgttgacaagctatttgagttgcttgattctattgagattggagaagaaaaagttgcccaagttgtaacaaacaatgggagtaactatgtttatggtagtaggaagttgaagcactttgagtatgttgagattctttacaaacaaaagagagttagtgaggcatgcaatcactcgatttgcaacttcttatctttcctcggaaaggattcaccaagagaaaatattagaaccatgtttgcattgaatgattggaatgaaaacaagttgtcaaaggagacaaagggaaaggaagccactaaaactgtattgatgtcaaatttttggaagaatgtagtttacattctcaaagtgatggctcctctaatgaaagtgtttcaacttgttgatgatgcaaacaaatatagggacgcgtttcaaatcattgataaaagatggaatgttcaactttattctccattacatgcaatcaatcactttttgaatccagagttcttctatgacaactctcaaatagaatttgatggtgaggttgtaaggggattgtatgaggtcatcaataagttggagggagatttagagatggagaaaatcatcatgagggagttgctatcttatacaatgggggctgttggataccatgttgacaaacctgatcaaccttacatgtttcttgtggatgaagttgtaatgccaccgtccgcaaaacctccagctattgtgttaatgacttgtcgagcagtctcgattatggtaccttctatagtcataagaggtccttgtggattgtggagaaaatccttcaagtcccttggaggtgtgagtgcctttcgcagtgctcacatgattcttgagctaagtgcttcttcaagaactctttcacgattggtgtttaaggctatgtactag

SEQ ID NO: 87808 - DNA, 216 bp, Glycine max
  Peptide Sequence Number=SeqID_179493
atgggactgttaaaagccaccgttcgtgacaggtgcgtcgctgccggaggtctcgccactgttcgtgccggtgcgtcgctgccggaggtcgtcgcggctgcgtgcgcgtgcggggtgcgggagggacgcggctgggtgcggcgggttgcgggagggacgcggctggtgcagggaggctcgcggttgggttctctcttagatggaaggttgttctga

SEQ ID NO: 87809 - DNA, 861 bp, Glycine max
  Peptide Sequence Number=SeqID_179494
atggcgataggaacaatggttcgggaagagaaggctgttatatatgtcaccagtcagtatttgactgagtctcctctgatgcctgtaatagaaggttacgatgaagtccattttgaagtggagctggttcactttattcagcatttcaccagcacgatcagtgaatccgtccacgtgtcatgtcgccagtcagcttggcgaaatagggagtgcatgtcgccagtcagcttggcgaaacagggagtgcatttcaccagcgagcttggcgaaacggggacagctttgaccgaaacacatgttggtacatgcaggctacattcagaagcatgctgtagggatgtagccttttcagaagcatgtgttttgctaacaccaccaacgaaacatgcacatgatggtcacgtgaaagctgctgcatttttcgatatccccaatgtcgtgaaagctgtgcatgtttcacgtgattttccaatggattgtccccttcatgacagtctgcttcgcgttcattacaagggtactgttctcaatgaagaaaagagggtattctatgatacaagggtagacaatgatagtcagccattggagttctgttctggagaagggcttgtaccagagggatttgaaatgagtgttcgtttgatgcttcctggagagatagctcttgtcacatgccctcctgactatgcttatgataagtttccgaggttgctgacgaaaatccattgtcattctgttctattcctatgctttattgccatacttcctccttttatgactaggccattaaatgtccctgagggtgctcatattcagtgggaaattgagcttctaggttttgaaacgccaaaggtactttaa

SEQ ID NO: 87810 - DNA, 62 bp, Glycine max
  Peptide Sequence Number=SeqID_179495
atggcgccaaaaacttgttcggtcgcggcaagtgcgccagatcgcgcaagtagtataaaacg

SEQ ID NO: 87811 - DNA, 290 bp, Glycine max
  Peptide Sequence Number=SeqID_179496
atgccctcgccttcagaggactacacgccctcgccttcagaggggtacacatcctcgcctgcagagggctacacgccctcaccttcagagggctacacaccctcgccttatgagggctacacaccctcgccttcagagggctgcacaccctcaacttcagagggctgcacaccctcgcctttagagggctacaggccctcgcctttagagggctacacgtcctcgcctttagaggactacacgccctcgcctttagaggactacatgtcctcaccttcagagggctacac

SEQ ID NO: 87812 - DNA, 414 bp, Glycine max
  Peptide Sequence Number=SeqID_179497
atgacaaattcatttgttgggcatccatatgcaggtcgactgactaaagatgagaagattgttgttgttgatatgacaaagtccatggtgaagccaagaaatattcttttaacgttgaaggagcacaatgccaacagtttgaaagctgtatgcccgaatgctacaaacttgtgtcggtttcacattgacaagaatgtgaaggcaaagtgcaaaaccctgatttctcaaaaaaatgcatgggattatgtgattgaggcttgggggagtttggttgactgtccatgtgaaagttattttgatgagtaccttaaaaactttgaaatggattgctctccgtggcctatgtttgtggactatgtgagccaaaacataggtgattccgcacaaagaaaattttgtgaaagcatggactaa

SEQ ID NO: 87813 - DNA, 531 bp, Glycine max
  Peptide Sequence Number=SeqID_179498
atggccttagtggttgtcagcgactgcattattcccgtcgcgctgatcccggtcatgttgagcgcatttcaactcgaaaataaccgactgactcggcttgaagccgaagagtcacagcccctcattgatgccgtatgggtggatctggtcgagccggacgacgatgagcgccttcgcgtacaatctgagctggggcaaagcctggcaacccgtcctgaactggaagacatcgaagcttctgcgcgtttttttgaagatgaagatggcctgcacattcactccttcttcttctttgaagatgcggaagaccatgcgggcaactccaccgtggcctttaccattcgcgacggtcgcctgtttaccctgcgcgagcgtgaactgcccgcgtttcgtctctaccgcatgcgcgcccgcagccaggcaatggtggacggcaacgcttacgaactgctgctcgacctgtttgagaccaaaattgaacagctggcggatgagattgaaacatctacagcgatctggaaagctgaccgc

SEQ ID NO: 87814 - DNA, 303 bp, Glycine max
  Peptide Sequence Number=SeqID_179499
atgcgcatgctgaaggtgggatcggtacacacggataaggactatcatgaggctctatgtacttcattccgtttaccccgccttcctaatttgacatttcccattttccatggaataagtaggattcaggtgataacggggataaccattgctgttctgaaatgcagactcctcactacggggtcggatgaagggattcgaaagacagcatggatcggggagaggagggagaaaggtgaatccgctcatgatgcgtggaaagtaggggaagagtctgattcaaaaccgtctgcgatagatcac

SEQ ID NO: 87815 - DNA, 588 bp, Glycine max
  Peptide Sequence Number=SeqID_179500
atgtccgccatgttgttcacctcccaccgtctgggcccgctgaccctgcccaaccgcatcgtgatgccgccgatgacccgctcgcgtgcggctgccggcaacgttgctaccgccgagatggcgacctactacgcgcagcgtgccggtgccggcctgattgtcagcgaaggcacccagatcagcccgcagggccagggctatgcctggacgccgggcatccacagccccgaacaggtcaagggctggcggcaaggtgacacgatgcggtgcacgccgccgcgcggttacgtggtgccgcgcgcgctcgagaccgatgagatcccgggcatcgtcgaggcctatcggcgcggcgcgcaactggcgcatgaagccggtttcgacggcgttgaagtgcacggcgccaatggctatctgctggaccagttcctgcaggacagcaccaatcagcgcaccgacggctacggcggctcgctcgagtgcccgcgcccgcctgatgctggacgtggtggatgcctgcgtcagcgtctggggcggcggccgggtcggcctgcacctgtcgccgcgtggcgatgcgcatacgatgggtga

SEQ ID NO: 87816 - DNA, 165 bp, Glycine max
  Peptide Sequence Number=SeqID_179501
atggagggagacataggtctcatactagacctcactctcaaagaaaagaaaaggatagaagtgaagagagaaaagttccattggttacccttaacttccaagggtatgccctctattggtggacttcccttattagggaaagaaggattcatggggatcctctag

SEQ ID NO: 87817 - DNA, 527 bp, Glycine max
  Peptide Sequence Number=SeqID_179502
ccaaagcatctgaagttgtagccttagggaagctgaaaactcttactaagagtaccattagagaaagatctttaaaagcacaacatagttccatgatcactatctcaaaatttgagtatgagtatctaacaaatcatgcagcctcagtagaagaaattgctgataaaaaagtagcagcagctgaggcatggattgaagctctcaaggccagcgagaaggaaatactgatggaaacaaaaatagctcaaagacaactcaaagaatcaaaattggagcaagagctggaggtatacaccaaagagaagatgctttcaagaagagttagtagtagtgaggagcttcacaattcatatgcatattttacacttaggtggcaccatccagtttttagtttacaattacacgaaccccagaaaaaggtgaagtcccttcactaccgcttacacaaactaataatgatcaatttgaagcgacatatgatacactcacaccccacacacgccaaagacagtagctttcatggatga

SEQ ID NO: 87818 - DNA, 264 bp, Glycine max
  Peptide Sequence Number=SeqID_179503
atggacctgggtatagggccctgtcgcaacgtgcccttcgcgagcgagcgaaggcgaggctcacgggtgcgctttccaaaggaggaaaggtgcgcagagtcgccaccaatgtttatttgtggaaaacgtcgggaaaaccaaaggaaaccggtcaaaatgaaaattctaagttcgggagttgtatttacgcttgaggaaggtcgacaaaagcagggcttttgctcctacgtaccctcatttggagaagaaatcagacctacgtag

SEQ ID NO: 87819 - DNA, 141 bp, Glycine max
  Peptide Sequence Number=SeqID_179504
atgactaaagcacgtcaaaagggggtatggaaagaaaatgggggagatgcttgccacccagctcgcccaggtgagctaggttgctttctccagaagcaaccgccttctcaaggaattttctggaaggcccatgtgggcctg

SEQ ID NO: 87820 - DNA, 453 bp, Glycine max
  Peptide Sequence Number=SeqID_179505
atgaattcctcctccatttatattcttgtctttctccacctttggttatgtagcttaccttgcagagagagtgtgtgcatcccaagtgagcgtgagacacttttgaagtttaagaataatctgaatgatccttccaataggctttggtcttggaatcataataataccaactgttgccactggtatggagtcctctgccacaacgtcacttcccatcttcttcagcttcacctcaacacttcaccttctgctttcgagtatgactactataatggattctaccatagattcgatgaggaagcttatcggagatggagctttggtggagagataagtccttgtttggctgatttaaagcatttgaattacttggacttgagcggcaatagatttcttggagaagattcctcctcagattgggaatctctcagattcggtgtatccttgacctga

SEQ ID NO: 87821 - DNA, 159 bp, Glycine max
  Peptide Sequence Number=SeqID_179506
atggagcaagttagcataggacaccagaattgcagtgaattctacaggctttttgctgcaaaattccctccttggttggtgttttggtttgtgctaaaggtggtgtttgtcattggaagtgtggaaaacacttgggctgctggatccctccacctttag

SEQ ID NO: 87822 - DNA, 334 bp, Glycine max
  Peptide Sequence Number=SeqID_179507
atgtctgcagatgtaaccttctttgaagacacaccattctacccatcatctactgaccattcttcttccatccagaatgtccttccaattccctctccatgtcctctagatacctcaaatccagatgtcagtgaggttccttcttctccacctcatccaattgaagttgcttctccacctcttctcacaaaccaatgcaggatacaacaagttggtccttcaatacctgaagcttcttttcatgattctcctccttcttcaatcaatcctcaagccatggatcctgccacttctcatccctctgattcagattggcccattgccatccgaaaag

SEQ ID NO: 87823 - DNA, 61 bp, Glycine max
  Peptide Sequence Number=SeqID_179508
atgagaggcactatgcacgagcctcaagcaaacctaggggcagatcataagttcttacctg

SEQ ID NO: 87824 - DNA, 318 bp, Glycine max
  Peptide Sequence Number=SeqID_179509
atgggcgaaagcctgacggagcaatgccgcgtgaaggtagaaggcctacgggtcatgaacttcttttcccggagaagaagcaatgacgcagccgcggtaagacagaggatgcaagcgttatccggaatgattgggcgtaaagcgtctgtaggtggctttttaagttcgccgtcaaatcccagggctcaaccctggacaggcggtgaaactacaagctggagtacggtaggggcagagggaatttccggtggagcggtgaaatgcgtagagatcggaaagaacaccaacggcgaaagcactctgctgggccgacactga

SEQ ID NO: 87825 - DNA, 479 bp, Glycine max
  Peptide Sequence Number=SeqID_179510
atgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggaaaatgcctcgagccaaagttcgagtaccaggcgtacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 87826 - DNA, 369 bp, Glycine max
  Peptide Sequence Number=SeqID_179511
atggttatgggggggtttcatcagcagactctccttccctgtggagaaaacaccgagactttttcaagtctcacaagttatccagaactacgtagatctgagttcctcattggagggtacgtaggagcaagagccttgcttttgtcgaccacaccaccttttgctgtcatgacccaagagctggtaacccgcggagacaccttacggttatccgcacctcgtcattcagtgaccccaaatgtgattgatgagcaaaagtgcgggtcatttgcaccctttccggagatgtcaacatctttcggcggcgggcccgatgacatgcagagacaatttttcaagtctcacccaagttcatctagaacaccgtag

SEQ ID NO: 87827 - DNA, 405 bp, Glycine max
  Peptide Sequence Number=SeqID_179512
atggcggactggccttccttgaggtccttcacttcggcagccagcgcatcattgcgctgctgcaggccctcattgtcccgctcctggttggcgacctgggcttcgagcatcatcacttcacccgaattgcccggaccgaaccagaagcggtactgcagccagcccagcagcagggccagcaccagcagcatccagcgccagtcgcgcatcggctcagcgcttcagcgaaacgaacgcgtcacgaccggcgtaacgcgcgccggcgccgagggcttcctcgatgcgcagcagctggttgtacttggccacgcgatcgctgcggcacagcgagccggtcttgatctgggtggcggtggtggccacggcgatgtcggcgatggtggtgtcttcggtttcgccggaacg

SEQ ID NO: 87828 - DNA, 190 bp, Glycine max
  Peptide Sequence Number=SeqID_179513
ctcatattcaagtattctcaccgatggaaatggcgaatcagagttggaggcttcaatctcttctccttctctaacgtttggaaaccttatcagaacagctagaggaaagcttaaggaatgtcagggaaccattagagatgccgctattgctgccagaacacacgtgagtccacttagagataaaggatga

SEQ ID NO: 87829 - DNA, 143 bp, Glycine max
  Peptide Sequence Number=SeqID_179514
aaaaagataactctttccgggccccgcgacgtctccggactcctaacgttgcgtcagcgcacgtcccggttcaggaatttaacccgattcctttcggagtacgcgcacagagcgctatcagacgggcttcccccgtcccttag

SEQ ID NO: 87830 - DNA, 348 bp, Glycine max
  Peptide Sequence Number=SeqID_179515
atgaagtttgatggttcgcgtactatgcatgaacatgtcattgagatgacaaacattgcaacaagacttaagaccttgggaatgactgtgaataagaactttcttgttcagtttattctaaactcattaccacctgagtctgacccgttccaaatgagttataataccacgaaagataaatggaaatggaatcaaggagctgaaaagaaatttatgaagaagcatgataaaggcaaaagctcattaaagatcaatgacgacactttgcaaatccagaatgaggtatcaaaaagagcaataattgccaattttatgggaaatctagacatttccagaaggattgcctaa

SEQ ID NO: 87831 - DNA, 159 bp, Glycine max
  Peptide Sequence Number=SeqID_179516
atggcggtcgggcaagtatgccccccatcgtctagtggttcaggacatctctctttcaaggaggcagcggggattcgacttcccctggggttcaattggtcagagcaccgccctgtcaaggcggaagctgcgggttcgagccccgtcagtcccatataa

SEQ ID NO: 87832 - DNA, 237 bp, Glycine max
  Peptide Sequence Number=SeqID_179517
atggtggaagttaaagaaatgaggcgatgtgagagagttggacaatatggttattggtggtatgaaactccatgccaacctcccgaaacatggaaggagaagaggatagatggaaaatctaacttggaggacaagcgcacaacggggatggacaaggacaagacaagacaattgagggtgaggaagaggactgtaggaaggagacaacacagatcgccaatgatgcaggaagactaa

SEQ ID NO: 87833 - DNA, 421 bp, Glycine max
  Peptide Sequence Number=SeqID_179518
ggatcttccaccaccaccatcgctgctggccaccaccgccatggaacctccggagacccaacaacaccagttcctccctctctttcatctcctcgttcatccacattattttcctctgatgatcagtgtcagagtcaaggtgttccttttgaaggcactcttgtggatgactggaaatttgattattcaaggcatgatgctcacagaatggcattacaagccaatgcacctctcccgtatccccaccttgttaatatttttcttcatcatttcaatgttcctttggatgatgaaccagatgtcaaggttaaaaggtctttctccattggtgccggtgttgttacctcctttggttaccgaaagtatgctgatggtcagtgggttcgcaaacaagacttgccactgcctactcctgacgaac

SEQ ID NO: 87834 - DNA, 585 bp, Glycine max
  Peptide Sequence Number=SeqID_179519
atggttgtaggaaatacaaccatagaaaaacctggtgaagaatggagtgaggaggaaaagaaattagttcaatacaatttaaaagcaaaaaatataattacatctgctttaggaatggataagtactttagggtatcaaattgtaaaaatgcaaaagatatgtgggataccctacaggtaacacatgaaggaaaaatatttccaaatgaagatcttatcaataaagttttgagatgcttaagcagggaatggcaacccaaggaacatgaaatggaattgataagattgaatcaacatgaggagaatgataagaaaaagaaaggaatttctgttaaagcttcatcatcaacccaagaaggaagcaatcagcctggacatctgagggttgattgcccaatcttcaagaaaagaatagagaaatctgaaaagaaattatttaatgaaaagaagactaagaaggcctacattacatgggatgacaatgatatggacccatttgaagattcaaaaaacgaagttgtaaacctgagtctgatggccaagaattatgaaagcgatgaagagatgacatttcagaatcattag

SEQ ID NO: 87835 - DNA, 684 bp, Glycine max
  Peptide Sequence Number=SeqID_179520
atgcatcattcacatatatccattcttatttttcttttcacattggtggcattgctcattgcatctttccttaaaatcagaactgtaatcattgtaatcaaaaggaaagaacatgctttacggcgcctttaccgaactcatgctagagctagagtaatgagtgaaatagaagaggtgcaagaacagatgaaggccgacatggatgccatgaaagaccaaatggcggccatgatggaggccatgttgagcatgaagaaaataatggaaagcaatacggctgcagttgccactacgagttcagaacaaactttccttcctactatatggcttgcctcccaactatacacacccaatgttgcacacactcccgatgagaatgtcgacaactccgcacctatacccattgagagccaacaaccccaatctgatcatgcacatgtctctcaagccataggggagacacatgaagcaccccgaaaccacaatctagccgacttcaaacctcacctcagatgttccattgaggggcaagtagttggtggtgtacccctaccaaacacctcggggggccctcagtatcacccacaaccacaacccttgaattttgtggtgggaagagtctttcctgctatggtggaaagggagaaattcagtcatatagaggaaagactgagggccatttaa

SEQ ID NO: 87836 - DNA, 312 bp, Glycine max
  Peptide Sequence Number=SeqID_179521
atgagaggtgtagaagcaaagcttcatggtgaatcaaaagtgattcaaagatgttttgatgataacaaagatgatgacaaaggtgatgacaaaaagctcaaaggtcaatcaaagaatgagttcaagatgttcaagatagaatcaagaatacttcaagattcaagaggaaagttgaattcaagaatcaagaatcaagattcaagagatcaaggttcaagactcaagattcaagaatcaagaaaaagctattcaagaatcaagaaaaagcttaatcaagataagtatgaaaaggttttttcaaaaactgagtag

SEQ ID NO: 87837 - DNA, 735 bp, Glycine max
  Peptide Sequence Number=SeqID_179522
atgtcggatgaacttcttgttggaggtgttgagagtagaaagcttaaacgtaagattgaggaggcatcttccacagatgtaatagattcagagttcgtattgtctctaagtcttggcaataacaaaatggttggtgaatcctcatctaatttcttatgcaagtcattgaaaagccatcaggagtcaccaggttttgcttcaaaacttgtggaaaacatcaataatcatgtgattatgcctaagcagcgccaattctcctgcaagttttgtgataagaaattttcaagctctcaagctttggggggacaccaaaatgctcacaagcgtgaaagagttatatcaaggatggataaagacatggaaacttttggacttggtgctcacatgtgctcatactcatctattcctcatcatcacccctttcatggaccaacacccctttattatggggctaacatgcaccccatggctcacatgtcggccatgccttggccaaattttgtacttgactttggcaaccaaggattgcgcaccacatccatctcagggaaacgatttgggatggccaacccttggggtatagctgctgaaactccacctaatgtgcatcgtagggatgtgggatttaatgttgagcataatcaagttccttcacttgatatagctcatagagctgcaatggctcgttctggccttagtggccttttgggaaatcaatatactagaaaccaatag

SEQ ID NO: 87838 - DNA, 443 bp, Glycine max
  Peptide Sequence Number=SeqID_179523
atggttactatgatagtagataccttgcctgtattctactatgagaaattagtgggttacatgccctctagcttcgcagacttagttttccccgaagaaaggattgagatgggtttgaagaggggaaagtttgattacatctccccagtaggtgccagcggtaggagggtcaaaacagctggggcaaagaagaaaaagggagatgcccataccgtcacttcaacacctgcgtggcccaagccaccagaaccccccatggtacccaccaatacgcacaacatcactcgagtttttcgactcacgccgggggctcttccgacacagtgctcgcccagccaagggcacccatgcccccacaagggggagctcctctggctccggctccaacccagcctcacccggccaacaatgcccaccttggctcgggctggggatcctctaga

SEQ ID NO: 87839 - DNA, 918 bp, Glycine max
  Peptide Sequence Number=SeqID_179524
atgtttggaagcaaaggcgagaaccttggcaagtcaagacgaataggccccgctcatggacatcctggcactcttgatcttcggggtggtcctctttccaaatgtggatgggttggtggaccggccgatttatatggcacattcgaccgaagatgtgagaagaatagtgcaaggatcgtttgctgtacaacgaccctctatgtatggttggtttcacacctttttcgccaagaggtgagacacgtttgcccgctagaaggccaccgctcatgcacagagaaaaaggaggcaaactgggaccgactcttagcaagcaaagaaggagcgtctgtcaattggttcccccgatggaaagaaggaagaaccgggattcttatttcgtgcggggaatttccaaatgttcccttgatggggacgaggggttgcattaattacaatctcgtcctcgccataagacaacttggctaccctatgagagaagcaccattagaggaaggtttcacaccttttattgcacgaggtttcaataacaccaacgcgggggtgcttcagagggttcgcaaggcatgggaaagggtgcaaaagaaggacgaggaacttaggggaagtagcaacgggcccatcggcggttaccgtaggtggttgaaagcctacgcacaagaggtggagggtgaagctccggaagaagaagaagaggtacaagccctcaaaacagagcttgagagagcccaaacagccaaagaaaaattcaagtcagcagttgttaggatccgaaaagagaatgccgaactaagagacgtcaacatagccaccatcaaggccttggagcaagagaccaagagggctcgcaaggaagaacatggccaaaacaagttccgaggggctctgtgggtcagtaacagcgaacttaagctctga

SEQ ID NO: 87840 - DNA, 423 bp, Glycine max
  Peptide Sequence Number=SeqID_179525
atggagctacattatgcctcgttaaacatctcaagccaaaaccccgattcttctatttttgggacaaaagacttgatttggaaaaagagtacaacatttgggcttgctgtgaccctaaatgggccttcccagttgggaccaagctttctagctcggggatcttttctagcttcacctcggactcgtcatacgaggtcacaaggtttaaaggctcgtggtagaacttttgtattgtatctcctcgctactcagagtttggtggcttcttccctgatcctgatcatgtcttggactttgtttgttgtttcgagttctaccctcatagtttcttcattttgttgttactggaacaacaatctccttgtctatggttcctcgacttcaatggggatcatggcgtctttgccatatgtgagtcgataa

SEQ ID NO: 87841 - DNA, 297 bp, Glycine max
  Peptide Sequence Number=SeqID_179526
atgggaatagagattctggagcctaacacgtgcattaggggttgctgcaccagcccctctattccccttcatctccctccctcttcttatacccttctctctcctattgcccgaggttgggaatgcatttggtggtcagcgactaaatatccgggtagatcgagaccggttgatggagaagctcacgcgaccctacgtgaatgggattggctacaagtaattacggctctcaaaggaggagaacttatggaatcatcgtttgggagcctacatcgaagattgttgttgaattgctaa

SEQ ID NO: 87842 - DNA, 699 bp, Glycine max
  Peptide Sequence Number=SeqID_179527
atgataaaagtgcccattgaagccatcacatccctcactcaatactatgatcaatcactcggatgcttcacttttggggactttcagttggcaccaaccatagaagagttcgaaaggatcttaggatgcccattagggggaaggaagccatacctctttgccggattctatccttccatggcaagaatagcaaaagtggtcaagatctcggaacaagagctagatcaagtgaagcaaaataggaatgaggtggtagggataccaaggaagcgcttggaggagaaagcaaaagctttggaaaatcaaggggagtggacctcgttcattgacatattagcattgttggtgtttgggactatactactttcgaatgtagacgggctagtggacctagcagcgatcgacacctttcttgcttatcaccacaacaaggaaagccctgtcatcgttgttttggcggatgcatatgatacatttgacttaagccataagttagttagactaacccccttgagaggtgcaccgtcgaaggaagtcatcacgtctttcatcgtgcaaggcttcaatgaagctaaggtgaagatacttcataaaatccgtaaagcgtggaatagagtgggaaggaaagataaggagcttagaggaagtagcaatggcgtcatcgggggctatcacaagtggttgaagtctagaacgtaa

SEQ ID NO: 87843 - DNA, 474 bp, Glycine max
  Peptide Sequence Number=SeqID_179528
atggacacctatgttagtcctttgaccgctcaaatcactggtaaagttgtgggagaagaagaagctgacgacgttcatgctaatcaaaatgatcatgatgaaggagaattgattaacatcgtctactgtaattttctacagagacagaggtcaccaaacctagacttcatccaactcatgtttgtcgcgagtttcatcatccaccacccttatcttctctggcttctcactgtagtttacaaaaccaaaggtgaaacgaaagatattgacctggtagaggaggaacaggcacggattggtgctgatcattctagtgcgacctctaataaatatgagaattataaggaggaagcacggaagaaaacacttaagcataaaccaaagagggtggagagtgtcaacgatgatgcagaagcctttggtgatgactggaaaattctgattgctctatgcattgtgaagctgaagcagtag

SEQ ID NO: 87844 - DNA, 507 bp, Glycine max
  Peptide Sequence Number=SeqID_179529
atggattttacaaagatagtggaaatctcaagtaggttgcttgagtactggatcctatccctcttaagattattgaggccacaaggtccaacaatagatgctgatgaagtgatgagtagagaaacaaatgaagtagaattcatgggtttaggtgctactgctactatagacgtagaagaaccaagctctaatacaaaaggaaaaagacaaggttcaacttcttctggtacacattctcacaagatcgaagaaaaagaaggaataacaacttctttggataaaatggccaactcttttgaccggatggtagaaaaaatggatggtaaagtcaatgatgaagatattcaagaagtattacgtgagacaactttgataccagatcttaatagacaacaatgggctaaagctattaaatggttagctgaagatccaaagcagttagctattgtgaaagcccttccaattcgcgaaaagacagattatgttttaacacatcttgcaaaatga

SEQ ID NO: 87845 - DNA, 277 bp, Glycine max
  Peptide Sequence Number=SeqID_179530
gattgacggggcgaactgctagttttcggatacgagatatccaccctagtcactatggacgcatttgtccaattgacacgtcggaaggaatcaatgttggacttattggatctctagcaattcatgcgaggattggtagttggggagatgaatactatatggtagcaacaggaaattctttggcacttaatcgagatattcaggaggaacagactgttccagcccgataccgtcaagaatttcttacgattgcatgggacaagggggatcctctaga

SEQ ID NO: 87846 - DNA, 738 bp, Glycine max
  Peptide Sequence Number=SeqID_179531
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctctcggattccccttgtccgtaccagtttctgagttgacttgtttcgacgcccggggaaagaggccccgaagggcccgttcccaatccgtcccccgaccggcacgcgacgacccgctctcgccgcggaagcagctcgagcagtccaccgacaggccgacgggttcgggactgggacccccgtgccagcccctcagagccaattcttttcccgag

SEQ ID NO: 87847 - DNA, 1242 bp, Glycine max
  Peptide Sequence Number=SeqID_179532
ctgcacgccgatgcgggcgtcgctgttgccgtggacgaagccgacgatgcgggcaaaggcctgctgctgctcgtcgttccacagccccgggcaccccggggtgatgcggccatcgggcgagacgcaggtcatttccaccatcaccagcccggcgccgcccatggcgcgggcgcccaggtgcaccaggtggaagtcgcccggcacgccgtcggtgcaggaatacatggccatcggcgacaccaggatgcggttcttgagcttgacgccgcgcgcctggtacggcgtcagcatgggcagcggcggccgctggccggccggcgcctgagcgccggcatgctcggcgatccagcgctcgaagccttccagccaggccggatcgcgcagccgcaggttctcgtgcgagatgcgctgcgagcgggtcagcagcgaataggcgaattgttcgggttcgagttccgcgtagcgcgccacgttctcgaaccattcggtggagttgcgggcggcgttctggatcttcagcacttcgacgctgcgcacttcctcgtaatgcttcaggccgcgctcgacgctgccttcggcgccgctcaggcagcgcgccagttcgatggcgtcttccagcgccagcttggtgcccgagccgatggagaagtgcgcggtatgcgccgcgtcgcccatcagcaccacgggcacggcgcgcttgccgcggctggtttccagctggttccaatggacccaggtgttgcagatgacgcgcgggaagcggatccagatggccgagccgcgcagatgcgaggcgttgctgaccaggggattgccgtccagccagggcgcaaacagtttttcgcagtaggcgatgccttcttcctggctcatctgctcgatgccggcggcctgccaggtttcctcgggcgtttcgacgatgaaggtcgacatgccgtcttcgtagcggtaggcatgcgcctggaaccagccgtgttcggtctgcacgaaggcgaaggtgaaggcatcgaacaccttcttggtgccgagccagacgaagcggcagcggcgctggtcgatatcgggatggaaggtgtcggcgtagcgggcgtcaccgatggtctgggcggagaccggatcggcttcgcgcaggttctgcatggtggcatccgagaacaccacgccccagccgaaggtgtcgtagggccggttgcgctcgataacggtgacttcgttggccgggtcttgcagcttcatgagtag

SEQ ID NO: 87848 - DNA, 291 bp, Glycine max
  Peptide Sequence Number=SeqID_179533
atgacttgtcgtttccggattttcacaaattgcctaatgatgggtgccaagcacctcacaaggaccaaagaaaggtcgcatgtcatcaagcaaagggcgcagatgaccacattggcctctgctcgtcaatcggggtcactgaatgacgaggtgcgaataaccgtaaggtgtctcccgcgggctaccagctcttgggtcatggcaacaaaaggcggtgtggtcgacaaaagcgaggcttttgctcctacgtatcctccaatgaggaactcagacctacgtagttctggataa

SEQ ID NO: 87849 - DNA, 706 bp, Glycine max
  Peptide Sequence Number=SeqID_179534
atggcttcaggattaattttaaccgccgtcggggccgaggcgatagaggcggcatatcaggccggtgaggtggtcactatcccgatcgtcgcgttcggtgatggcggcggggcctctgtgacccctgaccctgccgtaaccaaactggtcaataaatttggggatgtgccctttacgcagggcgaatcgggtagcggcatgattgccggccaggcggtgattaacgcccgtgagcacccgggtaaagtggttcgggagtttgggctgatgagtagcgccggcgttctgattgcctatggcgcctatccagacacctacttaccggaacaaaacgactcgatcgtaaaagagctggtggtgaattttgccatgccgttggtacacgctgaaagcgtggtgctcgagattgaccccaatatttcggtgctgacgattgaagaggctgatgcccgctatctcttcaggaagggcgacacagcgacgggggatctaggcgccccaatgttccaggcaaacggcacgaacggcataccggccggcgccggcatgtacaaggagcaattggacaaccacgccccattttattcgcccgattatcattggtccgtgacacctggaagcacttatatccccctggttaaagggcgaggaactcgaaaaggcaaagggtggccgacggccgttagctttggctaccttatgccgg

SEQ ID NO: 87850 - DNA, 261 bp, Glycine max
  Peptide Sequence Number=SeqID_179535
atgaccatgattacgaattcgagctcggtacccatttacatgacaaggcaactagttgtgcatgcatcatttttaccttttgatcatcctgagcattccattactggtgaatctgtgcattctgttattcgtgattttgaacatcctgatttggagcattataattttgagcattctgattctgagcattctgattttgcacattctgagaacatggcacaacctccaccccgtgagaggaccctaagggggatcctctag

SEQ ID NO: 87851 - DNA, 449 bp, Glycine max
  Peptide Sequence Number=SeqID_179536
tctggagccccgcgaattcattgcctagcgctgttcgccaattctccattctcacttttattcggagacccatgaattcattgcctagcgctgattcatgtgtcatccaccaacgagtctggagccccgcgaattcattgcctagcgctgttcgccaattctccattctcaatcttattcggagacccatgaattcattgcctagcgctgttcatgtgtcctccaccatcgagtctggagccccgcgaattcattgcctagcgctattcaccaattctccattctccacttttattcggagacccatgaattcattgcctagctctgttcatgtgtccttcaccatcaagtctgggagccccgcgaattcattgcctagcgctgttcgccaattctccattctcacttttattcggagacccatgaattcattgcctagtgctgttcat

SEQ ID NO: 87852 - DNA, 359 bp, Glycine max
  Peptide Sequence Number=SeqID_179537
atggcaggagctggtgacaatggtggtgtatatcatcaactggacagatttcagcgcttattactggacgcgatgactacacaaatgcaacgtttgttgaaacgtaacaatgaagagctctacaggcgaataggaggactagagcaccaaatgaatccaaatgctgggagaccttatggtggcagtagaagggtcaatgatggatcgaaccgaatagaggggcaagatagaattgagggagtaaaactcaatgtatcctcttttaaaggcaggagtgacccagacgcctaccttacctgggagatgaagattcggcatgcattctcctacaatgattatctggaagagcagaaggagaa

SEQ ID NO: 87853 - DNA, 342 bp, Glycine max
  Peptide Sequence Number=SeqID_179538
atggtgggttacacaccttcaagttttacagatttggtcttcgccagcaaaaagatcgaagtggatatgaaaagaggcaaatttaattatcctgcttggacgaatgagaaaactggggcaaataaagagggtgaggatgagggagaaacccatgctgtgactgccattcctatacggccaagtttcccaccaacccaacaatgtctttactcagccaataacaaaccttctccttacccaccacccagttatccacaaaggccatccctaaatcaaccacaaacgagaaagcctgtagaattcaccccaattccagtgtcctatgctgaggggatcctctag

SEQ ID NO: 87854 - DNA, 621 bp, Glycine max
  Peptide Sequence Number=SeqID_179539
ggagttgtcgcgctggttcatatgtatgaccagttagatgaggcttgtaggaccaccacccgacagcttgcgaggtacttgacgctacttcaggagcaccctacagggcactttgtgatgggtcagctcagatggggtgctatggtcgtcacagttggaccggagagagtggtacgccaaatcggttacatccagagcatccctccgccgcctgttagtgcacgattgtcacacgatcagatagatgacaggtggatgcagtttgcggatcacttactacctgcggatcagctttgtctagtgcctgggcaggtatctgcggattacatggagtggtttttccgcatatctcacccattcatgacaccgacccaggcaggtgaccaacagagggatgcaccagctgcagaccctgaggactacatacagccgcctagcccccaggttccagtggcatttgacccccctccacatgtggatgattacgagggatatgaggcgattgcacagaggttggagcgtgtgctcaaccttaggatagtccgtgcaggcacagagttatatgacattatgcaggactacctgacgatcgcgagagggggacccagtgctgatgggact

SEQ ID NO: 87855 - DNA, 666 bp, Glycine max
  Peptide Sequence Number=SeqID_179540
atgggttctccacctgcctccactcctcgtcctcttcctcctcctccttcggacgcatcggattcgccgtctgccgtgaagcggacacgcaaagcctcacgtctacgatcgttgtccactagaccacctggtgctgagagtccagtggtgcatgttgatcctgctactgggaaggccgacggtccccacaggaagaaattaagatcatatttagggattgtggcgcgtgataagggtggacgtcacatacgagaactggaaggaggtccctactgctcagaagggacctcattttgggaggatattcaggaggaatttgatatcccagaggcttctgacagtaggacgaaaaggaagttactgcagaccgtgggggagagatggaggcagtttaaatcagaccacacgaggaaatgggcccatgcagccgatcaggacggtgtcgaggacactgtctgtgagaaatacggcatcagcaaggaaaagtgggcccagttttgccagactcgtagagaccctcctgagaggtatgatgtgtgcatgaaggcacaggccatccagaagcagaatactgcccctcacgttttgtctcgtgggggttatgattatttggagcagaagctcctggctgagaagacgaagaagaagctggaggaagctgcatag

SEQ ID NO: 87856 - DNA, 72 bp, Glycine max
  Peptide Sequence Number=SeqID_179541
atgactgtgaaaaagaggctaagtcatgaagtgccaaaagtgacaattgagcttagctcatcagtgggctaa

SEQ ID NO: 87857 - DNA, 1196 bp, Glycine max
  Peptide Sequence Number=SeqID_179542
agacgaatgggtcccgttcatagacgttcttgcactgttgatcttcggaggagcactctttccaaatatggataggttggtggatctagcagcgatcgacgcttttctcgcctatcatgaccacaaggaaagcctggttgtcgctatgttagccgacttatatgacacctacgaccgaagatgtgagaagagcagtacgagggttgtttgctatactccagctctttatgtatggttggtttcgcacctctttcgccaagaggtgagacatgcttgcccgctagaaagccaccgttcatgcacagagaaaggaggggcaaattgggaccaactcttagcaaacaaagaaggagcgtctgtcaactggttccctcaatggaaagaaggaagaaccggggttcttatttcgtgtagaggatttccaaacgttcccttgatggggacaaggggttgcatcagttacaatcccgttcttgctataaggaaacttggctaccctatgagaggggcaccgctagaggaagagctcgtgcctatcatttcacgaggtttcaataaagccaacggggagacacttcagaaggtctgcaaggcatgggaggtggtgcaaaagaaggacaaagaactgaggggcagtaacaatgggcccatcggtggctaccgaaggtggttgaaagcccacgtgcaaaggccctttaggacggaactcgagcaagcccaaacagtcaaagaaagggcttgtagggaagagcacggccggaacaaattccgaggggctctgtggggtagcaacagcgagcttaaactccaaagagaggaaatggaccaatcacgagtagacagtttgatcttgaaagatgaattgaaggcttgctcgaggtccaaaaaaagtttgtctcagcggttatgcgagacaaagaccaacatgttagctatcatcaccaagtaccaagaagaactaaatctagtcgtggcccacgagcatagagtggcggacgagtatgcccaagtgtacgcggaaaaggaggctagaggaagggtgatcgactcgctacatcaagaggcaacgatgtggatggaccgatttgcccttaccttgaacgggagtcaagagcttccccgactactagccaaggccaaggcaatggcgtacacctactccgcccccgaggagatccacggacttctcggctatt

SEQ ID NO: 87858 - DNA, 228 bp, Glycine max
  Peptide Sequence Number=SeqID_179543
atgggttgtatcaattataatcccatccttaccataagacaacttggctaccctatgagaggagagctgtcggaagaaagtatcacgcccttcatcgcacagggtttagtgatcccaatgcaaggatatttcaaagggttcgaaaggcatggagcatggtgcaaagaaaggataatgagcttaggggaagcagcaatgagatcgtcggtggctatcacaagtggctga

SEQ ID NO: 87859 - DNA, 737 bp, Glycine max
  Peptide Sequence Number=SeqID_179544
atggtgcatcagtgcgtcgttgatgatgcttatgctgaggcaagcccacgtgcctccaggtgtcttacgggtaaggctcatatgatgaggatcaagggagccccataccgggcacctatggaagccctgactgtcacggacgtgtcatggatgccctatgctgagcaccggggagttaggggcttcgacctgatctcatcgtacacgggccaacttaaatggggtcagatagtagtctacgttcgaccaaagcgggcgcttcgacagttcgggtacattcagaccatccctccactgcctgttcgtgattcgttgacgggtcctgatatagacgactggtggctgcacttttcagaccatcaagtgcccatgggggagatctatgtagttcctagccaggtggcgccagactacatggattggtttttttggatttcgcacccgtttgtcacgccgaccgaggacgatgctgagccgagacatccgcctaccccacatgatgaggagttcatcgagccacctatcctggaggttccagttgcgtccgatctccctacgcattcagtggttgactgccaaggatgtgaagcgatggttgaaaatttgggagcgatcgctgagcatttggagcgggtcatcaacctcaggatggtcactgaaggcattgacttatatgacatcatggctcgttgcctgaggatagctagaggtgatgccgcagatggaagtcttaggcc

SEQ ID NO: 87860 - DNA, 981 bp, Glycine max
  Peptide Sequence Number=SeqID_179545
atgtcccttttcaggatgctggaagttcatgctcacactgagtcctgcagggctgctcgattcatcaacggtggacgtgcgatcttgacaggttctccggattgcttaatactggctacagatgtggaaactggatctacaattgctcgtcttgatgatgctcatgaggctgcgataaatagattgataaacttgactgagtcaactgttgcctcgggagatgatgaaggttgtataaagccactattcaacttacagccacccattactattctgaagatggttgcaatattgatgtttgagttatgggaaggccaggtatgggatatcagagaacgttcttgttgcaattcttttaattcccatgaagattacatttcagacattacttttgtgtctgatgcaatgaaactgttggcaacaagtggagatgggactctgtctgtttgcaatcttcgaagaaataaagtgcaagctcaatctgaattttctgaagatgagctactgtctgtggttttaatgaaggagaagctgaaagacattaaggatgttctcattctcttcgatcgatttactgatctctcttctaattctattgatgctatgttgaagcttgatgaagacaggattattaccggatcagagaatagaattatcaacctggttgggatattaccaaacagagtcatccagccaattgcagaacactcagaatatcctgttgagtgtcttgcattctctcatgataggaagtttcttggaagcatttcccatgatcaaatgttaaagctatgggacttggataatattctacaaggctcaggaaacacacaaagtaatgaagctggagctgttgacagtgacgatgatgagatggatctagatgatgatccttcaaagaatagtaaagggaacaagagaaagaatgcaaataatgggaatgccctaggtggatcgaacaacttctttgcagatttatag

SEQ ID NO: 87861 - DNA, 432 bp, Glycine max
  Peptide Sequence Number=SeqID_179546
atgatacatgttgtaaaaaatgtgaggatccctaagtatttggacttggaatggttctttcaacaagggttcaacatctccaatatgctagaagtacaaggattgccaaagctagtgcagatgaaaaaaatattttatccagagctagtcaaggttttctactcttatgcatgtgttgaccttgaaggtaacctcttctctattgttaatggagtagatatggtcattgatgtttctatgtggaaggaaataatcggtttggacatgggtaaagtccacaagttcgatgaaacgcctaatgggtacaacaagatgcaaacctataggggaatgcttcttgaccctgctaggaacttgaggaatcgcttaggagttggtggactgactatagaggatagaatgtatcaagatgaactgggtactattgattga

SEQ ID NO: 87862 - DNA, 126 bp, Glycine max
  Peptide Sequence Number=SeqID_179547
atggcagctcatggtggccattggtggtcgtgggtggtggaggagacggggatcttgcttaacgagctcatcttgctaagcggaaatccacttttggcgttaagtatggcctgtcgtgctgagtga

SEQ ID NO: 87863 - DNA, 351 bp, Glycine max
  Peptide Sequence Number=SeqID_179548
atgactgggcccttctcatgggatgagacatatcaacaagccttcttggcttccaagaagaccacagccacaccgtcagttttgagcgacccaggccaggagtgttttgatgataacaaagatgatgacaaaaaggccaagagaatgatttcaagattgagtcaagaacaattcaagaatcaagagtttcaagttttaagattcaagaatcaagtttcaagtttcaagtttcaaaaatcaagaatcaagaataatcaagatcaagattcaagactcaagattcaaaaatcaagaaaagactcaatcaagataagtactaaaaagtttttcaacacattgagtagcacatga

SEQ ID NO: 87864 - DNA, 276 bp, Glycine max
  Peptide Sequence Number=SeqID_179549
atggatgctcttgtcttgataagagagatatgggcggcattccacgttcgtgggattgctttgtcatccaactcttgtagtcggtacactccgttgtcgaggttggttgtgatcctagagagaccgtcccagttgggaccaacctttcccgctcagggatcttttctggccatacgaggtcgtcgggttgaaagtagtcttcttgtcgatggttccccgacttccatgaggattatggcgtttgttccatattggtatgcccagagtatgttgtag

SEQ ID NO: 87865 - DNA, 168 bp, Glycine max
  Peptide Sequence Number=SeqID_179550
atggatactcacctgagtcaggatggcgtagaccagctgacacttcgacagggggagggtggtcatgctagtgcgcatgatccgcattcgtctcctcgtcacactccgggcaaaatcctgccccagaatgcacaacaattggcttatggcctcctcatcaaagcctga

SEQ ID NO: 87866 - DNA, 209 bp, Glycine max
  Peptide Sequence Number=SeqID_179551
ctatctctagaatatgtccattggatttaatgctgaaatatgtgcaatttcagttgagcttagctcatcaatgggctaagtgcgcatccactgctaagcgcagtttcagcgcgcttaacgagatagaagaatctggcagagcatcaatattaaggctgcgcgctaagcgtgagttcagtgtgctaagcgcagcagttgtctttagctag

SEQ ID NO: 87867 - DNA, 1185 bp, Glycine max
  Peptide Sequence Number=SeqID_179552
atgcccgctaggaggaagaaaaccatatctcttttctgggttctacgccctccatggaagcacttggaggagaaagcaaaggctttggcagatcaaggtgaatgggcttcattcattgatgtcctagcactattggtgtttagagtcgtcctcttcccaaaggtggatgggctagtggacctaggaccgaccgacgccttcctagattatcaccatagcaagcaaagtctggtcgtggctgttttggtcgatgcctatgacacatttgatcagagatgcaagaagagcggtgcaaggattgtctattgcacacccgctctatatgtatggctggtgtctcacctctttcatcacgaaagtagacttatttgtcccctagaaggccaccgtatgtgtgctgagaaagggaaggcaagttgggagcagctcttggctgggttctcaaacgtccccttgatgggaacgaggggttgtatcaattataatcccatccttgccataagacaacttggctatcccatgggaggagcgccttcgaaagaaagcatcacgcctttcatcgcacggggtttcagtgaccccaatgcaaggatgaaggataaggagctcaggggaagcaataatgggatcatcggcggttatcacaagtggctgaaggctagaatgcaagaaataacttggctccagaagctaaagctctcaagtgaggaagaggctgaaacccctaaggaaagcgaaaaggtgcaagccttgaaggtggaacttgaaaaggtgcaagcggtcaaggaaagcaacaacgagcttaagcttcgaagggccaagagagaccagtcgagagtcgaaggtatgatattagagaacaagttgaaggcttgtcaaaggtcaaagaggcatttgtccgaacaattgagtaggacgaaagaaaacatgtgggccatcatcaaccaatacaaagagaagctaaatctagcttcaacccatgagcaaaggtcaaaagacgagtatgcgaaggtatcggtcctgcaagcaaaaagggaagcaagggagaaggtgatagattcattaaacagagaagcaataatgtggatggataggttctctttcaccttgaatgggagtcaagagcttccaagactgctagccaaagccaaggcgatgatggacatgtactcggctcctgaggaa

SEQ ID NO: 87868 - DNA, 447 bp, Glycine max
  Peptide Sequence Number=SeqID_179553
atggatatgatgggaagatctatgttcatgagaaggacacaattgtctactatttctatgatgtccctgataacaagaagtagacacctatcatggtacctgtacagtgcctgctcatggcacatgacagacgaaagtggatatggagtcttctttaacaaggatgaatgtgccgtaaaatgtaaagacatgtactccttgttttctatcaagggaaaaagcaacctctacaagatcagattaggagaaccttcagatcaaaagcccttgggcccgcctgggcccactaggaagcttagggctgaagtaactagctcgcctaggcgtgagggggttaaggagaagggtccaacacctgaaatcaagaggttttcagtgaaattagtgagaaagaggagaaagaagaagaaaaatcaaggccgaggcgcttccgtaacgttttcgtga

SEQ ID NO: 87869 - DNA, 165 bp, Glycine max
  Peptide Sequence Number=SeqID_179554
atgatccttcttccgttcattcctgcggaagaacttcttccgcgagagtgcacagaagaaccttcttccacagttgaaaataacaactgcataagaaggttcttccgtggaatcacacggaagatgttcttccgcaggaatgcacggaagaacctccttccatag

SEQ ID NO: 87870 - DNA, 435 bp, Glycine max
  Peptide Sequence Number=SeqID_179555
atggacgaaaatcaatggatgtatgatagtataatgtttcaagatgttgatatggatgatcaaaatgaacaagaatgtggtgtgaatgaaccacatgttgattgttcggatgcgttcaatatttctcagatgtttgacagccgagatgatgttttgcagtgggctcgatccgttgctcatgaaaacatatttgtggcggtcattataaggtctaacacaaacactggtagtagaggaaggacttcgtttgtgttaattggctgtgaaatgagtggtgagtataggtgtaggaagaaagaatttgttagaagagatacagggactagaaaatttgggtgtcccttcaagcttcatggcaaactagtggttggagggcaaggtaggatggtgaagttgatgtgtgggattcataatcatgaattggccaagtcatga

SEQ ID NO: 87871 - DNA, 102 bp, Glycine max
  Peptide Sequence Number=SeqID_179556
tcgaagtacttccgtaagcgattctgtggaaattcttcatcgttcttcgtcgttcttcaccgttcttcatccgttcttcgttcgttcttcgttcttcaacgg

SEQ ID NO: 87872 - DNA, 238 bp, Glycine max
  Peptide Sequence Number=SeqID_179557
atggtcgctaggcaagacattgctgagcagcagtgtcatccatatttgggtcaggtagtcatgctggtgcgcatgatccgcacccgcctccccgcagcggtccgggcgaaatcctgccccgagtcttcactattcgttgtccctccagggacgctctcctctgtagagtctgcctcagatgctgacatgatatactctgaaaaatcaacatcaaggagtgggtcttcgtcatcctcag

SEQ ID NO: 87873 - DNA, 489 bp, Glycine max
  Peptide Sequence Number=SeqID_179558
atgtctgttggatcccttatggggagcaccgggaggtccgggacttccacgtcagatcgtgctattccggtctcttgcgctgggggcctgttgctatttattaccgaccagagaggatcgtgtggcagtttggctacacgcagatcattcctgatccttctgtcgattcatgggtctcgtatgatgatatacatgataggtggatgcactacgaggatcatatcgtaccagcatgccccgcagacgggtatccctcacgtgccggagccaggagcatcgtctacatctgcggaggagcctagacatgcagtgaaagtttgtgatgacattgctgagaggttggagcaccatctgagtctaggggtggtcatgcctggctcatcgacacatgaggtgatcgaagaattcctcagattagccaggagtgtgacacaggaccatctagtatacgttaggtgtagacgcaggcggcgcactgatcaggcatag

SEQ ID NO: 87874 - DNA, 363 bp, Glycine max
  Peptide Sequence Number=SeqID_179559
atgtgttggtttagaataggtagcaaaatacctttggcaatttacactttgggtatgatagcaaaatacttggatgtattagaaataccaagatgtgcacatgtgcaatttttggtaccccaaaatgctttgagtatgcatgtatgtaaatttagccaaggagatgtgtgtgatgaaatggccccaaggaagattgcctcaaagaggtccaggaaggacaaggcagccgaaggaactagttccgctccggagtatgacagtcaccgctttagagcgctgtacaccagcagcgcttcgaggccatcaagggatggtcgtttctccgggagcgacgcgtccagctcagggacgacgatatactga

SEQ ID NO: 87875 - DNA, 369 bp, Glycine max
  Peptide Sequence Number=SeqID_179560
atgaaagataagagggatgaagaagaaaaactagaaaaccaaaagaaaaagaaggatagtaaggccttgtcttcaaaggccaaggggaaggaaaaagaggaaaaggattcctccaagaagattgttaagaagaaaaattattttgcaacaaaatgtgatatcaaagaagcactccttcttaaacaatctttctaccttctcctatcaagggaaacatcccttagtaccgccatacctctgagcttgagtaatcaagggtttcccatggaccctaagagaataaaggtcattcctgagtggcctactccaccatgtataagggaaatttggggcttcaatgacttaacaaacttctacaaaaggtgttga

SEQ ID NO: 87876 - DNA, 177 bp, Glycine max
  Peptide Sequence Number=SeqID_179561
atgacaagacaaatgcaaggcatgagtgatgacacagtatggatatacatgcatgaaagcacgtggttgatgaaaagaaacatactagacgaacaaccatgcggaatggagaaggaagagagagaggagacgccacttcaaggagaagatgagtctagaagaagctcaccaccatag

SEQ ID NO: 87877 - DNA, 129 bp, Glycine max
  Peptide Sequence Number=SeqID_179562
atgggcaaggatggacattctcaccctgggtcaaggtttatggtaagttgggattttggctcaaggcttgtagaacggctggacataatgtatgtcagggtgtgggtttggccagcggttcagggataa

SEQ ID NO: 87878 - DNA, 345 bp, Glycine max
  Peptide Sequence Number=SeqID_179563
atgtcctcgacttcagaggactgcatgttctcgccttcagagggctacacatcctttagaaggctgcatgtcctcgccttcagagagctgcacgccctcgccttcagaggactacacatcctcgccttcagaggactacatgtcctcgccttcagaggactgctcatcctcgccttcagagaactgcacgtccttgccttcagaggtgtcgcaacgtacccttcgcgggcgagcgagggcgaggctcacgggtgcgcttcccaaaggaggaaagatgcgtggagtcgccaccaacgtttatttatggaaaacgtcgggaaaaccgaaggaaaccggtcaaaatga

SEQ ID NO: 87879 - DNA, 462 bp, Glycine max
  Peptide Sequence Number=SeqID_179564
atgaccggccctctcgataagtcaatctcttcctttctcataagggtggacccttgggtactagtacctatcggctttagaggactacacgtccacaccttcaaagggctacacgccctcaccttcagaggactacaagtcctcgccttcagagggctacacgtcctcaccttcaaaggcctacacgccctcgccttcagaggactacacatcctcgcctttagagggctgcacgtcctcaccttcagaggaatacacgtcctcaccttcagagggctacacgccctcacctttagaggactaaacgtcgtcgccttcaaaggaatacatgcccttgccttcagagggctgcatgccctcgcctttagaggactacacgtccttgctttagaggacaaccaatcctcgccttcagagggctacacgccctcgccttcagaggactacacgtcctccccttaa

SEQ ID NO: 87880 - DNA, 327 bp, Glycine max
  Peptide Sequence Number=SeqID_179565
atgcacccaggcacaatcaaggcaccttcgttacctagatcacttatatgtacttccaaggtgtatttgctacctacatcacatgcacttcctttgctaaatttacatacatgcatactcaaagcattttggctaccaaaaattgcatacgtgcacattctgaaaatatgtgcaaaccaaattccccatgggttgtttccctatgaaagtcacgcgctaatgccattgaggcatttcaccgaacacttggtgggcgcgcgtttaggcatcaatagcaagagaacggggacaatgtggcatgtcccattgcttcaaaatgcattatag

SEQ ID NO: 87881 - DNA, 393 bp, Glycine max
  Peptide Sequence Number=SeqID_179566
atggcgtctactaggcaccctttggacctagagaagtccaatagggccctggggtttccggctttgatcacgggcctctgtcagttctacggagttcatgtcacccctagcaaggcaggcacagggagacgtacatcaggacgcgggcgcaccgccaccacctcgataggccgatctggctgggccactgagagtggagcggggcagggttccgccccttttgtatgccctaccccggagcagtttggggccgaggtctcatggcctggagactggcctgatgccccgacaggggaggagcctacagaatcccccggtgaggcggaggaatctcgtatggatgaagatatgactgacctgctcggtttcttgggagggagcggagccacatga

SEQ ID NO: 87882 - DNA, 687 bp, Glycine max
  Peptide Sequence Number=SeqID_179567
atgattctgagtcaatccatagtaatcaacaagttgtctatagagaccaaacccgagtttgattcagatggacgaattatgtatgtgcctaatgtatctggtaagccgtatcttatcactgacagccaccgtgattcacccgtaggctttggtgttaagatcagttcaacaaagaagacctatatcattcagagaagagtttcgggagggggcagaagtccttcagagggcaagtcaccttcacaggctcgtgaagtcgcgagaacctatgcacaatcgatgaaatctaccaaaagaaatccaaatgcagttaaacgagaagctgatatcgcagagctgaccctcagtgagatttttgctcaatatcgtcagcaccttctaggacgaagcaaaccagcaaaaccaaattcaatccgggtgctggataaagcagaacagaagcttaaagagtgggagcggtatcgagtccgtgacctcacaggaagcctcattctcaagaagtttgatgagatagcctcaaagaccagaacgacggccgagcagactttcagatgggcaaatgtggcagttcaacattcaattgatttagaggcgatgaatgcccagagccagcaacgattacccgttctcacctataatccctttacagtcctcagagtgcaaaagatataccgtagatcgctctga

SEQ ID NO: 87883 - DNA, 701 bp, Glycine max
  Peptide Sequence Number=SeqID_179568
gtgtggatgttctctcttactccaacttggcccctacatctcatacattagaccttactgtggacagagccaggttgatctttggcctagtctctcatatggacatgaacatcgacgctttcatcttaggacaaatgacttccattgtccagtctaactcttgggttgtctctgacagccttacatttgagagcctaagcccaatcattaacttggcctacatcaggaagaagtgttggaaccctgatgatctaacagttactttccaggggactaggagggcgagggcgaggccagctcatattccatctacttctgcagctccatcacctactctagcatctacttctatagctccttcagttccaactcatgtggtagctcctccaggatccatcctatcagtggagcagttcttagagagggtagcctggcttggggcccaaccttctcttgatagggaaggtgaaggtcccacaacccaggctagaccagagatggctactactcctgagagatcacttgagggcagaccagagcctcctactccagtggtagacctctcctcaccacagcttgcagctgacccttccactcctgtacttgacataccagaggaccagaccacactagtgctggcactaaatacctctcctccagctactccagtacttcacttgacagatgaggaggatgcttag

SEQ ID NO: 87884 - DNA, 369 bp, Glycine max
  Peptide Sequence Number=SeqID_179569
atggcatttctaggagaaactagcagtcagacgattgtcaactcaagcctaaaaaccagaatacacaatacccttcagctatccgacaaacaatttttggatgaaaattcactaccggaagccattcaccgatacagaacaccagatggaataataaacttacttgaatgcactatgcctcgtattcatgacgcgatcctgtattacaacggcaaatggaacatgccaccgcagaacaaatttgttacaggaaaaaatcctaagaaatttcaaattccttcaacatgtaccatcgatgaactgaagaatttaatcaagcaagttgcacctaaagggattccccctcttggaattcacgaatcacaaacg

SEQ ID NO: 87885 - DNA, 468 bp, Glycine max
  Peptide Sequence Number=SeqID_179570
atggtactgaaggtacttgattttgaaggttctggtttacgttatgttcctgaaaatttggggaatttatgctacttgaagtatttaagcttccggtatacatggataacaagtctaccaaaatccattggcaagctccagaatttggagaccttggatataagagacacaagggtgtctaagatgccagaggagattcgtaagcttactaagctacgtcagcttctgtcttattatacgggtttaattcaatggaaggatattggaggcatgacatccctacaagagatacctccagtgattatagatgatgatggagtggtcattggagaggtaggaaagctaaagcagttaagggaactgttggtggcagcttgtcctatgggggacgttaacaaggttgccaaattggattttacagttcccaaatcttgtgcaactgtctttggtgggctccaagttgactaa

SEQ ID NO: 87886 - DNA, 102 bp, Glycine max
  Peptide Sequence Number=SeqID_179571
atggttaattgggcaagccttggaaaagactgttttcaccttctcgctaagccaatctgctggcttagcgagcatccgctaagcgcaacactcttggcctaa

SEQ ID NO: 87887 - DNA, 330 bp, Glycine max
  Peptide Sequence Number=SeqID_179572
atggacaagagtatgattgatgcaaccagtgaaggcgctttaatggacaaaactcttgttgttgcaagacaattgatttcctacatgatagccaattatcaacaatttggtactagagtggctgcaacatccaaggttattgcaaatgaagtttctgtttctatggttgctgataaccagaggctggagaataaacttacagaattaacatccctttttggacaaccatttagacctcaacaacaacaatataatccttactccaacacttataatcttggttggagagatcatccgaacttgaggtatggtcctagtccacaacagtag

SEQ ID NO: 87888 - DNA, 786 bp, Glycine max
  Peptide Sequence Number=SeqID_179573
atggcaccgatatcaaacattctacctgagagaaatgtggagctctccgtagagacagtggcactggagaccattaatgacttctttgaaacccccgtcgtccttgatgacagagaagattatctggcatactcacaatacctgcacacgtacccagatcaccaggccatcgcgacaacattatacacacctggaggagggttcgtcctgaatgccgacggggccccttggaagcctttgcggaaggatctcactacgctcgttcagacatggagcatactttcctattttaaccttgcccctaccttttacacttttgatctcaatgttggcagggcaagggtcattttcgacaccctaacttttgagtcactaagtcctgtgatcaacttggcttacatcaagaaaaactactggaaccccactaacttgtccatcaccttcctcgggccccgctgtgtccaagcccgagccacaacatcagacgcccagcctctaacacagcctctaccaccaccagccacacaccgccaaccgccatccacctcagtctcgatggacccgcaaaggcagatgcttcagtccatctaccaaggccatcagattattgttcagggacttcacagactctccgtccacctggggatggacccaccattgacgactccagaggccttcatccaacaagttgcttggccaggagtgcaaccctctactgatggaggggtgagccctttgaggtcagagacactactgaagccaaagctggggatgacatcattgtag

SEQ ID NO: 87889 - DNA, 198 bp, Glycine max
  Peptide Sequence Number=SeqID_179574
atggcagctcgcccaagcgagctgagacttaaccatgaagcaactggcttgcccaggcgagctggttacttaacatggaagtcttttggtagcccaggcgagccagaggctagcttggtgaccttgctatttgactgggcaattggcgaaaaccaaggaagtgaaaccgaaaaacatgaggacattgaagttttatga

SEQ ID NO: 87890 - DNA, 306 bp, Glycine max
  Peptide Sequence Number=SeqID_179575
atggttccaaggtccagaagtgaaggaattaggagaaataagagagaagaagaagaaagaagaggaaaacaaggccgaggcgctgtcgaatcacgaccgtcatcaatccctacaccatttctcgctccgtgttcttcgttcgtcattcgaacgagagagagctccaagaataatgaggatcccttcgccaagaaacccttcaggcttcaccaagaaactgatcggcgatcgaggaacaagaagtcaggaaccatagctgtcgtgaacgagagaaagtgcacagtgcggggtgaaacgagtcactga

SEQ ID NO: 87891 - DNA, 586 bp, Glycine max
  Peptide Sequence Number=SeqID_179576
tttacgtgtgccattttatattggcggtctagatgatgagggtggtgtttctcagtcacagtctacccagtattgccaagataagtttttgcataatgctcaaatagtgagctttggtgaaataaagactttgcgacaggactgttactgtttgactgtgggcactgtcgatgaggtgcagcctgccattcgtgccagaatcatgttactcacactattccaagtatgtatcaaaatatttggtaaaactgcaaatgaatgtcgtcaagagttgattgcgagtgatgatgagatcaaggtgttccctgcgtgtgttgatcaattgttgggtaaaacttgggttgtcagattcaaacaccgtatacaaatgcaccaatcatccgtgtttgattttagtgaacaggaacatcatatacagtcagtgatatccacactaggtctacagtcatctgaatatgatcctggaaatgctgcctttgtaactcctgcaaaaagaacgtccgatcaacaaggaagtagacagtttgatagtgacgacttcgcaacatatgaactatcgaccaacaagcatataaaagctgagtaa

SEQ ID NO: 87892 - DNA, 249 bp, Glycine max
  Peptide Sequence Number=SeqID_179577
atggaagatgctgactttggcggtgagggcagaggcacaggtagaggattttcagtgagtgcaggtgcaggagtagtagttggaggtggcagaggtggttggacgaatggaggcaacctttgttgcattaacaagttcatgttgaagagcactgagtcattgaaaaggggatggctccaaaggttggtaagtgacttcaaccagcggaggttcaaaaacattgatctggggtctaagatgagcatgtag

SEQ ID NO: 87893 - DNA, 153 bp, Glycine max
  Peptide Sequence Number=SeqID_179578
atggcgactcgtggtggtcaccggtggtcatgggtggtggtgaagaagatcaagcttagcacaacaatctcgcgaagcagaaatccacttttggcgctaagcacggcctctcgtgctgagcaaatttcctcttgggttgggaattgcgcttag

SEQ ID NO: 87894 - DNA, 324 bp, Glycine max
  Peptide Sequence Number=SeqID_179579
atggaaccagctacggaggagttaataacaaaacacaactctcacctaaaatatttccaatgtcatcacgtcggcttggcggctccaacaaaagaatctctctccacatcatctactcccacgaacgaaggttcgcaatcatcacaagtaccaatcacatggtacaaaattgcaaggagaactgagcttaaagaggaagccatcatgagagcatgggatgagtctgttagtgattgtgaggttctagaggtggaggagacatccccactacttgaagcttcccagatatggagagctaaatcctctgttggttcttccttgtag

SEQ ID NO: 87895 - DNA, 363 bp, Glycine max
  Peptide Sequence Number=SeqID_179580
atggtcgtcattttgcctaaggaaaatgttgtcatctggttttgttccttgcacaataggccagacaactacctgaaaggaatgattgacagtgctttgaaagaatttgacgagagtccacaaactaaatccaaggctgctggtaggtggattgttgttaaatgtaatagacaaaaagtaagcactaagtgtgtgtactacgtcatgcactggatatcaactataattttaggaagtttcaagaataattgggaaacgtattccaatgatgctagaccattggaaccagagagaatgaaggtgcatcgtatccagtgggcaacatactatttgaaagttaaaaatgaaacaattagtgtttaa

SEQ ID NO: 87896 - DNA, 945 bp, Glycine max
  Peptide Sequence Number=SeqID_179581
atgattgctattgggctagacatcgctcaactaggcccaactaattttgtcgaagagcccagttggggcccaagagtcacagcccgggttggtataaaatctgaacttaaaaccctactttctccctaccgtgcgcacgttccgagttttctgatcgctcatagagagttcgacgcggcggttgcagaagaagattgcaagatgaagttcaacatcgcgagtcccaccactggatgccagaagaagctcgagatcgacgacgatcagaaactacgagcattttgggacaagaggatctcacaggaggtcagcggagatgcacttggtgaggaatttaagggctatgtcttcaaaattactggaggttgtgacaaacaaggattcccgatgaaacagggagtgcttactcctggtcgtgttcgacttttgcttcacaggggaactccttgcttccgtggatatggaaggcgtaatggagaacgtaggagaaagtctgttcgtgggtgcattgtcagcccagacctctctgttttgaacttggtaattgtgaagaagggtgagaatgatttaccaggattgactgatgctgagaagccaaggatgagaggcccaaagagagcatccaaaatccgtaaactgttcaacctgtccaaggaggatgatgttaggaagtatgtcaacacctaccgtcgtacatttacgacaaaagctgggaaaaaggtgagcaaagctcctaagatacaaagactggtcacccctcttacgctccaacgaaagcgggcaagaattgctgataaaaagaagagaattgccaaggccaaatcggaggcagcagagtaccagaaactccttgcctccaggttgaaggagcagagagaccgccgcagtgagagtttggctaagaggagatccaagctttccagtgctgccaaggcagctgtgtaa

SEQ ID NO: 87897 - DNA, 366 bp, Glycine max
  Peptide Sequence Number=SeqID_179582
atgggtgcacaaatccttcaagaactttgtatattttggaatctgtttgatggcatccaagaggggaatgttgacttccaccctcctgaaagtctcaagaagatcagaatcaagctccactttatttgcaggaatggatctagaaggaaaaggtataggaatctgttttggcaccaacatctattgaatttggaagctctttgccactcctcaaggttgccatttgcttcatcagctcctccaaggaaggtccataactattattctacacaggttgtgcaggaccatacctcaagttcggatgatctctccaaccaagattataagtgttggagtaaggattatattgttgttgttgaggtctaa

SEQ ID NO: 87898 - DNA, 171 bp, Glycine max
  Peptide Sequence Number=SeqID_179583
atgagcagagtcgccaccatcgtttatttgaggaaaacactagaaaaactaaaaagacaaggtctgcgcagttttgagaataagggttcaggagttatttacgcacgaggaagggtgtttcccttgctcctacgtatcctcgggtgggctgaggaattcagacctacatag

SEQ ID NO: 87899 - DNA, 1182 bp, Glycine max
  Peptide Sequence Number=SeqID_179584
gaagatactgggactaagctggtaagtagaagatcaatgaaggttatgcagaaatcctctttagcgggaagacaatcacagaatctggagataggggactacaacaaacactatcgccttaactggaggaacaatgccgacattacctccttttatttcacccatttccccgacgaagctaatgaagagttgctatggaggcacttcaaaaagtggggtgacgtacatgaagtatacatcgctaaaaggctcaacaaggatggcaggagatacaggttcatgcggttcaagggagtctcggatgcaaaaggattggaggtgagactggacaacatcttcatcaacgattgtaaactatttgtcaaccttcctaggttcgacagaccagttcggaatacagagttgcagaaaaagaaccccattgggaggaagtacaccgacgaagcaagtaagccctgcggggtaactattggtgctcttcggagatcatatgtggacgtggtgactaaaggggggtgccaaggagacaaaaggacagacgaggcacaaacaccaactattctgatcaacccagatgaaggcggggaatattggtgtaacgaaacctgggtgggcatgctaaagaaggtgtgggaaatgaaaaatatcaggagggctgtagctgctattggggatgtcatcgagtcagacgatgacacagaggaccgccgacgattggaccgggctcgagtattggtgcggacaccgcttccgccgttgataaggtcggaggtcatcatccgtgtgggggagcttgagtatcgggtatggattgtggaagagacagggttcgaaggtgggtcgaaccggaaaggaagctcgccgtccgatgggtggtcggagatgataacatcggacgacgaaggggaggttggtgatgttcttgacgacactaataccaatttctccttctcgccggagctgcccaaccagaaattgtctccgtctcgtacccaacgggcagaaggagggaccgatgtgcgctgttgtgatcttagacccctgggtaatatccaggcagacgttacacccaaagaaaagtcaaaaggcactgtagaaggtatgctgggctctagctttggtaagctcaacctaggggacagcttcgcaggaacagaagaggaagctgctaacaccaaagag

SEQ ID NO: 87900 - DNA, 285 bp, Glycine max
  Peptide Sequence Number=SeqID_179585
atgcagttatccgcccgctcgatgagtgatgaacgcgcagggacagattctgtgccctttatcattcaggagcagcgagtcgagtggaacaacaagttgggtggtaaacgcgcagagatagattctgcgccctttatcattcaggagcagcgagtcagtggaacaaaaagttgggtggtaaacacgcagagaccgattatgtgccctttatcattcaggaacaacaagttgggtggtaaacgcgcagagacgaattctgtgccctttatcattcaggagcagtga

SEQ ID NO: 87901 - DNA, 309 bp, Glycine max
  Peptide Sequence Number=SeqID_179586
atgcaggttgaaggttatagcatttgtggaggagcccaagaatccggatgttgtataccccaagatgattctgctaaagaggtaaactacatggggaatcaaaacaaacagggatttcattcaagcggcttttcaggttaccagcaaggagggaacttcaatcaaaatcaagggaaaggatggaggtcacatctagggaatcatttcaataaagatcaagtaggaccttccaacaaacctcctaatcaagggcctaacttgtatgagaggaccaccaagctggaagaaactttggctcagtttatatag

SEQ ID NO: 87902 - DNA, 183 bp, Glycine max
  Peptide Sequence Number=SeqID_179587
atgaggaaattaggtgccaaaagagctaaagacatcttggaactaagtttcaaggctgaagttgaacttcaacatggaaagaaaattagggctgtcaaatttgattgtggtggtgagtactatggcagacatgatggatcaggagaacaacgtccagaactatgccaggcaaacctagcatga

SEQ ID NO: 87903 - DNA, 249 bp, Glycine max
  Peptide Sequence Number=SeqID_179588
atgactaggggaaatccaggtgatttacaaccctttgatcctgaaatagatagaacttttcatagattagttaggcatagtgtgcatcctgatcattctgtgcattttgagctttatgagtattctgttgctggtgattctgaatattctgattttgagcattcaactactaattttcatactgagaacatggttcaacctccaccttatgagaggactgatatgtcatcattttctcatatttcttaa

SEQ ID NO: 87904 - DNA, 228 bp, Glycine max
  Peptide Sequence Number=SeqID_179589
atggcagaaatcaaccaaggtaagatgatgaccgctcacgattggtcgcatatcatcttggctcttactcgcaggtacatagggacggatgcaagtagggctagggtcatgaccgaccgatcattgccccttcccggcactaaacaagcagagaacgtcgctgcaaggcagcccagtatcctttgtggtcgcagtttcttttactatttgtttgttttaaatgggtaa

SEQ ID NO: 87905 - DNA, 581 bp, Glycine max
  Peptide Sequence Number=SeqID_179590
gtaattccgattggattaactcaccatccttcacttgccaatttgttatgacatttgttgttggatcacctatgattcttgtttccaaggaacttgtcttggatttgttttctgtttgcacccttgtaatgttggaagaaccatctcctttgaggttcattctccggagaatagaaatctttcctgagggtatgctagaagtagtgtctaatccttggaggtttacagtagggaactggttatgtgactcagatctggttagtcctactggaattgaacgggttctaactgaaaaagaccttctggctgactcatattcagacctagaggcttctattcttgatgaaaaagaatttctcctattgaaggttatctctacctttccggagttatcttgcttaatatgctctatggttggagcgggtcggggaatagacggtgtggccttatccataacccatctttcgggaagagttacttcatcccattttatttttcttgggagagacacgttagcctttgtcatttcagtgataaacaaggctgctgggattgatccttctttcatgtcaaggccatga

SEQ ID NO: 87906 - DNA, 330 bp, Glycine max
  Peptide Sequence Number=SeqID_179591
atgggtagcctggcccaggactcagcctccccttcacagggaggacgaaggtctcaccgctcagagcccctgatcagaagaaagaggctagttgaaacacaagaagctgcagccactttggagaaatctcttgagaccacttctgagccttcagaaccagtggcagatacagtttcaattcagcaagtagcagacccctccactcctgaggatcagactacaccagtcctatctcagaacacctctcctctagctacccctgtgcttcacttaacagatgaggaggatgttcaaacacaggatactcaggacagatcacaggatttttaa

SEQ ID NO: 87907 - DNA, 273 bp, Glycine max
  Peptide Sequence Number=SeqID_179592
atggcccgcacgaagaagacaggggagatgacgactgaggccgcaaaggaaatcgctcagaagattgccacacagggatcgttcgtcccccatggacgtcaagatgttctggccgctactattggacgtccagagtaccctggacgtgtccgtgctgctggagccagtgtcaccatcaagcaatactttggatcggctccacggacgtctcgcaacgcttcctccctgcctcctgacaaattacaacagctgactcagcagatcagggactag

SEQ ID NO: 87908 - DNA, 327 bp, Glycine max
  Peptide Sequence Number=SeqID_179593
atggctcaaattgaggagtctcaagaggtcaccatggcaaggtttttgcatggtcttaatagggagatccaaggcattgtaaagttgcaccattatgactctttcgaggatctcattcatcaagctatcaaggtcgagcaacaattaaagaggaagaaaatatacaagaagtccccctatggttcttcaacttggaaagataaggagacatttaagaaggagggaggatcttcattcaaatctcatgagaaagtgtatcttattctagttcttctagtgaaagtgaaagtgaatgtgatgtacaacccctggaaggtgatcttttga

SEQ ID NO: 87909 - DNA, 1134 bp, Glycine max
  Peptide Sequence Number=SeqID_179594
gaagagctggcgctgctggaaacgctcgataccggcaaaccgattcgccacagcctgcgcgacgatattcccggcgccgcccgagccattcgctggtacgccgaagcgctggataaagtttatggcgaggtcgcgcccaccggcggcaacgagctggcaatgatcgttcgtgaaccgattggcgtgattgccgcggtagtgccgtggaacttcccgctgctgctggcctgctggaaactcggcccggcgctggcggcagggcttgcgaaagaagccggactcccggacggggtgttaaacgtgatcagcggctttggccacgaggccgggcaggcgctggcgctgcatcctgacgttgaagtcatcaccttcaccggatccacccgtaccggcaaacagctgctgaaagatgccggcgacagcaatatgaagcgcgtgtggctggaagcgggcggtaagagcgccaatatcgtcttcgccgactgtccggatctgcaaaaagcggtcaacgccaccgccggcggtatcttctataaccaggggcaggtctgcatcgccggcacccgcctgctgctggaagagagcatcgccgacgagttcctggcattactgaaagcacaggcgcaaaactggcagccgggtaatccgctcgatcccgataccaccatgggaatgttaattgataacgcccatgccgacagcgtgcacagctttatccgcggcggtgaaaccaaaagcacgctattcctcgacgggcgcaaaaatccgtggcctgccgccgtcggcccgaccattttcgttgatgtcgacccggcctcaaccctcagccgcgaagagatcttcggcccggtgctggtcgtcacgcgcttcaaaagcgaagaagaggcgctgcagctggccaacgacagcgactacggtcttggcgccgcggtgtggacccgcgatctgtcgcgcgcacaccgcatgagtcgccgcctgaaggccggctcggtcttcgtcaacaactacaacgatggtgatatgaccgtcccgttcggcggctataagcagagcggcaacgggcgcgataagtcgctgcacgcgctggaaaaattcaccgaactgaaaaccatctggattgctctggagtcttga

SEQ ID NO: 87910 - DNA, 1220 bp, Glycine max
  Peptide Sequence Number=SeqID_179595
atgactgcaccgcgagtggaaaaattacgccagtttattcaagaccttgatgctctgcatcgccagtttaccgatgaggccaccctgctcgacgccgtcgccgagcgcctggcttcgctggtgcaaaaagacgactggttgccggaagagtacaccctgccgcatccccatcactatcagcagtatttgctgcatgccgattccggccaacgtttttcgattgtcagcttcgtctgggggccggggcaatcgacgccgatccacgaccatcgggtctggggagccatcggtatgttgcgcggcgcggaggagaaccagcgctaccgactcgacgaacgcggtttgccgatcgccactggccctgctgaacggctttcacccggcaaggtggaaaaagtctcatcccgcgatggcgatattcatcgggtgagtaacgcgctcgctgaccacgtctcaatcagtattcacgtctacggcgctaacatcggcagcgtccggcgtgctgtttataccgcggatgggatcgccaaacctttcgtctccgccgaggtacgccaggcgctaatcgatggcacaaaagtggcgctcatcgatgttcgcgaagaggccgtatttgccactaaccatccgctgtttgccgctaatttgccgctcagcaagctggagctggagatttttcgccgcgtgccgcgcctgacgacgccgattaccctctacgataacggcgaaggtctcgcggagcaggcccttgaacggctgcaacgctggggctatcaggatgtcgcgctactggctggcggactgacgggctggaagcgcagtggcggcgagctctttcaggacgttaactcaccgagcaaagcgttcggcgagctggtagagagcgagcgccagacgccctcgttgagcgccgaggaagtgaaggcgctgatcgagggtccccagccggtcgtggtggtcgacgcgcggcgtttcgatgagtatcaaacgatgaatattcccggcagcatcagcgtgcccggcggggagctggcgttacgcatcgaaggcctactgccgtcggcgcaaacgacagtgatcgttaactgcgccggccgtacccgcagcattgtcggtacccaatcgctgcgcaatgccggcttagccaatccggtatacgcactgcgcaacggtaccatcggctggaccttagccggactgtctcgagcacggccaacagc

SEQ ID NO: 87911 - DNA, 747 bp, Glycine max
  Peptide Sequence Number=SeqID_179596
atgagcaaacctgaacaagtttgggaccaaacttggcattggatggctgatgacattgtctataattataaaaaatcatcaacaagtccagcattacagcttgatgatagaactcttcaaaatctggtcttgcttgaaattgaagaactgctgcaagcaaatcaaagatcgcttagagactatccttcaatgccatatccagaggatgcgaattgtccagcttatctagacaatagccttatattagttgaactgaattacaacaatcaagaacttagatcagagtttgaacatctattttctcacatgacagctgttaataaagatgaaggtggtatgttttttctctatggatatggagtttcggtttttgaagactcaacttgcaatatccatcaaggaactcaattagctaaactattaaatcagacaagtctgatcatttgggatgaagcacccatggctcacaaattcagttttgaggcacttgatcacagtcttagagatatcatcaaacacaactcaaaggacaataaaatctttggaggtaaagtcatggtctttggtagagatttctggcaaatcctgccagtcattccaagaggcagccgctctgatattgttaacgcaacaatgaattcctcttatctatgggatcattgtcagatcttgagactgacaaaaaacatgcacttacaaaacaacatgcaagcaatagatcaagaagaaattgtagcttttgcatag

SEQ ID NO: 87912 - DNA, 186 bp, Glycine max
  Peptide Sequence Number=SeqID_179597
atgggacaccttagtggtcaaggggttcccatgaaccctaagagaataaaggtcattcctgagaggcccactccaccaagtgttgagggaaaaagcctagagtttcaggaacctctggatttgaggtcaaatccttttcaagggggagggaatgatgaaatcctacccaccaagggcattggatag

SEQ ID NO: 87913 - DNA, 582 bp, Glycine max
  Peptide Sequence Number=SeqID_179598
atggctttccgtcatccccgttgtgatcggactcatcctggcgctgcccctcggatggctcgcgcagcgggcaggtctttttcgctctgcaatgctcggcgcagccgggctgctttacaccattccttcgctggcgctcttcgtccttctgccgctcgtgttgggtacacgcatcctcgatcctctgaacgtcgtcgtcgcgctgacgatctatgcgctggctcttctggtgcgaaccgtcagcgacggactggagtcggtgtcgccggatgttgtccaggccgcaaatgccatggggtatcgccccatgcaccgtctgctcttcgtcgaacttcccctcgccgttcccgtgattgcagcgggcctgcgcgtagccgtggtttcgaatgtcagcatcgtctcggtcgcggcgctcgtggggacaccccagctcggcctgcttttcacacagggactgcaactgcgctttctgacaccgatcattgcaggcattatcctgtgtattgttctggcggtccttctggatggcattgtgcttttcatcgcacgtcgtctcacaccgtggcaagctggaggtgctga

SEQ ID NO: 87914 - DNA, 770 bp, Glycine max
  Peptide Sequence Number=SeqID_179599
atggagacatgcgatgccgaactcgccgaagcgccttccgtcgatgtgggcgcgacggttgctcattcgattatcgtccacgcggaagattccgtcccgatgcagatcgaagatcgtttcgtaaaccacgggatcgtcccggattacgtcaatcaggacttcagcaccagaacgccgaacggctatctcaccgccgtggcaccgatcatcagggctgaacaacatatcgaggccgttacagcgcagccttgggaatgcaagcttttggcgatctccaaagcagagccctgccttctggtgcgacgccggacatggtctgacgttggtgtcatctcgtcgacggcgttccccgaggagaacctcatgacggtcatgttggacaaggccctgagctggcacgatgtcgcccttgtgagccaaggcgatcatctcgtcctttcggacgaagcctaccggcggatcgaaagggcaagccgaattgtcgacggcatcgttgaaaacggtatccgtgcctatggcgtcaacacaggtgttggcgctctggctgacacggtggtcgatcgcgctgcccagggaaagctttcccgcagtatcgttctcagtcacgcctgcggcgtcggcccattgcttggccgtcacgaggtacgcgcaatcattgcctcacaaatagccaacttcgcccatggttactccggtgtccgcagggagatcgttgcccatctgacgaggttcctggaatgcgactgtatccctgatgtgccctcaaaagg

SEQ ID NO: 87915 - DNA, 289 bp, Glycine max
  Peptide Sequence Number=SeqID_179600
acttatcaaggtaatccttgtgggggggtaccctgacttatcttccttcactggaagtggcgtctacccagacttatcttccttaaccggaagtggcgtctacccagacttatcttccttcactggaagtggcgtctaccctgacttatcttccttcaccggaagtggcgtcatccaaaaactctacagcctgtatcaagtgatccgccccgcaatgaagctccaggaaggagatcaacttgatgttctatgcctcttgaaggtggcagtccatgaggaatctccttag

SEQ ID NO: 87916 - DNA, 1281 bp, Glycine max
  Peptide Sequence Number=SeqID_179601
cttgacccttctgcggccggtggcggcctggccgatctgccggcgcagccgtgcatcctgcttgccgccgacctgtcgccctcggataccgccaacctcgacaccacccgcgtgctcggcctcgccaccgcactgggcggtcccacctcacacactgcaatcctctcgcgcacgctcggcctgccggcgctggttgccggtggcgccgaactgctggcgatccaggccggccgcgaggcgatcatcgacggcagcagcgggcggctctacctgtccccctccgaggcagatcttgcttcggctcgcgcctggatcgctgggcagcagcagatccgagcgcgagaagcggcgcaacgtgcgcagccagcgcagaccaccgatgggcatcgcatcgacatcggcgccaacgtgaacctgcccgagcaggtgccattggcgctggaacagggcgcggaaggtgtcggcctgatgcgcaccgaattcctgttcctcgaacgcggcagcacgcccagcgaggatgagcagtacgcaacctacatggcgatggccaacgcgctggacggccgtccgttgatcgtgcgcgcgctcgatatcggtggcgacaagcaggtcgcccacctggagctgccacacgaggaaaacccgttcctcggcgtgcgcggcgcgcgcctgctgctgcgccgcccggatcttctggaaccgcagctgcgtgcgctgtatcgcgcagccaaggacggtgcacgcctgtccatcatgttcccgatgatcacctcgttgcccgagctggtcgctctgcgcgccatctgcgagcgcctgcgcaccgaactcgaggcgcccgacgtgccgatcggcatcatgatcgaagtgccggctgccgcagcccagagcgatgcgctggcgcgccacgccgacttcttctcgatcggtaccaacgacctgacccagtatgtgctggcgatcgaccgccagaatccggagcttgccgcagaggccgacagcctgcatccggccgtgctgcgcgcgatccgcgccacggtggacggtgcacgcacgcaggggcgctgggtgggtgtctgcggcggcctggccggcgatccgttcggtgcgatgctgctggcgggactgggcgtggacgaactgtcgatgaccccgaacgacatcccgtcggtgaaagcacgcctgcgcggcactgcgctggctgatctgcagaggttggccaacgccgcactggactgcgaaaccgctgaacaggtacgcgcgctcgatggagcaggcgcatga

SEQ ID NO: 87917 - DNA, 153 bp, Glycine max
  Peptide Sequence Number=SeqID_179602
atgagaaagcgccacgctttcccgaagggagaaaggcggacagttatccggggggcggagcctatggaaaaacgccagcaacgcggcctttttacggttcctggccttttgctggccttttgctcacatgttctttcctgcgttatcccctga

SEQ ID NO: 87918 - DNA, 510 bp, Glycine max
  Peptide Sequence Number=SeqID_179603
gttgttgaagtattgccagtcaaaatttctattccttggattatagggttgaaccaagcacgtgcttttaagaaaaaagttcgtcaagtcaaggtcaagtatggaagtaaccagcttgcaaaagttggggcagaagatggatcagaggaggtgcaagagcggatgaaggctgacatggaggccataaaagagcaaatggtcataatgatggaggccatgatgagcatgaagaagataacggaggtcagtgcggctgcagttgccgcaaccagcgccgttgctgaggtggacccaactcccccatctagcctcaaccaaataaatcatccaacctcagatatgaacaagcatgccttcccatcatacggcttgcctcccaactatacaccacccaatgttacgcacactcctgatgacaatgttaataactccactcccatactctttgagagccaacaacctcaatctgatcatgcacatgtctctcaacccatgggggagacacatgaa

SEQ ID NO: 87919 - DNA, 942 bp, Glycine max
  Peptide Sequence Number=SeqID_179604
atggaaagcaatcatttaagagaacagaagaaggcaaaaacctccaagaagaagcaaggagaatgttcccaggttgttatcaaccacttggatacatggttcacaaataaaagcaggaagaatgactacaagatgatatatgttgtcaaaaacatgagggtccccaagtatttggacttggaatggttctttcaacaagggtttaactttctaaatctactggaagttcaaggactatcaaagttggtgcagatgaaagggacattttatccaaagctactaaaggttttctacacttgtgcacatgctgaccttgaagtagatatggtcatcgatgctactgtgtggaaggaagtaactgatctagacatgggtggagtctgcaagttcaatgaaatgtctattgggaatcgcttaggagttggtggactgactgcaaaggacaaaatgctagtatacctcatcacctacattctcacacctaggtcaagcaatcatgctcaagaagtaacagatgatgatctacagatagtttatggtctgaaatcgggtatcaagatgaattgggtactgttaattaaagacattatgctgaagtgtcgtcgtttggtggattatgaatttccttatgatgtgcttgcctcaagattcattgactatttcaaggttgatgtctctaatgagattgtggactttgccaaagcctctagtgagattactgataggcatctcaagaaacttggaatgaggtttgttgatcatgaatggataatggctggagagcctacagctggaaacaagatggatactatgcttcaccttcatcaagatcagtcaactagagttcatagttctttggagaatataacttctaggttggaaaacattgagactagtctgacctttagcaacctccttaaccctgatgaggatgaagcttag

SEQ ID NO: 87920 - DNA, 156 bp, Glycine max
  Peptide Sequence Number=SeqID_179605
atggcaaccatcatggctatcgagtttgatgccagcaacaaccggtctaagctatggctggaaacaaattctcagctccttgtccatgctttcactcatcctacgatagttcattggacactctacaccaaatggatgaattgtatgaagtttaag

SEQ ID NO: 87921 - DNA, 936 bp, Glycine max
  Peptide Sequence Number=SeqID_179606
atggctccaaagaagcttccagctaaaagggcaaggaaagatgctgctggagaaggatctagtgcggccacacaagtggatgtggagtttgacggacatcggtttcaaagcaaggaacatcaacacttttttgaggcaatcaagggttggtctttcctcaaggagaggcgggaggaaatcgctaggaggcagtggactcaacttgcgacacccatgactaagtatgatccagaaatagtcatggagttctatgccaatgcatggctcacgaaggagggagtcagggacaagcgcacctggctatgtgttccagggcaagacttcgcccgaagcgtggcaaggagatgggtgcagatcatgcacactagcatgaccaccctgacacagatctggatgacattgctgctcagcaacatcctcaccaatgatcataattctgacctccccctgccaaagtgccagctggtctatgccatcttgacccaggtgagtgttcatgtggcccaattgatcttagatgccatctatcaatttgtagggatcacgccttccagacacccagtggacccggagaagtccaacagggcactagggtttccagccttgatcatgggcctttgccagttctatggggtgtcgggggaggaccagcagcagccagctgtagatgcaccgccgccacctctattgcagccaccatctctaaagtccatctttgctcacctgcgaaggatagagctccatatgcatgcatatatgaagcatgtgaccgaccagcaggcagccaatcataggggtcagttcagggcaacaattgcatggctgggagataagcctaattttcaagcaggggaaggacccgcaacggccctcggggatgaagatagagctcaggaagatgatggcacaaccaatgtgatggaatacttcctttga

SEQ ID NO: 87922 - DNA, 512 bp, Glycine max
  Peptide Sequence Number=SeqID_179607
atggacagcataagattcaccgcacctttcaaggttcagaagaaccttctccaagttcctttcacctatcacaggcaatggctgcgcaactaccccaaatacgttttattccactacgatggcgagatacatttcattagggtaagaacacttggtactaaatgcttttttgctgatggcttgaatgattttagaagggcatacaacctcaacgaaagcgtgattctacgtttggtcgccggtgacaaaaacaccactttcaccgtttatattgacggacctgcacaccaccactctagcctaaaacccatcatttatagaaggagatacatctttactgttgatatcatagatgatatgctacagcagaacctacctttaacacttcctgcagcggcttccaaatttgtgtatggctccaaaaaaagtattaccatccaccacggactttcaaaatccaccaaatggccactcaccatccaccatgacatccctgccattacacaaccatg

SEQ ID NO: 87923 - DNA, 177 bp, Glycine max
  Peptide Sequence Number=SeqID_179608
atggctctgaaacggtggcctcaaatgatgcatcctctacatgttatggtacctgggctgtgggaccttcatcttccctgtgaagagaaggttgggccccaggccaggttactctctctagaaactgctcaatggaaggaaaggatcctagaggagccaccacctgtaaactctgaa

SEQ ID NO: 87924 - DNA, 336 bp, Glycine max
  Peptide Sequence Number=SeqID_179609
atggcaggagctggtgatggtggtggtgattatcatcaattggacggatctcaatgtttattactggacgcgatgactacacaaatgcaacaattgttgaaccgtaacaatgaagagctctacagacgaatagaaggactagagcaccaaatgaacccaaatgccgggagaccttatggttggaatagaaggacttatcaaggtaatccttgtggcatctaccctgacttatctttcttcactggaagtggcgtcatccaaatctccgtagcctgtatcaagcgatccgttcctagtcaggatcacatcatctggtatcagagcttcgactcttga

SEQ ID NO: 87925 - DNA, 162 bp, Glycine max
  Peptide Sequence Number=SeqID_179610
atgaagttatttggtggcctaggtgagccaaaggctagcttgggcgagctagaggctatcttggaaacaaaggacgtcgagtcttatgaagcacaaacaaggacaaaagacattgaagtctttgagatgaaaatgaaggcattgtcgtctttgaaagtgtaa

SEQ ID NO: 87926 - DNA, 91 bp, Glycine max
  Peptide Sequence Number=SeqID_179611
atggatatctcagagccctacactggggcaataagaggtaccatgcatgagcctcaagtgaacctaggggcagataaaaaattctcacccg

SEQ ID NO: 87927 - DNA, 1029 bp, Glycine max
  Peptide Sequence Number=SeqID_179612
atgacgaacatgaaaacgctggtggtcgccgaaccgcgcagcatggtgtggcagcagcgcagcgtaccgacgcctgccgcgcacgaagtcctgattaaaccaattgccgccggcatttgcggcaccgatattcacgcctgggccggcaatcagccgtttttctcctatccgcgcgtgctcggccatgagctgtgcggtgaagtggtggcgctgggcgcggcggcgcagggatttcagccagggcagcgcgtggcgctgattccttacgtggcctgtcagcgttgcgacgcctgcttaagcggcaaaaccaactgctgtgaacagatttcagtgattggcgtgcatcaggacgggggcttttgcgagtttctcagcgtgccggacactaatttgctggcggttgacgatgtggcgcctgaagcagcggcactgatcgagccctttgccatcagcgcccatgcggtgcgacgcgcggcgctggtcgccgatgagcaggtgctggtggtcggagccggaccgattggcctgggcgtcgcggcgattgccgccgcagccggtgcgcaggtggtagtggccgataccagcgctcagcggcgcgcgcacgttgcgcagcagttgcagctggcgacgatcgatccgctggcggcggattttacggccgcgctgcgcgcagagtttggcgggcggctggccgctaaagtgattgacgccaccggcagtccggcggcgatgaacagcgccgtgcagctgattcgtcacggcggcaccatcgtgtttgttggcctgcacaaaggcgatctggtgatccccgacaccgagtttcacaaaaaggagaccacgctgctgggcagccgcaacgccacgcgggaagacttccacaaagtgcgcgccctgatggccatcggtcagctgcgggccgatatgatgctcaaccgccattacgacttctcgacgctggccgagacttttgagcccggggtgatcaacaaccctgagctgatcaaaggcgtcatccatttctcccgctag

SEQ ID NO: 87928 - DNA, 720 bp, Glycine max
  Peptide Sequence Number=SeqID_179613
atggctacctcaccaaaagaaactgcagcttctggttcaccatctgtcccgtcatctccacaccaggaacaacctgaattcaacatccaacccatccaaattattcctggtcaagcctctgtccctgagaaactggttcccagaagaccacagggagtgaagattgctgaaaaccctagccctgcaacgagtcctagggaaacgcctctgttgcctgaagctgatgaagatgtcccaacatcgtccaacccaaatgtttctgtgcctgatgtcaagaaagatgttccaacatcttccgctccaaatgctgaagcactcccttcacccggtgaagagggatcaactgaggaagatgatcaagccgcagaggagactcctgcaccacgggcaccagaacctgctccaggtgatctcattgacttagaagaagtcgaatctgatgaagaacccattgccaacaggttggcacctggcattgcagaaaggttacaaagcagaaaagggaagacccccattaagaggtctggacgaatcaaaacaatggcccagaagaagagtactccaatcactcctgccacatccagaagaagcaaggttgctatcccctccaagaagaggaaagaaatttcgtcatccgattctgataaggatgtcgaactagatgtctcgacatctaagaaggcaagacttcagggaaaaagtgcctggaaatgtccctga

SEQ ID NO: 87929 - DNA, 175 bp, Glycine max
  Peptide Sequence Number=SeqID_179614
atgaaacggttacagagggcggggttgaggagctctcgcggtgttgggttggggcataacattaaatgtcggtccctcggtggtgaatgtgggatatgggtcgaagtcaccttgagcatgctctcaaggttcttcacgggcgccccctacaggctggggttgctgacccacaaca

SEQ ID NO: 87930 - DNA, 114 bp, Glycine max
  Peptide Sequence Number=SeqID_179615
atggaatcaaaaaatgcgaaaaatgatgaccctagggctgcaaactcgggttgctcgcccaggcgagctcagcttgcccaggcgagctcagcttgcccaggcgagctaacctga

SEQ ID NO: 87931 - DNA, 498 bp, Glycine max
  misc_feature (495)..(495): n is a, c, g, or t
  Peptide Sequence Number=SeqID_179616
atgagccttgcccacataaccgtatctcccgattcatcgcatgaggatcgtgcccaggccattcgagacactttgcgcgacgccattgtcgatcgccggctggcgccgggaacgaaattgtcggaatcggaagttggaacgttgttcgatgtcagccgcacggtggtgcgcgcggcgctgcagatgcttgcctatgagggcctcgtgaaggccgagcgcaatcggggcgctttcgtttccaatccgacgcccgacgaggcgcggcaggtatttgcgtcccgccggctgatcgagcccggcgtcgttgacgcggcaatcgaaaaaatcacgcctgtggcggtaaaaaagctgcgggaacatctgttggaggagagcaggcatcagcaggaacgcgggccgagcgcacggcgggccgaaatcaaggcctcgggtgattttcacctgatgctggcgtcaattgccggcaatgccatcctggaaaaattcatggatganctg

SEQ ID NO: 87932 - DNA, 237 bp, Glycine max
  Peptide Sequence Number=SeqID_179617
atgtctcgagagaggactagtttagaggaatgctttctcgaggcatcaactctcaaaagtaaccaagtagggacttgtgatggttgtgatttttgtgttgctcttttcttgtgtgtattctttccatgtctcacttcctcgtgtgtgcaaggagtgatggctggaaggaatgatcgtgctatagttgatgctctccaagccttagctcaagctataaggaatccaaataggggataa

SEQ ID NO: 87933 - DNA, 207 bp, Glycine max
  Peptide Sequence Number=SeqID_179618
atgaaactggccaaatacaagctaaaagcccaagtggagaaggacgaaggcccaagtggagaaggacaaagcccccaagtggagaaggatgaaccaatctcagacttatcaagcctgtatcaaacgatccgctcctactcaggttcacatcatctggtatcagagcttcggctcttgatacagtgtctttcagactttgtgtcataa

SEQ ID NO: 87934 - DNA, 234 bp, Glycine max
  Peptide Sequence Number=SeqID_179619
atggtagaggaggaggcaggtgagacacaggttagacaggaagttgctgctactcctgagaggtcacgagagcatgtagcagacccctccactcctatactcaagataccagaggacccgaccacaccaatcctaactttgaacacttcacctccagctactcacgtacttcatctgacagatgaggaggatgttcagacacaggacactcaggaccagtcacaggaattctaa

SEQ ID NO: 87935 - DNA, 456 bp, Glycine max
  Peptide Sequence Number=SeqID_179620
atgggtgacgtagaggaagtgcaagaacagatgaaagccgacatgtcagctctgaaagaccaaatggcttccatgatggaagccatgctagatatgaaaagattgatagagagtaatgcggcaacagctgccgccaccagcactgtcgttgaagcagacccgatccttccgtctacagcaaatctagcacatcaactcgccccgaatatggtgggacaaggaagagacacattggggaataccaacagctcgtgtttggggtacaaccgaagtgcttacccctatggtctaccccccaaggaagagacacattgggatccttgcttgatgcatccaggtgcatcgcatgatatggaaacatgttcagcggtggagcagttgttgcagcggatgatagaccaaggccgactcgagatcggtgacgaggacgagaaagaacaacatgtctgcatgtag

SEQ ID NO: 87936 - DNA, 252 bp, Glycine max
  Peptide Sequence Number=SeqID_179621
atgagtgaagtagaagaggtgcaaaagcagatgaaggccgacatggaggcctttaaagagaaaatggccccaatgatggaggccatgatgagcataaaggagatactggaagccaatgcggttgtcgttgctgctaccagcgttgttgctaaggtgaacctgatgccctcatctgacctcaaccaaatgaatcatccaacttcagatatggtaggcaaagatttgggaagtacggacaaccctatgatgtga

SEQ ID NO: 87937 - DNA, 435 bp, Glycine max
  Peptide Sequence Number=SeqID_179622
atgtggcatacactctcaatgaaaatctcaataactccactccgatactcattgagaaccaataacctcatcaggcacatatctctcaaaacatgggggagacacgggcaagcagttggtggtataccctttgaaaacactttggagggccctcagtttcgcccacaatcacaaccattggcattttgcggtgggaagagcccctcctgctatggccgaaaagggaaaggtggatcatctaataggaaaggctcatggccattgaaggaggtgaagattatgcctttgctaaggcttgaggagttgttcctaatacccaaacatggtcattcccaagttcaaggtgccggactttggcaagtacaaggggactactcgctccaagaaccatctaaagatgtattgtcagaagatgggggcatacgcaaaagatga

SEQ ID NO: 87938 - DNA, 480 bp, Glycine max
  Peptide Sequence Number=SeqID_179623
cagagaccaagtttggtcattctgtacccttgtatcatccagaggcggcgggcccgatgatacgcggagataccttatggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgatacgagagaccaatacccgagtggcggcgggaacgacaagtcagagaccaagtttggtcaccccgactctcgtcaaccgagaggagcgaaattagtgtcatccgcaccctttttcgtccggggacctttgcttgatgacatgggacctttcgttggtccttgcggcgggcccgatgattacgcagagataccttatggttattccgcaccctttttgtcatccagaggcg

SEQ ID NO: 87939 - DNA, 621 bp, Glycine max
  Peptide Sequence Number=SeqID_179624
atggaaagaaaagatgaggagcttagaggaagcaacaacggtgttatcggtggctatcataaatggttaaaggttcggacgcaagggatagtttggctcccgatgctaaagatttcaagtggggaagaagctgaagtccttgaggaaagtgaagaggtgcaagccctaaaagtagggcatgaaagaatgagagtgataaaaaagaagctcaagacggtcgtcactagggtcaggaaagagtgtgacgagctaaaggatggctctatggggaagcaacaacaagctcaagcttcaaagggccgaaagggattagccgaggaggagctaagcctagcgactagtcatgggcagagactaaaggatgagcacgcgaagatagtgatgcaatcctaccccgcaagggcattggatagaagactccaagtagattgggccagagatgcaaaagaaggccctaggcttcttgatgaggacatgaccaagagcaagggcaaggatccacttgaaggacttggaggacctatgacaagggctagagcaaggaaagccaaggaagctcttcaacaagtgttgtccatactatttgaatacaagaccaagtttcaaggagaaaagtccaag

SEQ ID NO: 87940 - DNA, 369 bp, Glycine max
  Peptide Sequence Number=SeqID_179625
atggctacagccaggtgggccctcaagcatcccgtttatggcattgtgatactacggttgggaatttacacagccagacccaacgtttccaagttatgttctttcattagttcaatgaattcatccatccttatctcggatgacgttcctaaatggaaaactccacacgactccggaatttcaaaaaacactattgacaacaacgaagtaaatactaacgtaacagttcaaacgacattcatgtggctccgcatgccaccgggctcttgggtcacggtaacaaaaagtggggtggtcgacaaaagcagggcttttgctcctacgtatcctcaatttgtgatgaggaactcagacctacgtagttcttga

SEQ ID NO: 87941 - DNA, 597 bp, Glycine max
  Peptide Sequence Number=SeqID_179626
atgattgcagtactttttgaggcagaagccctgccagcagctcaggagcgatatcttcagctcgcttctgagctgaaacctctgttatccgacacgcctggatttatttccattgagcgcttccagagcctgaccacgcccggcaagatcctctctttgtcctggtgggaagatgaggattctgtcgccggggaaccaatccgcatgcatgacattcacgttattctcaaaaatagcccgggctcactgggttttctgggaagtgtattggggaaaaacggtgtgggtctcgaagggggtggcgtgtttacaacgcctgaaggcgggcatgcacacttcctcgttgaagacggctataaagcgcgcacggtattaactgaagccggttttgacgtctgcaacgtatgtcgtcctcttgtcagaaaattagcgcaggaacgtcccggcgagctgggcgaaatcgctgacacgcttgcccggaacggcatcaatattctggtacagtacagcgaccaccataaccggctcattctcatcacggatgatgatgtccgggcagccgaagtaacccgaaaatgggcagtagcttctgaatga

SEQ ID NO: 87942 - DNA, 459 bp, Glycine max
  Peptide Sequence Number=SeqID_179627
atggcccgagttatgttggggaacggttacgaacccggaatgggtttaggcaaggacaacggcgacataactagcctaataaatgccaaaggaaatcgtgggaagtatggtttaggctataagcccactcaggcagatataaagagaagcatcgcgggaaggaagggcggtggtcaaagcttgcggttgagacaagaaagtgaaggaagcccgccctgccacataagcagaagctttataagcgcgggtctgggagacgaaggtcaagtggtcgcgatatacaaagatgatgttccgagtacattggatttggtacgaccatgccctcctgatttccagctgggaaattggcgagtggaggaacgccccggcatttacgcaacgagcataatattcgatgacgagtcccccgaaggtactaatacctgggacccgtctatcaacttcgagcaagaatga

SEQ ID NO: 87943 - DNA, 258 bp, Glycine max
  Peptide Sequence Number=SeqID_179628
atgtataaaaaaacacatgaggttgcttgttgggtgtccaccgaggagagacaagcagcaagaataagaggcttatacctcagagcaattttatggcaagatatcagcttctttgacaaggaaaccaatactggtgaggttgttgcaaggatgtcaggtgacacacttcttattcaagaagccctgggagagaaggtattaatgaaaagctacaactaccaaatcatcactatttcctctacaacaaaattaaaataa

SEQ ID NO: 87944 - DNA, 558 bp, Glycine max
  Peptide Sequence Number=SeqID_179629
atggctacctcaccaaaagaaacttcatctcctggttcaccctctgtaccatcatctccatcatccaccaaagcaccatcaaaccaggaacaacctgaattcaatatccaacccatacaaatgattcctggtcaagcccctattcctgagaaactggtccccaaaagacaacagggagtgaagatttctgaaaaccctagccttgcaacaagtcctagggaagtagacacggagatggataagaagatccgcagtattgaatcaacagaggaagaggatcaagccacagaggagacccctgcaccaagggcaccagaacctgctccaggtgacctcattgacctagaagaagtagaatctgatgaggaacccattgccaacaagttggcacctggcattgcagaaagattacaaagcagaaagggaaaaacccccattactaggtctggacgaatcaaaactatggcacagaagaagagcactccaatcactcctaccacatccagatggagcaaagttgcaatcccttccagaagaggaaagaaatttctcatctga

SEQ ID NO: 87945 - DNA, 171 bp, Glycine max
  Peptide Sequence Number=SeqID_179630
atgtacatgcgggggtaccttatggttatccgcacattttgtgatccagagacggcgagttcgatgacatgcgggggtgccttatggttttactttcgtcatccagagacattcaagcccgacgacgcacaagattcttctctgctaggcagggacaatcgagcccgatag

SEQ ID NO: 87946 - DNA, 399 bp, Glycine max
  Peptide Sequence Number=SeqID_179631
atggagcatgaaacattccttgcaacttggttggcagagattgattcctctcccaatggcttgaaaacaatagttagtttggctgatgataagagggagatgtcaccacacgttatgcaggatggtggaagcagtcaatactgtatcatcatcgtgattttgcaaagaatattactcagtgaaagagaagtctacgcaatgatgctggtgtttccacctgaattttctcctttgacaactattttatttggaaatccttcccaagacaccgttgaaccactgatggaggctttggaggaagattataaagatggaaatgagataaatgaatcaaggcagtttattgaaggagtattggatcttgaaaagagaatcaatagactagatacattgacttag

SEQ ID NO: 87947 - DNA, 99 bp, Glycine max
  Peptide Sequence Number=SeqID_179632
ggtatccgagaggggcacaatgcaggctggagatcatctggtaaggagaatccccaggctttagatagtttagagggactaggcaatgagcccggataa

SEQ ID NO: 87948 - DNA, 753 bp, Glycine max
  Peptide Sequence Number=SeqID_179633
atggagacgtgtttggaagtagaggaattgttacaacggatgatagaccaaggtcgactagaagtcggcattgaaggaaaagaagagcagcatatatgcatgcaatctacggaggggagtggtgttgcgaagcccaaacccttggtgatatacttcactaaaagtgcagcctcgcaaaagcccgggcactccttaatggccaaacctgttcctttcccgtaccaagatagtcacgcggtcccgtggagatatacacctccggagaagaaggaagaagaagtcactgacgtcagctcgctgtcggctaaagtaacaaatatcacgggactgagtggtgtgacccgtagtggtcgtgtgttcgcacctccggacctaccggtccaacccgccgacgtcaagggaaaaggaaaagagttagtggaggaacaagatggtttcgaagcacccgggatggacgcttcggaaaaagatattccagcaaagggaccccggataactaggagatccgatgacgagtcccccgaaggtactaatacctgggacccgtctatcgacttcgagcaagagatgaatcaaacggaagatgaaggagatgaggatgtgggagttcctttagaactagaaagaatgtcgcccagaccaaaagctgaaattcgtagtggaggggcacttggtcatcgtgtcaggcgaggaagatatcttggtaagttgcccatcctccatgccttatgtggaagccgcagaagatcgtag

SEQ ID NO: 87949 - DNA, 141 bp, Glycine max
  Peptide Sequence Number=SeqID_179634
gtcgactctagaggatccccgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 87950 - DNA, 490 bp, Glycine max
  Peptide Sequence Number=SeqID_179635
atgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggaattgctaagagtaaaattcgggaaaaagaaccgattgtatgggaaatacttcaagaagttatgcagggacatcccgtattgctgaatagagcgccgactctgcatagattagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgag

SEQ ID NO: 87951 - DNA, 576 bp, Glycine max
  Peptide Sequence Number=SeqID_179636
atgcaaaagaggaaagtttttgctcttgatgctccagctttaaagaaggcaaagaaagcccaaccaatcgatgaaccccaggagctctcaaagtcgcatctctcaggaacttctctcaaagcaaagaagggacctttggaaagaagtggaacctccaaagatacagttttagaagaaggtgcacttatggatgcccatcatcatactcccctaatacatactctggacactcatgatgctaggaccttcaggatatggatcgtatgggtggactctcaaaaagtctccacttttggctataatagaagtgacaatattgtgcaccacgacattattgaggttgacgaagatgttgttgttgctgagacaaaaaatgttgcctctatccaaattgaagcattttctaaagttatggacgatgccattgtgcctagggtcgtcattaatcttacaaacactggtgtcatggacgaaattggtgaagtttccaatgcaactatggttgatgaagttgaaccacatattcaaaaccttgcgtccaagcagtctacaacttcaaataaggccacttcttga

SEQ ID NO: 87952 - DNA, 111 bp, Glycine max
  Peptide Sequence Number=SeqID_179637
atggtccccaatggagtcgccaactgttgcaacctacccttcggcgggagggcgacgcgtgactcgcgggggtgtttccctttgctcctacgtattcctcaattgcgataa

SEQ ID NO: 87953 - DNA, 423 bp, Glycine max
  Peptide Sequence Number=SeqID_179638
atggctactcagttgaaccaagcccagtcccaaaattctgataaattgccttcacaaactgtgcagaatccgaaatatgtgagtgccatcaccttgaggtctggcaagcaaattgaagtgcctccactagtagcagcacctacacctgaacctgtcaagcttcattctacacctgaaaaagaggatgagctagctgcgcaaaagagaaagcttcctgatcatgagggagctaataaaaattttcatgcaggtggaccttcttctagtagtcctgacttacagcagcctcctatccctcttccatttccaaacaaaaagatggaagaagtaaagaaggagatcttggagaccttcaggaaagtagaggtgaacatacctctactagatgccatcaagcaaatccaagatatgccaagtttctaa

SEQ ID NO: 87954 - DNA, 471 bp, Glycine max
  Peptide Sequence Number=SeqID_179639
atgagggacttagcaacattggagaagagtatgattgatgctgccagtggtggagctcttggtgatatgactcctattgaggctaggaatttgattgagaagatggctttcaactcccaacaattcagtgcaagaaatgaagctaatgtccttagaggagtccatgaggtggccatggattcatcttcatctgctgaaaataaaaagcttgagggaaaacttgatgccttggtcaacctagtaactcagcttgccatgaatcaaaaatctgcatctgcacctgttgcaagagtctgtggtctatgttcttctgaagatcaccatacagaatatgcaatttcagcaagagagaagagcttgtccctcctttctagaatgctgctggtccaagaaggccatatgttcctcctccaatgcagcagcaacaacaaagacaacatgcaactgaggccccttctcaaccttccttag

SEQ ID NO: 87955 - DNA, 405 bp, Glycine max
  Peptide Sequence Number=SeqID_179640
atggcagcagagttgatccatgattgcgttgtgatggagtgcctagagggtgtttgggagaccctcgaaggcaatgagaggtgccgaatctatggcacaattcgactcactgctacttcgctagtacatccggagcaacccgcacgcacacttcaacagcctgtggggtggatactacctactcctactccatatcgactagttgaaccggttcaagtgatagaggtgtcatcctctgaagaggatcttgaagaggacctagaggggttacctcctgaacctgctgtggatgcccctgacttaccagaggatgatgaggacccgctccatgatgttgattctccagaggattttatgtcagcatctgaggcagactctatagaggagagcggccctggagggaca

SEQ ID NO: 87956 - DNA, 597 bp, Glycine max
  Peptide Sequence Number=SeqID_179641
atgaattcaagattcaagagaagaaatcaagaagcaacaagtcaagacttcacaagggaagtattgaaaaggatttttcaaaaaccaaacatagcacagttttgttttacaaaagagtttttctcaaatttttctaagttaccagagtatttactctctggtaatcgattaccaatttcttgtaatcgattaccagtgttaaaatttgatttcaaaaagcttttaactgaatttgcaacgttccaaatggttatgggtacatcctttgtggtacaagtagagggtacatctacttgggttgttgtaactgagaacaaaagagggtacatctcttgtggattagttcaagttgaaggtaaatccacttggttgttcaaagagaacaagggagggtacatcccttgtgaatctttgcttgtaaagaattttacaaggttgaaagaaatctcaagaaatggtggttgcttgtgtagacaaaggatcaagctgaaagttttgatgatgccaaaggattacatgaatcatatgcttctcaaagatttactcaagacaaagcaattagagatattcaagatggataatcaagacagtctatag

SEQ ID NO: 87957 - DNA, 243 bp, Glycine max
  Peptide Sequence Number=SeqID_179642
atgaagttgacctcgtccatctcaatggaagaaggggtagggcttcaatgtcaaagagctgaggtcaatgtcaaagaaaggagcaagcagaaagctccattggagcttgtaggcctaggatcttcttcatcaatggattcctttgcttcttggaaaatgaatggcagcggaatggagaaggaagagagagaggagatgccacttcatggagaagaggagtctagaagaagctcaccaccatag

SEQ ID NO: 87958 - DNA, 437 bp, Glycine max
  Peptide Sequence Number=SeqID_179643
atgtcgctaagcggtagtgtttattttgtgaagatggcctccaggaagcggaagagcattggggcaaggccaactgctcagtatgacactagacggttccattcgcttgatgcttggaaccgttatacaaataacatcttaggaatgagcattttgccagagaggaaggtagagatatactacacagagtttgatgacttcaagacaaagttggagagatgtaatcttcacaaacgcctcaccaacttggctgataggactattgatgttgctttggtgaaagaattttatgctaatctctacagctttgaggacccttcaccaaagcaagccaaagttagaggccacttggtgaagatagacacaaccagcctcaacacatttctagagactcctgtagtcctagaaaagggagagacattacccagttactctag

SEQ ID NO: 87959 - DNA, 678 bp, Glycine max
  Peptide Sequence Number=SeqID_179644
atgaagaacggtgaagaacggacgaaaaccttcacggatttgcttacggaaacatctcggaagcgttacggaagcacctcggcttggattttcttcacggaaacaatttttctaagcaaattcgaaagagagagaaggaatccattattcttggaagaaaggcaacaatgtgaatatacttcaaggaaaggccaaactacaggttttgatgaagaggcaataggtcagcttctttgcttcccagggcatgattttgcacgaagcatggtagggaagcggttgcaaataatgtgcaccaatatgactactcttactcaaatcttgatgaccttcctcctgaataatgttcttccaagtgaccataactctgatctgactctacccaaatgtcaattggtctatagcattatggagcatatcattgtatgtgtggcccaactcatttcagatgttattcaccagtttgttattggcaaacctcatacgcacccagtgcacccagacaaatccaacaaggcactagattttcctgctttaatcacaggtctatgtcagttctatggagtgttggtcacaccaactaaactcatccgatcttccatcaacagatcattcattgacaaatattgcatgccaaggctagtacagcaaccggagaagattagtcacctcagctag

SEQ ID NO: 87960 - DNA, 789 bp, Glycine max
  Peptide Sequence Number=SeqID_179645
atggctaatcgaggaggagaaggaaatagaccaccaaggaggactcttggtgactatgcttatcaacaaggaccaaagcattacaacagcatagtcattcctccttttagcaacaaggttgtgggattaaagccaacaatgctcagtctaattggctcacacccctttgctggaatggatcatgaggatccatacacacgtttgtctaccttcatggagctatgcaataccatggagcttctaacgaagatgctgaagctatctaccttagtgctttcccattctccttggaaaaaatcattgcaaggttctttcctccatctagattcatcaatgcaaaatctgccattgctactttctcccaagggtctaatgaacctctctatgaaacataggagagattcaaagcgttattgcggagctggaggtactatgacaccaaagagtccggaggaagcaattgtaatcattgactccattgcagccaatgtgacttccgtggtggtcaccatcacaatagacactgttcagcacctggtgattgtcaacaagaagatgaggcccattatctgtagaatcaagctagacctcaacaaaacttccaaggaaactaccaaggctacagaggtggctcaggttaacccgaaggaacagtctaaggtgattacgacaaggaggaggactatatttggtttgaaggatgatggtgagtgtagtgacaaaaagaaaaatgaaggagttgaagatgatgaaatggaaggagttgaaaaggaaaaaggagaaaaatga

SEQ ID NO: 87961 - DNA, 345 bp, Glycine max
  Peptide Sequence Number=SeqID_179646
atggggatcgcacccacagagacacccagtggacctgaagaagtccaacaaggccctgggggatcgcgcccgcaagacacccagtggacccgaagaagtccaacagggtcttggagttgccaagctctaattacgggcctctatcagttctacggagtgcttgtcgcccccagcaaggtcatcaggccccctactaatcgagctttcatcaagaagtactgcgtccccactccccaggcaggcgcagggcgaaacaccacagcagcctggggatggccggcagcgggcaacagacgtaccgccatcactctagagttcacctcagctcatccacaaaaaggttag

SEQ ID NO: 87962 - DNA, 123 bp, Glycine max
  Peptide Sequence Number=SeqID_179647
atgactaaagcacgtcaaaagggggtacggaaagaaaataggggaggagcttgccacccagctcgcccaggcgagccaggttgcttcatccagaagcaaccgccttctggaggaagaatctga

SEQ ID NO: 87963 - DNA, 297 bp, Glycine max
  Peptide Sequence Number=SeqID_179648
atggatgggctagtggatctagcggcgatcaatgcttttcttgcttatcaccacggcaaggaaagtccggtcgttgctgttttggctgatgcttatgacacattcgaccggagatgcgagaagagcagcatgagaattgtctgttgtacacccgctctttatgtatggctggtctctaacatttttctccatgaaagtagacccgactgtcccctacaaggtcatcgcatgtgtgccgagaaagggaaagcgaattgggagcaactcttggcgggtatggaagggggcgtccgttaa

SEQ ID NO: 87964 - DNA, 1120 bp, Glycine max
  Peptide Sequence Number=SeqID_179649
atggagtttatctctaatgcaatgatactttcattctcaatactattgttgctaccaagtgcatcatattcactatatcaaaagcctaaaaatcatattaagacagctatttttgtaactgggagttttgaaatgggacccggatcaattgcaacaaaaacatttgagaatataaagtttccaaaaggtcatgttggaattaagagtttttatgcggaactagttgaccaagaagggaactctataccttcgtatgaaacttaccttcatcattggtttgcaataaagtaccaccaaaatattaccatgtcacctaatcctaagcttcgtcgtcctgaggatgcttttttccaaagaaacgaaggcacatgtaatggtgacattcttccacattattggggatttggagtagaatcacgaggaacaacctcaaaaattcccgatccttttgctatagaacaaggtaacccaacaaaaattaaaaatggatatgaggagaaatggttgctcaacatcatggtcattgatacacgtggtgcacaagataagaaagcctgcactcaatgtagatgtgacaatatgaatctcccgaaggacttttataatgtcacaagggatatacataaccaaagattgactacaaattataaaggaggtctcttttgttgtcaggacaacttacaatgcaagcaaatagagggttttcaaggttcaaggagaatggtttccttaagatacaaaattagttgggttgattggaacatataccaaataccagttaaggtttacatacttgattccaccgacaaagtgaggtcaaatggttccaaaatacttcatgattgtctggcagagtataccattccagctggtggtggtggtgattctcctcatgtccaaaaagcaaacatcccaatggaaaatggaggttatctaatttatggcactgctcatatgcattcaggtgttgtaaatgcaactttatatggacaggatggaaggactttatgtacatcaacaccaaaatatggaacgggaaaaaaggctggaaatgagaaaggttatctcattggaatgtctgtttgttatccacaaccgggttcaatcaagattcatgatg

SEQ ID NO: 87965 - DNA, 645 bp, Glycine max
  Peptide Sequence Number=SeqID_179650
atggaaggaaggaaaagaaggagtccttttctcatgtggaagatacccaaacattccgctgatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaggaagtccaagctctcaaaagcgagttaggaaaggcaaaactcgccaaggagaagttcaagttggctgctacacacgttcggaaggagtgtgccgggttacgggaaaagaatgcaattaccgcaagagcccttgaacaagagaccaagagggctcgcaaggaagagtatggccggaacaaatttcgcggagctctatggggtagcaataatgaactcaagttgcgaagggaagaaagggaccagtcgcgagcacatagcatggttctgaaagaggagttgattgcttgttcaaggtccaaaagaagcttgtctcagcgtttatgcgagacagagaccaacatgttagctatcatcgccaagtaccaagaagagttgggtctagccacggcccacgagcatagaatcgcggatgagtatgcccaagtatatgcgaaaaagagctag

SEQ ID NO: 87966 - DNA, 660 bp, Glycine max
  Peptide Sequence Number=SeqID_179651
atgaccggccctctcaatgagtcaatctcttgctttctcaaaagggtggacccttgggtactagtaccctcacctttcgaggactacacgtcctcaccttcagagggctgcacgccctcaccttcagagggctgcacaccctcgccttcagaggacaacacgtcctcgccttcagaggactacacgtcctctccattagaggaaaacacgtcctcgctttcaaaggactacacgtcctcgccattagaggactacacgtcctcgccatcagaggactacacgtcctcgccatcagagggctacacgccctcgccttcagagggctacgcgtcctcaccttcagagggctacatgcacgccctcagaggactacgcgtcctcaccttcagagggctacatgccctcgccttcagagggctacacgccctcaccttcagaggactacacgccctcacctttagaggactacatgtcctcaccattagaggactacacgtcctcgccttcagagggctacacgccctcacctttagaggactacacgtcctcacctttagagggttacacgtcctcgccttcaaagggatgcacaccctctcctttaatgggcttcacgctgttgcttttagagggctggacgccctcgcctttaaagggtga

SEQ ID NO: 87967 - DNA, 153 bp, Glycine max
  Peptide Sequence Number=SeqID_179652
atgcatgctttgttagggtcattcaacagtggaaattggtctgactctaaagtccttgatagtgcagggctgagttgttgtgctttcatgaggaatcgaggtgcgtcctggttgagtttagtcttacaagaggaatctgcggacgatgcttga

SEQ ID NO: 87968 - DNA, 234 bp, Glycine max
  Peptide Sequence Number=SeqID_179653
atgactaatgcaaactgtccgcaagagtcattgcattctgtctcaaacgggaatctaagattatggaaatctatccactattgctttaagtctgaaggaccctcgaaaatagataatatatgtgcgagagccaaagggcaggaagatgaagacaatctctggacattgtgttttggtaaaagacatatcagtttcgaaagcagctcccattctcacaaagtttgtctctgctga

SEQ ID NO: 87969 - DNA, 240 bp, Glycine max
  Peptide Sequence Number=SeqID_179654
atgcaagcaaaaggcaatcaaaagtggcttgagggagcaagaaccgcaagccttcaaactgcgaacgcaaaggatactgggctgctctacagcgacgttctctgcttgtttagcgccgggaaggggcaacgaccggtcggtcgtgaccctagccccacttgcatccgtccctatgtacctataagtaggaaacaaaaatacgcggccaatcgtgaccggtcatcatcttaccttggttga

SEQ ID NO: 87970 - DNA, 57 bp, Glycine max
  Peptide Sequence Number=SeqID_179655
atgtcgctacatgttgatgggttctcccaagttagtgtggaaaagtggatggattaa

SEQ ID NO: 87971 - DNA, 519 bp, Glycine max
  Peptide Sequence Number=SeqID_179656
atggttctggttttgattactacatgcattccaggcatcatcatagctcaacccaccacactttttaacagacaaggcaccacactggacaggagaatgggaccccattttgaaatccctccagcatgtctcatagcacttagacaaaccattgaacaatggattttcatcattaacatacaacagatacgtaccaaagatagcttccctgggagtcttcaagccaagcacaatggacctccaaaatcgagtcccaccctttccgggactcaattctatcctagttttcttcgacttgcgaaagtgagcaaatgttcaaacgaggaacgcctaatgttcaaaccaaaggacgtacgtcaaaagataagtgccagacacgaactccacaaacacgaactcgacaatgtggttgcagtcacgaaagtgcagcccagtttgcaacaaacacgaactcaggcagaaggagaaacaacaagaacgccctgggagtaccatttccgggactctttcctttcctag

SEQ ID NO: 87972 - DNA, 261 bp, Glycine max
  Peptide Sequence Number=SeqID_179657
atgcaggggcagactgcccacaaaggagaatctgcgaaaaaggaacatacagatcaacaattgcatcaaatccaaccaatttggtgggaatcgatgtcatggatgaatatcaaaggcgatttccccttcagcccgaaacagcacttcatgcagcacatttctatccagatcgaaggattaagggctgttggaccttgtggcctcaataatcttacgagggataggcttagaatacagaagaagcaacaacaatcaatttaa

SEQ ID NO: 87973 - DNA, 225 bp, Glycine max
  Peptide Sequence Number=SeqID_179658
atgtcacgtcaacgtgactttccaagtcattttgagtattcagaaaaggttatcgaatttgaaattattgagctgaaaactgacgatgacgtgctgaaggtcttagtacactctaactactggaaacaatttggcctaatagaaattttaaccgtttttagtaaactggtaatcaaaatggaagatgacatgtctcagtcacaacataattcaatgcaaaattag

SEQ ID NO: 87974 - DNA, 162 bp, Glycine max
  Peptide Sequence Number=SeqID_179659
atgggtgagaaggaagagaaaaagaagaaaaagaagggggtgaacttatcaaaatggggtgcaaatagcagttttcaaatttttgaatctaggctctaccagaacattttggaaacttggttacttaaggaggaagtaacccagctcgcctgggcaagttag

SEQ ID NO: 87975 - DNA, 404 bp, Glycine max
  Peptide Sequence Number=SeqID_179660
atgtgcttgatgcaagcctcattggaagaacaaacgagacagggtacctttgtcccccatggtcgtgaaggcatactgaacactgccatcgggccaccggatcatggaggccatgttcgggcagtggggtctggggtcacaataagtcaatactttggaagggtagcacgtggctccagttgctcatcagggtcgatcagccatgtacaatgggctgaaataattggaggcctacaggaacagtggaaaaatgaaatacagaggggatcgttgatcccaacacatattcagccagatatacatgtgctaggagcacgagtgagcacaaaagggagcaatgcagagagtgttgtcaacccatgtctacctaatgatgttgctcctgtcgaaccccctatggggtt

SEQ ID NO: 87976 - DNA, 414 bp, Glycine max
  Peptide Sequence Number=SeqID_179661
acacttgttcgcattgccacacctcttaggcttgagtttattcctcaagtaaaggagttgttggatgagggtttggttcgcaagagcttaaatccttgtgctttgttggtgcccaaaataggtattattaggcaccaaatccctaaaataggtggtatgatgaatgctttgggtggagcaacactcatttgtaaaatcactcgtgcacccaacatcttcatgatttgtgtacatagggactcattaggtaggaataatcaacatgaaaatacagaaaaaggggttcccatgaaccctaagagaataaaagtcattcctgagtggccctctccaccaagtgtgttgaggaaaaagcccagagtttcaagaacctcgggatttgaggtcaaatccttttcaaggggtagggaatga

SEQ ID NO: 87977 - DNA, 514 bp, Glycine max
  Peptide Sequence Number=SeqID_179662
atggaggagtacactattcatattcccccccctataatatttatgattaataacttagctagagaattactaagggcttttaaaacaggcttaaagcccaaaagatatgtgaagcccagacgctttggtccgatctgggagctagggcttttcttcatatttaagctgtggtatacgggaaaaatcagatcaagaaatggggtagggattattgtggacaaggagtggaagaaggatgtcgtggatgtaagaagagtaggagatcgtatcatagtcttaaaattggtagtgggacaggacacctttaatgttattagtgggtacgcacctcaggttgggttagcagaacactttaaggtaaaattttgggaggatctagaaggggtacttcaggatataccccaaggagagaaagttttcctaggaggggatctcaatggacatgtaggtagcgtgactagaggttttgagggggtgcatgggggttttggcctaggggagatgaatggggagg

SEQ ID NO: 87978 - DNA, 1599 bp, Glycine max
  Peptide Sequence Number=SeqID_179663
atggaagacacactcacatgctgcggagaagcacagaataagcgaggcggttccacggcggggatatcagttgcttctgcaggaataattgggaacttgattgtatatctgatacgtgaattcaatataaagagcatcgatgctgctcaagttgcgaacgtggctaatggaagctcctctctatttcccattgttgcagcaataatggctgactctttctttggctctttccctgttgccttggtttcttcttgtgtttctttcttgggtacagttattatagtcttgacgacaattatcaagtcgttgaagcctgacccctgcaacaatactggaccaaacctatgcaaccctccatccaaattccaacatgcagtcttatatgggggcataacactatgtgcaattggttttgggggtgcacgcttcacaacggcatcgttgggagcaaatcaatttaatgaggcaaagcatcaggacgtattcttcaactggttctttttgacttggtacattacttctattgcatcctttactgggattttctatgtccaagataatgtgagttgggcttggggctttggcatatgtagtgctggtaattttattggcctagtcattttcttacttggttatcgattttatcgccctgataaccccaaaggaagtgcattcttggatcttgcacgtgttcttgttgcatctatccgtaagtggaaatctcaactctcttccgcaaacaagcattactatagtgaccatgatgggatacttacagtgcaattacctgctgcaaccccaggaaaaagattaagattcttcaatcgtgcagctctaataactgatggagaccttcaatcagatggctcaattgagaaaccatggaggctatgcacagttcaacaagtggaagatttcaaagctatcattggaatcttaccactgtggagtacaagcatattcctatccactccaataggaatccaaggcagcatgacagtccttcaagctttggccatggatcgtcaaataggaccccattttaaattcccagcgggctctattactgtcatacccttaatttccacatcaattttcctcacatttcttgatagggtggtttggcctgcatggcaaaagttgaatggtaattctcctactactctccaacgaattggagtaggccacgtattcaatgtgcttggaatagctgtctcagctcttgttgaatcaaagaggctcaagatggttcattctgatccctcagtggccatgtccattctgtggttgtttccacaattggtgttagttggaataggagaatcgtttcattttccagcacaagttgcattctactaccaacaacttcctcagtcacttcggagcacatccactgctatgatttccatgattctagggatatcttattatctaagtaccgcattaattgaccaagtgcgtaggagtactaattggttacctgctgacataaatcaggggaggctagataatttttactggatgttcgtcctagtggggggtatcaactttgtatattacttggtatgttcaactttgtacaagcataccaaagtgtaa

SEQ ID NO: 87979 - DNA, 3081 bp, Glycine max
  Peptide Sequence Number=SeqID_179664
atggctgagaaggatgacacagagggacgatgccctgcatgtcgttctccatatgataaggaaaagattgttgggatggctgcaaactgtgagagattggtggctgaagttcatatggaaaaaaaggtgaagaaccagaaagcaaagtcaaaatcttctgaagcacggaagcagctcagtagtgtgcgagtaattcagcggaatctggtttacatagtgggattgcctctcaatctggcagacgaagatttcctccagcagcgagaatattttggtcagtatggaaaggtcttaaaagtgtcaatgtctcggactacagctggtgttgttcagcagattattagtagcagcagtggtagcccccatagtggcatagcagaatatattacttactcgaaggaagaagaagcaattcgatgcattcaaaatgtgcatggattcgttttggagggtagacctttaaggtacctatctggatttactgaagctattcaggggcttgttttggaaccactaaatattgtcatgcatggctcagaaacatgcaatccagattgtctatatcttcatgagattggctctcaagaggatagtttcacaaaagatgaaataatttcagcatacactagtcatgttcaacaaattactggtgctgcaaacaatatacaacgacaagcagggaatgtattgcctcctccattggatgattgcatggataattcatcaggaaaaccaattgtgaaaaattcatcaagtacctctgttagcattgtaagaagttcacctcctaatggaacttctgggagacctatagctctttctgcggttgcatggggtacacgggctacaaattgtcagccagctgctgatggtttattatgtccaaatggactgtccaggcctaaacctgatacaatcagcagcagcctacccttttcctctgctgttgcatgcacaattcaggcttcattaaatagtgatgtgacaaagaggccactgttgagtgatgggagtcgtagtatgacacctcaaataaaaaatgaattattgaaacctgttgaacaaaatagaagcatggatatcctggatagtgctggtgaaagaactttggtttctgatgtttctctttcagctgttaaattgaacaaccagttgtcttctctaccattagccggagatagtggtagaggcagctttactgcaactaacacaactagttcaattgacatcactcgacaaccattaagctttggtcctgaggaagcagttatatctacctgtgaagagattgagaatttgtcctgcgagttttcttctgtttacattgatagaaatgcccaaaataaacactacagcctatccatacctagcagctcacctgataatgtgttggttaaatctatgcaatctcaagaattgcagtataatactgacaaattgaaagatttaatgattaaaaatgcagacagtaaagctgctgcattatataatgaggtttgtaatttaaaggaacagtgtgatttgtcattggattctcaatctcaagtagtatcagctaatactgaagtggaagatgatgtaacaacttttgataatcagagacttaaggatccagaagttattggttcttatttgcccgagtcagccagtttccttcatgtctcaaatcattctagtcctcttcttctgcagcgtggtgacccatgtaatgttgtaaatgctggttttttagatgccaatgataaagttgaggataactcactattacatgcacataacatatgcaatggatattctgatgagatcagtaccagttcttattggttccgccatgatgcaagcaatgagcaccacattggaagattagttagtgatgcagttaatattggaagtgatgctgttatggacaagggtgagagtagtataatttcaaatatattatcgatggagtttgatgcctgggatgactcgctggcatcacatgagagtttgaccaagttgttgggtgacaacactgacagccagaatggtccgttaaaaaaatctagttctaggaaagttcaaagtaacaatcaatcaagattttcttttgcatggcaggaggaatccaaattccaagccaatgtacctccatcttctggtgctacccagccatttccaaagaatggctcactcatccaggattttgtggaaagagacttttctttgaacaagctgggttttgcaaatggcttcccctccaataacctcaaggaatctggaaatcttggcagtggtcatttcattgcttcaaacaataagctttcagctgtttcaagagcacaaatttcagcaccgccaggattctctgttccgaacagggcaccacctcctggtttctcttcagttgagagaatggggcaggcttttgactccctctctgggaattcattgctggacccttctttcttactgagaaattcttatcaaacaccctcaaatggaaatattggtggtccaggtgacgttgaatttatggatcctgctattttggcagttagtaaaggccctgaacagtttaactactttgaaaatgaggccagagttcaattattgatgcaaagatctccctcaccacagcaagaccttcgattttctgaaattgggaattccttttctcagtttggtgattcttatggcatttcttcaaggttaaatcaatcacaagttagtaatctggcttcatttcctcagttatctctgcagcagtctagaaatgcagtcttgtcaaatggccaattggatgggcggaatggaaatggtctgggacatttgggatttgagattgttgggtatattggccatggtaaagccaagtcagaaataaacaaacagaatttttctgcattgccaaaggtgatggggatggctcatgacataacctgtctattgggctacgaaaggatgaaactctcgcttatagctgcagctggttactgctctcaatctccatcccttcttcttgtagttcttgatttgcagaagcaagctgcgttgagatttaagaaatcaatcatggatcggaaagtatttggcaggtag

SEQ ID NO: 87980 - DNA, 495 bp, Glycine max
  Peptide Sequence Number=SeqID_179665
atgcgagcacatccagagagggaggctatcatgcatctactatgcataccggggcaagatttcccccgtgccgctgcaaaaagacgtgtgcggatcatctgcaccaacatgaccacccttacgtggatgacgttgctatttagcaagattctacccagcgaccacaatgccaatctccccctgtcagatgtatcagttgggatcgtgcccacaagacaccaagtggacccggaaagaagtccaacagggccctggggtttccagctctggttatgggcctctgtagtcctacagggtgcccgttcccctggcaagggatcgcgcctgcaagacacccagtggacccgaagaagtccaacagggtctgggagttgtcaagctctaattatgggtctctgtcagttctacggagtacctgtcacctctagcaagggcatcaggccccctactaatcgagctttcatcaagaagtactgcatccccaggcaggcgtag

SEQ ID NO: 87981 - DNA, 312 bp, Glycine max
  Peptide Sequence Number=SeqID_179666
atgtctcctccacctctagaacatcacaatcgctcacgaactcagctcaagctctcaggccgacttcctcttcaagctccattctctgcaggtgcccttgttggtgcttgcacgcttagcgcaactctagctcgcttagcgcgcattagtgaattttggcttagcgctcgtcttttcgctcaacagatggactcaagcggtgcgcttagtgggattagccctcgctcggtgaacatccacagctcatccttcttccagattcttcctcgcgctcagccaaaggagtgttgcgctcagcgaatggctcgctaa

SEQ ID NO: 87982 - DNA, 876 bp, Glycine max
  Peptide Sequence Number=SeqID_179667
atgcaggccggaatcgccgtgattcctactgcgcccgaagtgacgcgcaatcgcgatagccactacccttaccgttttgacagctacttttactacctgaccgggtttaaagagcctgaagccgttttggtattgattgcaagtgcgcagcctagaagtatcctgttttgccgcgataaagacatcgagcgtgaaatctgggacggtttccgttatggcccggaggcggcaaaaagcgaattcggttttgatgaagcgtattccatcacgcaactggacgaacagttgcctaagctgatggcaaaccagccggaactgttttttagcctgggtgcggacgctggctgggatactaaaataagcggctggttgaatgcagtcaaggcgcaagcccgcacaggtgtgcaggcgccaggcaagctggttgatgtgcgtcaagcgctggacgccatgcgtctgcttaaatcccctgatgaaattgagttgatgcgtcgttcggctaatattgccgccgcagcgcataaccgtgccatgcaagcggtgattcctggtaagtgggagtacgaaattgaagcggagtttttgcatgaattttaccgccagggtgcacaggcgccagcttacaccagtattgtggcaggcggtgccaatgcctgtacattgcattacaacgcgaataatgctgagttaaaagctggcgacctgttactgatagatgccggttgtgagctggatggctatgcttccgacattacacgtactttcccggtgagtggccgtttcagtgggcagccgggaagccgtgctggaaacaggcagttatcgccagttttacatgcatcgcaccgggcattggctggggctggatgtgcatga

SEQ ID NO: 87983 - DNA, 711 bp, Glycine max
  Peptide Sequence Number=SeqID_179668
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccctggttatctgcatcatcgtctgcctgtcatgggctgttaatcattaccgtgataacgccattacctacaaagcccagcgcgacaaaaatgccagagaactgaagctggcgaacgcggcaattactgacatgcagatgcgtcagcgtgatgttgctgcgctcgatgcaaaatacacgaaggagttagctgatgctaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctgatcactatgcaaaaacaactggaaggaacccagaagtatattaatgagcaggggtaccgagctcgaattcgtaatcatggtcatagctgtttcctgtgtgaaattgttatccgctcacaattccacacaacatacgagccggaagcataa

SEQ ID NO: 87984 - DNA, 484 bp, Glycine max
  Peptide Sequence Number=SeqID_179669
gcaccctctggacccggataagtccaacagggccctgggatttccggctttgatcacaggactctgccagtcgttcggagtccccatcgcacctagcaagagacaggcccagggggatgctccgcaggccgcagacgtgccgccaccttatcaggctggcctagctggatcgtttgatacggaacagtatttgcggcatttggttcgccagcaggcggccaaccaccgggcgcatgtacagacccatgattgtctttaccagttgagcctcagcctgcagagccagagttttacttcttttccgtgtcctactccggaccagttcagggcagaggtcgcatggcctggagattggcctgaggcccgggcaggagaggcgccagcagaggcaccagcaaaggctcccgacgaggcagatgaggcccgcgaggacgaggagatgactgatttacttgatttcttaggagggagcggggccacatga

SEQ ID NO: 87985 - DNA, 300 bp, Glycine max
  Peptide Sequence Number=SeqID_179670
atgagatgggttaatagagtgggttcctattccatagatccaaagaatcattttttacaattcacccagtggaatagcaaagatagtaccaacaaaagatgggaatttatgtggctagccctttccttctccatttggtaccatagaaatgccaagatattcaagaaccagccgttcactcctgaaaaggtcatggatgatgccttgttccacacctggtcctggataaaatgtgtggagaaggacttccaaatgcactttaatttctggtcaaccaatctaaaggatgttctttcttag

SEQ ID NO: 87986 - DNA, 417 bp, Glycine max
  Peptide Sequence Number=SeqID_179671
atggtgaaagttggaacctcttacgtgccgatcaacgtctcattttcgccaaaagttggcccagggcttccccgggctccagtggcttctgtttctatcagctgtccctcctgttcagctactgacgggggtggtggcgtaacggcaaaaagcacccgccggacatcagcgctggcaagtgtagcggtcaccgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtggagaaagatgaaggcccagaggcagaggcactaccaagactactaattgttgctgaaggcccaaactaa

SEQ ID NO: 87987 - DNA, 391 bp, Glycine max
  Peptide Sequence Number=SeqID_179672
atgagaggaccagaggtttcctttggtgctaatgttattgccagcaacaccaccgatgatggggttaatgtcgcttcatctaaccctgatgaggaggttgacatcttcgagcatataaggcaaaaggatgaagctactgagaaaggaaaaaaatgtaggaagataaagaaacgtgaggcaaaaagggttagaataacatgtcttaaacaaatgggaaatatgaaagagtatcccttagttgacctctctttattcacctgggtttttggagaggtcgatactcatacctctatcttcttgaccactaaatttattatcgacctgaaggaaagggtaaaacttacctacgacaacaattctgattgggttgttgtcgatcactgtcttccca

SEQ ID NO: 87988 - DNA, 318 bp, Glycine max
  Peptide Sequence Number=SeqID_179673
atggatgaagatcaatggatgtatgatactataatgtctgaagaagttgatatggatgatcaaaatgaacaagaatgtggtgtgaatgaaccacaagttgattgttcggatccattcaatacttctcagcttcgtggcaaaccagtggttggagggcaaagttggatggtgaagttgatgtgtgggattcataatcatgaattggccaagtcattagttggacatccatacgctgggcgattgactaaagctgaaaagacacttattgttgatatgaccaagtcaatggtgaaaccaagaaacatcctgctaacttga

SEQ ID NO: 87989 - DNA, 461 bp, Glycine max
  Peptide Sequence Number=SeqID_179674
ttaggtggcaggcagagatacccaagtggttatccatataaacactttttcgctatccgtcagactcagagtccgatttatgtcgtcttctacaccattgtcatcctgacccgtgaagtcaggcagagatacccaagtggttatccgtataaacactttttcgctatccgtcagactcaaagtccggggctagcaaacccgttgacacgcagagacttacatcgtcttctgcacctttgtcatcctgaccctaagtcaggtggaaggcgggggtaccgtatggttatccgcacctttcgtcaaccaggggcaaacgagctcgctgacgcacagagactaacgtcatcttttgcaccttttgtcatccagggacagcgagtcaggtggcaagcggagataccttatggtcatccgcacctttcgttaaccaaggcgaacgagttcaatggtatcaggatgat

SEQ ID NO: 87990 - DNA, 467 bp, Glycine max
  Peptide Sequence Number=SeqID_179675
tggcttttaagtcgcgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 87991 - DNA, 327 bp, Glycine max
  Peptide Sequence Number=SeqID_179676
atggatcaattacgtaataatgtgaatgctaggtcgttgcccggaagcaacgcgctgtatggctcgagtacagtgtcaaaagagcaagggccactgcatccccgcccggatgtagtgaaaagcacacttactggaaaatctatggaaatagtggatgttatggtgaggaggaagatcaattttatgtgcctacaagaaactaagtggacagggattattgtggacaaggagtggaagaaggatgtcgtggatgtaagaagagtaggagatcgtatcatagccttaaaattggtagtgggacaggacacctttaatgttattagtggg

SEQ ID NO: 87992 - DNA, 330 bp, Glycine max
  Peptide Sequence Number=SeqID_179677
atgcacatagatgaattctgcatcctttatcattcagatttcgcaaattgggtgataaacgcgtatacgaattatgcgtcctttatcattcaggaacaacaagttgggtggttctactggcagggaggttcactggccgaatggtgtttcgctcgaacgaaattagtgtcttatctttacttcccttttatctccaataaaagacaagtaaagaggggcaactgtcataccctaattttgtctggggaccatccgttgttgggatgcgaccctcgtttgaccactttgaggtacttggcacccatcgttaggcaattcgtgaagttctga

SEQ ID NO: 87993 - DNA, 918 bp, Glycine max
  Peptide Sequence Number=SeqID_179678
atgaaagccgtcggccagcttaccggcggcctggcccacgattttaacaacctgctggcggtgattatcggcagcctcgaactggtacagccggatgagcgcgatgcgccgcggatatcgcgggcgctgaaggctgccgaacgcggcgccttgcttactcagcggttgctggccttttcgcgtaaacaggcgctgaacccgcaggcggtggcgctgcagccgttgctggagaatgtctgcgaactgatgcgtcattcgctccccgcatcgttgcgtcttgaaattgaagcgcagtctcccgcctggccggcgtggatcgatgtcggacaactggaaaacgcgattatcaacctggtgatgaacgcccgcgacgccatggaggggcggtcaggcgttatcgcgctacgtacctggaaccagcgggtcacccgtagcgatggacggcgtcaggatatggtggcgctggaggtgattgaccacggctgcggcatgtcgcaggagataaaagcgcaggttttcgagcccttctttaccaccaaacagaccggtagcggcagcggtcttgggctgtcgatggtgtacggttttgtgcgccagtcgggcgggcgcgtggcgattgaaagcgcgccagggcagggcaccaccgttcgtttgcagctaccgcgagccacggcagcggcggaggatgaacgaacgccgttggttagcgaaccgatggtgagcggcgagcggctggcgttggtgcttgaggatgaagccgatgtgcgccagacgctatgcgagcagctgcatcagcttggctggctgacgttggaggcgcaaaacggcgagcaggcgctgcagatgctggcggcctccggggatatcgcgttgttgatcagcgatttaatgctccctggggggctgagcggcgccgag

SEQ ID NO: 87994 - DNA, 1992 bp, Glycine max
  Peptide Sequence Number=SeqID_179679
atgaaaaaagtcgtcacggtttgcccgtattgcgcatcaggttgcaaaatcaacctggtggtcgataacggcaaaatcgtccgggctgaggcggcgcaggggaaaaccaatcagggaaccctgtgtctgaaaggctattatggctgggacttcattaacgatacccagatcctgaccccgcgtctcaaaacccccatgatccgtcgccaacgtggcggcaaactggaagccgtctcctgggatgaggcgctcgattacgtcgccacccgccttggcgccattaaagaaaaatatggcccggacgcgatccagaccaccggctcctcccgcgggaccggtctgcaccagtcggtcggtaacggcgccatgagtaatgccatcacggagattgataacaccgatctggtgtttatcttcggttacaacccggcggattcccaccctatcgtggcgaatcacgtcattaacgccaaacgtaacggggcgaaaatcatcgtctgcgacccgcgcaagattgaaaccgcgcgcatcgccgacatgcacattgcgctgaagaacggctcgaatatcgcgctgctcaacgccattggccacgtcattattgcagaggatctgtacgataaatccttcgtcgccagccgttccgaaggcttcgaggagtatcgcaaaatcgtcgaaggctatacgccggagtcggtggaagagataaccggcgtcagcgctcaggagatccgcgcctgcgcccggatgtacgccagcgccaaatccgccgccatcctgtggggcatgggcgtcacccagttctaccagggcgtggagaccgtacggtcgctgaccagccttgcgatccttaccggcaacctcggcaagccgagcgtcggcgtcaacccggtgcgcgggcagaacaacgtccagggcgcctgcgacatgggcgcactgccggatacctatccgggctaccagtacgttaagttcccggaaaaccgcgagaagtttgccagagcctggggcgtcgacagcctgccggaacataccggctatcgcatcagcgagctgccgcaccgcgccgaacacggtgaagtccgcgcggcgtacattatgggcgaggatccgctgcagaccgatgccgagctttccgcggtgcgcaaggcgtttgaacagctggaactggttatcgtccaggatattttcatgaccaaaaccgccgccgcggccgacgtcatcctgccgtccacctcgtggggcgagcacgaaggcgtgtataccgcagcggaccgcggcttccagcgcttctttaaagcggtggagccaaagtgggacctgaaaaccgactggcagatcatcagcgaaatcgccacccggatgggctatccgatgcactacaacaacacccaggagatctgggacgagttgcggcatctctgcccggattcaccggcgcgacctatgaaaaaatgggggacgtcgtatctctttaaagaaaaattcgacaccccgaacgggctggcgcaattcttcacctgcgactgggtcgcaccgatcgataaactcaccgatgagtatccgatggtgctctccactgtgcgtgaagtgggccactactcctgccgttcgatgaccggcaactgcgccgcgctggcggcgctggcggatgagccgggttatgcgcaaatcaacaccgccgacgcggaacgccttggtatcgaggacgacgcgctggtgtgggtgaactcgcgcaaagggcggatcatcacccgggcacaggtcagcgaccgacccaacaaaggggcggtttacatgacctaccagtggtggataggtgcctgtaacgagctggtgacggaaaacctcagcccgataaccaaaacgccggagtataaatactgcgccgttcgcgtggagccgattgcggatcaacacgcggctgaacagtatgtgattgacgaatataacaagctgaaagcccgactacgcgaaagcgcaatgggttga

SEQ ID NO: 87995 - DNA, 225 bp, Glycine max
  Peptide Sequence Number=SeqID_179680
atgaccaccagtggccaccacaagccgccgttgcttgctgccgaacctccacaccaagaagaacgttgtaatcaaagcagaatcctcctcaaggattcgatggagaaaattccctcaatttttcatttcgttgcttctctaagacttgtatggtctgaagacctggggagtgcgaatctcaggcatgaactatacatgtatatatatgcgaaggggatcctctag

SEQ ID NO: 87996 - DNA, 831 bp, Glycine max
  Peptide Sequence Number=SeqID_179681
atggctacctcaccaaaagaaacctcatcccctgtttcaccctctgtaccatcatctccatcatcctccaaaactccatcaaaccaggaacaacctgcactcaatatccaatccatacaaatgattcctggtccaggccctgttcctgagaaactggtccctaaaagacaacagggagtgaagatttctgaaaaccctagctttgcaacaagccctagggaagaagacactgagatggataagaagatccgcagttttgtgaataacattttgaaaaatgcttctgtccctgatgctgataaagatgtcccaacatcttccaccccaaatgctgaagtcctccctttcatcccagtgaagaggaatcaacagaggaagaggatcaagccacagaggagacccctgcaccaagggcaccagaacctgctccagaagaagagcacaccaatcactcctaccacatccagatggagcaaagttgcaatcccgtccaagaagaggaaagaaatttcctcatctgattctgatgatgatgtcgaactagatgttcccgacatcaagagagccaagaaatcagggaaaaaggtgcctggaaatgtccctgatgctccattggacaacatttcattccactccattggcaatgttgaaaggtggaaatttgtatatcaacgcagacttgctttagaaagagaactgggaagagatgccttggattgcaaggagatcatggacctcatcaaggctgctggactgctgaaaactgtcaccaagttgggagattgttatgaatgtctagtcaggggaattcattgtcaacattccctctga

SEQ ID NO: 87997 - DNA, 483 bp, Glycine max
  Peptide Sequence Number=SeqID_179682
atggatgactcatcaaccattgaagaaactgaggtaaatcctgaatttgaagaagttttggaagttttgaatgaaatgcatgaagaagctcaaaggcttgctattttgaacaaaaagatgaaaagcgatttgaaattgcatatcactaaattggcttcaacacaaaaagcatttaatgagatgcatgagaaagctcaaaggcttgttgtgttaaacaaaaagctgaaaagtgaacagaaattgtatgtcaataaattggcttcaacacaagaagagctaaacaaactaaagcaagaaaatgaaaagcttgtttcaaagtgtaaagccactacttgtgatgatacctccaattcctttaacatggatgattgcaagtttttgcaagcaaagtttgagaatttcaaaaaggatcaccaagttgagtgtataaaattgcaaactgagctttcctaccttaaagatttgtttggaaaattaaaatga

SEQ ID NO: 87998 - DNA, 492 bp, Glycine max
  Peptide Sequence Number=SeqID_179683
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctaccaagtctcatttcactagactacatagtattaatcccatcaggaccgatctaagaataaagcaactgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 87999 - DNA, 934 bp, Glycine max
  Peptide Sequence Number=SeqID_179684
aggactacacgtcctccccttcaaaggactacacgtccttaccttcagagggctacacgtcctcaccttcagagggctacacgccctcgccttcatagggctacacgccctcaccttcagaggactacacgtcctcaccttcagaggactacacgtcctcaccttcagaggactacacgccctcgctttcagaggactacatgtcctcgccttcagaggactacacatcctcaccttgagagggctacacgtcctcaccatcagagggctacacgccctcgccttcagagggctacgcgctttcaccttcagaggactacacgtcctcgccttcagaggactacacgtcctcgccttcaaaggactacacgtccttgcctttagagggctacatgccctcgcctttagaggactacacgtcctcgtcataagaaggttgcatgccctcgccttcagaggactacacgtcctcgccttcagaggactacacatcctcaccttcagaggactacacgtcctcccctttagaggactacacgccctccccttcagaggactacacatcctcaccttcaaaggactacacgtcctcaccttcagagggctacacacccttaccttcaaaggactacacgtcctcaccttcagagaacaacacgtcctctctttcagagggctacgcgccctcaccttcagaggaatacacgtcctcgccttcagagaactacatgtcctcgccttcagagggttacacgccctcgccttcagaggactacatgtgatgcaatcctaccccccaagggtattggatagaagactccaagaggattgggctagagctactaaagaaggctctagggttctcatgacccttagggtatattttctgagcccatggaccaaggttgggtcctctcttctttgtaaatattag

SEQ ID NO: 88000 - DNA, 369 bp, Glycine max
  Peptide Sequence Number=SeqID_179685
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggatgggagaaggctggaaatgaagggacaagtttaaagaagcaagtccaggcactgactctcagaaattcaacacttgaagatagagtcacccatctagacagtgcacttaaggagtgtgttaggcag

SEQ ID NO: 88001 - DNA, 366 bp, Glycine max
  Peptide Sequence Number=SeqID_179686
atgcagaaaagattcacacagatagtcaaccatcttgcttctttaagaaaaatcttccctaatgaagatctaattaataaagttttaagatgcttaagtagggaatggcagcccaaggaacatgaaatggaacaccaacgtcttaatcaaaatgaagaaatcgacaaaaagaaaagaagtatagcacttaaagcctcttcatcaatgcaagaagaaaatgaagaagaagaatcagaagatgaagaagacttctcactctttgtgaagaagtttcaaaaatttgtcaagaaaagaagaatcgagaagcgtcagaacttcaacaatggaagaagatctcaagaagactctcaaattcttagatgctaa

SEQ ID NO: 88002 - DNA, 615 bp, Glycine max
  Peptide Sequence Number=SeqID_179687
atgtgtcactacatgcccactgaatgtgagatacctgcggtcaatgtcatgaatgggactactcagaagtgcaaagcatgtgagaagactgtgtatttggtggatcagctcactgctgacaacaagatctatcacaaatcatgtttcagatgctaccactgcaagggtacccttaagttgagtaattattgttcctttgagggtgttttatactgtaagcctcattttgatcaactctttaagaagactggcagcttggacaaaagttttgaaggtattccaagaactgcaagacttgaaagatctgccgatcaggtccaaaccaatacaaaggtttcaaatttgtttgctggaactcaggaaaaatgtgttgcttgcaagaaaacagtttacccaattgaaaaggtagctgttgatggaacatcttaccataaggcttgtttcaggtgcactcatggaggatgtgtaattagcccatcaaattatgttgcccatgaacatcgtctttattgcaggcaccatcatactcagttgttcaagcagaaaggtaacttcagccaacttgacaagcaagaaaacgatgaaggggtgacggagaacagaataactgagtaa

SEQ ID NO: 88003 - DNA, 357 bp, Glycine max
  Peptide Sequence Number=SeqID_179688
atggatactaaattatatgattattggtttatgggtacattgaaattcattgttataagtgttttggatcttgatcttgctatattggaagagaagcctgctactattattgatgctagtagcaatgaagagaaatcccattataaagcttgggaaaaatgtaacagactcaacctaatgttcatgaaaatgactgttgtagacagtattaacacaactctccctaagaatgataatgctaaagagtttatgagattagtgggagagcgctctcaaacaaataataagtctttggttgggacattaatgagtacatcgaccaccatgaagtttgatggtttgcgtactatgcattaa

SEQ ID NO: 88004 - DNA, 399 bp, Glycine max
  Peptide Sequence Number=SeqID_179689
atgagattggttaagagactcctattcctcttaagattattgaggccacaaggtccaacagagggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgtgaatctttgcttgtaaaggtttttacaaggttgaaagaaatctcaagaaccgcaggttgcttggggactggatctaggcacgggttgttgccgaaccagtataaaattcttgtgtttgtcttcttcttccctacactctttaatttccgttgtgcacttttaattatcgcttttacttttggttaa

SEQ ID NO: 88005 - DNA, 785 bp, Glycine max
  Peptide Sequence Number=SeqID_179690
atggaaggactcggttctcagcataagatggaagataatggtgatagtgtgacaatggtctttatgatgattaagttggatggggaagccatcaataggagtttcaaactcaagaggcctagggctttggatgactacagtttgtacctaaggtatggaggtgatgaccataatggtccttggggatcagaaatgacattaagttgtgatacctcaacgaggatggggaactcctgtagccgacttggtaatcccaacaatcaccgagagcataatcaagttatggtgagagtaactgtccataataccaagcattcatggatcattattcccgaacaagttttttctgcgaaacaagtttttagcgctgttgccggggaacttctttccgtttataaagaagagttcagtaacacttctgcaggtgatttagctccattggatttggagatagaagccagttgtaggaggaacaacgcagaaagaagaagaaaaattttacaggacaagacagcacaaccaagtctggaggaagcccaatcatctgagtcatcttcgatctttccagagataagagaatctgaagtaggtgcattagaggctaacattatggctgacgagcaaccacacatactcttgaggactattctagctccaccgtgctacccttatgcacacttggctacatatatagagatatgcaacacaatgaaaattgtcggtgtgcctgaggatgcaataaggctaagtttgttttcattctccttatctggagaagctaagag

SEQ ID NO: 88006 - DNA, 650 bp, Glycine max
  Peptide Sequence Number=SeqID_179691
atgtctagcaggaggtcacggtcaaggcaaacaagtagttcaaggaatatcaccgatgatcagatcaatgatcttgtctccaagttgcaacagcttcttccagagattcgcgataggcgctctgacaagaactatgaagtatgtcgcggcctgatgcggtccgatgcagctgtttcacccgatgtgttccggcagttgcagcgttgcgttgtggatctttctgtaattttcaaaaacaatgcaatgggtggaagggatttgaatccggtacttcctcctccttctcctcctttcatccttaagctcttccttctccaccgtaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 88007 - DNA, 267 bp, Glycine max
  Peptide Sequence Number=SeqID_179692
atggccttcccattgtactataaaggtacaatgatgctaattggatctccgattcacatcagacaaaatccactatgtgttcatatttggcctggtgcggttgcaaggagatcaaccaaacaatccataattgcaagatcaactatggaatcagagtttatagctctagagttggctagtagtgaggctaagtggttgaaaaacttcttagtctacattcctttgggaatgaaaccaaccccgtcagtgccaatgcaaaaaccatag

SEQ ID NO: 88008 - DNA, 1011 bp, Glycine max
  Peptide Sequence Number=SeqID_179693
atggctactctacctgcctcgcctcctcctcctccttctcctcctcctcctccttctacagtaacatcagcaccacctggggcagagagaccggtggtccacgtcgatcctgagactgggaaggctgacagtccctacaagaagaaattaagaacatatttggggattgtcgctcatgataaggttgacgtgacatacgagacttcaaaggaagtccctgctactcagaaggacttgatatgggaggatattcagccgacaaggacaatgtggacgatgctgtttgtgaaaagtacgacattagcaaggagaaatagacccagttttatcagaccagcagagacccctcatgggaggatgtgcggaaaaagacaaagaaaaaaactagaggaagctgctcaatctggaagcactgagggcatgattgaccctccatctcccatcagacgacacgtgaagtggaagatggcccgcaccaagaaaactgggcagatgatgtctgaggcagcaaaggaaattgctgagaagattggacttgcagtgcctccagagactgaggttggtccctcagctactcgtgtcagcacaaaggggatttgtgttgatccttcatcgatcgatccagacatgggtgactcagacaaatgcgggttagtttataagggatccacaacggttcacagcatccctttgttgcataaccaagtgaaggttggtgttgaggaggttaaagatgtagaggctctcgttcctgtacccactgacgaagcaattgtgtctccagcaaaacctccagataggtcggatcatgaggtcgatgatcccctatatttgatgacgttcaccatcccacaactttttttgaagcctctccaggttatgtgggatgctaccttgttcggggtgtttaatgaagacttcccattgtacataaagcacgaagatctctctaaaattgcacacagtggtcaatgtctcagcatatctgttatacaattgtggattctataa

SEQ ID NO: 88009 - DNA, 324 bp, Glycine max
  Peptide Sequence Number=SeqID_179694
atgggacaaggcccaaccaatagcactcccccaccgtttgatcaagaaaaatctatggttgggatcacacaacgtttcggtgcccaatgtgggaagctgaatagacgtgggaagcaactgttacatctacaatgtaacagccacttcatggcaataaaagcgcataaccgtcaaggggaagagcctaagcatgattatgaggagtattactcaactgctaatcatgatgtaacaaattcacagaccccaggtccgaaaggtatcctcccctcggctctgctaaatactcatgcacccaagacctcagtgaggaacaataagtag

SEQ ID NO: 88010 - DNA, 615 bp, Glycine max
  Peptide Sequence Number=SeqID_179695
atgaagcaccttgagattgcagaagactttacaaaagggattgagtatcttcacatgggttgtgttcatccagtcatccatcgagacttaaaaaacaacaacattcttcttgacaaacaaatgagagccaaggtttcggattttggtctctcaaaacttgcagtggatggagcctcccatgtttctagaatagttcgtgggacatgttttgtatgcggtgacaacaatggtgatggtggtggtgttagcagcaatagcgatagagatgctaatggtggttgtggtggtagtagcgatataggcaatggtgatggatgtgttagcaatgctgatggtgtcgatgacgatggtggtcatggtattagtgttgatggtgacagtagaggtggtatttgtggtagcagcgatgacaatgatggtgatggtgacaatgacggtggcgatggtggtgaccttgtggtggtggtggtggtggtggcattggttgtggtggtgatagtggtagtaatctggtggctgggtggtggtggtgactatggtgatagcgatggtggtggcgacagcgaggaccttggtagtagcgatgacgacagcgacagtaacagcgaaaggtag

SEQ ID NO: 88011 - DNA, 300 bp, Glycine max
  Peptide Sequence Number=SeqID_179696
atgggagcacttaacatcatcaaccacaatatgaagattcgattgaacatttatagtcgcacgaggttcaagcagaagaatagccgcgtggatgatccaacacaagagtattgtgcagatccagtgtttgatcatcaacagacaagtgcaaatgtctcctttctcgacaatgatgagaaccctaggattgaagagttgcatggcgtcggaaccctcggtggtgggagtgggaggatgcatgttgtccaactggatgaggatgtcgacgtggaaaccctcgaggacataggcgagagttaa

SEQ ID NO: 88012 - DNA, 366 bp, Glycine max
  Peptide Sequence Number=SeqID_179697
atggaggtaggggagtcaacaaaggagaaggttgatgatgctagccctagccaaaacgagactcttgtaacggaagtaaatgctagtcaattatctactgataatgcggatctctatgggccttggatgatccccgacaatattgtcttcgattcggcgaacaatcttaatctcattgacttcgatttggtggagtggttcagagacgggaagagcatgagcaacgtggtggggacaccatactatgtgacgccggaggttctgttgggaagggagtacgatgagaaggttgatgtgtggagctatggggatcttccgaactatgtccctcgccgccaaggatctcttcagaaaaatgttttgtag

SEQ ID NO: 88013 - DNA, 309 bp, Glycine max
  Peptide Sequence Number=SeqID_179698
atgaaggcgagtaatgtgtgggaaaagggtagttggaatttggctaagttattcaccaacataacggaggttgtcgtagatgctattcatcttgttcgtcccatgatggtggagggcatgagtaatgtgtgggtctggggaaatgagatttcaggcacttacactaccaagagtgcttataaagatgttctcacaaagatgggggcgatgatggcgaaccctttggttatagtgcatgaagcaccccagttgctgaaacctaagttgcatactgatgccctcggagttttgtttcctcgcgggttttag

SEQ ID NO: 88014 - DNA, 333 bp, Glycine max
  Peptide Sequence Number=SeqID_179699
atggcgggaaatggaatcttcatgaagggttctgagagtggaaactgtgaaaagcaccacaaagacattgttttggtcaccgaggttacgaaggtggatggggaagttgtcgatgatgatgatgaaaacgtctatgtggttgtcccacttagccaaaatgatagagaggcttgtggtttgacaaagatgacatgcatttgtggatctcgtcaaaagatgacactaagtagcaagagtttgatggaattggagttgaggatcacgaagatgattctgagggcgcagagggagtccacgtcaaaggttgaggggaaaatgagaattgaagaatag

SEQ ID NO: 88015 - DNA, 114 bp, Glycine max
  Peptide Sequence Number=SeqID_179700
atggaggagacaattatttctttaggaaataggggtgttggaggaggagatgcaaaagttggtttatactttcttgtgggattggtggttatagagggcaggttatgcgcttga

SEQ ID NO: 88016 - DNA, 165 bp, Glycine max
  Peptide Sequence Number=SeqID_179701
atgatctacgaggaggggggatttaagcagctcaggcaacgcaaatcgctgctggtgctggcgcctttggccaagcaaaacgccattgaagatggcgacttcctgcagcgtggaatggtagtggcttggaaactcaacaaggtaaagctgcgagttgaaatttga

SEQ ID NO: 88017 - DNA, 150 bp, Glycine max
  Peptide Sequence Number=SeqID_179702
atggcagtctcgaggcggtctaggctgatgaaggaaaggtcgacttccgctattggagggcggcagggaagggccaccacgatattgctatcaggtggtgcatttagagaaagtgtcgattgttcaaagaaagaatccacagtgaagtag

SEQ ID NO: 88018 - DNA, 762 bp, Glycine max
  Peptide Sequence Number=SeqID_179703
atggccgactccacccctctcctctcccaacccaacccatcatcatcatcgtctcccgacacacaagaagcaccgccatcgaaccaacaccatccctctctggggtccacagtagaactctgcataggcgagttcaactggtcccagttcctccagtcgattctggtctccctcgcatggatattcgacgcccagcagaccttcatctccgtcttcaccgacgccctgcccgagtggcactgcaccgagcggggcgccaatgcatgcaagactgccaccacagtctgcagcctcccaaagggctcgtgggcctgggacgtgcccacgcaggcctccatcgtgtcggagtggggcctggaatgcgccaactccgcgatcacgggcctccccgcttcgatgttcttcttggggtgtttgattggcgggttcgtactggcctcgctagcggactcgtcgctcgggcgcaagaacatgctcttcttctcgtgcctcgtgatggccatcacttccttgctcgtcactctctcgcccaacgtttggatctattccgctctcaagtttctctgtgggtttgctcgtgctaccattgggacctctgcgctcgtgctggcctctgagctcgttgggaaacgggttcttgtccctgccagccatggcttacataaacaggagttcttcatggaggaacctttatctgtggacatccatttcaaccatgttctactgcatactggtgaagttgttcgttacggagtcccctag

SEQ ID NO: 88019 - DNA, 159 bp, Glycine max
  Peptide Sequence Number=SeqID_179704
atgtcttgcattttgaatttaatgtgtttcaacttcaatttcagcgaggcttgtgcgcttagcgagagtcatgcgctaagcgagacactcagctcgcttagagaattgggagaatctggaggagaatctgagaagcatctgcactcagcgcgtcattag

SEQ ID NO: 88020 - DNA, 447 bp, Glycine max
  Peptide Sequence Number=SeqID_179705
atgaaagatataagcccacctcaggatcatagccaatctgcgacaaaacataaaacaaaggtcaaaattgcaacacaaacacataaacctcctagatgtgaaaaacacaatatgaatcaaacgcatcatccaaagcagagccttagacggcgccactggaatggagtacctcttcatcgcgtgacttggctcggagctaacaacggtcgcgacatctacgttgtggatgccgatggccgcatcgtgctccttttcggtgtaggattcaaaggagtgattaggagaggaagaggtgagaatttggagtaccttgtgcgatggaaagacagcggagcaagcgagtgggtgacgaggaagtttgtggccttgagtacagagagtgagagggataataagaatacaaagagtcttgaaaacaacataaaatcttttaagatggttttgtaa

SEQ ID NO: 88021 - DNA, 291 bp, Glycine max
  Peptide Sequence Number=SeqID_179706
atgactgttgcagactgtattaagacaactctccctaagactgataatgctaaagagtttatgagattagtgggagagcgctctcaaatagatgataagtcttttgctgggacattaatgagtacattgaccgccatgaagtttgatgaaacggggcttaagaatcaaggaagccactcagtccattatgtaagccaccaagggagtcaaggagctgaaaagaaatttataaagaagcatgataaatgcaaagggccattaaagatcaatgacgactctttgcaaatctag

SEQ ID NO: 88022 - DNA, 1545 bp, Glycine max
  Peptide Sequence Number=SeqID_179707
atgcccttgcgggataggattgcatcaacacaggtgcatttcaagaagaaaggttcatttgaacaagaaaggtgcatttcaagaagaaaggttcatttgaacaaaaaagcgatgtctcgaaaagaaaatcttatatctgaattgcatccaaggaaagggacatggaagatagcggtgtgtataaccgatatgtgggatgttaagaagcacaatgggagacaagcgattgacatggtcttaatagaccaaatgctagtgaagaagggtgtaaagattggggcaacgctatggcaagagttgttccctgaatttcaaccgaagttaactttaggttgttcctatttgatccaaaacatcaaagttgtggacaatcaatctgaatataaagaggttgaaagacttgaaattcctgctaatgtacacgtgataactgaaattgctgatattatttctggcattgcaccgcgacatactttagttgattttgtgggtgttgtcgctgaagttattgaacgaaaaatagtgaatcctgcatacaaggttacggtgaagttgagagataatagtgatgctgagatcctcatgacactgtgggaggattatgctcttcagctagatgatgctattgaaaaaaaccattttgttagggagtcgttggtgcttatgttaacattggctaagatcaaagatgccaaaggtgaatataatgaccttcctccttgcagtttatgtgttccattttatgttggtggactaacagaagaagggagtggttcgcaatcccagtataccagtaattcacaaagaggtgatcgtgataagttcttgcataatgctcagatgaccagcttaggtgacataagcagactgagagaggactatttctgtttgaccgttgctacagtggatgaaatcctaattgatacaccatggagttatgatagttgtccaaattgcactacaacgtttgatccattaaaaatagtgggtgcctgtcgttcatgccaaaaccaagttagtcatacagttcccaggtataaattagttgtgaaaatggaacacaatggagagaaagctaactttcatttttgggatgcaacgtgtatcaaaatgtttggtaagacaaccgaggaatgtagacaggaattgattgcgggtggtgacgagatcaaagtgttccctgagtgtgtggatgatttggttggtaagacattggcactcaggttcaagtaccgtgtaaacatgcgccagtcttctgtgatggatgttagccaagaagaacatcatatccagacattgactttcaaaattgttctacaggatgaacaaactataaggaagtcacctgcatcgtgtgatgagacttcatcaggggattaccatccgaagccttcattgtcccagtcagctaactatgaccctgggaacactgccttcatcacccctgccaaaaaattgagcggtcaacaagccacaaatgaatttgattctaaggatactactgcgtatgagctatccacaaacaaacatattaaagctgagtaa

SEQ ID NO: 88023 - DNA, 171 bp, Glycine max
  Peptide Sequence Number=SeqID_179708
ggaagaccaagtggtttaaatgacgcacatgatccaacgatgcttgacatttgtgagacaccacctttttcgacagctatgcctaatatcaatgattcgcactacgttgacgatgtacacgccaatcgtaacgatcatgatgaaggactatgggagaacattgcaacatga

SEQ ID NO: 88024 - DNA, 2871 bp, Glycine max
  Peptide Sequence Number=SeqID_179709
atgggtacaccaccaacttcccccccacaatcaaatattcagtctgaagcaaagtctaggaatactagaaaatcaacacggctacggaggttgacagtacgatcattagatcatccaagaccaactgtacaggtggatgccgcaactggccgaggatcgggcccacacaaagagaaattccacaattatcttggggtggtggcccgagagaaaattcccatagtacataatagctggaaagatgttccggacaagctaaaggactgcccccatgtactttctcgtggagggtatgatttacttgaaaagaagttgatggatgataaaatcaaaaagagacaacatgaagcaatgctgactgagtctacagtagacatggacgagcccccatctccaattaaaagacatgtgaagtgggtgttggcacgcacaaagcaatttgggcagatgacatctgaggcggcacgagaaatctctgataaaattgcctcattggaagaacaatcatcacagggtacgtttgtcccgaatggtcgtcaagacatacttaatacagccattgggcgaccggatcatggagggcgtgttcgtgcagcgggttctggggtgacaataactcaatactttgggaaggcagcacgtggctctggtagctcatatagatccttcaaccaacaacagttggatgaaataatagtaaccataaaggaacaaaacgaacgcaggctagagacatttaaacatgtgttgaaggaacaaatcatacttgagatttcgcaaaggggatcgactgtcgcagctcctattcagccagatatacagctattaggtgcaagagttagcacaaaggggagcaatgcagaggctgttgtcaacccatctccgccagatcatgttggtcctgtcaagccgactatggggttgtatgtccatagggaactttgtacaaagttggtggcattaggaaaaacatatgatggaggctctaccatacacggtgtggcttatgcagatgatgtcgtcagggttagtgttgacttggttattaatggtgaagctgaagtcccatttctgacatcagacattaagtatgtcagccagtcgctagacacattcattgcatggccaacatcacttgtaaaactagtctcaaatgagcgtacaagttgtactccaaataaaaacaatgatgttcctgtagaggacccgttgcgcgagttgattaagagcctagttgacatttatgagaagcctgtagagttcgtgtgggatcctgctagatttggaattccaaatggagctacatcgttgttcgttacatgtgctgatgtcaacaaaatcatatcaggcgtacaatgtttgaacataactatactacagttgtggaccatccatatggaagactggactaataccttgggtcttggatcaatttatggattccttgagccgcaatctatactgaatgcaaaggataaacgacaagaatcagagaaccgtgttgtgtggttttgttctttgcgtagaaagccagatgttcatataaaatctgcaattaacaatgcatttaagacattaaattcaacttctgaggggaaatctgatcaaactacaccaaggtggctagaaattaagagtcacgttcaaagcggaggctatgagtgtggttattatgtcatgcaatggatgtggaacataatcggcggggaggtgaagactgattgggcgatgcttgcagcttccatcccagtcgttgacctgtctctcctcacttcacatgaccctcaaattcacaccaaagttctgtaccaacttggcaaggcctgcgcagaatggggtttcttcatgggagaaggggagagtggagagctcacaaatcatgagattccggagaagctggtggaggatgtgaagaaaaagtctcgtgagtttcatgatttttcggtggaggaaaaggagtttagtgacaaagtcccttttacacccatcaggaagaaggtagtggtgcaggccaacaaaaactacttgataattcaaggtcaagggtatctgaatacaaccatagaatggaacaacaccgcaaattccaccggctatacttcctatagctactcctttttcatctttgcttctaagttcactgcttacaacatcagctttaagaacatggctcctccaccgccaccaagagttgttggggcacaagcagtggcactgagggacacactcaatgatgatagtggaagacattattttaaagaatgcttcatccaaggatccattgatttcatattaggaaatgctaaatcactttatgaggattgtaccataaagtgtgtggcaaaagaagagaaggatgagattagcggatcgatcaccgctcaagggaggcaatcgatgaatgaggaaagcggattttcctttgtgaattgtagaattgttggaagtggaagtggaagtgggagggagtggcttggaagagcttggggagcctatgccactgtgttcttctcaagaacatacatgtctgatgtcgtagctcctgatggatggaacgatttgagagatccctttagagaccatcttatgtcatctgctttcatttattatgcagcacctttggctgtccattcgatgaaggatgccacttcctgcattatgttcctggtggcttcaaagttggtagcaatcctgttaatgatcaatgttggtagcaatcttgttaatgactgcaccgatgttgaaatactaacttacaaagacgttcctggagatccaacgataaagcacgatttcaacatcggggctgacgtcatcaccgatgttgaaatactaacatacaaagacgttcttggaattccaccgatgtag

SEQ ID NO: 88025 - DNA, 318 bp, Glycine max
  Peptide Sequence Number=SeqID_179710
atggttatgggatctgtccccgtgatgacctacaaaatatgcacaattgttcagacaagtgattacctgatcaagcttctcctaatcggtgactcttccattggaaaatccttcttgcttctcagattcgctaaccgtggagatggaagggaaaaccgtcaagctgcagattgtgagtattcacacttcactgacacgaatcaatgtcttttaccgactacttcatttataatgcctagaaagcatgatcatgcatggaatggaacactttttcctttattttattgttggtcactcaacgtctgggacggtgcttag

SEQ ID NO: 88026 - DNA, 615 bp, Glycine max
  Peptide Sequence Number=SeqID_179711
atggtcgtggatttgattgatcctccattggcaattggagagaattttggcacagaagccgagggttggaaaatcccaatccctttgaaggaatatgttgaaagtactttctatcagtaccaacgtgaggccataacagctgatctatcatcaaaagcttttgtcttgatacaggttggcctctatttctggctttgcttctgctgtaaaatttgtttaatgttttacatacttgccttttcttttagcctaaccaactccctttcagggggccccagggactgggaagactcagaccatacttgggattctaagtaccattttgcatgctactcctacaagaatgcattcaaatcttctatgtctaaaaacttcgtaccccattgcccagaggctcttcgctatgcgaagttctttgttgtatatgcattctttagttttatcttgagcagtgcaattagatgtagactttacatgtcagggtgcctggagtttcacttgctaaaatcaggctacaaatggcaaaaagaacatattgatttcaaatacattcttttattcttggcagttgcttccattgacaatgtactaggatctgacaaacagaggagttga

SEQ ID NO: 88027 - DNA, 555 bp, Glycine max
  Peptide Sequence Number=SeqID_179712
atgaaggccttgaaggaaatctttgacatttcaggaagcgggcgaggcggcgtcgaaggtagctaccaggaacaccttgagctcaagaagggaagtggaaaaacgggaaaggactattcaacgacgtgcttttgtagcaccgtcgttgatgaagaagctaatattacaaaaatgccaccgtgcaagaaactactacgggctcgcacaatcgatgtagaatgcgcgtcaaatggggagaacgtgagcgatgcgggtggtgaaattcttgagctcctcgacgacgtcgttgaaggcggtcccacaggaaaagacgagcaaaacggcgatggtgatggtggtgctggcgcgctcgtctctaggaatgtcaccattctttctccctcttcgaggaggttcttcagcgtcgcgcttgtctctgagtcatgcagctctgtcgccggacccttgcaacgctcatctccatcgaagcttgaagatgagaggccagagagtgtttcttctctctgccccgctctctatgatggcaacgaagagtcacgatacaagaaaaagtaa

SEQ ID NO: 88028 - DNA, 732 bp, Glycine max
  Peptide Sequence Number=SeqID_179713
atgaagttctttgactttggctactcatgttattttgatagtttatatgtatttggtagtttctgtcagcagttaatacacaagcttactggtgttgccattgctttgaaaacaaccagtgtttggcagaaccatccaggatttgatcacaacatagagggttggacggtatttggaaaaggagcaatcaaggagcgaatatcgaatgcaagcagtagattcattgttgctcacaacagaacacatccattggatagtttctctcagaaggtccaacttaagaaaggaatgctatacaccttttctacttggcttcaggttagtgaaggaagtgacattgtgtcagttatgtttaaaacaaaaggaagcaaaatgacatggataatcagaaattaccctgcagagcttgtgatagtgctcactcgcggcaatttttgggtatcccttcgaagtattgttcatatatgggtcatgagcaagaagggccctctctatgttgcaatgtttaagccaattggaatcatctttgcggtcatcatgggaattgcctttcttggtgactctatctatcttggaagtgtgcttggagcagccatagcggttattggtttttatgctgttatttgggggaaaagccaagagcaagcaaaggaagagtgtgaagtctatgatgactcggaatcatactcgcccgttgtccctcttttggagaacaagagaatggaggaatag

SEQ ID NO: 88029 - DNA, 255 bp, Glycine max
  Peptide Sequence Number=SeqID_179714
atgtctcaagatcaagctgctgacattttcaccaagccactcaagttggaaactttcgtgaagctaaggaagggccattttgaacaaggtgaagaagcagaaagcggagatgaaccagatcaaaaccaccgttttggaatggctcaagttcagagtcttacccgtcatcactttgtacggcaaacaatatcaaagattaacttagtgagtagtacagtcccaaccaaatcagtgtcatcaccacccttttgctga

SEQ ID NO: 88030 - DNA, 798 bp, Glycine max
  Peptide Sequence Number=SeqID_179715
atgaagggtgcccaagcctatgatgccatgatgcagaggattctgttcgaaccgtgtggatggagggtgaggtggcgggccagagatagagtccatccacacatgagcctttatgggttgtgtgacccgtctgcaagtccttcacataaaaagagtttggcaggaaaacaacagcagagttggtttgttgggaccagtgtacggatgatgaagcaccagattatcgagatcattggttacatgatgtgtcgctccactgtcaaacagaaaatcatgttgcgatgggccggcagttgcagtattgacctaaacttgtccagtgtgagccggagagttacgaggtggcggtgggacactaggatgctgctgttggaaggttttgcactgagagagaacatgacctttgatgttgcaccactgacagcggccaagaaaaggtttgtgagatgctttggcataggtgtttttgagaaggatccaaagatcatgcgaggtcttggtgtgagacaccagggaggccacttcattagagagaatggtgaggagagcaccatatataaggcggtcctgtcgacgccaggtttggagatcatagccatcaaggagagcttcaacttgttgtttccaattaggataattgttgggaagaagtttggtgacattggtgaaagtgatgcaagcaaggggtttggatggctcatgggggttgggaatgaaggagttgttgtcggccatgggaggcaagggtggggaacgacgtccttaattgaagaaatagggaatgggtggatcgtttag

SEQ ID NO: 88031 - DNA, 267 bp, Glycine max
  Peptide Sequence Number=SeqID_179716
atggctaccagcagctcatgttcttcagttaatgatccaacccagacccaaactggaatccggaatgagagtgcctctgttggtcatcatgttcgtgctggtaacctgactgttggtcatctgcctagtcctgttgttggccctgttggtgctggtgttgtttgtcatgttcatgatgctgctagtgaggtaggaactgaaggacaacaaactgaaaaacatgcatatcctcctttgattgatgcaactcctctctcactcgattaa

SEQ ID NO: 88032 - DNA, 267 bp, Glycine max
  Peptide Sequence Number=SeqID_179717
atggatgtatgcacacaggtggttctatcagcttgttggatcacacaattcacttggtctggtactgcatcaagtgttggtgaatcagaactcactcttttagaccctgctgaagaacaaagacttaggagtcagtgttgggttgctatcgcgggaccaaagcataagggatacctttatggtactggagatcctgctcatacttacaaatgcgaaaatgacagcttcatgcagcaaatatcttccaatcgcgttgaagatgcataa

SEQ ID NO: 88033 - DNA, 192 bp, Glycine max
  Peptide Sequence Number=SeqID_179718
atgggttgtgcgctaagccccagtgtcgttttgcatcctaggaggcaatggtaccgacaactcaccctcctgctggagaagcagattgatgtggcatttgtgaagaagttctactctaacatctatgacccggatgacggctcttcgaagcagtgccgggtacaagggaagatcattaaatttgacacttag

SEQ ID NO: 88034 - DNA, 273 bp, Glycine max
  Peptide Sequence Number=SeqID_179719
atgtttgatactttgaaaaatgatggagaatttggccatttcaagttagggaatggtggaaaaatgaaggttgaaggcatagggagtgtgaagatgaagctccatgatggtgctattcgaactttatcaaatgtgaggtttgtaccttttgctgttgtcaatatgatttctatgggggagatgacatcacaagggtgtaaatatgttggttcaaagtggagatgtaaggtgtacaaggggagacagttggtgttgcaaggacaaaaaaataag

SEQ ID NO: 88035 - DNA, 279 bp, Glycine max
  Peptide Sequence Number=SeqID_179720
atgagcggatttgtcaccaacatttattcgaggaaaacattagaaaaaccaaaaagaggtatgcgaatttcgaaaagaaaagggttcgggagttgtttacgcatagggaaggcaaagggtcaccttggggcagttacagcttgcccaggcgagctgaaacttaaccctgaagcaggaagtaaagataaggacactaatttcgttcaagcgaccttgttattcgaccgagaaattggggaaaaccaaggaagtgaaaccgaaaaaacaagaggacattga

SEQ ID NO: 88036 - DNA, 405 bp, Glycine max
  Peptide Sequence Number=SeqID_179721
atggagagattctcagatgcaggctgggagtggagctttcaatggaggcaatcactttttgatgctgagattgacgtggctgatagattcttgggagacacaaaaggcatctcaattcatcctaaccatcaggacaagtgggtgtggaagggagattcaagtgataattattcagtggggagcgtgtacaagctgcttttgggagattccatagatgagaatcaagatggacaaaattcttccagtttggtgggaatcgatgtcttggttaaacatttcgggtgtttttccacaaactctgagatatcatttcctccaacatggttttgggaggccttctggagtcaggtctcagagatggcagatctggcggatagctttaacctggagtatatggcagcatag

SEQ ID NO: 88037 - DNA, 402 bp, Glycine max
  Peptide Sequence Number=SeqID_179722
atgggactaccaacgacaatgccataccaaaagaggaaaactctagatgaggtttcactattatcaagcgagtcggagacccgacatgatcacaaatcgacctccactccctatggctcacatagacctaggaatcctcagtggagtcgtcatctgtcgcaacctacttcacaacggaacgatgaaagcaaaatcgataagccaaagcgttcgtctccaagggagaaaatgagcggagtcaccaccaacatttattcgaggaaaacgttagaaaagccaaaaagaggtctgcgaatttcgaaaagaagggttcgagagttgtttacgcatagggaaggtattagcaccccacatgcctgtcacaagggacgtcagcctttaatcgagtgtgcaaaaacgtga

SEQ ID NO: 88038 - DNA, 399 bp, Glycine max
  Peptide Sequence Number=SeqID_179723
atggcattttcgatactggctagacagtgctccataggaaaattccctcacgatggtattaatgactcctctaatctattgaggcgggctcgttatcttgctcttgttgaggttgacgttcgcgtctttgttggtgatgcctttgtcgctttctctcctctattttgtccttccttctgtccgtatcttggcttttgcgattatcatcttggtgaccctcaggtgttgctcttgttgggttgttgtcaggtttcttcacgaattgagctaggtatccgaccttgtttggttctctttaactcgggtctgggagctggtaccaggggtagctgtataggtatctcctcattgaaggcttcttcaagaatggtggctcgatttacggttaagggtgtataa

SEQ ID NO: 88039 - DNA, 525 bp, Glycine max
  Peptide Sequence Number=SeqID_179724
atggtagttttaggatacacgttaatcccaatgaaggttattactccttccattacctgttgggttgtgaaggctcaagtcagtaggctatggaaaacaattgagcatgctaatggagatgcaattgggagacatagctggatggatttcagcaatatcgtcagtggaaaactttgtgaaaatggcataactactcaaaagttagtgagagatagtaatgttgcagctccttttttggtaattcaacatagcagactacaaggatgtggtgcattgactcatggtgaaatgtatgttgaaactgtggtggccaatgtcagcaacatattattggatccaagtttaccaaccatgtataattctggaataagagtcaggcctagcaaagtatatgtgattaatcttggaccatttgcaaaagacgcgtattttacattccttattcttaatgcacacaaaaggattacagatttgcatttgtttggatcagtcaatattttcactcctcggtatacaaccgtttag

SEQ ID NO: 88040 - DNA, 420 bp, Glycine max
  Peptide Sequence Number=SeqID_179725
atgaaggcaaagtgctatcaattggcaaaaataatgatgcagatcacaaaaattgaagatgagatgttcaagaccattcttgcaaaggatcagatgtttggtgaagtcagtaggttgtttgttgttagatggaaagatcaactcgatcattactggcattcggtagacaaacatgacaacatgcatgatgttgtctacaacaaagatttgcccaagccaaccattgtgcacggatggacaacactaaggacattctatgggctcaagggagatcaccatgtcacattaacctattatgtgccaaattcaatgactttcaaggtgcttctgaatgaatacaaggccatgtgcagcagcttgggcaaacgaccattatatgctgcaaaaagcacattagcacttagcagcaccaagatttga

SEQ ID NO: 88041 - DNA, 444 bp, Glycine max
  Peptide Sequence Number=SeqID_179726
atgaatgataaaaagtttatggtaactcgatctcaaagggttgaaatacctgagcataatcctaagattgaaagagcttgtcacaggaacaacgctaatacaaggaaaagaagaatgggtgaaacaaatagaggtaataataggaatagaggcaatgaggctgacccactggagcacaccctgcaagactatctcacctccatggtaggaatcactactagtattatgctccctaacttgggggacctaaactttgagctgaggcatagactaatcaacatgattgagagaatgcaattccatggcctgccatctaaagatcttgttcttcatttgaagaaattcctgaggatcataggcacaatgaagagcccaactacaactccagactacatcaaattggatgcctttatgttcttactaggggtaaaggctgaagactag

SEQ ID NO: 88042 - DNA, 772 bp, Glycine max
  Peptide Sequence Number=SeqID_179727
ctatccctctccctctccctctccttcacacgttcctgctacggttctttcttcttcttcttcttcttcttcttcttcttcttcttcttcttcttcttcttcttcttcttcttcttcttcttcttcttcttcttcttcttcttcttttctgtgttttgcttcctcgtgccctcaagaggccatcattcgtcccttcatccgcatcgtgccgccgatgagtgcccctgtcgtcgacgtcaactttgccatcatctttgccataagtcccttcgtttttgcccctcttcctctttcgcatttgcggcaaaggccgacaacatttgcacgtaggcaacaggcggttgcacctgttgctgaggatgttaagcatgtgtatcatgcagttgacaaggttcatgagcaacctcaagaggcagtaactgatgatgtagttgctaatgcccagggttttttaggcggacccaatgatacatcaattttgatggaatatgtttatcatgtgacaaccacaatttggaatagaggggaacgtcctgagttgaagttgtcctcctatggaaggaaggtagaaaaatttggaaggtctgctctagagattgaaggcatagtggctgccacaagattaagtcttctgattgcatgttccttggacaccgtaggagaggtgactatcaccctcgatgatgtggcattgttgctacatctacccattacaggaaccttccatacctttgatgctcttcatgaagaccaagtcgtggacttgcttgaa

SEQ ID NO: 88043 - DNA, 459 bp, Glycine max
  Peptide Sequence Number=SeqID_179728
atggtccgcggaagaaggctccgcaggttcttccgcgagaaggacaggcgcgggcatccgcggaagacaacgttcttccgctggatcccatggaagaacctgcagaaccttctttcgctggatcccgcggaagaacaccttcttctgctcgaataccaacagttcactttcacacgcgcggaagaaggttcttctccgcggaaaaaccttcgtcttcaacctcaagcaccacacgtcactaatgtcatctatcctacgaccatttgcacgattcacagagatacgaggttagaacactatcctggatggcggaaggaaacgaacaaagaaagccaatggaggaaaaacccaatggaggggaagccggggagaacgaaagccaacacggaggagaagaagccatatgagaagaaacgaatggcgcagaggaagaagaagccagacgagaagcaaatttga

SEQ ID NO: 88044 - DNA, 150 bp, Glycine max
  Peptide Sequence Number=SeqID_179729
atggatgattcatttgttcttgtcattgggtttgctgtggttgagaataataatactgattttaatgcattaatgatggctgctgtttcaatgcccactatattgttggtgtttattgctggagagaatctgatctcaattgacgtttga

SEQ ID NO: 88045 - DNA, 939 bp, Glycine max
  Peptide Sequence Number=SeqID_179730
atttttgctgacggagttgctggaggtgtctgccgaggaggccagagccaagacagcactcacacgtggggcatatctcgcgcttatctgctgcaccttgtcggttgcactctttttgctaataagagtgcaacatacgtgcatgtggttaaccttgacgctttccgggacctcgctcatagtggtggttacgcttggggagttgccgcgctgattcatatctatgaccagttagatgaggcttgtaggaccaccatccgacagcttgcggggtacttgacgctacttcagtgctggatctatgagcacttccctagtgtgcaccagtgcgtgactgacgatacataccaggagacgtccccacgtgcttcccggtggttgacgtcgaaggcgcacatgaagggaatcacaggagcatcctacagggcatgttgtgatggtttgaccgtcacagagtgtcctggttgccgtacacagagcatcggggggttagggcgtttcaggagatttcatctttccaggatagatgacatgtggatgcagtttgcggatcacttactacctgcgagtcagctttgtctagtgcctgggcaggtatctgcggattacatggagtggtttttccgcatatctcactcattcatgataccgacccaggcaggtgaccaacggagggatgcaccagctgcagaccctgaggactacatacagccgcccagcccccaggttccagtagcatttgacccccctccacatgtggatggttacgagggatatgaggcgattgcacagagattggagcatgtgctcaaccttaggatagtcactgcaggcacagagttatatgacattatgcacgactacctgacgatcgcgaaagggggacccagtgctgatgggactgtcagggctcgtcagagacgccgcacggaccattga

SEQ ID NO: 88046 - DNA, 465 bp, Glycine max
  Peptide Sequence Number=SeqID_179731
atggctctgagattcgcagcagctgcttctgcttctgtctcacgaatatcaaggccacaaaacccaccattcttttcacttcaacaccgcaacaacggtactctcaaattccatagcccaccttttcatcatccacttcccacaccctcaaaacgctgcaacgttcgagccataagcgaggtagctgtggaacctgaaatttcaaagaaagaacaaaatgagtcacctaaagattggaagattaaaatgctctatgacggagattgccccctctgcatgcgcgaggtgaatatgctaagagagaggaataagagttacggcacaatcaagtttgttgatataggttctgatgaatactctcccgaggagaatcaaggccttgattatgaaactgttagtcttagctctagcctctatggtctatgccaattatcacttctcatgtttaataggcatgagccttaa

SEQ ID NO: 88047 - DNA, 1839 bp, Glycine max
  Peptide Sequence Number=SeqID_179732
atggctggagggttgcttggagataaccttggattgaaggaagatgtgatcaagagggtgtgtggtttggcctccaaagctcacaatcacaagtcaacggacaagctctacttttacgataaggttcggacttcttcggggacataccatgttttcagcttctcgggatcttgggatcccgctgaatggttttttagcaaaccctttggcggatccaagatagatcctacccaatttccttcactcagaagtattggtaacgatgaacctgctttggtgaacgaaggcttcgcaaagagattcgatcgcgtattgaaaactagctttaaagccgaggtgaataaggctattggagatgggaagcaagtagtgtttacggggcactcctctggtgctgcaatagccattcttgctaccttttgggcattggaagagtatcttaaccctacaaaaatccaaaaacccacgccacccttttgtgtcacttttgggtctcccttaattggcaatcatatattctctcacgcttcaaggagagaaaattggtctcgctatttcatacactttgttttgagatatgacatagtgccaaggattttgctttctcgcttggcttctattaagcaaacttttggttctgttctccaattcttgaatcccaattccaaaacttccacccaggatccaacaagggctagtttaatttctgaattttacaaaactgtgatgacaaacgcagcgagtgttacaagccatgctgcgtgtattctcatgggaagcacaagtttgttacttgggacagtggcgaattttgttgagttgagcccttataggccctttggaacatttattttctgcaacggaaatggacaattgattgtggtgaaaaactcagatgctgttttgcaactcttgttccacactgctcagatgagcgatttggcagaacttccagaagttgccaatgttagcatattgcaacaccaggcctatgaggctgaattggatgatagcttgggaatgcagaatgtagtgtacttggagcaactagagcaacttccgttgtctgctgatggttctaatagcgatgttgcaacaatcagtgcagccttggatggccttggactgagcacaagagcaaggctgtgtctacgagcagctggtgagttggaaaagcagaagctaaaaaatgaggagaaaatcaagaaggagattcaggagaaagccgtgccaagcatgacgaagcttcaaaattacaaaacaacatgtgagatgcacaaggggaagggctattacgatgccttcaaggtgcaaaatgaggaaaacgacttccaagcaaatgtgaagaggcttgtgttagcaggggtatgggatgaagtgattgagatgctaaagaggtatgaactcccagacgagtttgaagggaattcaaaatggattgaacatggaactgaatttcgtcgccttgtggagcctctagacattgcaaactatcaccgccacttgaagaatgaggacacaggaccttacatgataagggccaggccaaaacggtataggtacactcaaagatggttggagcatgctaaaagggtgccaaaacctgctcctatcactgaatcaaccttttgggctgaagtagaagagctttatagctggattaacagcaagaggcatcttgatgatgaagtaaagcaaagggttgtgcagcttcagaaagaccttaaaaagtggactgatgatgagaaggtactaaccaaggatacgttcttgaaggatcctaactttattaggtggtgggatattctacctcaggaactcagggtcacttccttctag

SEQ ID NO: 88048 - DNA, 431 bp, Glycine max
  Peptide Sequence Number=SeqID_179733
aaataaaaaaatttgctaataattcaacattccggaagaaggtcttccagaagttaccaaggcctattccggaagaagtgcttccggaaaacactttcggaagtccttattccggaatgggcttctttcagaagttactaaggcctattccggaagaagtgattccggaaaacacttccggaatggaccttagtaacttccggaagcacttcttccggaagaccaccaaatcttcaaatacttcacgggaccaccaatggaaagcgcaagggaccaccaccgaaagcaacaacaaccaaaaccaccgaaagaaagcagagaaggaagaagcagtaaaaaaactgagtaacgaaagcgtgaaatccaaccgtgcaacgcataaatttaaagaaaattacacaggggcaaaatcgtcattatatatgcattaa

SEQ ID NO: 88049 - DNA, 1869 bp, Glycine max
  Peptide Sequence Number=SeqID_179734
atgcctcgcgccacaacaacccaatcgcagaacataaagcagagggtactcacgtgcctaacaaagctctcagatcgcgacacacaagtcgcaggagccaacgagctcgagtccatcgcgcgcaccctggacccgcactctgttccagtcttcctctcgtgcatccactccaccgacgcctccgacaaaacccccgttcgcaagcaatgcgtgcacctcgtggccacgctctcccacgcccacggcgacgcgctctcccccttcctctccaaaatcctcgcctgccttgtccgccgcctccgcgacccggactcctcgatccgggccgcgtgcgccgactccgtcggcgcactctcggcgcgcgtcacgaggcaaccgttcgccgcggcgttcctgaagccgctggcggaggcgctgttcactgagcaggacccgagctcgcaggctggagccgctctctgtctggcctccgcgattgaagcggctccggatccggacccggccaggctggccaggttgctcccgaggctcgagaggctgatcaagagcaaggtgtttagggccaagccagcgctgctggcgctcgttggaagcgttgtcgaggcgcgcggcgcgacgagcggcgccgcgttgaggagtttggttccttgtcttctggaggcgctggggagtgaggactgggccactaggaagggcgcggcggaggcgttgaagaagctcgcgagcgtggagagggacctcttggcggagttcaagggtggatgcttgaaagtgtttgaagatcgccgatttgataaggtaaagttggttcgggaggttatgaatcagatgttggaggcatggaagcatattcctgatgtttcagatgagttctctccacctcctcaattgcagttgtcttcaaaagagaatgcaagtgatgggcgctatcctcctgtctctcaaaattcatgcagtccaggttctgtaatgagtaaattgaggaagaaatcgagcccagctagcaaatcaactccaccagatagatctgctgttaggaatgcaaaaaagagtgcattaagtggcgataggatgggttcaggtgttttgcagaaactgaaccataaccattgggatgttcgaattgctgtgtcaaatgttcctgatcgtggtgaacgccggcagaaggatgaagatgttttggaaagaagcaaaaaggataaaagcagattttttaagcaggaaacaaaacgggctctatttgataaaaattctgatgacaagatgcataaatctggtgggtccaaagctggatctcgtgtggttccttgttctgaagagagtcaagactcaggtcctgtctgtaatgtaactaaggatctccataggaatgacaaagagagtgaagaattatctttgattcgtgctcaattagttcaaattgaaaagcagcagtcaagtctgcttgatcttgtacagaaattcatggggaactctgaaaatggaatgcatactttagagactcgtgtgcatggcctggagttagcattggatgagatctcttatgatttggctgtatcaagtggaaggatatctaaatctgatgctcctaagaatacttgttgcctgctacctggtgctgaatttttaagcaccaaattctggaagaaaacacagggccggtattcatcgtaccgattctctagaactggtagcactccattactagcttccagtcattacagagctaacaggaatgccaaatctaataggttggcaagccatagatttagggtccatggtgatggaagcttcatgactaatcctctggcagagattaaaattaattcaagggagatttcaggctctgcaagatcagagctagcttga

SEQ ID NO: 88050 - DNA, 147 bp, Glycine max
  Peptide Sequence Number=SeqID_179735
atgccagtagaaagatgtagccaattgagccaaggtggccttgaggccggaatggccagccggaggagtagatggcttgtatatgatatcaaagctaaacccgagaaggccattgttacaaccctggtgtgtggaaagcctgggtga

SEQ ID NO: 88051 - DNA, 888 bp, Glycine max
  Peptide Sequence Number=SeqID_179736
atgggcccaaaaaagagcgaaattattaggattcctatcaacaacaacattgagtacgcgaagaaggtctttccaaaagactggttcatccctaagaaatgggtgaactttgagaatctgatggaagaggaattttctgtcaaagacctctttgatcatgagaaagatataacgcaggagacggtggacattatgctatatcaaaagttgcatccaaataccattgacaagaaggccttggtcggcttcttaaggaatgtgaacctcgagtatatgtgcagattcatccataattttttgttcaacatagtgatgcctagactgggatcaagagattatcattcaaggacaaatttcaagcgaaggacaagaagaaccttattccttatgaggaacggtggggtagatgtgtttgagttggaaccgtctacaggtgctacacagctaaagcatagtgctgagaaggttgccataatggaagtagatgatgagcctgtgccagaaacttcaatcattgaagcatcccttgtggaagcagatgatgacatcattgaaacagatcttggagtggctgccttttgtcctaagccaatgtatgatgttgatgaacaactatttgctgctcagtctgatacaacatatgaagacaagctaagacgattcaatgcgatctatataggcccaaaatctgtctctatagcaatgatgaataaccatttggaggcacaaaagaaaatgatgttttctaaagaacacttaagggcaggtttccctgctattgatcatttcttctattcatcttgggataccttacctaaagaagaagagcacacacttggcatctatggtgataggggactagtgatcaaggagttccctccaagatag

SEQ ID NO: 88052 - DNA, 123 bp, Glycine max
  Peptide Sequence Number=SeqID_179737
atgacggcggcggagaagatgaactacaacaagtgcacccagctcgatctgaatgtgcgcacagtgtgtttaagtactgaccgtgagagtgagccaactatagagttaataattaggaattaa

SEQ ID NO: 88053 - DNA, 1059 bp, Glycine max
  Peptide Sequence Number=SeqID_179738
atgagtaaaaacaaagaagagttaagcatggtggcaatttcgctttacagagggaaccttcaccgggtaccggacgtgccccgtcgatggcccatgccagcccccaaaatcactctcaaagacttcaaatcccttctcgctcgtcgctccaaggcactttcgcgccttcaaaactcaaaccctaaccctacccctacccctctccccaacggttcccaaaccgaaccacctcccaccgttaccgttaatcacggcgaaggcccttccaccaccgtcgcccgtgaagacggatatcgcaaagaaacgccgctcgtcgccgttagttccgccaagaaaccgctcgctggatctgattcagagaaaccgcagctcgattccaagattgacgaggcttcggtgaaaaaaccatccgacggtgtcgccgcttcggaggaaaagcagaccgagccggtcgctgagaatgtggatcagcttaatgaaaagaagaaaaggaaaaaggaaattgaggagaagttgcaagggttgaatgataataaacataacctggtgttggtgttgaagcagattctgaatgcggaggaggagttgaagagacgaaatagtatgcaagtagttgcaatgcatggtccttcggtcccacttcaaggggatggaacaaatgatactggtttgatgattaggcatatgcccccgaggttgggatcccagggaaatcttgttgctgctgatgtggatggtggtgaaggggatgattttgctaactatacgatgcattctcgccatgtgcttcggacaagtagtatgtcaccttcttcagagtccccactacggaggacccctagtcttcaacagaatgtgatttcacatccttctcgggcaaatatcggggctgctggtagtccatcacgctttgctctctcaggtcatcagggaaatcccgtaaacctaccttcagtgtctgtgtcaggaactagttacattgcatcatccccttccccagcagcatctggtggcacttctgttttcagagacgcccgtcagccaagtccatggaagtag

SEQ ID NO: 88054 - DNA, 525 bp, Glycine max
  Peptide Sequence Number=SeqID_179739
attgtctctgcccagccatcgcatgcaagcgttatcttcggctcctctgatgccaccatccactcaaacaagcaatcgaatccattgtggcgtccaccaccgcatcaacatttgaaaatacttggaaacaacacgtcgttcaccaaccaaacgttgttcgcggaggagttccagcacacgcacaattggatcaagaaccagtgccacctgccccggcaagcatggaacgagaaacttgcaagctacacacgccgctacgaggactgcaagttgatccactcgaacttcaactacaacaaaaacgtgttttggaccaagtttttgcaagagcttcctgcacttggtaaagcacatgctgttgcaggagcttcttgcacttgctctacgtgtcccccatgcccacacccgatcgatgttccacgagctcaaacagtgtttcttgaagaagaggattattggtgtgcgggaagagtcacaagttcgagaacgagatttcagaactttcaggtggaagagaggatgaag

SEQ ID NO: 88055 - DNA, 480 bp, Glycine max
  Peptide Sequence Number=SeqID_179740
atggttgcacactatccttcaacagtgaaattggcttctaaaccagagcagagagcacacccaatcagcagaagtccccagtttaacactgatgcacatgaaaggaacaacgcggcaactgcaccggcgggggcggttccaccagcggcgtcacgatcttgctgcattgctgcagcttcggagacggcggcgacggcgactcctcgcggcgaggctccctcctcgcggcctttggcctcgccggctgcgacgccgcgtagaggcgtgcagcccatcggcggcggtgctgttggtggttgtggcggttgtttcctccttatacgaatcgggttccggcgagggttcggtggtgtcttgtgggggagatccttgggacatggtgtgaaacagagagatcaaaagggttttaggttaagtacggtgggattacgtgtagaggaccatggttgggttcgcattgaaggcggaaaatcaaagtga

SEQ ID NO: 88056 - DNA, 339 bp, Glycine max
  Peptide Sequence Number=SeqID_179741
atggagaagaggttcagggaggcagtggaaagcaaggggttagaagctgaagtaaaggacatggattgggagagcacattcttcttgcgccatctcccagactccaatatctctaaaatccctgatctcagccaagagtaccaggatgcaatgaaggaatttacacagaaattggagaagcttgttgaggagttgttagacttgttatgtgaaaatcttggattagagaaatgtcgttggacagcattgttgcagaccttgccagtcatgaaggagttgttaagggataaaagaaggcagtccagcaatcatcatcgaaatctcaggtgttgcatataa

SEQ ID NO: 88057 - DNA, 375 bp, Glycine max
  Peptide Sequence Number=SeqID_179742
atgtctaagcatcgccagaagctacattggccaaccaattggaggtcacagatcaagtcattcgcagatgcaggtaaccaatttgactttcaatctatgcaattgaaaaatgatgatgatgttaacacaataacaccagatggtatattaaacttacttcaagccactataactcctactcataatgccctcctatattacaacaagaggtggaacatgccacaccaagacgactttgtgggttacttgttcacaggaaaaaatccaaaaagattggacattcctttgggatgtagcatcgaaaaattgaaggatgtgatcaagcaagttgcacttcaagagattccctcttatagtattcatgaatcacaaacg

SEQ ID NO: 88058 - DNA, 3175 bp, Glycine max
  Peptide Sequence Number=SeqID_179743
aagatgcgcagatagagaagcaattccgagcgagcaacgtatcagatcctggctgtgcctcggttttgaaatcaatactttgtgcgaggtgcgacccattttcaggggagctatttacagttcaatcctcacctagatcagttcctgtgctttgcaattccaccataccagcaaattcttctcaatcaaagacagaggtgcacgttttttgctctcaagtatgggacacatgcaatgatgtatccatagtgaattctccatttgccccttcattacaaggtcaagcaggagcaccagctcacaccaatgctaccaaactcactgatttatggcagtccaaaactgacttttgcactgcatttggtggagcatctgataattcatcagtgtgctttgaaggtgaacctgtttcactgaataaaactgagacctctattagcccccctcacggcttgtgccttgagagaattggtaatggatcttacctcaacatggtggctcaccctgatggctctaaccgcgcattcttctctaaccaaatgggcaaggtttttctggcaacacttccagatgtgggatcaggaggaacaatgaagcttgatgaatcgagtccttttgttgatctaacagatcaagtttattttgatactcaatttggaatgatgggcatggcatttcatccagattttgctaaaaatggacgattctttgcttcatttacatgtgataagtctaagtggtcaggatgtactggaagatgttcttgtaattcagatgttaactgtgatccatcaaagttaggtactgatcacggtgcccaaccatgccaatatcaaactgttattgcagagtattctgctaatagcactggatctcagccttccttggtggaaagtgctaaaccaactgaagtgagaagaatatttaccatggggctcccatttacatctcaacatggtggtcaaatactcttcggacctaatgatgggtatttatacttaatgatgggatatggaggaggtgcaggtgatccttacaattttgcacaaaacaagaaatccttgcttggaaagattatgaggcttgatgtagacaacatcccaagtgcagcagatattagtaaactcggcctttggggtaactactccattccaaaggacaatccttttagtgaagataaagatctgcagcctgaaatatgggccttgggactaaggaatccttggcgctgcagttttgatgcagaaagaccttcctactttttgtgtgcagatgttggacaggatgtttatgaggaggtggatctcatcaccaagggtggaaactatggctggcgtgtttatgagggcccctatccattccaaccaacacaatcacctggaggaaatacttcggtaaattcaataaatccaattttcccattaatgggatacaaccattctgaattaaacaagaatgaaggatcagcatccatcactggaggatatgtctatcgatctaccactgatccttgcatgtatggaagatacttgtatggagatctatacgctggagcaatatgggcagccacagaagatccgcaaaatagtggcaatttcagcaccagcagaattcccttcagctgtgcacgtgattctcccatacagtgcgactctgcacctggaaaccttcctgctttaggctacatcttctcatttggcgaagacaacaacaaagacatttacatccttgcgagcaccggtgtataccgagctgttcgtccaagtcgctgcagttatgcttgctctcaggaaaaggcaactactactacaacttcagctccctctcctacttctcatgctacacgttggaggccaaccatatatgcccgtaggcaacaacaagaggcgcatgctgttgaggatcctcttacgactgcggaggaattaaacgaagagaaacaacaaccacatgttgaagaaggtgttactaatgttgagggttttttagatggaccccatgatacattagttttaagagattttgaaaatctgctttacgagtctggaatggagaggaaggctaagttcagcaggcctgctccagagattgaaggccttgtggctgccagcggactaagtcctttgatcgcattaagagaggtgactatcaccttagatgatgtggcgtcattgttgcatttgccgataataggggcgttccataacttcgagcaactttatgtcgaccatgttgtcaatatgttggtgaaattactcgagacgaaaatcgatgcatgtcactggatcgtagtagcacgagcgtatttgttgcatctgcttggatgcacactctttgctaacaagagtgtcatacatgtgcatgtgatattcttagatgcactacatgacttgacgcagagtgggacttatgcttggggcattattgcacttgtgcatatgtatgataatttaaataaggcgtcaaagagcatgacgaggcagcttgcaggatatatcactctgttacaatgttggatctacaagtatttttcgtctattggttctgccatagctgccaaggattatgacgagcggagaccgcgtgcatgtcgatggacctttggcaaggcattacctgtgttgacgtatcgtaggcatctggacagattgacccctgatgttgtgtgctggattccatatgatgatcaccgctcatttagagaatttaagaccattctgccatatcctgctttgcctttaacttctgttgaagaaatggatgctagatggatgcagtttggtgactatattgcaccagtaggacaaatttttgtagtgcctcgtcaatgttcgtcatattacatgcagtggttctacatgatttcgcatccatttatgactccagcacaatcaggggatcctcctagatttccgctggttcagcaatatgacacatttgttgaaccagatgtgtctcagcaatcgagggcggcaacgacacctaataaaccagacgttgatgtgcatcttcctcgacatgcagtagatggttatgtagcaattgatgctaaattggagaggctactgaacctgaggatcttgactgaaggaacagaagcctatactgttgccaaagaatgtctaagcatcgccagaagctacattggccaaccaattggaggtcacagatcaag

SEQ ID NO: 88059 - DNA, 151 bp, Glycine max
  Peptide Sequence Number=SeqID_179744
gagatttagggataaaaaagaggttacagaacctgaggcagacccagaaagggatcagagaactgtttttgcctaccagatgccgctaaaagcaacagagacaaatgtgtatgagttcttttcaaaagctggcaaggtcagttgcttttaa

SEQ ID NO: 88060 - DNA, 1272 bp, Glycine max
  Peptide Sequence Number=SeqID_179745
atggctctggttgttgctgcataccttatggttgttataatcctagagaacatctttagtctgcaatcatgggtgcgcatatttatatttgttgtgcttatggtgttgctagcctcacttctttgcattgcatttgaagcacatgaaaagaactccggtagaagttttctagatgaggggtcaccactaattgtcgagccaagccccgaggatactacagaaaaggaggatgcaaggaaagattctttcaacaatcaaaggactaatttgcaactaggagaaaacctgaatcttttccaagcagtgaaaactgtgaacttttgggttttgtttgtttctgtggcatgtggtatgggatcaggacttgcaactgttaacaacttaggccaaataggggaatcccttggttataccagccatgagacaggttccttggtttctttgtggagcatttggaatttcctgggacgcttcggagccggttatgtgtcggattattatttgcacacaagaggatgggcaagacctttattcatggtcatcactttactgatcatgagcattggccatgtggtgattgcttctggacttccgggtgccctgtatgccggttcgatattggttggtatttgttatggctctcagtggtcactaatgcccacaatcacttctgagatatttggtgttggaaatatgggcagcatattcaacaccattactatagcaagtccagtgggatcttatatattctctgtgagagtggttggatatatatatgacaaagaagcatgggatggaaatacttgcattggaactcattgttttatgttttcttttctcataatggcttctgccgctattctgggttctctgtcggctttagttgagtcgccggagttctccccttgcgccgctgcagcaatgttgacgaactccgcatccggcggtgacgctccttctcgcggttttgatacgccgaagtgggaccttgaatcggcggcgctgctccacgcgatctccgagcatggcgggtacgcgtacgtgagcatggcggcgctggcggcaagttctggaagttgggctgaagtagggaaaacgcaaaagacaaaagaagggtgttccgtcctggcggcgtggtggaacttcattcacagtaggtggcttgcgttttggatcaacggtgtcgtgcggaaacagaagctacgtttaagtaagcatcttaaaccttactctctttcgattctcaatcgctctcaatcaattgcagcataa

SEQ ID NO: 88061 - DNA, 219 bp, Glycine max
  Peptide Sequence Number=SeqID_179746
atgaagcgcaccctcacctactccattccttacaaaataaagatcttcaaccttgtgcgtttctggaacatctctacgctgtctccctcctctttgtcctcgttcatttacgtgaatgttgaagttgaagatgattcattgcccaagataagtgcagaaaaggtggtgaaaccagaggagcacaatggtgagattatgagtagcacgaccaatttataa

SEQ ID NO: 88062 - DNA, 186 bp, Glycine max
  Peptide Sequence Number=SeqID_179747
atggcgagtcggctggatgtcgcagtaatccatcagattttcggtcatccgaatgccatgaaaggaagcatgttcttcaataagaccagcaattcagtgaagcttttatcactccacccaaatcttgccttcaagtttaccaaagctaacactgctgacaaccgcgtgaaagatgtgcacccctga

SEQ ID NO: 88063 - DNA, 156 bp, Glycine max
  Peptide Sequence Number=SeqID_179748
atggccttcatagtcagcaagataaacatggggttgatgaaggcgatgggatcgacgaagaggttgggggaaggagatggggagtttcaggatgtaggagatgacgttggaataggtgcaggggatgttggagaggtagatgtaggagtggattga

SEQ ID NO: 88064 - DNA, 225 bp, Glycine max
  Peptide Sequence Number=SeqID_179749
atgagtgagcaacatgatcttgaacaccatcaacaacacaagcagattgttgaaggagtgaagagagagaggcacctgcatcgttcaatggagttgtggaagcatagagagaatagaacggttgagaagctgagagaagagggggatggcggctcctatgttgtcgaagaggtagacttttccaacaacttggggcagaagctaatgttaatgtatcagccctga

SEQ ID NO: 88065 - DNA, 471 bp, Glycine max
  Peptide Sequence Number=SeqID_179750
atggtgtcatttgtggactgtagaggtgatggcgtggagttcatgaacgtaagtggaagctttttgaaggttgtcagtggggaaataatggctgcatacgcccgaatgagtttctgcaatgccacttacgaacacaatgtggccaagataatgcagttggttctttgtgaagacgcatttggaatgtcagaggagggatgggctatagaccagaatgttgtcgaagaacacaatgacgaacatccagagaaagggtcacagaatgtcattcatggtggcttgaaaagtggacagtgtgttccagagaccgaatggcatgactttaaactcgtaatagtcatggtgggttctgaacatcatcttgtggatgtcttcttccaccattctaatttggtgaaaaccctttcccctataatccatgcaacatctccagcttctatccttcttcttgacaaggagaactggagatga

SEQ ID NO: 88066 - DNA, 234 bp, Glycine max
  Peptide Sequence Number=SeqID_179751
atggatttttacaaggttgaaaagaaatctcaaggaccgcaggtcgcttggggactggatgtaggcacaggttgttgccgaaccagtataaaaactcttggagataaaagaagtgatgaaatcctacccctaagggcattggatagaagactccaagaagattgggctagagaggcaagagaaggtcctaggattttcatgagccttagggtagattttgggcccatggactaa

SEQ ID NO: 88067 - DNA, 213 bp, Glycine max
  Peptide Sequence Number=SeqID_179752
atgaacccaaaagcgattagtcttttgagtccagtgatcaaccaagaagcaaattcgcttcttgcaatgaatccaaaagcggttagtcttttgagtccagtgtttaaccaagaagcaaatcctgcttcttgcaatgaacccaaggaacgttggtcccttgtgttcagtgttcaaccaagaagaccttctcttaaaaacagtcgccaagagtag

SEQ ID NO: 88068 - DNA, 1443 bp, Glycine max
  Peptide Sequence Number=SeqID_179753
atggttttaatcgaaggttcatcattggaggagtctgtcgataacgggtctgaggtttgtgggtacaatgatgaagtttttgaggtgtcatctaattctaacttcttgggcatttttgagccagttgctaaaaaaatgggtgagaatattacgactctagtggcgatggatgctactgacacaaggacttccatgagagttgcacctcaacttaagaagagccctgtccagaaggagaagtgttcacatgcccctattacgcttctcgggtacacgtgggttgatggtgaggtgaggctcccgtttgatgatttcttggcgatacgtgcttcatatcctaaacgtggcttcaacgcaacttcatccaaatggtcgtttgcaagacaaggctcaatggatattgttgatctagataccaaaacgaaaccctttgtttcctttctacctattggaaacaatgcccccgccagaatcatgactcaagctaatgctaacatgaatgcattctgcctggcctgtaggaatcagattgttgtcagcaaaggtcctctaaatcctcatctcaatcgaacatcggggccatgcgacgcaccaactgatgtggtgcctcctcccgtcactgtgaccaccaaagtggctcggggaaagcttctggtcataaggaaaggagctcccgagagaaaaaaagtcaagcaacaaatgcttgagtttcaaccttccactaccacgaccttggccaacttctcggccttgaccaaccaaggtttatttgttaaggactttcagctagatcgtctcatccctccgacgatgatctctaaccatgggtggcaagtgctgagcaagagcaatgatactgctaattgggccatcttctgggcctttcttgctaaggggctagagacacgtactactaatgttgaagccttcgttaggtcttgggatggcgagatttctaggcttcgatcaaccttggtggttgctgaaaaggagaaagaggaggccgctgtgctacacttatgtgaattctctgacctaggcgtctttggaatcaacaaagatgtatattatggggagttgatgttaattgatgatatcttgaaggatgcaacccccacactggagaggttgatgaccccgactaaggactttcaagatgatggtgccggagctgaggatgaagaccatgcttttgacgatgtgtataatgcacatgaggcgggcttaaaccactgccttcgacaggtgctacacttatgtgaattctctgacctaggcgtctttggaatcaacaaagatgtatattatggggagttgatgttaattgatgatatcttgaaggatgcaacccccacactggagaggttgatgaccccgactaaggactttcaagatgatggtgccggagctgaggatgaagaccatgtatggcctagggattga

SEQ ID NO: 88069 - DNA, 111 bp, Glycine max
  Peptide Sequence Number=SeqID_179754
atggaagcaatgatgagcatgaggaagatgatggagcataacactactacagttgttgctacgagtactgctattgagatggacctcgattcacctggtcggttcaatcaa

SEQ ID NO: 88070 - DNA, 504 bp, Glycine max
  Peptide Sequence Number=SeqID_179755
atggaggagattttgactattgagataaaacctggctggaagaaaggaacaaagattaccttcccagagaaaggtaaccatgagccaggtgtcatcccagcagatcttatttttgtgatagatgagaaaccgcatgctctttatagaagggatggtaatgatttggtgatcaaccaagagataacccttcttgaggcccttactggtaaaacattggatctcaccaccttggacggaaggagtctcatgatcccattgacagatattgtcagacctggtgctgaggttgttgtccctaatgaaggaatgcctatatcaaaagagcctgggaggaaggggaatttgagaattaagctcgacgtcaagtatccttcaaggctaactccagagcagaagtctgatctgagaagagttttaggaatactctccacgggtgaaactgagtataaaaggctaacatacgatgagcccatgtcttgccatttggacttttttgcagggtag

SEQ ID NO: 88071 - DNA, 324 bp, Glycine max
  Peptide Sequence Number=SeqID_179756
atggagaagggtttgttgatggtgaaaagaaaagggtttgtggtggttaaagacactaccactgacatggtgtgcatgaggctagtgagcttgaatgcaaggtcagaagataggttctatgtagatcagcgtgagaatcgccagtttatatcaagaatttcagatggtcaaaaggttcttgatatttgctgctttagtggcggttttgctctaaatgttgtgcgtggaggtgctctaaatgtcaccgataatttggttgttcaactgtctcgaccttgtcatttagaaaggaatgatccatgcaacttaccatcattgaggtag

SEQ ID NO: 88072 - DNA, 222 bp, Glycine max
  Peptide Sequence Number=SeqID_179757
atggaggatttcgagagagatgagggtttcaagtggctcgtgtggaatctagtgggcatattttcttattttatccatttagtaaatcttgttgggaacatgtggagatatgggagaggattaatcccttggtggcctaagcttcatctttcaagcaatgttttcttttttattcttcaaagcttcattgagagcaataaggccttgtttgctatagtgtag

SEQ ID NO: 88073 - DNA, 711 bp, Glycine max
  Peptide Sequence Number=SeqID_179758
atggctgtgttggattatgccggattggagcatcgcgacaacctgtctttcgagttcattcttttgagagcgggagctagtgaggttcatggaaaatggaatcaaaacgatgaagaaggaggtccaagggagggggtggatgagggtcatggggaggcgcaatccagtatggtgccatcaccaatcatgatgggcatcgtggatgtcggggtggataaaaggtggaggaaggggtttcctgttgctaatggtccaaatcggaattgggaagagttggcagagggatcgaggaaagctcgtcgtcatcatcaagccaattcttccgccgagaggcgtttaacaggaggtctcggagttgaaagggaagcattggtagtgaccggagtgaataatgaaggttggaacgcctgtacttcgcgatggagttcgggggacaaccctgagatgaagcaactcagcaaggatggcgaggcgagaccaactacgcggtgtgaagcgatattcgagagcttggagcatggctggccaggaggtgaggaacctgttgcgggtcatccactggtaccaacacgaggcggatccatcccatgggatcttggccatcaaaacgagggtcgcctggccttgagtaagtcatgctaccgcctcttcaagacgttcaatggaggattgtctggtattatgttctggcagagtggatttctaagatag

SEQ ID NO: 88074 - DNA, 270 bp, Glycine max
  Peptide Sequence Number=SeqID_179759
atggcgacatcctccaagacgcaactcgccagcctggatggcgccttccagcctacgcctgaccacctgcaggtgctgcagcctacgcctgcaaagctctgcaaagctgaagtcgctggtcaaaccagcgcttccatgcagcctcctggatgcgtcaataccagtggcgacaacactgcctgtgtcaccagttgcagtggcgacatgccacgtgtcacctcttccccgaaggcaccagtggtggtggcgccatgcatggcatctacgtaa

SEQ ID NO: 88075 - DNA, 354 bp, Glycine max
  Peptide Sequence Number=SeqID_179760
atgaaaggctacgcgttcaccaagtcgccactactgttggcgcttccaaagccacctcagcaaaaggggacgcgctgctgggaatggcgcttccatggccacgtggctcgtccctgtcgaagcgccatcagcactggcgccatgcatggccagctacgtacaaaacagcaccccctgggaaatacctccaaaacagccctagtttgggaaattctttctaaaagaaccccaaacagggaaatgtgccacgatgctttttgcaaaccaataattagagcaagcgttccaaaactcaacttggatgatgcttttgagcaaaaaaatgacattgcgaaagcgtggaagatgaactag

SEQ ID NO: 88076 - DNA, 348 bp, Glycine max
  Peptide Sequence Number=SeqID_179761
atgcgggttgtatatcgaaaaaatccttcctgcctagttgtcttaggaaaagtttatgagggatccacaatcgttcacaacattcctttgttgtatgataaagtcaaggttggtgttgaagaggttagagatgcagatactctcattcctgtacccactgaagaggttaaggtcatagagcagacacttaacaccttccttgcttggtcgacacatcttgtcaagcgtttatcagaacatgaagttgtgggacccgcgaaacctgcaaattggccggatcatgaggtcgatgatccccaatatctgatgacattgaccatcccacaactttttctgaagccgttgtag

SEQ ID NO: 88077 - DNA, 1422 bp, Glycine max
  Peptide Sequence Number=SeqID_179762
atgcatagtctacgtgagttagagagagaacgagtggctgagagagtgaaacacaaggtgggtaaagtgagggagaaacaaggaggatggaaccagaaaactttcaattgttttagaacaaagaatgatctaaaggaaaaagaaaaactagaggcaatccccaacagtgtcgttttacatcacaaacttcccagaggtgttcttagaagacacagaactatcaaggaggtctttgtagcatacagaagattaagacaaggtaggagatatggttttgttcgcttctcagaagtcctagacattgacaaagattctctattactcaagaaagttgagttcatgaaagtccttatcatgacctctacccaacagacaatctcaaaaaacttcaaaatcagcatcaatggagtcattacacaagtcaagcttgtggaggaaatgaaagttttcgaaaatcactgcttctataaaggcgatagaattagcgatgaggaagatacttgcagtaaagatagtgaaatgggtatgtgtttgggatcttcaagctcagagtgcttttttgatgcctggcatgcgacaaagcacgatgttgttcggagacaggattatgagtctatgaacgctaggccccaaaaggaagaggaacaacttggggaaacgaatgattgtcataagtatttgaactacaaaatctcattggtggagaagggtggaatattaaaatctaatagcaaagtttcaaactctcttaatagcaacacaccaccttttactcctttccctacaaacaaggttgatgatgcactatgcagctcgagctctaatatcaaaagaagaaagattactatagctggcaacaataatcagtattgtagtaagtcacattcaagcagcaatgacaaaggtgaggtagagaagatgttgaaccaaggagtaaacatgggtttctcaaactatggcagaaaaagggtagttattggcatcctcattaacttagagaaaagagatgaaagcaaggtcaagactgttaaaagactcattagaaaatatgatatccaatttatcgcactacaaaagagagaaaaggacttcatagacttagagttcggtaagcgattatggggtgactatgatatgtcttggaaagttatacctacaaataatacagccagagacaattggagagacaacaatgaggtgatcacattggtaaacgtctactcaccttgtgacttggaagatccatcttttcatgaggtagtcaaagagatatggcagaactctcaagtggagggacaaagtgcatatgtcttgaaggaaaagcttaaaatcactaaacaagctttgaagaggaagagagaagtttgtgtgaggaagaaaagacaagaaaaatacatcttcaaggtgaattttggatattag

SEQ ID NO: 88078 - DNA, 681 bp, Glycine max
  Peptide Sequence Number=SeqID_179763
gaccagaggattaggtcgtgccttaggtcaggttactggcagaggtgtcggcagaggagatcatgatgattccgatgatgctccgcagcgtcgacgatctactgcatccgcacggaggcagcgagtcgctgtgactgcggcgcataatgagccagtggtccctacgccagatgttcaggatgacccgatggaggcatcagctgctgtagaggacattgtggtagacattcctgcgaacacaggcgcggaggctgctgaggatgagcatgagggattttcgggtggtccgagtgacccatccgtgttgacctatttaggcaggcctgtcccagccattcagggacttgttgctggtacaggactaagtcctctgatcgcgtgttctgtagacaccggcaatcggggatttttgtccgcatttgtcgagcggtggcaccgggagacgtctagtttccatctcccggtgggagagctcaccatcattgacttacacgcttttgagcccttgcacgtggacgatgcggttcagatgctggtggacttattgatggtctctacagagtctgttagggctgaacagcccagtgtcgtggaccgttgcactctgtttgctaacaagagtgcaaccaatgtccatgttgtctacttggaggcccttcgtgacctcagtatgacgaagag

SEQ ID NO: 88079 - DNA, 534 bp, Glycine max
  Peptide Sequence Number=SeqID_179764
atggccatggaactagatcgcaaaaacaaggtcaaatctgatctcgaatccttcctcagagcgaaacggtactaccaccgcctcggtcgtgtctggcaaaagagcttccttctgtacggtacctccggcaccggaaaatcgagcttcgtcgccgccatcgtcaatttcctctcctacgacatcgacctctgccaaatccctagcgattcggatctgaaattgctcctcctcaaaacgacgccgagttgggctattaaatcggttatcactgccttgcaagcaaacggtgatggcagaaggtgcggcttgatcagacggaagacggaggatgatctaatggatgaaccatatggggttgtgtgcgatgaggatctccataagttaaggatttgcggaaactacgggaggatgcgtgaacggaacgtgaaaggacgcacggaagaaggatggaagaaagagagaggaggaaggattcaagagaaaaattatatattttgtaacggatttaagtctttcatatctttattttattaa

SEQ ID NO: 88080 - DNA, 2184 bp, Glycine max
  Peptide Sequence Number=SeqID_179765
atgccactgcgagccactgcgagctcttgtacgtctatctgcactcaattcaactcggagcttagggctcctgaacttcacacgtcgatttggagagacacatttgttaagagaacaggagggaagacctgcaaaacaaaggactatgacgctcaagctcgagaaagcgatagagagagaaatgtgcacaggcttgctactcgtgtgctggtgtattgtgttgagggttcgatgaaacctgcccctaagcgtggacgaatgttgtccgatgtcgggtgtggtaccctcgacaagtgtgagggaattgcaggtcgatgtggcttgtcaagccctcgagcctggacaagtgttgtccgggttgcttttgtcaagttatctgggatgggcatgtctttggtgtgtcaggtaaaggaagttctgattgttgtagggagcattgaagacacacgttacgttctgtctactactacgggcggtgcgtcatggtgcgaaaatttagggcaccacttctactcccgccagtattcattttctctgacaatgtcttcattcttgtttgattccttcattggcatggatgacggtgattctaggggctcaattgaacaacccatgatcaaccaagaggtcatctctattggtagttccttgtcgaaggatactcgctgtggtgcctccgacaacgagttcttctctttggagaggggtgcgaccttccgctattgttggggagcctgtccctgttactgtgatcctcatctcttatgcttttggggtgtgaggagaggtagcggcagtggagatgtaaaggcgtctccccatgtgcgacatagccatagaactgggtcgtcgtcatccatacttgtcatggttggctatgcgtgggtgaaactggcgaaccttgaggactaccgcaagttggtcgttcaggcttgtgggaatgacaacttccctttcttagaggcggcgtcgggcacacttggatatgtcctcttctcaactccacccaaacagttggccaatgctgactggcaagattggttgggtctccttgaacagcatttccaagaagctgtcctatctattgatgtcttggttgatggtttgtcactgatgttcaacagggacaaggagccccacttcccattctataggcagtttaaccctactaggttcaagtcgtttgacgaggatctactgacccctgtggagagggtcgacgaggctattttggagcagctatcgaccttgctggacacgcgggccattctgtctcttccttcggtgggacctacgggtggggctttgccaccacctgctgctattgctgctgccggagaaggggggttgatgcccggtgcgggtcgccctttgatcgtgcaggatgtgccttcagctctaccaattatcgaggctcctgctgtatctgatttaacctatgaacgaatgcgcaagcataagtttcatgcttctttggatgatgttgttactcctgctccttcacctccacttgttattgctattcaggaggccactcttgatgttgctaaagttaatgtgccaactactttggctagttctattgtggcaccatcgtccaccgttgttgcacctttgctaagtgccgatgtggcaaccactagggcttatgtggtgctacctccttattctttagctccaatgagaagtttggcgattctggaagagaatgaactacgacaccaggaggctttgcacaaggtggcatcctcggaggaggaggttgccaaatggagggctaacgtcatcatcgcctttgttgaggttgtaaggttgaactgccaactatcttccaaagttggtgggcatacgacgaagagggatgagcttgtgaaagtggttgctgatttagaggcccaattgaaggagtcagagtccaggctagaagagagagaggccaacaaggagcttgaggaggagctactcgtttacaagaaggagtccgtggagcaacatgaaaaaggatttaacaaggctatcaagcaggttgggttcttcactaaggaccttgacttgggtctctttgaccctttcaaggatgtgaaggatggtgtcttgcttgacaaggaggattttgttgcggaggagaagattgttaatgaggagcagggtgttgcgaagcaaggcaatgatgcccatgtctag

SEQ ID NO: 88081 - DNA, 346 bp, Glycine max
  Peptide Sequence Number=SeqID_179766
atgaggtcgctccatgaatcggccaagtacactactggtgatggaaccactactctcgatgccaatattgactacttcttatgctttcttcactttcaatcttctttgttagttatgtgttttgatctcattgactggattgttagaatcatattggctgaagcgagaggtgcagcaggagctatggatgaagtggacagtgagttgcctgaatttttaggaggtacttgtaaatgtgccaatcaaggaggacgtatcccgagggctgataaatctgctgtgaaaaaagttgatgagaaagcttccaagcctaagaacacgactgataaaactgcagcatcaacag

SEQ ID NO: 88082 - DNA, 513 bp, Glycine max
  Peptide Sequence Number=SeqID_179767
atgatttcctcatcgcacttgaggatacgtaggagcaagggcaacacccttgtcgaccccaaaaagctgccgtcccttgtgacgggcgcatggggtgctaataccttccccgtgcgtaaacaactcctgaaccctcattttcaaaatacgcagaccttcgcctttttggtttttctagagttttcctcaaataaatattggtggcgactccgctcgttttctcccttggagacaaacactttggcctattatcttggcctttttgcacccctgccgaagggtaggttacgacagtatttcatgcaaactaactttgcaaatgcatccccacaggaaatggctctgaagaagcttccagctaaaaggtcaaggaaaaatgccgctggagagggttccaatgcggccccacaggtggacgtggagtttgatggacacaatttctggagtggggaacaccagtgccgatttgaggcaatcaagggctggtcgttcctcaaggagaggagggtctag

SEQ ID NO: 88083 - DNA, 297 bp, Glycine max
  Peptide Sequence Number=SeqID_179768
atgactacagcatgcctcgcaggtgaagcggggtggccagaatggctagcgggcagggcaagtaccatagatggccatggctatactcgtggaagacttccgctcgaggagaagactaccatgtggaagagactcacacttgagggggagatgtgttgggttacaagtgtgagatatcatcttctttggatacttcgggtttggacattgaacaatgttactctcaatctggacaaattgcaaaaaaataaaaataatggtaaaaacatctacagaattggatatggcactgtatga

SEQ ID NO: 88084 - DNA, 375 bp, Glycine max
  Peptide Sequence Number=SeqID_179769
atgaaggaacttctacctcaaatggaagcacaacctctatcccgtataccaaagagaatggggttgccccagttgaagtgtgtaccaagcctcaactgccccattaatcttgggcctataaggcgtagaattatggtgttggatcttgaaatcctcacacatttccttcatcattttattgttcagattggtggcattatcagtgataatcttcctggagggtacatctacttggatttgactgagaacaagagagggtgcatctcttgtggatcagttctagtggagggtacatccactaggttgttcaaagagaacaagggagggtacatcccttgtggatctttgcttgtaaaaggatttttacaaggttga

SEQ ID NO: 88085 - DNA, 399 bp, Glycine max
  Peptide Sequence Number=SeqID_179770
atgtcgactcctgctaggaagaggctgatgagagacttcaagaggctgcaacaagacccgcctgcagggatcagcggtgccccccaggataacaacataatgctgtggaatgctgtcatatttggtcctgatgatactccatgggatggaggcacgttcaagttgactctccagtttactgaggattatccaaataaaccaccaactgtgcgatttgtgtctcgcatgtttcatccaaatatttatgctgatggaagtatttgtttggatatactacaaaatcagtggagtcctatatatgatgtggctgctatactcacatctatccaggatattctaggggaaaactggaggtggcaattgcatcatttattcagtaaccatccaatcagtccatga

SEQ ID NO: 88086 - DNA, 345 bp, Glycine max
  Peptide Sequence Number=SeqID_179771
atggggttcttttggttttatttccggcatggggtagttttgtacgtgaacagtgcgccatgcaggacccaaaccgccattgccaatggcgagtttggtgtcactgagcaagctgcaaatggcactggcgagacgtgcctaaaccgccattacaggtggcgatttgtacaagcccggaaccgccagtcaaactggcgagttcctttgagctttaaaggggagttgcaactgccattggcgagttgcctggaagttgcaactcccattggcgatttagggctcaaaatagccatcaccagtggcgattttatgcctatatatacgtttcagctgtgtgttttctga

SEQ ID NO: 88087 - DNA, 348 bp, Glycine max
  Peptide Sequence Number=SeqID_179772
atggtttcattaggtgagactcagattactcctaattgggtattgattctctcccctacaatgagtctcatacaatgcaatacagaacagtcaaaaccagccatagaaaaagtagaatccaatccagcaatacaaccatactggcaacattttcacaaaaaataccaagacacaactcaaaatagtggacatgcttaccttcaccaacactggaaaggtctgaaaaacccacgacttcgcctgcgtcgcggtagcggtggtgggagcagcgggtcacagggacaagttcttcacggcgacaacctaaatctcaggctggtagcgggacggacttcacggcggtgctag

SEQ ID NO: 88088 - DNA, 258 bp, Glycine max
  Peptide Sequence Number=SeqID_179773
atggctcaaattctcacaaaggtgatgatgcaatcctaccccccaagggtattggatagaagactccaagaggcttgggctagagctactaaagaaggccctagggttctcatgaaccttaggggggtgtgtgtagctaaggctctagcttctcatctcaaggaggtgagcttagctattagaggggaagcttcccaaggaagcttcttaaggaagtttctcaaggaagcttctcaaggaggtgatcttagttattag

SEQ ID NO: 88089 - DNA, 375 bp, Glycine max
  Peptide Sequence Number=SeqID_179774
atggcaaccccgtttaaaacaaaagatatcaatgaggaagtaacctctgaagatattaaaagcctaatggaacaggcaaactacaccaataaatatttacaaattttaggagaaaccattaaaactaaggtagttcctaagcaaaaatcggttgaagaagcctctcccagtattcccattgaaaaaccactgttcaaacctttcaaagttttcaatgttagtgagaaagctaagcgaaagattagagaacttaggaaaactaaatccttagttgaaggagtaggtgacaatcatagtgaattactaaacaagattggtagtttacttaaggtcattccggaaactccccaaacctcggaaaatacttccaaaatg

SEQ ID NO: 88090 - DNA, 318 bp, Glycine max
  Peptide Sequence Number=SeqID_179775
atgaagatgagactcatcaaaatggtttctagtgatgcacgaatacacaaggaacggttcttaataaattacaatattaacatgtctctgtcgcaacgtgcccttttgcgggcgagcgaaggcgaggctcacaggtgcgctttccaaaggaggaaagatgcgcggagtcgccaccaacgtttatttgtggaaaacgtcggaaaaaccgaaggaaaccggtcaaaaatgaaaattctaagttcgggagttgtatttacgtttgaggaaggtattagcacctctcacgtttgtctcgaaggacaacagcctattttttag

SEQ ID NO: 88091 - DNA, 159 bp, Glycine max
  Peptide Sequence Number=SeqID_179776
atgtggggttaccttcccggatctctgccgcagaggatgccactgttgatgctggttctcgttagggttccgccctctggttactcttggaaggatgtttgcggtggtggttgtggattcgccatggctatctctggaactactgcaaggttgaaatag

SEQ ID NO: 88092 - DNA, 114 bp, Glycine max
  Peptide Sequence Number=SeqID_179777
atggaggcacatgatgttgatgtgggtaccactgttgttggagtcaaagacggggaagaagagatacattataaaagaatgagatatattatgcaaatcaaagagcttcattga

SEQ ID NO: 88093 - DNA, 198 bp, Glycine max
  Peptide Sequence Number=SeqID_179778
atgacgtactggatgacctttcgctcagcgcgcatgcacaactcatccttcttccagattcttcctcgtgctcagccgaggagtgttgcgctcagcggatggctcactaagccagaagattggcttagcaagaggatgaaagttagcacttcacaaacttgcctaattaacctgaaattgagagaaaatgattattaa

SEQ ID NO: 88094 - DNA, 198 bp, Glycine max
  Peptide Sequence Number=SeqID_179779
atgtttgcttacagtcctttcgctaagcgcaagcctcgtgctaagcacatctttgttcatgcgctaagccgcaaatctcaagcgcttagcaatcaacccttgcatctgaggcttatttgctccgctaagctggccaaggttgagctaagccaacttcaattcgatatgaattcggctaagctgcagcctgatcagtaa

SEQ ID NO: 88095 - DNA, 300 bp, Glycine max
  Peptide Sequence Number=SeqID_179780
atgtttctgattctcgctaaccgaaaggtgttgttcgacaccggtttctgcacaaggcaaaagatcattcgacgttttggtcaaggatggggaaaatacccaagggaggggcaaaagggtcattttcagcaattttctggaccctggctcacccaggctagcctttggctcgcctgggcccccaaattgcttaggggtgaaggaaccagcttacttcaggatgaagcatcagctcgcctgggtgagctgcaagtccaccaagttcccttttttgctataaataagcgtgagggaggctga

SEQ ID NO: 88096 - DNA, 490 bp, Glycine max
  Peptide Sequence Number=SeqID_179781
atggttggattgaatgatcgtgcgatagctgatgctcttcaagccttagctcaggctatagggaatccaaataggggagaagctggtggagctattgagtaccaaggggaaattgagaaaattttccgagttatggcatgtccggaggggcaaaaggaacaagaaggagatggagttcttggagtgaagcaagctatgaattaccaaggtccaatgaggattaaaaagaatggaccacaacatcggggaaaaccatacttgacccctcctaagcaatatggtaattgccccaacaatcaaaagactgttgctatgggatttgctggtggtagtggtagcaaacccagacatattcaaagagattgtccacaccccatgaaggagaaaaatggtgggggcctgaatggtcaaactagacatccgaaggccactggaagactctttacccttaatggtgctgaagcttcaaaatcgaaagatctaatccaag

SEQ ID NO: 88097 - DNA, 324 bp, Glycine max
  Peptide Sequence Number=SeqID_179782
atggataatgaagagggcgtgcaggaacagatgaaggccgatctatcagccttgaaagatcaaatggcatccatttcggaggtcatgttaaaactccagaaaaccatagaggataaagccacggcaaccgcctccagtacagttagggaagcggagccggtgctacagcccgccttgaatccgggcctagacagaaacacggccgtgtttggtcgaaggaagggaccaatcactagaaccatgagcaagaggctccaagaagattgggctagagctgctgaagaaggccctagggttctcatgaaccttagggtagatttctga

SEQ ID NO: 88098 - DNA, 339 bp, Glycine max
  Peptide Sequence Number=SeqID_179783
atgacgaaaggcaacgatggtacctcaaagccttacactggggcaatgaggggcaccgtgcatgagcctcgagtgaacataggggccgatcaaaaaggactgcacgtcctcgccttgagagggctgcacgccctcaccatcagaggactacacgtcctcgccttgagagggctacacgccctcaccttgggtactagttaccctcaccgtcagaggactacacgtcctcaccttgagaggactacacgtcctcaccatcagagggctgcacgccctcacctccagaggactataaatcctcgccttgagagggatacacgccctcaccttgggtactag

SEQ ID NO: 88099 - DNA, 288 bp, Glycine max
  Peptide Sequence Number=SeqID_179784
atgcgcaatcttacctctgaagaatgttcaatcatttccggtgcaggagatcgcagcggtacattgacggtttccgcagaaactgtcggcgcagcgatcggcggcggcatcggctctatcggtggcgtggcgggcggcgttgtcggcactattgtcggcggtgctgtcggtaactatgtcaccggcgatcgtgcccccggctcagttggcccatcaggcattccctggggcgggagcaacggcggcggtaccatgtgggggaacaacaacaataccgattcgaactga

SEQ ID NO: 88100 - DNA, 209 bp, Glycine max
  Peptide Sequence Number=SeqID_179785
gaggttgcagcatttgtggtggagctcatgagtctggccattgcattcccattgatgattctgctcaagaagtgaactacatgggagggaataagcccaggcaagcaaatatagagaaaaatccaaaggaagaatgcaaggctattctgacccgcagcaggacggcagtcatggaggatgaggaaagaaggattgaggataccaaatag

SEQ ID NO: 88101 - DNA, 860 bp, Glycine max
  Peptide Sequence Number=SeqID_179786
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttaaccatagcagaggtgtccatagaagccattgcatcacttacccaatactacgaccagcccttgagatgcttcacattcggggacttccaattggtaccaaccattgaagaatttgaggaaattctaggatgtcctctcgggggaaggaaaccatatctttcctccggtgtctccctctttgagcagaattgcaactgtggtcaaggattcagcaagaggtttggaccgcataaaacagactcggaacggcatagcgggcctaccacggaagtacctagaagacaaggcgaggggtatggccaatcaaggagattgggtcccgtttatggatgtgttagctttgctaatttttggggttgtcctctttccaaacgtgcgaaaaaagtagcgcacggatcatctgttgcttgcccaccctctgtgtttggttggtttcacacctgttccagcaagacacgaggcatccatgtccgctccagagccatcgctcgtgaaggaaaggagggagtccttttctcatgtggagggtacccaaacattccgctgataggaacgaggggttgtattaactacaatcccgcgctcgctataagacaactagggtaccccatgaggggagcaccgacggaagaaagcatgtctcctttccttgtgagggatttcggcgcacgaaatttcaaggctatacaagcaatccataaggcatgggaaacccc

SEQ ID NO: 88102 - DNA, 477 bp, Glycine max
  Peptide Sequence Number=SeqID_179787
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgcacattagcatggcgtacttctcctgtttgaaccggggtttgaaaccaaacttatcctcagaggatagatggggcgattcaggtgagatccaatgtagatccaactttctcttcactcgtgggatccggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 88103 - DNA, 834 bp, Glycine max
  Peptide Sequence Number=SeqID_179788
atggcgtcctcggtggcgacgccgctggagcgcgcgctgggccgcatcgccggggttaacgaaatgacctcgatgagctcgctcggcagtacccgggtcattttgcagttcgatctcgatcgcgacatcaacggcgccgcgcgcgacgtgcaggcggcgatcaacgccgcgcaaagcctgctgccgaccggcatgccgagccgccccagctatcgcaaggtcaacccttccgacgcgccgatcatgatcctgacgctgacctcggacacctacagccaggggcagctttacgatttcgcctccacccagctggcgcagaagatcagccagaccgagggcgtcggcgacgtttccgtgggcggtagttcactgccggcggtgcgggtggagctgaacccttcggcgctgttcaatcagggcgtgtcgctggacaccgtacggcaggccatcgccaacgccaacgtgcgccgcccgcagggcgccgtggaaaacccgcagcagcgctggcagatccaggccaacgacgcgctgaaaaccgccgaggcctaccgtccgctgatcgttcattacaacaacggctcggcggtgcgtttggccgacgtggccgaggtcaacgactcggtgcaagacgtgcgcaacgccgggatgaccgacgccaaaccggcgatcattctggccatcagccgcgcgccggacgccaacatcatcgaaaccgtcgatcgcattcgcgccgaactgcccgccctgcaggagaatatcccggcctcgattaaactcagcgtcgcgcaggatcgttcgccgaccattcgcgcgtcgctggccgaggtggaacag

SEQ ID NO: 88104 - DNA, 196 bp, Glycine max
  Peptide Sequence Number=SeqID_179789
ccgatgtgatgaggacaagaacaagggcaaggatccacttgaaggacttggaggacctttgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 88105 - DNA, 162 bp, Glycine max
  Peptide Sequence Number=SeqID_179790
tattttaataatgttagaccattggaagcagagagattgaaggcgcttcacatccagtgtggaagcaatgccttccaagattattttgatgatgccaaagaatcaagagtcaagcaagttccaaaaaatcaagagtcaaacaagtttcaagaatcaagatga

SEQ ID NO: 88106 - DNA, 342 bp, Glycine max
  Peptide Sequence Number=SeqID_179791
atgattttgaggggccaagacatttatagtagccaagatgaggctactacttcaccttcctctagtgaaagtgaagaaggaaaaggggaagaatctagtgaagaaatctacccccaagaagaaggacagccattagtggttaaagagaagtgtaaggaggtaagtgtctcctccaagagtttaactaagaaggaaactcattttacaataaagacaaacattaaagaaactttccctcttagacaacctccacattttctcttttgtaaaaagacacttgttagcactgccacacctcttgggcttgaggttattcctcaggtgttgagggaagaagcctag

SEQ ID NO: 88107 - DNA, 360 bp, Glycine max
  Peptide Sequence Number=SeqID_179792
atgttaagtcaggtgcctcctcttcccctcattttcatttttctcttttctccactcaaaaccctttctttttcccatagcccaccaaacttgtctcagaaaaatgacgatctcggatccgttcaccgttggatcgtcgtgaaatttgagcaccacgttcgcaacccaatttcaagcattctcaccgttgggaatttcgacatcatgtttgagatgagagaaatacctttcgcattttcgtggttcagttcctcacaccttcacccttgggatttgcgagataatagtcacgcagagagaaaaaggaatcgcaccaagacagtacaagcggaggcttcaatcccttctctgtctctctga

SEQ ID NO: 88108 - DNA, 482 bp, Glycine max
  Peptide Sequence Number=SeqID_179793
aggcaagcaagctcgttgacacgcagaaaccatcatggtcgtctgcaccctttgccgaagactcaatgtctatcgaccaagactactttagtctctccttttcgtcatccagagataagcgagtccgatgacacacccgagactaccttagtctctcctttcgtcaaccagaggcaagcgagctcgttgacacgcagaaaccatcatggtcatttacaccctttgtcaaagactcaatgtctatcgactgagactactttagtctctccttttgccatccagaggaaaccaagtctgatggcatgcaaagaccatggtgttccctttgctatccagagacaagcgagcccgatagcatgcggagacaaacatagtcgtctgtttccctcatcgaaagactcaacatctatcgatcaaggctaccaaagcaccaaggcttttgctgatgcacctaatgtcttttatgctccttcttttgacag

SEQ ID NO: 88109 - DNA, 399 bp, Glycine max
  Peptide Sequence Number=SeqID_179794
atgtataccaaggcaggatttcgcccggactactgcagggagacgggtgcggatcatgtgcaccagcataaccatccttacacagatatggatgatgttactactcagcaacatcctgcccaggacggtgcctacgagacaccctatggacccagagaggtccaatggggccctggggttcctagctttgatcacgggcctctgccagatctacggagtgcccgtcgccgccagcaaggtcattcggcctcccattaccaaagccttcatcgagaagtattgcatccccaggcaagtgcaggactaggcaccgcagcagcccgaggaggatcagcagccagcggcaaatgcgccactgccgccacgagaggaggcatcgtctttgagatccctctctga

SEQ ID NO: 88110 - DNA, 1302 bp, Glycine max
  Peptide Sequence Number=SeqID_179795
atgggatcaaatcaaacacctctactcaagaaaaggttctatcaagtcaaaatcaagagcttagaggtcaccagtttacaagagttggggcaattgatgggtcaacttcaacagcaagccttccgcaaagcctatggtaagatttgggacttagctacgatagaagtctctgtggaagtgattgcatcccttacccagtattatgaccaacccctgaggtgcttcacatttgaggatttccaactagtgccgactatggaagagtttgaagaaatcctgggatgtccactgggaggaaggaagccatatcttttctctgggttctatccctccatcgctagagctaccaaggcaaaggccttggaaaatcaaggggaatggacttcttttattgacatcttggcgcttttgatcttcgggtttatcctctttccaaatgtggaagggttagtggacctagcactattgacgctttcctcgcctttcaccatagcaaggaaagcccggtcatcgccattttggccgacatggatgacacgtttgaccggaggcccgtttgttcgctacaaggtcatcgctcgtgcgccgagaaaggaaaggcgaattgggaccaactcttacctagcatggagggggcgtccgttaattggttccctcgctggaaggaaggaagaaccgggattatgtcctcgtgcgaaggatttccaaataggagcaccatcagagaaaagcatcatgcctttcatcgcacggggtttcagtgaccccaacgcaagggtacttcaaggagttcgcaaggcatgggatgcggtgcgaaggaaggaaaaagagcttaagggaagcagtaatgggatcatcggcaattatcgtaggtggctgagagttcagacacaaggattagattggctaccaaagctaaaggctgcgagagacgaagaggctaaagctctggaagaaagtgaggaggtacaagccctaaaggcggagcttgaaagagtctgggcagtcaaagtgaagttcaagtcaacggccatcaaaatccgaagagagtacgatgaactaagggacatcaatatggccaccaccgaagccttggaacgagaaaccaaaagggcccaaaaggaagaacatggccgaaacaagtcgaaaagaaatttgtcccaacagttaagcaagactgaagggaatatgtgggtcatcatcaatgagtataaggaaaagctaaaccaagcggtgactcacgagcaaaggctagaggatgagtacaccaagatatcagcagaaagggaagcaagggagagg

SEQ ID NO: 88111 - DNA, 548 bp, Glycine max
  Peptide Sequence Number=SeqID_179796
atgatattcaacaatagcaaaggacctcctacaatcataatacaaggccaatcatgtcacttgatcgacatcatgttacctgtgttcgatagtgctccaatgtttgcgcaactttatatctatgatactgagaatgagatacaaaataggattgaaggttcaagaaaccgctccctcgacacccacattgtcccacattgttttcaatactgccggaaacccctcgctcgaacctacagaaccccctacactgctcttggaagtgtggctcgaagaaactttacatacactcttggtactagggtgctgaaacactcgtgggtgctcaaagctcaaagctttctccgcgaggtactattgctgattgaggtacgaggaaagcttcaagtttcatgccattttgttagatctcactgccattgtcactgtttgggttcgagactacttggagcaccagtagcgataactagtgataaggatcctgttattgttcataacaagttactgacacttcttgtaattattttgaagtttggggcacttgtttg

SEQ ID NO: 88112 - DNA, 1170 bp, Glycine max
  Peptide Sequence Number=SeqID_179797
atggttatgtcagcagccacttcaaataacaacaacatccatcagttgcaatctttcaactctcagaacaacaattaccacctttgcggcacatccttctcttcgtacttgaacaacaaagaagacatcctggcagaatcaggccatggctatgtcagcagcagaaaggatcctcttggagtaaagaaggaagatgatggagaaattggagtatttgaagctgaaaagtacttcaatggagaagagattgaaagccccccaagagttgctgataatgatgcaaacaagcaccggccccaaaaagatgaacaaacagctcttgtaaccagaaagtacaaagttcagaatggaactccaagtgtaaggtctgaatcaagcttgaatagccaaagtgcacttttgcaaagtgttgtgaggaactcctcaaggaacatgaaaagcaaattgcataggaagagttttctagctggtcttggttgcaaatgctattgttctgacaagaattctgttgatattagtcaccatgcaggtgaaatcagtttcagcaaaaattctagtcacggaaaaataacttcaagaaatatgttcaatgctgatccagaggctaatcattcagttaaagttactaggcctcatgcagccgaaatctcgattaacaaagatgtttacttccaaagcccagagaagttaggggtgggattgagcaaagaaaacagtttagcactctcaagtttgaattctagcccaggaaataattcggcgaaaatgaaacttcaacaagtagagaagtcaaggaattcattggaagtgtttggctccccaatattgagtagcaggagcaagtctttgagctttgataaaaagttggtaaagacctattcctcttcttgggatgctgctcctaaaattgaagaaattgacttttcagcaaattctggtggaaactacaatgatgctaatagtgatgcaagttcagactttaatgtaaatattgatacggagaagaaaaagaatagtttgggcataaaaattgttgctgggataacacctgctgcttctgctttagcaatatctgcaataatcattttcctgatttctagaagaaatatgaaataccagaagaagattttcaggaaacgaatgtgtaagtgttctgaggctttatgctga

SEQ ID NO: 88113 - DNA, 198 bp, Glycine max
  Peptide Sequence Number=SeqID_179798
atggggtacaagctgtgggtagaacgtggcgggaaagaagtttctttctctcaaactccttctctccctctcttctctgaacctgtgtttcttcttctccacgaatttcaatctcctcgtggggtacgcgcagtggggaggttccctagccctcgaatgctaggtatcgttggtgatttcattgagcacaaggtttga

SEQ ID NO: 88114 - DNA, 546 bp, Glycine max
  Peptide Sequence Number=SeqID_179799
atgtctagaatttctagagagagaaaggtccaagttccagagagttttgagagattttgctatgtgaagatctgtagagaccagagcttgaagcaggagccgtatgcctttaccttgatcacgcagatgtatgctttgttagggtcattcaatagtggaaacgggtctgactctaaagtccttgatagtgcagggctaagttgtcgtactttcacgaggaatcgggatagtttatacgcctgttcatattcacacttatttttacacaccaaacatctatttgctgaaatagcttaccaaataacacaagttccccgagagttcgatactcggttcttactgttttatactacttgtgcgatccggtgcacttgccggaagccgaacaagagaattattccaagactaggcttagatcatttcattcaggaaggccggggccaatttggaggaatatggtgtttatggaaatctaataggtggaatgttgagattattcatcatggccaccaactcatgcgcatgaaagttggttggaaaaattag

SEQ ID NO: 88115 - DNA, 138 bp, Glycine max
  Peptide Sequence Number=SeqID_179800
atgcatctacgtgatcaaggtggccttgttcgtgctcgtgcgcttagcgcaattatggaccgcttagcgcacatcagtgaatttcggcttagcgcgtgcctttctcgcttaacggatgaactgaagcggtgcgcttag

SEQ ID NO: 88116 - DNA, 156 bp, Glycine max
  Peptide Sequence Number=SeqID_179801
atggaggaagttgtaccaatgttgcaagttccagatgaagaggtaaaagtgattcagcaggttgaggtgtgtttcaccattggaaggtacaatgataaggtgttgtgcgatgtggttccaatggaggcaactcatatactgttgggaagaccatga

SEQ ID NO: 88117 - DNA, 451 bp, Glycine max
  Peptide Sequence Number=SeqID_179802
tatttatgagaattttttgagggagctgaatcccactgcatcggatgctcaacttaaccaagacattccatccaactttcctacatggttcaagcaatatgtagataaaaaatatgagattgttgaagtaagccaatcaaacaaatatactaaagcatacgacccattcatatttgcacaacaagcagaacaagtttatttcacaacatatcccgagggacatcaaggatggttacccgtaatgaagacaaaagctcgccgcagaatcattgacaatatagtaagtgaaactgagcaagaggcttcataccaagatcatgagcttgtagggcttcaagaagtgttggaagttgaccctgatgtcattaatgaatctcttgtagtgaatatgaaagagaagataaataacctattttggtgtagaaaacatgtttatgtgagttttcattaa

SEQ ID NO: 88118 - DNA, 504 bp, Glycine max
  Peptide Sequence Number=SeqID_179803
atgacggaagggtgtgatgaagggttttgccttgcaaaccttcccggtgatgcttttagtctatggggaaacttctttgaggcaaagaaacaaatgatggctgatgccaagtttgcggggctgcttggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 88119 - DNA, 180 bp, Glycine max
  Peptide Sequence Number=SeqID_179804
atggcggacgtgtacttggctcccgaggaggcagtaaacaccataactaaacacactttcaggcacccctatcgaacccattccaaaactagagtcatgggtgacatagaagaggtacaagaacaaatcaaggctgatatagaggccttgaaggatcaagtggcttctgttagtgcttag

SEQ ID NO: 88120 - DNA, 141 bp, Glycine max
  Peptide Sequence Number=SeqID_179805
atgggggcgtattcttgcggacgaaaagttgttggtccatttctttcaagacagcttggccagagcggaactgtagcatggcagtacccagtacaatacggacatggctcccgatcggaaccagctcagagtattgactaa

SEQ ID NO: 88121 - DNA, 306 bp, Glycine max
  Peptide Sequence Number=SeqID_179806
atgcccctctattggtggactttcccttgtttgaaagaacgaaggattcatggggatcctccagtagagtattggaatgatcttaagagtgcccttaggaagaggcacattccctcctactatgaaagggagcttatggacaagctccaaaggcttagacaagggattcccatggaggcaggacatattcttttaggaaggccatggcaatttgataggaagatcatttaccgtgacctaactaatgaaattaccctcacccatcttggcactaaatttgtgttgcattctcaaacaccttcatag

SEQ ID NO: 88122 - DNA, 762 bp, Glycine max
  Peptide Sequence Number=SeqID_179807
atgcccgtgaaaagctcaatgcgctggatgtggaagtgtgccactggaatctgcattaacttcgaacccgaacggtttgatggcccgtttacctcgactggcccatgccgcaaaacggctccggaaagcttacgtatcggctatcagaaaggcagcgtcagcatggtgctggcaaaaagccaccagcttctggaaaaacgcttcccggacaccaaattctcctgggtggagttccctgccggcccgcagatgctggaggcccttaacgtgggcagtatcgatctcggcagcacgggcgatattccgccaatatttgcccaggcggcgggagcggacctcgtctatgtaggcgttgagccgcccaagccgaaggccgaggtgatcctggtgcctgaaaacagcgatatcaaaagcgtcgccgatctcaaaggccataaggtcgcattccagaaaggttccagttcacacaacctgttgctgcgtgccctgcaagaggccggcctcaagttcactgacattcagcctgtttacctgacgcctgccgacgcgcgcgccgcgttccagcagaagaacgttgatgcctgggccatctgggatccgtactactccgccgcattgctgcagggcggcgttcgcgtgctgaaagacggtaccacgctgaagcagaccggctcgttctatctggccgcgcgcccttatgcggaaaagaacggcgcatttattcagggcgtgctggatacctttacccagccgatgccctga

SEQ ID NO: 88123 - DNA, 191 bp, Glycine max
  Peptide Sequence Number=SeqID_179808
cgaggcgaggctcacgggtgcactttccaaaggaggaatgatgcacggagtcaccaccaacgaaggtattagcacctctcacgtcgacaaaagcggggctcttgctcctacgcaccctccatcgaagagaaaatcagacctacgtagttctttttttaagggtgaatcaagcaattctttttacttggaag

SEQ ID NO: 88124 - DNA, 303 bp, Glycine max
  Peptide Sequence Number=SeqID_179809
atgctcgtcaggggggcggagctatggaaaacgccagcaacgcggccttttacggtcctggccttttgctggccttttgctcacatgttcttcctgcgttatcccctgattctgtggataaccgtattaccgcctttgagtgagctgataccgctcgccgcagccgaacgaccgagcgcagcgagaaacagctatgaccatgattacgaattcgagctcggtaccctgagcatctcaaaatatcatggggtgtgtcagacacaaggtacggtgatattccaatcagtttgccttcagagttaa

SEQ ID NO: 88125 - DNA, 189 bp, Glycine max
  Peptide Sequence Number=SeqID_179810
atgtcccatgtcgtcaaggacaatcgagggaaatgggccccgaactacgaagggccttttgttgtgaagagggctttttccggaggagccctggggcaggatcgtcttgagctaccttctggggtggggacaaaacatggacagcagaaaccaatcaaggtacttaggaacggatgcaagtggggatga

SEQ ID NO: 88126 - DNA, 282 bp, Glycine max
  Peptide Sequence Number=SeqID_179811
gagctagcatcaaagctttgtatcccatggcgaggatttgttcttaacgctgagggagcaccttggaagcttctcaggaaggacctcacgactcttgctcagaccttgagttttctatcatattctaacatcgcccctacttctcacacgtccgatcttaatatggacagggcgagattagtttacggactggtgatgaagatggacatggatgtgggctccatcatttctggacagatatcacagatggtccagtccaactcctctcggcttggctgttag

SEQ ID NO: 88127 - DNA, 1278 bp, Glycine max
  Peptide Sequence Number=SeqID_179812
atgcctgccgccgcgaatggtgttatgttggtggcgttacggatagcgacgggcaacgcaatgaccagcatacgcggcatgattgaatcacaggtcctgggtttaaccgggatggcgttaaaagagattgattttgaaaacccgaagggcgagccgggcttatttggcccgcggtcggctatctggcaggtacacggcgactttacctcaatgctctgcggcggcattagcgcgctactgttacagatgctgcatccgctggcgctggccggtgtgtgggatcattcgcgttttcgtgaggatatctttggccgcctgcgtcgaaccagtcaatttatctcagccaccacgtttggcactaccgacgatgccgaaagattaatcgctaaagtgcaggggatccatcagcgcatcagcggcgttgcgccggacggtacgccttatcgcgccagcgatccggcgctcttaacctgggttcatgtggccgagtgcagcagctttatggcctctcatctgcgttataagcgcaccatcgtcactgccgcgcgtcaggagcaatactaccgcgaagcggcggaggtcgcccggcgacttggcgccgaagacatccccgaaacgccacgaagtggcgcaggtgctgctcaccacccgtctgccgggccggctaagccagccggtagggcgctggatgatggttgcgggtatcgatctgcttcccgattgggcgcagcagatgctggcgatccccatcaatccgctgcagcggcgaaccgccagagtggcggtcaatggcgtggcgcgggtacttcgcgcctcgggtcgcaagggcttattgccgatggcatccactctcattccgatttaattgctgattttgtggttctgattgccaataagaaaagccgtaaaccttccgacagcgatcatcattatggccactggcgctatgaaaatggcgcgtcgctgatattgggcgcgattttaatagttgtcggtgtcggcatgttgtggtcggcggtggataaactactccatccggaaaccattcaatccgtgcatgtaacggcattatgggtggcccttgcagcgctgatcgcaaaagagacgctgttccgttatatgctggcggtagcaaagcgcattcagtcgtcattattaattgccaacgcctggcatgcgcgctcggatgcggcgtcgtcggtagtggtggcggtagggatcgttggtaacctcgccggtattgtctggttggatcccgtggcggcattgttagtaggg

SEQ ID NO: 88128 - DNA, 135 bp, Glycine max
  Peptide Sequence Number=SeqID_179813
atgggtttgtcaggcttaaaggagcactcaaacccgatgacccccaaggcctacactccgaagagtccgtcagggtctctccctcctgattcaggtccaacccctaaaatcattttagcacacagacattgctag

SEQ ID NO: 88129 - DNA, 324 bp, Glycine max
  Peptide Sequence Number=SeqID_179814
atgatgacttctaggaaaagaaagtcaccatctacacccacacaagttagatttgatagatcaagatttacttcccaagaggcttgggaaagatatacagacattattgtgcctaggaagcttctgccagagaggaacgtggtggtctattatacaaaatttgatgagttcaaggaggaacttgaaagacaccactgggacgaggagttgactgactttggggatggcaacattgatgttgccattgtgaaggaattatacgccaacctctatgaccccaaggacaaatcacctaagcaggtgagggtgaggtcatcagattaa

SEQ ID NO: 88130 - DNA, 735 bp, Glycine max
  Peptide Sequence Number=SeqID_179815
atggctccgaaaaagcttttcgtgaagaggtctaggagagacgccgcggctgaagggaccagtgccggccccgagtttgatagccaccatttccagagcgccgagcaccaacagcgcttcgaggccatcaaaggatggtcgttccacagagagaggcgtgtccagctcagggaggatgagtacacagattttcaggaggagatagctcgccgacattggacgtcgctggtgactcccatggctaagtttgactctgaggtagtcctggagttttatgctaatgcttgggccacagaggaggggagtacgagacatgcattcatgggtgagggtcagaggaggaacaaggccgatgggttcgacgaggaggccatttcccaattgctatgcacaccggggcaagattttcgcccggaccactgcagggaggcgggtgtggataatgtgcaccagcatgaccaccttgacccagatgtggatgacattgttgttcagcaatgtcttgcctataagggtgatgcacctcaggccgcaaacgcaccgccaccacctcatcaggccgatcccgctgggtcactaggcatggagcgttatctgcagcacttggttcgccagcagggggccaaccaacgggggcaggggcagggtttcgctccttttgcgtgccctactccagagcagtttagggctgaggtcgcacggcccggagattggcctgaggcccaggcaggggag

SEQ ID NO: 88131 - DNA, 430 bp, Glycine max
  Peptide Sequence Number=SeqID_179816
gttccttattccggttgttaagcggaagaagagggagaaagaatgggcacagccccacgcccgcgttttcgacccgaaaggaattgaaaatgaaacaagaatctgtgttcactatctatggagcggagtgactatccttaatctcctcttccctatctcccccttgcctttttttctttttctcgccggcagacccagacgtagagtcccgtcggccgcccgccctacagataggagttcctatctctactgcctatccaacccgaagattcttattcatggtggagtgcttcgagtaggatccgaccccatcccagcagtcaaactccttcctgacccggctcacctgcctctgaagctggaatgcctttcttttatagaggaggctacccgaggaatcgataagtttgaagtgggatgtggaatgtga

SEQ ID NO: 88132 - DNA, 189 bp, Glycine max
  Peptide Sequence Number=SeqID_179817
atgtccgccagggtccagcctatagccttcttatgcttcttgagaactgacaacaacttctcctcttgctcatcagcaagggaggcagatataatcactggaaaactcttgctatcatccaatggtagaaggagatggtttctcagcctttacctcataaagaaagtcagaggtatgtgtacttcctga

SEQ ID NO: 88133 - DNA, 210 bp, Glycine max
  Peptide Sequence Number=SeqID_179818
atggaggttgaggaaccttggttggggttatggctaccactgagttatcgagtggatatgggatcaagtttagcatatgacaacggaatttggggctttgtggttgatttagggatggcctttatggataactgggtggtgggtaaggaggaggtttgttatgggttgagtaatgacattgttaggttggtgggaaacttggccgtatag

SEQ ID NO: 88134 - DNA, 201 bp, Glycine max
  Peptide Sequence Number=SeqID_179819
atgtggatggaccgatttgctcttaccttgaacgggagtcaagaacttccccgattgatagctaaggccaaagcgatggcggacacctattccgcccccaaggagatccacggacttctcggctattgtcagcatatgatagacttaatggcccatatgaaaccgctaggaagtttgtattgtcactcagatcttgactag

SEQ ID NO: 88135 - DNA, 525 bp, Glycine max
  Peptide Sequence Number=SeqID_179820
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccagttgcgatcttgctcaaggagggaagaaacccggagaaaagatacggttttctccccccaagagggcatcctagtatctcctcaaactcttcaatag

SEQ ID NO: 88136 - DNA, 231 bp, Glycine max
  Peptide Sequence Number=SeqID_179821
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggactttagcattgggaaatgtactgtttccttagaacttgataaagcagggactgaataa

SEQ ID NO: 88137 - DNA, 93 bp, Glycine max
  Peptide Sequence Number=SeqID_179822
atggcccctaatgatacctctgaaagctcattccaaaggttgaggcaagctttagctggaggtggattctcttttagtcctcaaggctgttaa

SEQ ID NO: 88138 - DNA, 748 bp, Glycine max
  Peptide Sequence Number=SeqID_179823
cgctgctcatgtgtcctccaccaacgagtctggagtcgcgcgaagttattgcgtagtgttgttcgccaattctccgttctccacttttattcagagacccatgaattcattgcctaatgctgttcatgtgtcctccaccaccgagtctggagccccgcgaattgattgcctagcgttgttcgccaattatccattctccaatcttattcggagacccatgaattcattgcctagcgttgttcttgtgtcctccgttatcaagcgcggagcctctggtgactgggaaatatgtttttctgttattttccggatcggttccttcgccaaacataaaaaaaaagaaggagtacagacgagagtcgtgatcacggaaagggcaggacggacgaaatcagtgtcttatctttgctttcctcttatctccgatgagagatacttggcaccctttgttgcacaatatgtgaagtcccgagacgtgccgggaaatcaaaaggaagcaggttacgcatccgtggaattccgtaatgtgaacggaaaccaaaaggaagtattttttcgcaatccgcccacttgggccttccagattcttcctccagaaggtggttgcttctggaggaagcaacctggctcgcctggaaaatccaagccgaggcgcttccgtaacgtttccgtgagtaattacgcgaagattttcaaccgttcttcgacattcatcgttcgttcttcatcattcgtcgatcttcaaccg

SEQ ID NO: 88139 - DNA, 246 bp, Glycine max
  Peptide Sequence Number=SeqID_179824
atgagtgaaatagaggaggtgcaagagcagatgaaggccgacatggaggctatgaaagagaaaatgaccacattgatggaagccatgatgagtatgagaaaaatgatggaggtcaacacagatacagtcgtttccgcaagtaccgccactgaggttagggaggcgaagcattgggaagtgcgagcaacacccattttatgtaggtccaaagcaagcattccttcccaccatatggcttactcccaa

SEQ ID NO: 88140 - DNA, 207 bp, Glycine max
  Peptide Sequence Number=SeqID_179825
atgcctactaggatgacattacaattagcaaatcgctccatcaccagaccttatggagtgattgaggatgttttggttcgggtcaagcatcttatctttcttactgacttcgttgtaatggacattgaggaagataatgtttgtttacaagtgaaggagattgatgagaaggttctgaaggagagaaccaagattgatccaggataa

SEQ ID NO: 88141 - DNA, 315 bp, Glycine max
  Peptide Sequence Number=SeqID_179826
atgagtcataactcttgcaagagtataagtgaagaacttagtgactactatagaggaaggcataggtcacatcctagacctcactcccataggagagaaaaggaaagaaagcctcaagaggctaacattaacctctcatacttccatgggaaggacaatgtaggggcctatttagattgggaaatgaaggttgagaaactctttgcttttgccatcatacaagtgaggaaaggaaggttcccttggctacccatagcttccaagggtatgccctatattggtggacttcccttgttgggaaagaaggattcatag

SEQ ID NO: 88142 - DNA, 222 bp, Glycine max
  Peptide Sequence Number=SeqID_179827
atggcagcggaatggagaaggaagagagagaggagacaccacttcaaggaaaagatgagtctagaagaagctcactgccataggaggccatggataagagcttggaggaagaaggagatgatgacgggaaaggaagagaagagcacaaacccactaatccaatatcaagtccaagattctccactaagtgtgcttaggtgtcatgaggcatgtaaagcatga

SEQ ID NO: 88143 - DNA, 303 bp, Glycine max
  Peptide Sequence Number=SeqID_179828
atgtcatatgctgacttactcccctatctgctcgataatgcaatggcagtcataaccccaacaagatttctcaaccattgtttcccagaggatacaaccccaatgctggctgagattcgaggaggagaatcactcgtgagttatgatgtcgccaggcaatactatataacaatagataccttagagccctacactggggcaatgagaggcaccatgcatgagcctcaagcaaacctaggggcagatcagaagttttcacccgataggtcgaaaacccgaaagggtggcctaggcaaaaattag

SEQ ID NO: 88144 - DNA, 438 bp, Glycine max
  Peptide Sequence Number=SeqID_179829
atggaacaagaaagccatgggcaaattcaaacagccactttagactggaatgctcgaggatacccgatggttgccaataatacatcacaatgctcaaaatcaaacaatgaagccctaagaaacttcgagcagccacaacttttgactagaatgaccaattggggcccatcatatatcggaatgctcaaaatggaactaggaagccttggcaaattcaaccagccacaattttttactggaatgctcgattggggcccatcatatatggcaccgctggaaatgggacaaggaagccttgggaaaattcaaacggccataagttttgacagggatgcccgatttaggtccataatatatcacaattctcaaaatgaaacaagccctgcgaaaatttcaattgcatcacttttgactgggatgcccaatgaaggcctataa

SEQ ID NO: 88145 - DNA, 744 bp, Glycine max
  Peptide Sequence Number=SeqID_179830
atgggatcaaatcaaacccctctgcttaagaaaatgttctatcaagtcaaaatcaagagcttagaggacctagctatgatagaagtctccgtggaagcaattgcatccattacccaatactatgatcaacccctaaggtgcttcacattcgaggatttccagctagtaccgattgtggaagagtttgaagaaatcctgggatgttcgctcggagagagaaaatcatatctcttttcgggcttctatccctccatggcaagagtagcaaaggtagttaaaatctcggtgcaagagttagatcgtgtgaagcgaaataggaacggggtagttggaataccaaggaaacatttggaaggaaaggcgaaggcattgaccaatcaaggagaatgggttccatttattcacaccttcacactgttgatatttggtgtcgtcctctttccaaatgtggaagggttagtggacctagcagctattgatgctttccttgcttatcaacatagcaaggaaagccaggccatcgctattttggccgatctctatgacatgttcgaccgaagatgcgaaaggagcagcgcaagaattgtttactgtacgccggctctctatgtgtgtgccaaaggagtcatcgcgctaagcgagctcaatgcgcttagtgtgcatcaacggctaagcccagcaccagcgcacttagcgagtaaaagggaatctggaaaggcatctgctatgcaagcacacgcttag

SEQ ID NO: 88146 - DNA, 243 bp, Glycine max
  Peptide Sequence Number=SeqID_179831
atggtgaaggctctacagcatcgtcacaatgatgtctgggctttgagcggaggtgctgatccacaagggatgtaccctcccttgttctctttgaacctagtggatgtaccctccactagaactgatccacaagagatgtaccctctcttgttctcagtcaacaacccaagtagatgtaccctctacttgtaccacaaaggatgtaccctccaatgtgttaagacaaatatctcaggtggttaa

SEQ ID NO: 88147 - DNA, 786 bp, Glycine max
  Peptide Sequence Number=SeqID_179832
atgagtcgattcaacaatctcatgcaaaagaaacaaaaaaagaaaagaaaaggaattgcactcaaagctaactcttcaaaggaagattacaaagaaagttcctgtaatgaagaagaggcagagaatttcaacttaatggtaaagaagtttggaaaatttctcaagaagtccaaagacaaaaaattctctaaaccttcaaagaagtttgaaagcagcaacaacaacttcacatgctttgaatgtgcttgggaagataatgcatctacatcttccgactcttctagtgatgaagaagttgcaaatgcatggcagatggcagattcaatggatgactcatcaaccattgaagaaattgaggtaaattctgaatttgaagaagttttggaagcatttaatgaaatgcatgaagaagctcaaaggcttgttttaaacaaaaagttgaaaagcgatctgaaattgcatatcacaaaattgggttcaacacaaactgagctggataaattgaagcaagaaaatgaaaatcttgtttcaagctataaagccattggttgggtttgtatctctacttctctcaatatggatgattacaagtctttgcaaactgaatttgaaaatttcaaaaaagatcactatgttgagcgtatgaagttgcaaactgaacatatcacaaatccataccttttaccactaatgaacacattcttggttggtccaaacatatcaaggtgtaacagttctaatggccttgaggtggaaacaatgtttttgctagaaaggaagttttaa

SEQ ID NO: 88148 - DNA, 930 bp, Glycine max
  Peptide Sequence Number=SeqID_179833
atggccaagtttgatccagaaatagtccttgaattttatgccaatgcttggccaacagaggagggcgtgcgtgacatgagatcctgggttaggggtcagtggatcccgttcgatgccgacgctatcagccagctcctgggatatccgatggtgttggaagagggccaggaatgcgagtatggccagaggaggaaccggtctgatgggttcgatgaggaggccatcgcccagctgctatgtataccggggcaagattttgcccggactgctgcagggaggcgagtgcgaatcatgcgcaccaatatgaccaccctgacccagatatggatgacgttgctcctcagcaacatcctgcccaccgatcataattccgatctccccatgcctaagtgccagctggtgtacgccatcctgacacggatgagcatccatgtggctcagttgatcgctgatgccatatatatttttgcaggtatggcgcccactaggcaccctttggacccagataagtccaacagggccctgggattccccgccactgatcacaggactctgccagtcgctcagggtgatgctccacaggccgcaggcgcgcccccaccacctcatcaggctggccaggctggggcatttggcatagagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggctgatttgcttgacttcttgggagggagtggagacacgtga

SEQ ID NO: 88149 - DNA, 395 bp, Glycine max
  Peptide Sequence Number=SeqID_179834
agaactatggcagtttggggtggctactagtggttgtgggtgatggagaagaagcttgggacgttggaaaaggttttggaaaaaggaaggagatggaaatagcatttttccaaggctacacgaatcacaaaggctgcaacactcaaaccaaatttcaagaagatccaacggttaagcaatgcacaaggacgcttttacccagatgggttcaggcagcttccttgagaagctttctcggtgttacaccttggccattagaccacctggggcagagagaccgatggtccacatcgatcatgcgaccgggaaggctgttggatttttcctgcagttactttttggtccaatatgttcaagggaaatccggtttgccggaaaacgcaccggatcatcaa

SEQ ID NO: 88150 - DNA, 357 bp, Glycine max
  Peptide Sequence Number=SeqID_179835
gatggtgatctggatttaaatgcctccccaaaagcacttgataaactactgggtcatctgctcgccttcaaagtcaaaatccaggcacagtatagtaattctgctgttttgaaatgctcaactgacttaactttaattaatgatgttctggacatgttgcctgctgctgagacatgttcaaagattaaagttacaacaccgtttgattccaatgatcctgtgcacgatgaatctcaatccatttctataacaacataccatgatccacttattggacttcccttgacaccaacaaaacgacagccatttcatgaatgtgatgatgaagcaagaaactcccacatttcaccaacttag

SEQ ID NO: 88151 - DNA, 447 bp, Glycine max
  Peptide Sequence Number=SeqID_179836
atgcgaagaccatcatggtcatccacttttgttgtttttctcgcaacctacccttcggcgggagggcgatgcagggctcgcgggtgcgtcttccatgaaaggaaaatgcgcggagtcaccaccaacgtttattcaaggaaaacgtcagaaaaactggaaaaggtgtggtctacgaactttaagtgtgaaaggttcgggagttgtatttatgcacggggaaggtcattgtcgcaacctaaccttttgcgggcgagcgaggcgaggctcatgggtgcgtcttccaaaggaggaaaatgcttggagtcgccaccaacgtttatttgtggaaaacgtcagaaaaaccgaaggaaaccagtcatgaagaatattccagattcgagagttgtatttacgtttgaggaaggtattagcacctctcacgtttgtcccaaaggacaacagccttag

SEQ ID NO: 88152 - DNA, 294 bp, Glycine max
  Peptide Sequence Number=SeqID_179837
atgggggagaagcttgccacccagctcgcccaggcgagcaaggttgcttcctccagaagcaatagccttctggaggaatcttctggagggcccaagtgggcctggttgctatttgcacccccatttttactaaatacaccccctgccttttttttgaatcttgcggattacataatcatcacttttttgacttacggaatgttacggaacctcactaattgtgcaacgatgcttccttttgatttccggtgtgtaacggaaccttacggattgtgcatcaatattttcttttga

SEQ ID NO: 88153 - DNA, 522 bp, Glycine max
  Peptide Sequence Number=SeqID_179838
atggatcatttcaaggtgctaataccttcctcaaacgtaaatacaactctcgaatctggaatattcttcatgaccggtttccttcggtttttccgacgttttccacaaataaacgttggtggcgacttcgcgcattttcctcctttggaagaggcacccgtgagcctcgcctcgctcgcccgccaaagggtaggttgcgacaaggccaatcccgctggatcactaggcatggagcgttatctacaacacttggttcgccagcaggcggccaaccaccgggggcaggtgcagatacatgagtgtctctaccggttcagcctcagtcagcaggggcagggtttcgctccttttgcatgccctactccagagcagttcggggctgaggtcgcatggcccggagactttcccgaagcccaggcaagggaggagcctacaggatcccctggtgaggcagaggaggcccatatggatgaagaaatgacggacttgctcggtttcttaggaggaagcggagccacgtga

SEQ ID NO: 88154 - DNA, 630 bp, Glycine max
  Peptide Sequence Number=SeqID_179839
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctggttcaagtccaggatggcccagctgcgtcaaggaaaagatagaaactgacttgactcttcatgcatgctcactcggctcggggggatatagctcagttggtagagctccgctcttgcaattgggtcgttgcgattacggtaatgggaaagaggaccgaaacatgccactgaaagactctactgagacaaagacgggctgtcaagaacgtagaggaggtaggatgggcagttggtcagatctaggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 88155 - DNA, 600 bp, Glycine max
  Peptide Sequence Number=SeqID_179840
atggggatgaggggttgcattagttacaatcccgttcttgctataaggcaacttggctaccctatgagaagggcaccactagaggaagagctcgcacctgtcatttcacgagggttcagtgagaccaacatggagatgcttcggaaggtccacaaagcatgggaagtggtacaaaagaaggacaaagagctcagaggcagtaacaatgggcctattggtgactaccataagtggttaaaagcccacgtgcaaggtttggattggctcccaagtctgagaaccgctaaaagggaggaggttgaggcaccggaggaagacgaagaggtgcaggcccttaggacagaactcgagcaagctcaaacagtcaaagaaaggttcaaatcagcagctctgaagatccaaaaggagaatgccgagctgagagatataaatacgactaccgcaagggcccttgaacaagaaaccaagagggatcgcaaggaagagcatgtccgagacaaattatgtggagctttgtggggcagcaacagcgagcttaagctccggagagaggaaagggaccaatcacgagtggacagttccataagaaagatgagttaa

SEQ ID NO: 88156 - DNA, 441 bp, Glycine max
  Peptide Sequence Number=SeqID_179841
atggatcattcctcttctctccaggttgtacttcgaattccttctccttgtcctctaggtaactcagaccaaaatgtcagggttgttccatcttctccaccaaattcacctaaagttgttcctccacctctcattacatatcaacacaggacaaggcaagttggatctataatgcctgaagcttcttctcgtgatcctcatccgtcttcaaccaatcctcaacctatagatccttcttctccttccacttcttctcatcattctgactcagattggtccattgtcatcaagaaagatacttgttctactcgtaatccttatcttatttataatttcttaagctatcatcatttgtctccttcatatgtttcttttgttttctcattatcttcccttactattccttccaatgtccatgaggcacttgatcatcttggctga

SEQ ID NO: 88157 - DNA, 561 bp, Glycine max
  Peptide Sequence Number=SeqID_179842
atggcgcctaccaggcaccctttggacccggataagtccaacagggccttgggatttcccgcgctgatcacaggactctgccagtcgtttggagtccccgttgcacctaccaaggtgattcggccgcccatcacccgggcttttattgagaagtacggcatccagagacaggctcagggtgatgctccacaggccgcaggcacgccaccaccacctcatcaggctggcccggctaggtcatttgacatggagcagtatttacggcatttggttcgccagcaggcggccaaccaccgggcacatgtacagacccatgattgtctgtaccagctgagcctcagcatgcagagccagggcttcgcttctttttcatgccctactccagaccagttcaaggcagaggtcacatggcccggggattggcccgaggcccaagcaggagaggcacccccagaggctcccggcgatggagaggaggcccacgaggatgaagagatggccgatttgcttgacttcttggggagggagtggagctacgtgactgggagatccccagatcat

SEQ ID NO: 88158 - DNA, 898 bp, Glycine max
  Peptide Sequence Number=SeqID_179843
gactacacgtcctcgccttcagaggactacaggtcctcgccttagaggactgcacatcctcatcttcagagggctgaacgccctttccttcagagggctgcacgtcctcaccttcagagggctgcacgccctcgccttcaaagggtcctctgcccttaaatgcttaaccgagacttgcgctcctggttatggggccagtagtttccttttatcagttcctgggccaccccttgatattggagggcgaccaactgtgcgagcacaaccagagaggaaggctatcacgcagctactatgcataccgaggcaagatttcacctgtgccgctgcaaagagacaagtgcggatcatgcgcaccaacatgaccactcttacacagatatggatgacgttgctacttagcaacattccacccggcgaccgcaatgccgatctccccctgggtagcgcccacaagacacccggaggagcccagcagggccctggggtttccagctctggttaccggcctctgtcagtcctacagggtgcccgtcccccccagcaaggaatcgcacccacaaagacacctagtggacccagagatgtccaacagggccctggggtttccatctctggaattgtgcctgcaagacacccagtggacccgaagaaggccaatagggtcttggagttgccaactctaattacgggcctctgtcagttttacggagtgcctgtcgcccccagcaaggtcatcagggcgaaacaccacagtagcctggggatggccggtagcagacgcaccaccatcagctctagagttcacctcagctcatccacaaaaaggtccgtgactgacaaggtcataaggcgtccagctcaagacgttaaagaagcgctactaggaggcaaccta

SEQ ID NO: 88159 - DNA, 164 bp, Glycine max
  Peptide Sequence Number=SeqID_179844
atggttaacgaatcgaaacgaagagaatgttactggggtataagagtaaggaaagctgtgcttggaggggttgatggggacccggtgccgagaggaacgaggataagggctacagtggtacctggagatatgttgtgggggtcaggagaccttggggacgtcag

SEQ ID NO: 88160 - DNA, 297 bp, Glycine max
  Peptide Sequence Number=SeqID_179845
atgtcgcgggggtcaggagaccttggggacgccaggtggggtgctatttcccaaaaccaagcttggtcaatcccgacccaacccgggcatagtcagtcagtgagaacctgtgacgtacctaaggaggcgagcttcctggcagtcaaccaattaaaagaacaaagtccacgaagcaaggaggcttgtgtggcgactggccaactatgtatcttggtggtattgaaaattacccttggtaatcgattatcattcatgggtaatcgattacagggtttaaaaatggagacaggatgttaa

SEQ ID NO: 88161 - DNA, 429 bp, Glycine max
  Peptide Sequence Number=SeqID_179846
atgagtgattcggcagatttggattcctatatacccactcgtgcggtacttcatttttgggaagaggttttgattgatcaaaaagaagaatctacttcaaccgatatgcccttaggcacggcaatacataacatagaaatcacactcggaaagggtggacaattagctagagcagcaggtgctgtagcgaaactaattgcaaaagaggggaaatcggccacattaaaattaccttctggggaggtccgtttgatatccaaaaactgctcggcaacagtcggacaagtgggaaatgttggagtaaaccagaaaaatttaggtagagccggatctaaatgttggctaggtaagcgtcctgtagtaagaggagtagttatgaaccccgtagaccatccgcatggggtggtgaagggaggccccaattggtag

SEQ ID NO: 88162 - DNA, 366 bp, Glycine max
  Peptide Sequence Number=SeqID_179847
atggggatcgcacccacaaagacacccaatggacctgaagaagtccaacagggccctgggatttccagctctggttacgggcctctatcagtcctacagggtgcccgtacccccccagcaaggtcatgccatcccgacatagggatcgcgcccgcaggacacccggtggacccaaagaagtccgatagggtcttggggtttccagctctgattacgggcctctgtcagttctacggagtgcccgtcgccccaacaaggtcattaggccccgtaccaatcgagctttcatcaagaagtactgtgcccccaggcaggcgcagggcgaaacaccacagcagcattgggatgaccggtagcgggcaatag

SEQ ID NO: 88163 - DNA, 1032 bp, Glycine max
  Peptide Sequence Number=SeqID_179848
atggaagtcttgcgcgctgatcacgccctgttcgaccaggtcccagctttcggccagcggcgcggtcaggtcgggcacgtcccagtggccgatatccgaggaccagatggcgttgatcttcacgcccagcgggttgaccttgtcgttgaaggccgccgccacggtgcggtcgtcggattccgagccgaagtagaagctgtcgacccagcgcttgcggatgtcctcgaccgattcgatgccggcggcggcgaagtcgtccagctcgtccgggtgcgggtcgcggctgtgcggcagggccgagatgcccaggctgtcgcgcagcagctgctgcgggtcgatgtcgcggccgcggatgaagtcggcgccgtagcgctggaacagctcgtgcagcagcgccacgtcggcgttggccgggttgtagttctgcaccgcggcgcggttgcgcttttcccagcggtccaccaggtgcgtgtagacgtgcgagccccagtcggcgccgccttccagcagcgccacgcgcaggttcgggaagcgccgcgtgacgccgccgaagaacagcgccttggcgaaggcctgcgagccatcggcgaagtggccgatgtggttgaacatgtagttgctgatggaatggcgcccggtccagccctggctgccgtagtgcgtggtgaccggcacgcccagctcgaccaccttggcccagaacgggtcgtagtcgtactcgctgtcgatgccgtagaagtcgatgtagctggcgtgccgggcgatctcgggatggtcggcggcgggatacttgcgcgcgatcgccttgatcggccgcttgacgccgccggcgatgttgatgaccttcagtcccagcgtcttgaccgcgaactccagttcctcgatgccttcctgcggcgtgttcaacggaatgccggccaccggggtcaggcggtcgctgtacttgcggtactggtccgcatggaagtggttgatggcgcggtgcagcggctggcggaactcatcgccggcgcccagcggcgccagcacgtc

SEQ ID NO: 88164 - DNA, 247 bp, Glycine max
  Peptide Sequence Number=SeqID_179849
gaaaaggctacaatgcgaaagatatttctctcagctcaaagatgttatcaaaattcccaacggtgagaatgctcggaattgggctgctaacttattgctcgactttcacgacgatccaacggtgaacgagtctgagatcgtcgtttttctaagacaggttaggtggcttgcgagaaaaagagagggttttgagagaagagagaaaaaacgaaactgtgaggcagaggaggttgaggagtcagcctga

SEQ ID NO: 88165 - DNA, 282 bp, Glycine max
  Peptide Sequence Number=SeqID_179850
atgtttacctgtgcatggatccttagattcataggaggtgtcctatttgttgataaaagcagcagcaaaatttccctaaggtggctgcgacgtgaaaatcagcatattggcaatgatgatctgataatttttcgtcacaaattggatatcatgaaacgacatgagtttctgtgggagccttacacaacaactgttatgtcagctttgccaccaatttgtttggttggaagtgtagcatggtgcgcggtggttccactcatttgtttccatgttgttgagtga

SEQ ID NO: 88166 - DNA, 388 bp, Glycine max
  Peptide Sequence Number=SeqID_179851
gtcgactctagagcatcccctctatgatgatgctccacaggccgcaggcgcgccaccaccacctcatcaggctggccaggctggggcatttgacatggagcagtatttacggcatttggttcgccagcaggcggccaaccaccgagcacatgtacagacccatgattgtctgtaccagatgagcctcagcatgcagagccagggcttcgcttctttttcatgccctactccaaaccagttcagggcagaggtcgcatggcccggagattggcccgaggcccaagcaggagaggcacccccagaagctcccggcggtggagaagaggcccacgaggacgaggagatggccgatttgcttgacttcttgggagggagtggagatacgtga

SEQ ID NO: 88167 - DNA, 780 bp, Glycine max
  Peptide Sequence Number=SeqID_179852
atgattgttcgagcaaaagtccctctcatatgttttgcaattgtcgaatggcatccaatagatagggtcatgagacaatttggactgcgacaaattattccagatgacccaccaaatctagatcaaattcacaacatagatatgagagggagaacatatattttttggcctcaccatcatcgtcagtggattctcaaatggaatcattggaataattatattgttcatggtgaaatggaccaaggtcttttacatgaaaattcagaatacatgcaatggtatatacgtcgaactagacgatatatatcgcgtgaaggagcagtatctacagaggtttattatcctggtcatcaccaacatcaatcatatgcggaacctaatgtacctccagtgcatgttcctaaatttatgtcccaacatcatccatcacaagcacaatatcaatcaacaagtttttctggtcatacgtctcaaggatgtcaacaaagttttcaaccactggggttctcatcatatatacctcaatattcatttcaagtcccttctacctcaaatgttttttatggctcctcacaaatgtttgccaccactttcaacactccttcatctgcatataatcttgcaccatctagttcttgttatcgtccatcattacctactcaaatacgtgacatgagtcacgaagatgaggacgaggatgaggataacaacaataacaacgatgacgatgatgatgttgatgatgatgacaacagtggtcatcatgttcctcaactataa

SEQ ID NO: 88168 - DNA, 600 bp, Glycine max
  Peptide Sequence Number=SeqID_179853
atgccgctacaaaaagacgagtgcggaccatgcgcagcaaacatgaccacccttacgtggatgacgttgctattaagcaccattctgcccagcgaccacaatgccaatctccccctacagatgtatcagttgggattgcgcccacaagacacccagttggccccgaagaagtccaacagggcccctggggtttccagctctggttacgggccctctattagttctacagggtgccccgttccccccagcgagaatcgcacccacaaaagacacccagcggacccggagaagtccagtagggccctggggtttccagctctgggatcgcgcctgcaagacacccagtggacccgaagaagtccaacagggtcttggagttgtcaagctctaattacgggtctctgtcagttctacagagtacctgtcacctccagcaagggcatcaggccccctactaatcgagctttcatcaagaagtactacgtctccaggcaggcgcagggcgaaacaccacagcagcctggggatggccagcagcgggcaacagacgcaccgccatcacctctagagttcacctcagctcatccacaaaaaggttag

SEQ ID NO: 88169 - DNA, 372 bp, Glycine max
  Peptide Sequence Number=SeqID_179854
atgcattccgccttgcatgctggcgaaacatgcatgggagcaacacgtggcggccatttcgccattgccaaactggcgacaaaggccaagttaggggcagcagggctaggcgttagggctcatgtggtaggcatgcagtgcagctgcagggtggcagggtgcagcaggtttcgcaaggaaggctggcgaaacaggccatgtgggccattcccactggcgaaacaacccatgttgtgctggattttgctatttaatgcgtgtcgttggtggtgttgcgtgctcaaaatattttctattgcttgttttgttaaaggtgatagcgaaatccttgaggctgccggaacgcatactcattcaagtggtggtgggtaa

SEQ ID NO: 88170 - DNA, 234 bp, Glycine max
  Peptide Sequence Number=SeqID_179855
atgcatgcacgtatatcgccatgcatgcttgcgatatacgcctgggaccggacacgtggttgttccgccagtgccactggcgaaatagttggcatagtggttttcgccactttgactggcgatttaggtgcagagggcacgtatatgatgaattcagttataacagtgttgtatttcaatggaagggaaaatatgttgctctgcaaatttgtgatgacgaaggggatcctctag

SEQ ID NO: 88171 - DNA, 156 bp, Glycine max
  Peptide Sequence Number=SeqID_179856
atgaccatagattcacctccacttcctatgttcccatggacccggtggagtcgccaactatcgcaacctacccttcagcaagagggcgatgcgaggctcacaggtgcatcttccaaggaaggaaaacacacggagttgccaccaacgtttaattga

SEQ ID NO: 88172 - DNA, 324 bp, Glycine max
  Peptide Sequence Number=SeqID_179857
cataagcttctggctgagaagaccaagaagaagctagaggaagctgcacaatcaggaagcattgatggcgtgatcgaccctccatcccccgtcagacgccacgcgaagtggaagatggcccgcaccaaggaaacaggggagatgacgactgaggccgcaaagaaaatcgttgagaagattgattcctttgaggagcaggcgacacagggatccttcgtcccctgtggatgtcaggatgttctcatcgctgctattggacgtccaaagcaccctggacgtgtccgtgttgctggagccggtgtcaccatcaagcaatacttttga

SEQ ID NO: 88173 - DNA, 623 bp, Glycine max
  Peptide Sequence Number=SeqID_179858
aaccagttgtgtcttcggcaaaaccacctcagaagccagatccggaggtcgatgatccgctttatctaaggacatggaccatcccagagtttttcttgaggccttaccaggttatatgggatgccaccgtgttcggggtctttaatccagacttcccgttctacataaagcatgaagacctctctgaaattgcacacggtggtcaatgtctcagcatatcagtgttacagttgcatctgactgaaacaagtatgcgagcgggaaattccgatatgtatggattccttgagccacagtccattcagaggctgggcaatcacagtttgagattgaaacggacactggcagatggtggtcatcgtgcccaaggaacacctagttgtctgtgctttaaaagtctagatgatgctccacaacctaaatcaaaggctcatgctaggtggattatcgccaagtgtaatagacaaaaaagaagtactgagtatggctattatgtcatgcactggatgtccaccatcattttagaaagtttcaggaataactgggaagcgtttttcaaaaccgatgttaacaataatacattcaacatcgattttaaaaccgatgtagaatgtcataaataa

SEQ ID NO: 88174 - DNA, 570 bp, Glycine max
  Peptide Sequence Number=SeqID_179859
atgtatatcgccagcatgcatggcaaaatacgcccacaccggacacgtggttgttctgccaatgtcactggcaagatagttggcacagtttttgccactttgactggcgatttcggtgcagaaggtgcaagcaaggtatatgataaattcagttataacaatcttgtattccaatggaagggaaagtatgttgcgttgcaaatttgtgatgacgaagatgttgaaactatgatcgaaagttttcaacaacaagatcaaatgtcaattcttgaattgtacatagaaaaggatgtggttggtggttatatgtttcattgtgtaaattctcttacatcatgtgaaaataatttatctaataatgaggcggaaccgccaagaattataagcaatttacatggtgatgaagatgatgattatcttgtgtctaactcatacgttgaagaatctttagacgaagatgatggtgttgacggtatatctaatatagacgatgaagtcaccaacatgattcaaccagtaagaattgttcacccaacagaaggtgtagaaggaattcaaaatccattctag

SEQ ID NO: 88175 - DNA, 537 bp, Glycine max
  Peptide Sequence Number=SeqID_179860
atgaatctggggatcccacggttatgtggctccgcatgccaccggactcttgggtcacgaggaaacactgggtcgaacaaagataggagaaaatcactcaaagtgtatcaatctcacacaatgcgtggcgagaaagtcgctagcgcacaggattttgacggcaatcaaagcgacaggacgactttaggttgtggtttcctttttcttgtttacttggtgacaattctgtattgttcagatattgtctggtccaaagacctttctggatgtttcttctgttttcttcctatccttgatcgggaattttctttcctttttttgctttctcccacttttgattgggaatttttctttctttttgttgttttccgagggcaaggattgacattctcaccctgggtcaaggtttatgataagttgggattttggctcaaggcttgtagaacggctggtcatgatatatgtcagggtttggccagcggttcagggataaaggggacatcctacattatttccatgatacacatgcaacaatga

SEQ ID NO: 88176 - DNA, 585 bp, Glycine max
  Peptide Sequence Number=SeqID_179861
atgacaaaaagatattggaacataatcttggaagagatgatggaagcaggagtcattttggccactgcaagtgagggaaaacaattcttaattgttggtacaaaaaaaaaagcagcggattcagtagcacgggctgcaataagagctcggtgtcattatgttaataaaaagtggctcggcggtatgttaacgaattggtatactacagaaacacgacttcaaaagttcagggacttgagaatgcaacaaaagacggggagactcaatagttttccaaaaagagatgccgctatattgaagagacatttagctcatttggaaacatatcttggcggcattaaatatatgacggggttacctgatattgtaataatcgtcgatcaacaagaagaatatacggctcttcgagaatgtataactttggaaattccaacaatttgtttaatcgatacaaattgtgacccggacctcgccgatatttcaattccagctaatgatgatgctatagcctcaattcgattaattcttaacaaattagtatttgcaatttgtgagggccgttctagctatatacgaaattcttga

SEQ ID NO: 88177 - DNA, 495 bp, Glycine max
  Peptide Sequence Number=SeqID_179862
atgttggtgcgcatgatccgcactcgtctctttgcagcggcacgggtgaaatcttgccccggtatgcatagtagctgtgtgacagcctccctctctggttgtgctcgcacagttggccctcctccaatatcagggggtggcctaggaaccgtgagggcgtgcagccctctgatggcgaggacgtgtagtcctctcaaggtgagggcgtgcagccctctgaagccctacgaaggtgaggacagtagtcctctgatggcgagggcgtatagccctctgaaggtgagggcgtgtggtcctctaaaggtgagtgcttgtagccctatgaaggtgaggacgtgtagtcctctgattgcgagggcatgtagccctctgatgttgaggacatgcagtcctctgatggcgagggcgtgtagccctctgaaggtgaggacgtgtggtcctctaaaggtgagggcgtgtagccctttcaaggcgaggacgtgtagtcctctaaag

SEQ ID NO: 88178 - DNA, 153 bp, Glycine max
  Peptide Sequence Number=SeqID_179863
atgttagccatcatcagtaagtaccaagcagaactaaatctagccatggcccatgagcataaagtggtggatgagtatgcccaagtgagtcaagaacttcctcgattgctagccaaggccaaagcgatggcggacacctactccaccgcctga

SEQ ID NO: 88179 - DNA, 261 bp, Glycine max
  Peptide Sequence Number=SeqID_179864
atggatgttaagtacctcaaggatgtcaagcgaaggttgcatgccatcaaacgatggtccccggatgaaattagggcgcggatgaccataaggtatctctgcatgtcatcgggcttgccgcctctggatgacaaaaggtgcaaaatgaccataatttgtctctgcgtgccatcggactcgatcgtctttggatggcaaaaaggtgtgcggaatggccataatttgtctccgcatgtcatcgggctcgccgcctttggatga

SEQ ID NO: 88180 - DNA, 623 bp, Glycine max
  Peptide Sequence Number=SeqID_179865
gcgaaattgccaaagagaagttcaagttggccgctacacacatccggaaggagtgtgctggattacgggaagagaatgcaactaccgcgagagcccttgaacaagagaccaagagggctcgcaaggaagagtatggccgtaacaaatttcgcggagctctatggggtagcaacagtgaactcaagctgcgaagggaagagagggaccagccacgagcacatagcatggtcttgaaagaggagttagttgcctgttcaaggtccaaaaggagcttgtctcagcgtttatgcgagacggagaccaacatgctagctatcatcgccaagtatcaagaagagttacgcctagccacggcccacgagcatagggtcgcggacgagtatgcccaagtatacacggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagaaattcatgggcttatcggctattgtcagcatatgatagacttaatggcccacataattagaaatcgttag

SEQ ID NO: 88181 - DNA, 411 bp, Glycine max
  Peptide Sequence Number=SeqID_179866
atggtaggcaaagatttgggaagtgtgggcggcccccattatgtgcaaattcaaaacaagcacgcctgcccgtcatatgacttgcctcccaactatacaccacccaatgtggcgtacactcctgttgaggatacacatgaaattccctaccacaatctagccgacttcgagccttgcctcggatatgcatctgaagggcaagcagttggtggtatacccctgcaaaacactttggagggccctccattccgcccccaaccacaacccttgcattccacagcaggcaaaatacctcacattatggaaggaatgggaaaagtgccggactttgactcatacaaggggactacttgctccaagaaccatctaaagatgtattgtcggaagatgggggcatacgcaaaagattag

SEQ ID NO: 88182 - DNA, 249 bp, Glycine max
  Peptide Sequence Number=SeqID_179867
atggatgaatataacggacatgggatatgtttatctgaaagattgttgtcctttaccgctgtcgcaacctacccttcggcgggagggcgacgcgtgactcgcgggatgcgtattccacgaaaggaatacgcgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 88183 - DNA, 717 bp, Glycine max
  Peptide Sequence Number=SeqID_179868
atggcaaggtcggcacggtgggctactgctggggcggcacggtgccgatgctgtcggccctgcgcctgggcctgccctcggccagctactacggtgcgcgcaaaggtccagttcctggatgagacgcccaaggccccggtgatcttccacttcggcgcccaggacaggagcatcccgccggagacggtccaggcccatcgcgagaagctgccgcagatggccaccttcgtctatccggccgaccacgccttcaaccgggagcgtgctggtggcggaaggaccgttgtcgcaagtgcggctgatgaacgacgaacgattcccctggctggtgctggtaccgcgccttgccggggtgaccgagtggatcgagctggacggcgagcagcaggacaagctgcgcaccgagctcaaccgcgcctgcaaggccctgaagggctgccgacggggtggagaagatcaatatcgcggccccgcgcaccgctacgagccgggtgcactggaccaacatgtcgcctactggaaggaacggctaggatatccagcccagtcctgagcgtttgccgacccgatgcgattcaacctcgttgccgccgtcctgctgatcctgatcggcctgttcatgctcgccagcaacctgggctggacgcacctgaacctgtccaagctgctgctgacctggtggccggtggcattggtgggtgtcggcatcgcgatgct

SEQ ID NO: 88184 - DNA, 88 bp, Glycine max
  Peptide Sequence Number=SeqID_179869
atggaagaaaaaaactcagcaagagcaagcaccaacagcaagcaccaacagcaagcacgcagaacactcaagaatggagaaaagaaag

SEQ ID NO: 88185 - DNA, 498 bp, Glycine max
  Peptide Sequence Number=SeqID_179870
atggcctctaggaaacacaagagtatcggttcaagacccacaactcaatatgatacaaggagatttcactccttagatgcatggaactggtacacggataatgtattggggagaaacatcttgccggtggagctctaccacattgagtttgatgattttaagactgagttggagaggcgtaatctccataaatgcctcaccaatttggttgatgggagcatagatgtggctttggtgaaagagtactatgcaaacctatacaactctgagagtccttcaccaaagcaagccagggtcagaggccatctagtgaagatcgacactaacagcctcaacacattcctagagacacatgtggtgttggcaaggggtgagactttgcccacatactccagatactacaggctgccttcagatcctagggagattgaggctaccctatgcataccaggccgagggttcatcttgaatgccgagggccatagtgggaggacttga

SEQ ID NO: 88186 - DNA, 255 bp, Glycine max
  Peptide Sequence Number=SeqID_179871
atggtcatcattgtcaatgcggaaggtattctgcgcttcactatccatgttcacacattattgcagtttgtggttatgtcgaaccatctgagcaccgacaaaaatgtagttgatgtggagccgaagggcataataggcatcactgtccaatgcaatcagagcgtaggagttgttcaaatcgttgatttatttaagggtattcaaattgatacaaacggagaactatctacaatgatgaactatggacttagttaa

SEQ ID NO: 88187 - DNA, 363 bp, Glycine max
  Peptide Sequence Number=SeqID_179872
atgacaagcagtaagaggtttgtggaggcggaggatgaggatagtgttgtatccaagaagaaagctgctgaaaagaaaggtactgatgaaaagaaaaatgatatgagagaaaaagaaaaagaagtagaaaaagaaaaagaaaaagaaaaaggaaaaaatgaaaaagatgaaaaaaataagaatgaagagaggagtagaagtgaacaagctagagaaaagaaaagagaaaaagttgtgaatgaaggtgcggaagtaccatatcctgtggtaccttccaagaaggagaaggaccgccatttggcgagattcttagatattttcaggaaactagaaataaccatgcccttcggagaagctttatag

SEQ ID NO: 88188 - DNA, 457 bp, Glycine max
  Peptide Sequence Number=SeqID_179873
atgggatctagtcaggtgccttcgcttaaaaataggttctatcaagtcaaggtcaggagcctaggagtcaccagtctgaaagagttagggcagttgatgggtcagctccagcgacaagcttttcgtaaagcttatggtaaaatctgggacctagccatggcagaggtctccaccgaggccattgcctccctcgcccaatattatgaccagttgttgaggtgcttcacctttggggacttccagttatcacccacggtggaagagtttgaagagatcctgggatgccctctaggagaaaggaaaccatacctcttttcaggattctatccctctttagctagaatttctaagatagtccaaatctcgatgcaggaattagaccacagaaagcaagtcgaaaatggggtggttggagtaccgaggaaatgtttggaagcaaaagcaagagtcttggcag

SEQ ID NO: 88189 - DNA, 336 bp, Glycine max
  Peptide Sequence Number=SeqID_179874
ctttgtcacagcttagagggcaatgctggtgcactcacaaattttgaggtccttcatttcttacgagctaaaggagcttcaaaggatccaacaagagttaatgccaaagtagcgcagtttgaatacaaggtttatgattatttggttgacactgctgcttcaattcaaacaagagagagcatcaatgagttattgacaagtgttaaacagcatgacctggcaaaaactgaagttctgaacatattaaacattggactagctgctgattttgaactatacccattagaagtttttagctcgcaagatattataaaatcaacctatgtcgaagcatag

SEQ ID NO: 88190 - DNA, 435 bp, Glycine max
  Peptide Sequence Number=SeqID_179875
atgactaggggcaatccagatgatttacaaccctttgatcttgaaatagatagaacctttcatatattagttaggcatagtatgcatcctagtcattttgtgcattttgagcattctgagtattttgttgctggtgattctgaatattttgattttgagcattcgactactaattttcatactgagaacatggctcaacccccacctcgtgagaggactcttagggagatggctgcacctgatttcacttatgaaaacgtgtgcattcaatatcctgatgagggtgttgcatatgttctcaagactggactaatacatttgttgcccaagtttcatggtcttgcaggtgaagatcctcataagcatcttaaggagttccatattgtttgttccaccatgaagccccctaatgtccaagagattatatctttctaa

SEQ ID NO: 88191 - DNA, 482 bp, Glycine max
  Peptide Sequence Number=SeqID_179876
aggtgactctaaaggtggtggcggtgcgtctatttcccgctgccgaccatcccaatgctgctgtggtgtttcgccctgcgcctgtctggggcgcagtacttcttgatgaaagctcgattaatagggggcctgatgcccttgctgggggcgacaggcactctctagaactgacagagactcggccgacagaggcccgtaaccagagctggaaaccccagggccctgttggacttcttcaggtccactgggtgtcttgggggagattggcattgcggtcgctgggcagaatgttgctaagtggcaatgtcatctatatctgtgtgagagtgatcatgtttgtgcgcatgatccgcactcgtctctttgcagtggcacgggtgaaatcttgccccggtatgcatagtagctgtgtgatagcctccctctctggttgtgctcgcacagttggccgtcctccaatatcagggggtggcccaggaact

SEQ ID NO: 88192 - DNA, 723 bp, Glycine max
  Peptide Sequence Number=SeqID_179877
ggtggacccttgggtactagtacccttaccttccgaggactacacgtcctcaccttcagagggctgcacgccctcaccttcagagggttgcacgccctcgccttaagaggactacacatcctcgccatcagaggactgcacgccctcacctttagagggttgcacgccctcaccttcatagggttgcacgccctcaccttcagaggactacacatcctctccatcaaaggacaacacgtcctctccttcagagggctacacgccctcgccttcagaggactacatgccttcagagggttgcacgcccttagaggattgcatgtcctcgccatcagagggctgcacgccctcaactttcgacgactacacatcctcgccttcagaggactacacatcctcgccatcagaggactacacggctacatgcacgcccttagaggactatgggtcctcatcttcagagggctacatgccctcgtcttcagagggctacacatcctcacctttagagaattacacgtcctcacctttagagggctgcacgccctcgccttatcagaggactcagtctgccatcagaggacacccgtcctcgccatcagagggctgcatgccatcgccttcagaggactacgcgtcctcaccttcagagggctaacatgccctcaccttcagagggctacacgccctcaccttcagaggactacacgtcctcacctttag

SEQ ID NO: 88193 - DNA, 226 bp, Glycine max
  Peptide Sequence Number=SeqID_179878
agctggacttagggaggaggaaagatcaagcatagctaggttccttagtgggcttaatatggaagtgagggataaggttgaactccttccatatggggacctagatgagctagtcaatcgttgtgatgagaatcctaaaactggccaaatacaggctaaaggcccaagtggagaaggacgaaggtccaagtggagaaggacaaagcccccgagtggagaaggatga

SEQ ID NO: 88194 - DNA, 753 bp, Glycine max
  Peptide Sequence Number=SeqID_179879
atgagtagaggcgcgcgtcgctgcaaaacccagggcgcgagcccgggcggagcggtcgtcggtgcagatcttggtggtagtagcaaatattcaaatgagaactttgaaggccgaagaggggaaagcctgcccaccctggaaacggctcagccggaggtagggtccagcggcttggaagagcaccgcacgtcgcgtcctggtgtcgctgtggccccattcggcccgcttgaaacacggaccaggagtctgacatgtgtcgagtcaacgggcgatcgagtgagagcatacctgtcgggaccgaaagaggaatatgctctgagcgggggcccagtcccgaacccgaggaactctggactgctcgagctgcccgcagcgatactgagcgggcaaatcgttcgtctgattgggtcgaggggacgaaagatatcgggaacgggccgtctagtactggggcctcttccccgggcgtccgaacagttcaactcaggaagctggacggacggggaatccgacgttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaagagtgtgtacactcacctgccgaatcaactag

SEQ ID NO: 88195 - DNA, 434 bp, Glycine max
  Peptide Sequence Number=SeqID_179880
aatgtttatacggataaccactcgggtatttccgcccgtcagcgtgactcaaatgtcagtatgacagatcttgtaagcacggaagatgacctaaatctccgtgtgtcaatgggcttgtcggccgcgattgacgaaggtatgacagatcttgtgagtgcggaagatgacgtaaatctccgcgtgtcaacgggcttgtcggccgtgattgacgaagggtatttccgcccgtcacatgactccagtgtcagtatgacagatcttgtgagcacggaagatgacgtaaatctccgcatgtcaacgggcttgttgggccgattgacgaagggtacagaagacaaccgtgactcaaatgtcagtatgaaaggtcttgtgagcgcggaagatgatgtaaatctccgcgtttcaatgggcttgtcgaccgcgattgacgaagg

SEQ ID NO: 88196 - DNA, 570 bp, Glycine max
  Peptide Sequence Number=SeqID_179881
atgggggctatcacagcgggatacggccggcgaaactgtgacgaacatcactcaaagcgatgttacaaaacggctgttaccgggaacgtgatgcagagaggcgaaaagcagacggcggccatccctgaccgccttaaagaaggattagctgcccgacatcaggtcgtggctgtatttaaacaattccgaatccgagcgcaggccgagctttttcagcgccgactgcttttgtccgctcacggttttgcggctgcgtttaaacttcacggcaatttgcgacacgctaagtccatccagaaaacagcgcaccacttctacttcgcgcggactgagggttttgaccttctcatacatattgcctttgctggagagatcgagaggttttccacctcgtacgccacttcctgcgacaggaatagccgcccctgcgccacctggcgaatcgcctggacgatctcctgcatattgtggctttttccaataaagcccttaacgccggcgctcagcaccattttgacaatcgccggactctccatggacgatgagatcaatatcttttgctgcggatag

SEQ ID NO: 88197 - DNA, 222 bp, Glycine max
  Peptide Sequence Number=SeqID_179882
atgacgtggtgtaggggactcatcgtccttctcaagaagtggcgagccagtgacgatggtgaaccaaagcggttgaaggcgacggtgtgcttcaaagactgggttggtctgaattggtacatggcacaggcaatccgatcagttcaggccaccattggcgtgacaaaaacattcttaagctcaaagccaccatcgacaatctctccatcaagagcaacatag

SEQ ID NO: 88198 - DNA, 147 bp, Glycine max
  Peptide Sequence Number=SeqID_179883
atgaagctagtttgggtgagacttcaaaggtctaaggtggaaggtctagggaggtttgggcttgctcccattgtatctgttgaggcgcaacttcaaactcaacatcaacaagttaatcccaagttcccattgtctgacctaccatag

SEQ ID NO: 88199 - DNA, 600 bp, Glycine max
  Peptide Sequence Number=SeqID_179884
atgaatgaactatctgaggaggagaacaaaaagaaattagttgaagatgccaagcttgctgccttggtaggcaaggtatctagagaaattcaagatgatgttattttggaatctctgaagactctgtctattgaggaagagcaaaggaagagtgtcgagaaggctaccatgatggagatagatggtgagccattgcccaaaggttctattgttcaatctatacatgcacaatctgaacaagagaggaagaaagctcagatggaggatttgagaaagtttatggagaaagttcaatctgcagtagaacatgcaactcatattttgtttttggatgctactcatcgacaagtagagctagaagctaccactactcttgcagacatgggtcctataaaaaaggaagctcttaaagtggccatgcttcagccagctattgaagaagttcttgtagaagccgaggatgatgttattgagacaaaccttagaatagatgaagacatactcaaacgtttagaagagatatatggagcactaaaatttgtctccatcgaagtcatgatggaacatctagatgtaaggaagataatggtgacaagttaa

SEQ ID NO: 88200 - DNA, 81 bp, Glycine max
  Peptide Sequence Number=SeqID_179885
atggcagggacgccacaaaatgctctcctccacaaaaatcaaaatttaccgatgatggtgaatgaccccctaattgcatga

SEQ ID NO: 88201 - DNA, 234 bp, Glycine max
  Peptide Sequence Number=SeqID_179886
atggatcgtgcccacaagacacccagtggacccggagaaatccaacagggccttagggtctccagctttggttacgggcctctatcagtcctacagggtgcccgttccccccagcaagggatcgcgcccgcaggacaccctgtggacccaaagaagtccaacagggtcctagggcttccgactctgattacgggcctctgtcagttctacggagttgtccgtcaccccagcaaa

SEQ ID NO: 88202 - DNA, 1027 bp, Glycine max
  Peptide Sequence Number=SeqID_179887
atgggaatcatggtgtctgtgtcttatgcccttagacttgtcgagtcttgtgcatacggccctgaggatgactctattggctgtctctgcctggccattggtttgaggatgctcgatagatgtgacaagtggtccaagtatgtccattccccatatggcaaagggccaatgggagctcagactatggagattgtcaagaggggtggcaaaaatgactgcaaactcttgacattgcctgcatttctttgtgaagtaaggctttcagacttcctagatgctagtaggacagtgcatctccaaaatagcagtgcatttgttgaggtgcatgtcgtatttgtagagctcttcgaagacctctttcagatctgccacgtgttgggctatgctctaagacttgacgaccatgacatcaacgatatgtctatgctcatggttggtgaggtccctgttgagctgtgttcactacctaggtttagtgtcatcgcgtggatctacatcgaattcaacgtcaaggctgtcttggtagacaatcaaggctcggactggagacccttcgtgaacactcatgacctgagtaatgccatccgttgtggggtgaggtttggcaggctccctagtgggaggataaggtgccaccttcaatctttttgcgtagcactatcgtgcttgcttttgatctaccttaacaatcatgatctctcccatcaagctcctgaagagttggcgttgaacgaaggtggtcataaggtcgatgtagcctctggtctctactcgttcccctgcgaaggcgaggaatgggccgatgtgagactagatgatgttggtggatctatcctagttgatgaggaccttggacaccatgaagttggcgattatgatggagataaccatgcggtcatcttagttgatagggttgatacccttgaagtctctatcagtgaaattgatgtcgatgtcttggatggcgtggaggtggcacttgtgagactggctagactgtcctccataggagaatcagcttgcaatg

SEQ ID NO: 88203 - DNA, 666 bp, Glycine max
  Peptide Sequence Number=SeqID_179888
atggagggttggcattacataagccccctaagctctgagccggcttacgagcaaaggagattgtctaatgtcgggggtagtaaccttgacaagttggagggtaaggagtcggtcaagcccccaagaatcgacaaggtggacatgcttttggttttgcaagcaaggtctgacatgttaggtgagggagacctttgtatttggaaactctgcccttttctgattgttggagaatgcattgaagcagacgttatgtcttgttcgttgcggcatgcgtgtgtggcgcacgcgcagtactcttgtatacatgtcactaatggagtgagcacgtacaagagacttaatgcctcagtgagtgaggttgtgtcgtgcggttcctccacagagtatactcgccatggtgcctccgatagcgaatcctcttccttggataagttaagggtttcatgtcgtaatggtggaggcacctcttgcctctgtaagagggtgcgaccttttattacttccctatccagggagcctatcttggtcacaatgattctccccccttctatttccggggagcaagaagaaacggtggggacattagggcgtctccccacgtgtgacatagccatagtgttgggtcgccatcgtccccacctgtcgttgctggctatgagtgggtga

SEQ ID NO: 88204 - DNA, 296 bp, Glycine max
  Peptide Sequence Number=SeqID_179889
ggaaagctgctgcttcaggtgctgtgtccaaggatgctctgattgctgaactcaaggacacatgcaaggtgctggaagcaaccatcaaagccaccacagagaagaagatggagctggaacggctgatcaaaaggctctcagaaagtggcattgatgatggagaagcagctgagcaagaagatgaagcagctgaggaagaggtagaagcagccgaggaagaagaagaagttgctgaggaagaggaagatgcagcagaggatactgaatcagatgatgattctgaagccaccccatga

SEQ ID NO: 88205 - DNA, 618 bp, Glycine max
  Peptide Sequence Number=SeqID_179890
atgggtttgtcattgcttttgatggaacgtgctgctgctctagcagaagggctaccagctccaacattatgcagcagtggggacgttagagatttaaacatagaatactttaaatatgctcatcagcatagaatcactgagggacagaacaaagtggtaattacttatagaatgtgggctaggctcatgtcttcaacaaatcagcctagctttacgattgctaaaactatctctgaagaaaaaagggaagaagaagcaaacggccatgtccctaaggcgtggagctggagtaaagctttcatcaaagagtttgatccatcgttatatacgttgaacaaattttcatgtatagcattggctggggtgtccactgagtatcttatatatggattttctgaaggaggtctagatgacataagaaagggcctaggcttcacacagaagaaggcagattctcatgttagatggcctttgctaaacacggtcttggtcttgtggaggcatgaagcagctcgagggaaggttgctgaggccttatcaatgggaaaatctataggatcctgcattgacattatagagaattctatcaatgtttcagatctcttactgaagctttga

SEQ ID NO: 88206 - DNA, 546 bp, Glycine max
  Peptide Sequence Number=SeqID_179891
atggtcattgatgctaaagtatggaagaaggtagtcgatttggacatgggtggagtccacaagttcaaagaaacagttgatgggtacaataagatgccgacctataggggaatgcttattaacccagtaaggaacttgaagaatcgcctaggagtaggtggctggactgcaaaggacagaatgcttgtctacctcattacctacatttttactctgaggtcaagtatcaaaatgaattggttacttttgatagaagacgacatgttaaagagtcgtcagttaatggactacgaatttctttatgtcgtgcttgtctcaagattcattgactatttcaatgtcaatgtatctaatgagatagtggattttaccaaagcatctagtgagattaccgaaaggtatctcaagaagcttggaatgaggtttgtcaatcatgagtggataatgactagagggccaatggccggaaacttggaacagatggatgaagatgctaaagttgaagctccacaagagcctgcacatcaatggagtccttttgaataa

SEQ ID NO: 88207 - DNA, 885 bp, Glycine max
  Peptide Sequence Number=SeqID_179892
atggaggaagcgcaaatttgggataagaaggtggagctgccagcattcatggggacagacccaattggttggattgctggggctgaaaaattatttgagggtgttgcgacacattggttctacatttggagccaaaacaatccagattcacattgggagtcattttccacagctttgataaaaagattcgaagatcaccatggtaaccacatctttgaaagattgagtatcttgaagcaagaaaattcaactaagacaaaaacccacatcaaaaaatgggagacttccacaaagttcttgaaagggaggaccgacatttcagagtggaaacacatgttgtgcaagatattgaatgaagaagttgattcccatgcctctcaacaagacaaaaatagcatggagggaaatgggacaaaattcagtgaagcaaaggctagttcttgggcaagaaaggaagaagttgatccaccgataaaaagggagaagcacaaggaaaacaaagtgacgaatgtggattgcgaagatgattttcttgataacccaattacaaatttaatcaagaaggaactcgaagctggtgattcaaccaagccacattgttttcaacattcagatttccatacaaagattgttatggtgaaacaaaaatcattcatgaaggtggttggaacaacaatggtgttgaaaccttggagtgtcaacttgttgggtgagcctttagcattaaattttgttgcatctatggttgaaagcttagccatggaactaaggcagaaggaatgtaccgagccagtcaagctgattaaagttatatggagtccacccttgtccctcccaccatcgaagccatcggacctcaatttgcatgcatcggacctcagttga

SEQ ID NO: 88208 - DNA, 447 bp, Glycine max
  Peptide Sequence Number=SeqID_179893
tcgttcggagtccccgtggcacctaccaagttgattcggccgcccatcacccgggcttttattgagaagtactgtacccagagacaggctcagggtgacgctccacaggccgcaggtgcgcccccaccacctcatcaggctgggtcatttgacatggagcagtatttacggcatttggttcgccagcaggcggccaaccaccgggcacatgtacagacccatgattgtctgtaccagatgagcctcagcatgcagagccaaggcttcgcttccttttcatgccctactccagaccagttcagggcagaggttgcatggcccggggattggcccgaggcccaagcaggagaggcgcccccagaagtacccggcgatggagaggaggtccacgaggacgaggagatggccgatttgcttgacttcttgggagggagtggagctacatga

SEQ ID NO: 88209 - DNA, 324 bp, Glycine max
  Peptide Sequence Number=SeqID_179894
atgctcggggaaaaagacagcgttggcgattctctggatatcacccttgtcgccttgttccagaaacaagcacggtatccttctggtatttcactaaccccacagtgcaacccattacatgaaccgaccagatgggatggatccgaggcaggcatttttcatcagttgaaggtgttccaaatcgtccttcgtagcagatttgctaagggagttccatcccttgcacacacacttgaattggatcaaaggtttcacgggaagacgagacaggatttcttcgatgagttcgtcacagaggagtggctaccatggtttcttctctga

SEQ ID NO: 88210 - DNA, 282 bp, Glycine max
  Peptide Sequence Number=SeqID_179895
atggaagccaatgcggttatagttgccgctattagcactgtcgctaaggtgaacccgatgctcccatctagcctcaagcaaatgaatcatccaacctcaaatatgttaggcaaagatttgggaaggcaagcagttggtggtatacccctacaaaaccctttggagggccctcagtatcacccacaactgcatctcttgcattccacaacggttaaaaaccctcatgactatggcaggaatgggaaagttggatcatctagaggaaaggctcagggccattga

SEQ ID NO: 88211 - DNA, 459 bp, Glycine max
  Peptide Sequence Number=SeqID_179896
atggcatccttcagccagatgcaatcccagtttcagtctcagatgcaatcacaggaacttgcactgcctctggagccagaggttggtccctcaagtgctcatgtcagcacaaaggagagttgtgttgatccctcaaggaacgatccacagatgggtgactcagaaaaatgcaggttgtacattgaagaaaatccttcctgcctggttgccctaggaagactttatgaggtatccacaatggttcacaacatccctttgttgcatggccaagtgaaggttggtgttgaggaggttaaagatgcaaaggctctcgttcctgtacccactaacgaggttaccttagtggggcaggcacttaacaccttccttgcttggctgacacatctcgtgaagcgtttatcagaacagttgtgtctccaacatcctccagaagcccagttagagatcgggggcctctag

SEQ ID NO: 88212 - DNA, 57 bp, Glycine max
  Peptide Sequence Number=SeqID_179897
ggagttgcagagtgattgtgaaatgctgagaagaggaggagggattccccttcttgt

SEQ ID NO: 88213 - DNA, 819 bp, Glycine max
  Peptide Sequence Number=SeqID_179898
ccgactggtctcttcggcgcgtcaggcgatcaacgagctgaacgtcgatctgctggaggtctcatgcgttttgacaataaagtcgtggttatcaccggtgcgggcaatggcatgggggaagcggcggcgcggcggttctccgccgagggcgccatcgtggtgctggccgactgggctaaagaggcggtagacaaggttgccgcttcgctgccgaagggccgggcgatggcggtgcatatcgacgtgtccgatcacgtcgcggttgaaaaaatgatgaacgaggtggcggaaaaactgggccgcatcgacgttctgctgaacaacgccggcgtacacgtggcgggcagcgtgctggaaaccagcgtcgatgactggcggcgcatcgccggggtcgatatcgacggcgtggtgttctgctccaaattcgccttgccgcatctgctgaagaccaagggctgcatcgtcaataccgcgtcggtgtccggcctgggcggcgactggggcgcggcctattactgcgcggcgaaaggcgcggtggtcaacctgacgcgcgccatggcgctggatcacggcggtgacggcgtgcgtatcaactcggtctgcccgagcctggtgaaaaccaacatgaccaacggttggccgcaggaaatccgcgacaagttcaatgagcgcatcgcgctggggcgcgcggcggagccggaagaagtggcgacggtgatggcgtttctggccagcgacgacgccagctttatcaatggcgccaacattccggtcgatggcgggggcgaccgcctcggacggccaccgaagatcgtctaa

SEQ ID NO: 88214 - DNA, 369 bp, Glycine max
  Peptide Sequence Number=SeqID_179899
agatgcaagaagagtagcgcgagaattgtttgttgcacgctctcacttgatgtatggctggtctcccactctttccgtcatgaaagtagtctcgtttgtcacctacaaggtcaccacatgtgtgccgagaaagggaaagcaaattgggagaagctcttggctggcatggtaggggcatccgttaattggttcccccgatggaaggaaggaagggctagagttttgtcttcatgtgaagggttcccaaacattcccttgatgggaatgagggattgtattagttataatcatgtacttgccacaagacaactaggctatcctatgagaggggcaccattgaaagagagtatcgcgcctttcaatgcatga

SEQ ID NO: 88215 - DNA, 145 bp, Glycine max
  Peptide Sequence Number=SeqID_179900
atgttggcgactcattctgggtatcaatcaatggccaagaagctagcgttgaattgcttcttcacctcttcttttatcttcagggacatctcgggcttcatcctcctcaacttttgctttaccggggaacactcgggatttagag

SEQ ID NO: 88216 - DNA, 204 bp, Glycine max
  Peptide Sequence Number=SeqID_179901
atgaaaacagtaatgttagtaaacagtatagtgaccttggtcacgtggctccgctccctcccaagaaaccgagccggtcagtcatctcttcatccatatgggattcatctgcctcaccaggggatcctgcaggctcctcccctgcctaggcctcgggccagtctccaggccatgcgacctcagccccaaactgcttcggagtag

SEQ ID NO: 88217 - DNA, 273 bp, Glycine max
  Peptide Sequence Number=SeqID_179902
atgtcctcgccatcagagggccacacgccctcacctttagacatctacatgtcctcacctttagatgactatacgtcctcgccttcagaggactatacgtcctcgcctttagaggacttcacgtcctcaccttcagaggactacacgtcctcgacttcagagggctacacgtcctcgacttcagaggactacaggtcctcaccttcagaggactatacgtactctctttcagagggccacacgtccacgcctttagaggactacacgtcctga

SEQ ID NO: 88218 - DNA, 191 bp, Glycine max
  Peptide Sequence Number=SeqID_179903
atggaacccaacctcaggtgggaggcgttaaatggaaacttctccaacatgctcttgggcatcacatttaggcttaagccgttgtcgatgagtactttggtcataacgtgttccatgcatttgaccgacacatgtaaagccctattatgtcctctcccctcggcggggatttcttcttcagtgaagataag

SEQ ID NO: 88219 - DNA, 467 bp, Glycine max
  Peptide Sequence Number=SeqID_179904
ttcctaaagaaatacttcccagagtccaagactgcggaagggaaagctgctcttcatttcatcagttccctgatgaatctctgagtgaagcattgccgccgttcagaggggaaaagataaaactgaagacctcggaagaactagctgagctaattgagaacatgtcagccaatgatcatgccattctacgagacagaacccatcaacccgcgaagaaaagcttttgtaccatctgtggtgaggctcatgaaacgggccaatgtattcccatggaagaaaacactcgagaaattcattatatgggaaatcaacagcgacaagggtatactcaaggaggattttcaggcttccagcagggtctctataatcaacaaggacagtggaggacacaccctggcaaccagttcaataaagaccagagtgggccttcaaacaggccaatccaacaagggcctaacatattctag

SEQ ID NO: 88220 - DNA, 237 bp, Glycine max
  Peptide Sequence Number=SeqID_179905
atgagggcgtgtagccctctcaaggcgaggacttatagtcctctggaggtgagggcgtgcagccctctgatggtgaggacgtgtagtcctctcaaggcgaggacgtatagtcctctggagacgaggattgactgtccttttgaaagaggtgataattcatgcaaccttatcctatcttttgcaaatctctccgggaaccccctcaaagtgtatgttttgtttgatttagtcacttga

SEQ ID NO: 88221 - DNA, 255 bp, Glycine max
  Peptide Sequence Number=SeqID_179906
atgacacccagtggacccggaggagtccaacagggccctcgggtttctagctctggttacgggcctctgtcagtcttacagggtacctgtcccccccagcaaggtcatgccatcgtgacatacgatcgcgcccgtaagacacccagtggacctggaaaactccaacagggtcatggggtttccaactctgattgcgggctgatcgaggccgtacccgaatcaaataaacatgaaaatgcagtaactaggaagtga

SEQ ID NO: 88222 - DNA, 266 bp, Glycine max
  Peptide Sequence Number=SeqID_179907
ctggggatggggaaggtgtggatctaggtattggggacggtccacgtgcatcaaccgaggatggagatggtgtgaatgctggtactgtggatggtccagcttcagtaggaggtggagatggtgtagctgcaacatctagaggcctaactggcattgacatagaagatggagatggagtagttgatggcagactatctcgaggtggtaataatctaaccacatatcgttttttcttttcaattctccctttcccactagagtcatga

SEQ ID NO: 88223 - DNA, 441 bp, Glycine max
  Peptide Sequence Number=SeqID_179908
atgttcttactgttagagagtgggcacacacaagacacttgttatcctattcacggattcctcgaaaaatcggtgaatatttcaaagtttgaaacatctgagataaagtttttgaagactgactatcaagagtatctccagctaaaagctgccaaggaatctcaaacatcatctgctataagtggtcataactccactgtatgcatttctcaatctgatgcttttgatcacattgctggtaatagttctttattttcacccctttctcctcctaaaattccttattttattactttagctgatggttctagagttgtagcaacaggaatcggccatgaatgtggtacgggttggacgattggcgtaggaattgaatctcatggtctttactacctcaagcctaatctttcttggggttttcttaatgaaagaacgatctga

SEQ ID NO: 88224 - DNA, 685 bp, Glycine max
  Peptide Sequence Number=SeqID_179909
tggtgtctcctccctctctctctctttctccattccgctgccattcatcttccaagaagcaaaggagtccattgatgaagaagatcctaggcctacaagctccaatggagcttgcatcaacatgtccttgccttcagaggacaacacatcctcgccttcagaggactacatgtcctcgtctttagaaggctacatgcccttgccttcagagtactacacagggctacatgcccttgcctttagagggctacacgtcctcgcctttgaggaggactacatgtccacgccatcagagggctacatgtccttcagaggactacacgtcctcgccttaagaggactacaccccctcgccttccgagggctacacgccctcgcctttagaggactactcgtcctcaccttcagaggactaccagtcctcaccttcagaggactacacgccttctccttcagaggactacatgtgctcgccttcaaaggactacatgtgctcgccttcaaaggactacacgtctttgccttcaaaaggctacacgccctcgccttcaaaggaggtctggacgccctcgccttcagaggtctaaacaccctcgccttcagaggactacacgtccttgccttcacagggctgcacgtcctcactttcagagggctccacatttgcgcctttagaggacttaag

SEQ ID NO: 88225 - DNA, 210 bp, Glycine max
  Peptide Sequence Number=SeqID_179910
atgcacatttgcaaagcatttagctacctattcaacatacacatgtacatggtgaacggcattttcacactatctaggcacaaggaaaacatggtgcagcccaaaccaagtgttggccttaaggagaaacctcaccaacatgctctcactcatcatgccttcttgtatttcaacaaacaaaagcttgggccccctaggcctaggtcatga

SEQ ID NO: 88226 - DNA, 377 bp, Glycine max
  Peptide Sequence Number=SeqID_179911
gtatgccacctaccaggcaccctttagacccagataagtctaacagggccttgggttttctggcattgatcacgggtctctgccagtctttcggggttcctgttgcgcccagtaagcagacggccaaccaccgggtgcacgtgcagacccatgactctctatatcagcttagcctcagcctgcagagccagggttttgcttcttttccatgccctactccggatcagttcagggcagaggtcgcatggccaggagattggcttgaggcccaggcaggggaggcatccgcagaggctcccgacgaggcagatgaggcccacgaggacgaggagatgaccgatttgcttgatttcttgggagggagcggagccacatga

SEQ ID NO: 88227 - DNA, 300 bp, Glycine max
  Peptide Sequence Number=SeqID_179912
atgaccaactactatccaccagaccttccttcttctattagagttcctcgaggcagccaaggagcagtgctgaagaaagttctccataggattgctgtgcagagctctaacttccttgacccaggaataaaattcccaccacaaaggcattattttatgacaagagaaaaaaaggtgggatgcagattcaacttgactttggcagaaggggcagaggtcattttgaaggacaatctgcctcctaataaggttttccttagatggaagcctatcccagagaagtctccaagcaaaagctag

SEQ ID NO: 88228 - DNA, 134 bp, Glycine max
  Peptide Sequence Number=SeqID_179913
gcccacttgggccttccaggatgttccaacagaaagcggtgccttctggtggaagcaacccagctcgcctgggcgagctgagctcagctaggcgtgctggcggcaaccacctccctcttttcccttttaaatag

SEQ ID NO: 88229 - DNA, 364 bp, Glycine max
  Peptide Sequence Number=SeqID_179914
ggctgttcatgtgtcctccacttttgagtttggagctgagtttcatgattgcctaagtgcggaccctcaaggcaatccttcatactccacctttgttccggagccatatgaatgttattgcctagcgctgttcatgtgtcctcccttgtcaagcgcgaagtctctgaagaaaaaaaagaaggagtggagacgagagtcgtcatcacagaaagggcccacttgggccctccagaagattcctccagaagctgttgcttcaggaggaagcaaccttgctcgcctgggcgagctgggcggcaagcttctcccctattttgctataaataggggaaaaagtgaagaagaaaagggttcagcaccttag

SEQ ID NO: 88230 - DNA, 315 bp, Glycine max
  Peptide Sequence Number=SeqID_179915
atgttcaatcatgagcatgcatatgcatctttgttgtcctgcgagtcaaaagaccgaagaagatttgcttcgagagttggtcgataccacaccaagtccaaggccaaggtaagcaaaggtagcaaaaataccttggatatgcatgtatgtagcaaaacacctcggatacgcatgcatgaaatggctccaaagaagctccccgtgaagaggtctgggaagggcaccactgaagagggttccagtgcggtcccgcaaggcgacacaaacttcgacaaacaccgattccggaggtgggaacgaagcccagggggatga

SEQ ID NO: 88231 - DNA, 351 bp, Glycine max
  Peptide Sequence Number=SeqID_179916
atggactcaaaatctaccctaaggctcatgagaaccctagggccttcccttggatctctggctcaatctacttggagtcttttatccaatgcccttgcgggccggacattttactttgaagttcccttaaatgagttgagaaataaccaagtgaaactaaagctaaaatcaactcacaaatcaaacatttgtccgcaaaaaggtcatttgaaaattgtttcagggtccaacaccttaaacgatcgcgaagaactacgtaggtctgatttcctcattgcaattgaggatacgtgggagcaagagccccgcttttgtcgaccccatgagatcgttaaaggtccaacgccttaa

SEQ ID NO: 88232 - DNA, 168 bp, Glycine max
  Peptide Sequence Number=SeqID_179917
atggatgaagatcaatggatgtatgatactataatgtctgaagaagttgatatggatgatcaaaatgaacaagaatgtggtgtgaatgaaccacaagttgattgttcggatccattcaatacttctcaggtgtttggtagccaagatgatgttttgcagtgggcttga

SEQ ID NO: 88233 - DNA, 198 bp, Glycine max
  Peptide Sequence Number=SeqID_179918
atggaatcttcccaagttcccattgattcaaattccaacagttctgcaaataaaattgaagaaaaagctggagatggaaatactcaagccattctcttgatgaagttgagcaatgatatgcagcacaatatcattgtacggagtcaagaacttgataggtccataatgaagcctaaattactaaacctcgatccctag

SEQ ID NO: 88234 - DNA, 243 bp, Glycine max
  Peptide Sequence Number=SeqID_179919
atggagaaagcagagaggtcgagagaagagacagagaggttgagcgagagagtgaaagatgaagagagtagagatagagaggttgaaatgtctctgtacatgtgtcataccctaatttcgtccggggacgatccgttgttgggatgcgaccctcgtttgaccacttcgaggtatttggaacccatcgttaggcaatttgtgaagttccgagacatgccagaagccaaaagaaaagcatcgtag

SEQ ID NO: 88235 - DNA, 765 bp, Glycine max
  Peptide Sequence Number=SeqID_179920
gctttgttcattgatgtcttggcgctattggtatttggagtcgtcctctttccaaatatggatggactagtggacctagcagcgatcgatgccttcgttacttatcaccatagcaaggaaagtccgctctttatgtatgactggtctcgcacctctttcatcatgaaagtagacccgcctgtcccttgcaaggtcaccgcatatgcgtcaagaaagggaaggccaattgggagcagctcttggctaggattctcaaatgtccccttgatggaaacgaagggctgtatcaattataatcttgtccttgccatcagacaacttggctatcccacgagaggagcaccgtcggaagaaagtatcacgcctttcatcgcccgaggtttcagtgaccccaatgcaaggatatttcaaggagtccgcaaagcatggagtgcagtacaaaggaaagataaggagcttaggggaagcagcaatgggatcatcaacggctatcacaagtggctgaaggctcagacgcaagagttagattggctcccgaagctaaagacctcaagtgaggaagaggctgaaacccctaaggagagtgaggaggtgcaagccttaaaggcgggacttgaaagggcacaagcagtcaaggaaaagttcaagatgatggccatcaaggtagtgccgcaacctacccttccgcgggagggagacgcaaggctcacgggtgcgtcttccaaggaaggaaaatgtgcggagttgccaccaacgtttatttga

SEQ ID NO: 88236 - DNA, 885 bp, Glycine max
  Peptide Sequence Number=SeqID_179921
atggaggaacaatcaaagatgcaaaagggttcttcaagtcagagtcaatggaattacgagactcaggaaacgccgattccttcctctattccctctgcctcattgttttcatctgaagaacagtggatacggtacacaaatctcttttcttctcgttctattgttgatagttttgaatgcattcaggcatttgaaaactccaatcttattcctttcatgtctttaaaattgcctgtttactctgatttagtcaaagccttctattcaaaccttgaaatccaagaaggcactttaatttctaaagtttatgggattaaaatgtatgtccatcctccacatggcaaaaggctaaggggagctcaagctatagaggttgctagggtgtttgggtggaacacctatgaattcctagcatcatctacacctcttcatgaagtcgagggtatctaccttgagtgtcagccaatagtagttggtggccactaccttggttgccaagaagcgtccctcggtatgaagaccacacattccttcatgcaaatctcgcatgatgtagtcttcttttggtgcttggagtgtcacctggatgatggtcttgaggtgtctagtcttcttagggctttccaacttggagagcaagtcttccctagtgttgctttcccttggtatgtgctcaagctttctcaacagtttcctgatggagtgatccatcttgataatgatttggtgactctaatagtatggcctgaggtgtcaagcaaaggttaccgtcttcctgaacgaaggctgagcttatggcctcctcagctactgaaagataaaggagcaagggtgctcttggctttggtctacttaggattggcgatatggcaatggttttcttag

SEQ ID NO: 88237 - DNA, 436 bp, Glycine max
  Peptide Sequence Number=SeqID_179922
ccaagatgaggctacttcttcaccttcccctagtgaaagtgaagaagcaaaaggggaagaatcaagtaaagagatctaccccaaagaagaaggaaaacctttaatggttaaggaagagtgtaaggagacacttgttagcattgccatacctcttaggcttgagtttattcctcaagtaaaggagttgttggatgagggtgcaacactcttttgtaaaatcactcgtgcacccaacatcttcatgatttgtgtacatagggactcattagcaccactcattgagttggtgagaaaccatgttccttcatgggaagatgcccaggaaatgggtgttgagaaaaaaagcccagagtttcaagaacctcgggatttgaggtcaaatccttttcaagggggagggaatgatgcaatcctaccccgcaagggcattggatag

SEQ ID NO: 88238 - DNA, 411 bp, Glycine max
  Peptide Sequence Number=SeqID_179923
atgactactctagttcatacatggagcattctttccttctctaacctgattcctacctcccacacatctgatgtgaccttggacagagccaagttgatttatggtgtcattatgaagatggatatgaatttgggaaccgcccagccttctccttctggagggggtggggcctccgtagcccaggagcctgaactagagcagccagcagcagcagcagcagagggggaggatgagctcacccctcctaagcccttttattttgatgcagatatacacatggctcaggaggaggagacttccacagaccaaatcctaaagccatccccagcacccatacctaatgatgccataccatccgcaccagcatctgagttagagcagcctatctctcacgattcaccagctgattag

SEQ ID NO: 88239 - DNA, 258 bp, Glycine max
  Peptide Sequence Number=SeqID_179924
gcgagggtcacgggtgcgctttccaaaggaggaaagatgcgcggagtcaccaccaacgaaggtattagcacctctcacgtcgacaaaagcggggcttttgctcctacgtaccctccatcaaagaggaaattagacctacgtagttctttccttaaaggggaagagcttgccacccagctcgcccaggcgagcaaggttgcttcctccagaagcaacagccttctggaggaagaatctggaaggcccaagtgggtctga

SEQ ID NO: 88240 - DNA, 558 bp, Glycine max
  Peptide Sequence Number=SeqID_179925
atgagtcttcattcttcatctagtgttaatggtgagggttctactcctaaggaccccttgtataagatattagatgagttgagatcccttaagttgtggaaagaaaaaccagagagaaaagaaaaagaccaaggtcaaggcatcttaggggtgacaccttctaagcccaaaggtgataagggaaagacaatagaaaaccaagcccctaaggctagtatgcaagagaagactagctctataaagtgctttaaatgtcttggaagaggacacattacttctcaatgccccaccacaaaaaccatgattatgaggagccaatacatttatagtagccaagatgaggctactacgtcaccttcctctagtgaaagtgaagaagcaaaaagggaagaatctagtgaagaaatctacccccaagaagaaggacaacctttaatggttatggaggagtgtaaggaggtaagtgtctcctccaagaggttagttaagaaggaaagtcattttgaaataaagacaaatattaaagaaacttcccctcttagacaggggatcctctag

SEQ ID NO: 88241 - DNA, 414 bp, Glycine max
  Peptide Sequence Number=SeqID_179926
atgttgagtcaacatcccaatattttaaactacactgactctgtgaagaagagagaatctgctctgtccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggaacgcctgatcaaaagactctcagacagtggcattgatgatgctgaggaagaagaagaagcagctgaggaagaagaagaagcaactgaggaagaagacgaagcagctggggaagaggaagatgcaacagaggatacagaatcaaatgatgatgattctgaagccaccccatga

SEQ ID NO: 88242 - DNA, 115 bp, Glycine max
  Peptide Sequence Number=SeqID_179927
atgagtgctctctattccgacttccccagagcctccggtagcacagccgagacagcgatgggttctctgccccagcggggatggagcgaaagaagttttgagaattcaagagaag

SEQ ID NO: 88243 - DNA, 366 bp, Glycine max
  Peptide Sequence Number=SeqID_179928
atggctagaacacgaggtttaggtcgtgttataggtgtctttataggcagagatagacgtgatgaccatgatgcagctgatgttcccgagaggcgtaggcctactgcctcagcccgtaggcaatgggtttatcagatgactgcagatgcacctgatatggctgaggatgttgctgacatgactgaggatatccctgatctggctgaggaggcacctgagatgactgcggacgtacagggtgctgatggtgctaaggggtcagatgctgatgattctgagggattcccaggtgggccacgtgacccagggggagccattgctgatggaagtgtcagggctcgacagagaccgcgcacaaagcattga

SEQ ID NO: 88244 - DNA, 468 bp, Glycine max
  Peptide Sequence Number=SeqID_179929
atgcatactagggcaagatttcacccagcgaccataatgccgatctccccctgcggagggatcacacccacaagacacccagtggacccggagaaatccaacagggccctgaggtttccagctttggttacgggcctctggatcgagcctgcaagacacccagtggacccggagaaatccaacagggtcctggggtttccagctctgattacgggcctctgtcagttctacggagtgcctgtcacccccagcaaggtcatcaggcctcctactaaccgagctttcatcaagaagtgtgcccccaggcaggcacagggcgagacaccacaacagtctggggatggccgacagcgggcaatagacgcaccgccgccacctccagagcccctcagctcatctaaaaaggttggagcgtggcctacgacccgtggccgaccaacaggtgaccaagtccaaagccaaaggtaa

SEQ ID NO: 88245 - DNA, 285 bp, Glycine max
  Peptide Sequence Number=SeqID_179930
atgggcccgaaatctatcctaaggctcatgagaatcctagggccttctcttgattgcatcaattcctttgaggagcaggcgacacagggatccttcgtcccccatgtacgtcaggatgttctcaccgctgctattggacgtccagagcaccctggacgtgtccgtgctactgaagccgatttcaccatcaagcaatattttggatcggctccatggacgtcccgtagctcttcctccctgcctcctgaagaattgcagcagttgaccgagcaaatcagggactag

SEQ ID NO: 88246 - DNA, 1377 bp, Glycine max
  Peptide Sequence Number=SeqID_179931
ttcgacgacgtggctttcttcgccaccgcggcgacggaaaacctcggcattgccgaactgcgcagccatttgctccagctgaccgagcgcgcgcatccgcaacagcagcgttttcgtctggcgctggatcgcgcctttaccgttaagggcgcggggctggtggtgaccgggacggcgttatccggcgagaatcagccggttgaacaggcgcgggccgggcagcgtatcgcgctgaacatcgtcggcgacgcgcaaaaagaggatctcagccgcggcgactggctgctctcggcgcagcccgcagaaccttgcgagcgggcgatcgtcgagctcacctgtcacgcgccgctcagccagtggcagtcgctgcatatccaccatgccgccagtcatatcactggccgcgtttcgttactggaaggcaatctggccgagctggtgctggatacgccgctgtggctggcggacaacgatcgcctggtgttgcgcgatatctccgcccgtttgacgctggccggcgcgcgggtggtgacgctgaatccgccgcgccgcggtaaacgcaagccggaatatctgcagtggctttacgcactggcggcggcgcggggcgacgatgcgcaggcgttggatattcatttgcagcgcgatgcggtgcgtcttgacgagtttgcctgggcgcggcagctgagcgccgacggcctcacggcattaattaaccgtccggactacctgcaggccgggaatagcctgcttagcgcgccgctggccgcccgctggcagaaaaaactgctcgacgcgctggcccgttatcacgaccagcatcgcgatgagccggggccggggcgtgaacgcctgcggcggattgcgctgccgatggaagatgaagcgctggtgctgttattgattgaacagatgcgcagcagcggcgtcattcaaagccatcacggctggctacacctgccggaacataaagccgggtttaccgatgagcagcaggccatctggcagcgtgcggaatcgctcttcgccgatgagccatggtgggtacgtgacctggcgcgcgatctgaacgtcgaagagtcgttgatgcgcgcggtgctgcgccaggcggcgcagcaggggatgattacggcgatcgtgaaagatcgttattatcgcaacgatcggattgttgaatttgcgcaattgatccgccgcctggatctgcagcgtggttccacctgcgcggcggattttcgcgatacgctgaatattggccgtaaactggcgattcaaattctcgaatatttcgaccgcattggctttacccgccgtcggggcaacgatcatctacttcgcgatgcgctgttattccctgaaaataaaaacggcgaataa

SEQ ID NO: 88247 - DNA, 324 bp, Glycine max
  Peptide Sequence Number=SeqID_179932
atgaatttattgcctagcgctgttcatgtgtcctccaccttcgagtctggagccccgcgaagttattgtgtagcgctgttcgtcaattctccattctccacttctttttcggagacccatgaatttattcctagcgttgttcatgtgtcctccaccgagtctggagccccgcgaagttattgtcgtagcgctgttcgccaattctccattctccacttttttcggagccccatgaatttattgcctagcccgttgttcatgtcctccaccaatcgagtctggagtcccgcgaagttattacgtagcgctatttgccaatcttga

SEQ ID NO: 88248 - DNA, 618 bp, Glycine max
  Peptide Sequence Number=SeqID_179933
atgattccttttatgtcattaaaattaccatattatcctgagttagtgagagtcttttactcaaatttgaaaattcaggatggcactttaatctctgaggtgcatggtatacctatgattattgatgagtctcttttcttttctttgacacaattacccagtcaaggtgcaccttttaagggtacccttgttgatgacaggaagtttgattactctagtcatgatacccgtcgcatggtctgcattgaccagacggatatgactggtatattgcttgtcgggtcattgacatttgattgtcgcatcatgcattatatcattgttaaaattttgatgcctcgttcttctaatcttgctcaagcttctgaggaggacttgattctgatgtgggctttcttgaccggtcttccaatcgactgggcccatttggttcgttaccgcatgcataaggcattgcggtctggtgcacctctcccttaccctcagcttgtgactttatttcttagacattttgaaattcctatggattctaagccttttgtgctagttaaaagctccttttctattggtgttggtgcggtaacctcctttggctaccgtaaggacgtagatgggtag

SEQ ID NO: 88249 - DNA, 1179 bp, Glycine max
  Peptide Sequence Number=SeqID_179934
atggggacaaatcaaaacggcaaaaggttttatcaagtcaaggttaaaagtctagatgtcactagcctcaaagaattaggacgattgatgggacctctccaaaggcaagccttccgcaaagtgtacgggaagattctagatttggccgcagcggaggtatttacggaagctgtcatatccctcgcccaatactatgaccagccgttgaggtgtttcacgtttggggacttccaaatggtaccaactattgaagagtttgaggaaatattaggatgccctcttggggggagaaaaccgtatcttttctccggctttcttccttccttgagcaagattgcagctgtggttggtgattcagcaaaagagttggatcgcacgaagcaaactcggaacggcgtagtgggcctgcctcggaaatacttggaaggtaaggcaagggatatggcgagccaagagaagtggggcccgtttgcagatattttagctttgctgatttttggggttgtcctcttcccgaacgtcgacggtttggtagacttagccgccattgatgctttcctcgcatatcaccatagcaaggaaagtccagtggtggctatcttggcagatttgtttgacacctttgaccggaggatagggggcagcgcgatcaattggcttcctcgttggaaggaaggcaaggaaggagttcttttctcgtgtggggactaccctaatgttccattgatagggactagggggtgtattaattataatctcgcactcgccataagacagctagggtaccccatgaggggagcgccaaccgaagaaagtctcttgcctttccttgtgagggatctaggcgcgcaaggtctcaaggttatacaaagaatccacaaggcgtggaggagtccgttgaggaaagacaaggagcttaggggcatccgaaatggcgtcatcggaggttatcatggatggctaagaattcatgcgcaagggttagattggctctccaaattgaaagttatcgatgaggagaacttcgaagctccggaggaagatgaagaagtccgagctctaaaattggagctgaggaaggcaaagctcgccaaggagaagttcaaatcagctgctacacacatccggaaagagtgcaccgagttacagaggaaaacgcggccactgcaagagccctga

SEQ ID NO: 88250 - DNA, 90 bp, Glycine max
  Peptide Sequence Number=SeqID_179935
gaaaaagctctacgtgctttgcttagaaggttgttcaattacatggctgccttttgggagatagacttgcacagaaagctatctaactag

SEQ ID NO: 88251 - DNA, 954 bp, Glycine max
  Peptide Sequence Number=SeqID_179936
ctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatttcggcgcacaaaattccaagactatacaaagaatccataaggcatgggaaaccccgttaaggaaagatcaagagcttagaggcattcgtaatggcatcattggtgggtaccacgaatggatgaaagttcatatacgaggtttagattggctcgccaagttaaaagtcgtcagcgaagagagttttgaagcaccggaagaggacgaagaagtccaaactctcaaaagcgagttaggaaaggcaaaacttgccaaggagaagttcaaggctcgcaaggaagagtatggccggaacaaatttcgcggagctctatggggtagcaatagtgaactcaagttgcgaagggaagaaagggaccagtcgcgagcacatagcatggttctgaaagaggagtttgattgcttgttcaagaccaacatgttagctatcgtcgccaagtacgaagaagagttaggtctagccacggcccacgagcatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatgacagacacctactccgcccccgaagagattcatgggcttctcggctattgtcagcatatgatagacttaatggcccacataattagaaatcgttag

SEQ ID NO: 88252 - DNA, 735 bp, Glycine max
  Peptide Sequence Number=SeqID_179937
atgggcggacgcggcgatgggcgtggtcggcgcgctggtcatcgcgcgttggtcatggggcctgatccgcgactcgggcaccgtgctgctcgacgccacgccgcaaagcgcccggctgcgccacgacatcgagcgggcgctggacgccggcgatggccagatcgccgacctgcacgtatggcaggtcgggcccggccacttcgcggcgatcgtgtcgctggtcacggcgcatccgcgcgacagcgctttctacaagggcaagctggcgcatatcgcgggcttgtcgcatgtgacggtggagacccaggccgtgccgtgagcgcggcggcccgcgggctcaatcgcaggcgccggcgtcgcgccgggccggatcgatgcagcgcttccaggcctgcgcatccagcgccgtcacgggcaggaagcgggtcatctcgtgcacatacaggaatacccgccccggggtctcgcgcaaggcctggtggaacggcgcgatctgcccggcgtccaggaccacctggccccgcgcgacggcaggccgtcgccttcgaccgtgtcggccggcacccgtaccagccgccagggttcatcgggaatctcggtggtgatgaccggggaagtgccgggcgccaccggcaggatccggtcttcctgggcgggcggtgcaccagcgtgccgagcggaccggcgcgctggtcgatggtgcgcagcagggcgccggcgtcgtcgcgcacgtag

SEQ ID NO: 88253 - DNA, 804 bp, Glycine max
  Peptide Sequence Number=SeqID_179938
atggcttctagaaagagaaagagcattggtacaaggcccacatctcagtatgacacaagaagattctcttcactagatgcttggactagatacgttgataatgtcctaggaagaaacattttacctaaaaggaaagtagagctatatcacactgagctagatgactttaaggtcgagctggaaacgcataatttccataaacgcctcaccaatttagccgatgggagcatagacctggctttggtgaaagagttttatgcaaatttattcaattctaaggaccgtccaccaaagcagtccagagtcagaggtcatttggtgaagattgatgttgacagtctcaacgcattcctggagacacctgtggtattagctgagggagagcataggagcgctgatttctggcctattctctcacttggatcccagtctaacacttctagacttgggttccctactcttatcaccgcattatgcggagccagaggggttgtatctgatagccttaccttcgagcgcctgagcccggtcattaacctagcctacataaggaagaactgttggaaccccgaggatctaacaatctttatccgaggggctaggagggcgagggcaaggctaactgagcttccttctacttctatagctcctactccagcatccacttcagtagccccttctgtcccagctaagacaaattctcagtgctttaaagccatgctccaaagcattcatcagggacagatcattttactacagagtttacagatgatggcacctccagactctattcctatagtatag

SEQ ID NO: 88254 - DNA, 258 bp, Glycine max
  Peptide Sequence Number=SeqID_179939
atggtgacaacaaaagagcttgagacacgcatggattcttatgagaagatcttctctgatcttcaagaatcaatggaaaattcatttgagatgatgcagaaatctatcgaggaactgatggtttcgattgcaacccaacataagggacctaaaatcacaactgaagatgaaaatcatagtgggactcatgaacccattgtctcggtggtggatagggcgcaaatcccttttccctcttttgatggttctaactattga

SEQ ID NO: 88255 - DNA, 330 bp, Glycine max
  Peptide Sequence Number=SeqID_179940
atggtaatcgattaccagcagctactgaacattctgtttcaatttttaaaccctgtaatcgattacacaatgtcttattttgatgatatcaagaagaatttgcttgagaaagagggagatgtaaatcatgcaagctttgatggtgtcgagaagaaatcacatgtttgtcatcatcaaaaagcgggagaatgtgaatctttgtttcaagattcactaaagaccaagccttgccttaaaacaaagtgctttcaagacatgcaaggctctggtaatcgattaccaggaagtgtaatcgattacccgaagacaggattgagaaatagctgttga

SEQ ID NO: 88256 - DNA, 426 bp, Glycine max
  Peptide Sequence Number=SeqID_179941
atggggttgaaccaagcacatgatttaaggaaaggttcatcaagtcaaggtcaagtatggaagaaagaacgtgctttacagtgcccttaccgaacgcgtactagagctagagtaatgagtgaaatagaggaagttcaggagcaaatgaaggctgacatggaggccatgaaagaccaaatggccgccatgatggaggccatgttgagcatgaagaagataatagaggtcaatgtggctacagttgttaccgcaagtactgccacagaagtggactcgactcacccatctggcctcaatcaagtaaatcctccagtctcggatatagtaagacagggaggcgaagcgttaggaagtacgggtggcacccattttgtgcaggttcagaacaagtattccttcccaccatatggtttgcctcctaactaa

SEQ ID NO: 88257 - DNA, 225 bp, Glycine max
  Peptide Sequence Number=SeqID_179942
atggtgcctctcactgtcccagtgcagggctctaagggtcatacaatgctcaatggaatgccccggaactcctccatgataagctcatgttgcattcaagttgtatcctcggaaaaatggaggcttcttttctggaaaattccttcctctgttggtgtttcggtttgtgttaaggatggtgtttggtattggatgtatgtcaggaaggctttgtggctgatttag

SEQ ID NO: 88258 - DNA, 179 bp, Glycine max
  Peptide Sequence Number=SeqID_179943
atgcacaatagcaataacaacttggggaacacagaccaacacccagcgaaggagagagaaccaaaagaggagctagaaccaccaacaacttcaacaatgcagatggttgcttgtaggagattgttcgtgagaaggaagatgcatttggtttttgggaatgttgtttgcaagccctattg

SEQ ID NO: 88259 - DNA, 516 bp, Glycine max
  Peptide Sequence Number=SeqID_179944
atgatctacacatggacacctacctcgaaggcaaaacgcgtggttcgcggagaagaagcagccgggctcgctggtcttgcggagaagaagaagcacacaggaagaagaaaagaagcagcaagaagtgatcttctgggaggaggaggaggagcgccttttttaaatttttacgattggatattgacaaatattactgattggcggttcaacagccaccatgctggaagctttagatgttgtataggtagtgacagtcctatcgagagtccttcggcttcggttagtaccagaatgctacaaaaggattctataaacctgtcaagtaaatgggaaacaaataagcataggaaagcttatggtttcatttccattccttttctgatcctgtttaaatatttggctactgatagagcatcttttgttgccctgcagttgggtcctgcagtcagccaaatgatgccagttgtggaggcaactcctttttactcaatagctagaaatgcatcagcttcataa

SEQ ID NO: 88260 - DNA, 738 bp, Glycine max
  Peptide Sequence Number=SeqID_179945
atgggatcaaatcaaacacctcttctcaagaaaaggttctatcaagtcaaaatcaagagcttagaggtcactagtttacgagagttggggcaattaatgggtcaacttcaatggcaagccttccgcaaagcctatggtaagatttgggacctagcaagggtagaagtctccatggaaccaattgcatcccttgcccagtattatgaccagcccctaaggtgcttcacatttgaggacttccagctaatgccgactgtggaagagtttgaagaaatcctgggatgcccacttggaggaaggaagccatatcttttctctgggttctatccctccacgacaagagttgccaaggtagtgaaaatctcagcacaagagttggaccaggtaaagcaaaataggaatggggtagtcggagtaccaaggaagtgtttggaggaaagggcaaaggccttggcaaatcaaggcgaatgggcttcttttattgaaatcttggtgcttttgatctttggagttatcctctttccaaatatggaagggttagtggacctagcagcgattgacgctttccttgcctttcatcatggcaaggaaagcccggtcgtcgccattttggccatgtatgacacgttcgacctgagatgtgaaaagagaggtgcaagaattgtttgttgtacacgggctctctatgtgtggctggtttcgcacctttttctccaagaaggtaggcctgtctatctg

SEQ ID NO: 88261 - DNA, 525 bp, Glycine max
  Peptide Sequence Number=SeqID_179946
atgactagaggcaatccatctgacttacaaccctttgatcctgagatagataggacatttcatagattacttagacatcatttagtaccttttgagcatcctgggcattctgttattggtgattttgagcattattgttttgaacattcagattttggacattctgagaacatgacacaacctccaccccgtgagaggactctaagggaaatggctgcacctgatttcacctacgaaatcttgtgcatccaataccctgatgaggatgtcccatatgttcttaaaactggactgatccatttgcttccaaagtttcatggccttgcaggtgaagacctacacaagcatctgaaagaattccatattgtctactccaccatgaaaacccccagatgttcaaggaggatcacatattttttaaggcctttccctcattctttaaaagggagtggcaaaggacctagctatattaccttgctccaaggtccatcacgagctgggatgacctcaagagagtattcttag

SEQ ID NO: 88262 - DNA, 546 bp, Glycine max
  Peptide Sequence Number=SeqID_179947
atgaagtccaagagaaggccagaatcaaagaagaggccaccaagctctaagcatcatgaagatacaatacagagaggcttgtcaaacccaaggtccactctgttgagtctcgcttctccaaaggctagtcaaacccaaggtctgcccttggtgagtctcgttttttcaatggctcgtcaaacccaaggttcttccttagtgagtctcgcttctccaaaggctcgtcaaacccatagtctgcccttggctcgtcaaacccaaggttcacccttggtgaatctcacttctccaaaggctcatcaaacccaaggtccgcccttggtgagtctcgtaagctcgtcaaacctaaggttctcccttggtgaacctcgccctggttcaaagctcgttaaacccaaggaatacaagaaacccaaggttgaaatcaaacctgagataatcctatgtcacctaactctctacggaaaggtcttacatcctacgtcatcaagacctcactatcggcctatccttaataccacaagaaacgaagcatcgcacaaataa

SEQ ID NO: 88263 - DNA, 216 bp, Glycine max
  Peptide Sequence Number=SeqID_179948
atgcgatcaagggagacacttgggcgagaggaggaggacgaaggcgaccctgacaccagagtagccaaagagggagcaggtgaagttgaagaagagggaggtggcatttttagagcactcattgtcatcacaccagtgctcaacaagtgtgtatcaatggtggacggaggggtcacggcaggaccagccaaagctgtggaagcaatgtcttcctag

SEQ ID NO: 88264 - DNA, 234 bp, Glycine max
  Peptide Sequence Number=SeqID_179949
atggggaaggggagcttacggtggcaccttccggaagacccgtttggggttcttccggaaattccggaagaaggtcttccgaaagatttctggaagaagggttcttccggaagtaataaaacgtattccgaaagaactggtcttccggaaaactcccggaacacctcttccggaaagtttccggaagaagtagtttttccgaaaacatttcggaagaagggttcttccggatga

SEQ ID NO: 88265 - DNA, 381 bp, Glycine max
  Peptide Sequence Number=SeqID_179950
atgcccttccgcgaagaccatttttggaagaatcttcttccggaaaaagatttcgtgattccggaagaactcatgaacactttctggaagaacgtcatccggaatatttccggaagaaggttcttccgcaagataaccttctacttccggaagaaggctttgaagatttggtggtcccgtgaagtatttgaagttttggtggtccccgtgaagcagtttttagagaagaaaaacagtaaaaagctgtatccggaagaaattttaagtactggaggaagaagttctggaatgagaatgttgaatttccggaagaacttcttccggaagttactaaggctcattctggaagaagtacttccggaagtacttcttccggaatga

SEQ ID NO: 88266 - DNA, 770 bp, Glycine max
  Peptide Sequence Number=SeqID_179951
gccttggcaaatcaaggcgaatgggctttcttttatttacatcttggcgcttttgatctttggagttgtcctctttccgaatatggaagggttagtggacctagcagcgattgacgctttcctcgcctctcatcatggcaaggaaagcccggtcgtcgccattttggccatgattctatcttcatgcgaaggatatcccatgagaggagtgccatcagacgaaagcatcacgcctttcatcgcacgaggtttcagtgaccacaacgcgaggtccgaacacaaggactgggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctctgaagaggtgaaaggaatcatcacgggtcaaaggcatgatcttgaaggacgagctaaagggaatatgtgggccgtcatcgatgagtgcaaagagaagctaaatctagcggcgactcacgagcaaaggctagaggatgagtacaccaagatatcagtagaaagggaagcaagggaaagggtaattgattcattgcaccaagaggcaacaatgtggacggaccgatttgctcttactttgaacaggagtcaagaacttccccgattgctagccaaggccaaagcaatggcggacacctactccgcccccaaggagatccacggacttctcagctatt

SEQ ID NO: 88267 - DNA, 490 bp, Glycine max
  Peptide Sequence Number=SeqID_179952
atgtctggacacggagtgcgatcttatgcaggtgagttggttccattggatttagaaattgaagcaacctttagtagaaacaacacagagagaaaaagaaagcttttgcatgacagaacagtagcatcaatccttgaagaggctcacttttctgagtcatcatcttctaattcacctacatccagggaatctcaaacagtagaatttgaagccaaagtcatgtctaaagagcaacctcgacgagtgaccctggaagattactcaagtacatctgtgttgcagttctttactagcattgcacggccagagttgattaagaacaatttgtttcatggtctgccaaaagaagacctgtatgcacatctagccacttatattgaaatttgcaacactgtcagactggctggcgtgcctgaagatgctgttagattgagcttgttttcattttccatgtctggagaggcaaaaagatggctccatttatttaaag

SEQ ID NO: 88268 - DNA, 195 bp, Glycine max
  Peptide Sequence Number=SeqID_179953
atgttagtctcttcgcgtcaacgggctcgtttgcctctagctgacaaaaggtatctctgtatgtcatcggacatgccgtctctggatgacaaaggtgcagatgacgacgttagtctctgcatgctaccgggccctcgagtcatgatagcagaaggtggggtggtcgacaaaaatgaggcttttgctcttatgtag

SEQ ID NO: 88269 - DNA, 331 bp, Glycine max
  Peptide Sequence Number=SeqID_179954
atggctccgaagaagctatccatgaagaggtctagaagagacgccgcagcagaagggcccagtgccatccccgagtttgatagtcaacgtttccagagcgccgagcaccaacagcgcttcgaggccatcaaaggatggtcgttccacagagagaggcgtgtccagctcagggaggatgagtatacggacttgcaggaggagatggctcgcagatgttggacgtcgctggtgactcccatggctaagtttgaccttgagatagtcctagagttctatgctaatgcttggcccacagaggagggactgcgagacatgtgtacgtgggtgaggg

SEQ ID NO: 88270 - DNA, 435 bp, Glycine max
  Peptide Sequence Number=SeqID_179955
atgtctctcaatcaagttcttgtgaaaagagacgcgttgtctcacagaggagtgctgagggacgatgctgacaggcgctgtgtgttatgctcaagtgaggacgagactgttaaacacatttttttggactgcagagtcgcaaaaaaaatatggcagcaggtttgtctttggctggatgatccggttgtggaaggggaagatattcaagcccactttatggcattcgggaagctaattatagggaagaaacaaaagcgagttaaacatcttatatggatggcggtaatttggaatatttggttgacaagaaataaggtaatctttaaagaggaggctgctgcaattccggttatgatttcgggaataaaggattgcgcttgggcttggttcatggcgaggcaagggaaaacttgttgggatggatggtcggactag

SEQ ID NO: 88271 - DNA, 279 bp, Glycine max
  Peptide Sequence Number=SeqID_179956
atggggatacaaaagaattctcaggcgggagaagagagacacaaaaagaattcaggcggttattccttggcgaattcttttcggaaaagagagaagggaatgaaaaagatgaatagtacaagttttcaaggtttggaaaatcagaaaacttcagaaagcttttggtacaaagaagaagaagaagttcaaagagattcaaggcttgtaaaggattgtaagagattgattggaaaagtattcaagatgcttgaaatgcaaaacaaagccttgcttttatag

SEQ ID NO: 88272 - DNA, 657 bp, Glycine max
  Peptide Sequence Number=SeqID_179957
atgtcgacaaggaaaccctcaaggacgcgccgggcttcgacaaggacaactggccgagcatggccgacgagacgtgggcgcgcgacgtgcacaagtactacaaccaggacgtctactggtaaggagcgcttgccacggccggcggccggcatatccgcttgcgcggacctgccggccggacccggcgcggcggcggcgtcagccggcgtcgatccagcggccgaggtctggccgcacctgctggcgcgcgcggccacgccgcacctgctcatcgtccagccgcgcggcgcccgcggaatcgatatcgaaagcgatgcccagcgcgccggccacgccgggatcctcgatgggcaactcccacgtcaggaacacctgcgacaagtcgcggctcgccgggaagtcggcctcgtcgaacatgctggaaccccgcggcaccacgccatgaggctggcaggtgtcgaacagcaccgcggtgccgcgcgtcagcgcgatgcgctggccgctgttggcgaacagcaggtccagtcccttgtcctcgctcaggaacagattgcagaaggccgcgccgccatactggtcgccgtcgtggtggtagcgcgcgccgcggcaggccatcaaggcgatatcgctttcggccagcgcgtcgcccaggcctag

SEQ ID NO: 88273 - DNA, 588 bp, Glycine max
  Peptide Sequence Number=SeqID_179958
atgtctcagcatatcagtgttacagttgtggattctgtaagtctttatataaaaggcttttatttacctaggcatctcactgaaacatgtatgcgagcggggaattatgatatctatggattcctcgagcctcagtccattcagaggtctgggcaatcacagtttgaatctgaaagttacataaagagttggatgcagagttcacaacgcgatgtgtatcttggagcctacctaaatgggttccactgcagcggacattggcagatggtggtcatcctgcccaaggatcacttagttgtctggttttgttcattgcataacaggccagacaactaccttaaggggattattaatagccttaaatcaaaggctcctgctaggtggattgtcgtcaagtgtaatagacaaaaaagaactactgagtgcggctactatgtgatgcattggatgtccaccatcattttaggaacttttagaaataattgggaagcgtattttaacgatcctagaccattggagcctatgagattaaaagcattgcggatccagtgggcacagttttatctccgagttagagatcaggcctag

SEQ ID NO: 88274 - DNA, 159 bp, Glycine max
  Peptide Sequence Number=SeqID_179959
gctgtagccagaggactaaaagatccttcttttcgtgtgattcaaaaccactttgcaatttctggaaatctaggagaggtagcagcaaaggttagatgggaaatccagcaccacaatcttctcaatagcaggagaaaatactctggaaactcaaggtga

SEQ ID NO: 88275 - DNA, 450 bp, Glycine max
  Peptide Sequence Number=SeqID_179960
atggctggtgaagatgacttctttgcaaacccttcaagttattcatatggctctgacttcagttataaccactacaaggaaactcttgtcttagttcccaaaggagatgagttagagtacagagacaatctgatattggtgagaatgattgatctttcaagtcaaatccctcaaagcttatctgatttgtccttcctcagtttcctgaatctatcataccacaacttatcaggcagaattcccacgagcacccaacttcagagctttgaagaacttagctacactggaaatcctgagctttgtggtcctcctgtaacaaaaaattgcacaagcaaggaatggttgagggagagtgcttctgttggacacggtgatggtaatttctttggaacatcagagctttcattggtattaaatgttcttaatgttaagagaactagacgagcttga

SEQ ID NO: 88276 - DNA, 333 bp, Glycine max
  Peptide Sequence Number=SeqID_179961
gtggcctggccaagagcccagccttctccttctagagggggttgggcctccgcagcccaggagcctgcttctgaggagccagtagcagcaaaagaagagggggaggatgagctcacccctcctaagcccttttattttgacgcagatgcacacatggctcaagaggagggtacctccatagataagatacctgagccatcctctgcacctactcctgaggagacccagccatctacaccagtcacggagccagagcagcctatccaggattcatcagcagctccagcactagatcttaatgaagatcaaccacaggatgagcaggacatttaa

SEQ ID NO: 88277 - DNA, 687 bp, Glycine max
  Peptide Sequence Number=SeqID_179962
atgtctctcaatcttccctactttcttgaatttgttaaagttttctataataatttgaaaattcaggatggtgttctttattctgaggtgcataatattcccattgttgttgatcagtccttgttttattcattgactaaactgcccagtcaaggtgttccttttgagggcactcttgtggatgactggaaatttgattattcaagtcatgatgctcgtagaatgatatgcaatgaccaggctgacatgactagtagattacttgttgggtcatttactttcgattatcgcatcatgcacaatatcattattcgtattttgcttcctcggtcttcaaatcttgcccaagcctctgaggaggatttgattctcttgtctttctccattggtgtcggtgttgttacctcctttggttaccggaaggatgttgatggtcagtgggtttgcaaacaagacttgccaccacctattcctgacgaacttaccccatctcctccaccagaaagggatgcttcttcttctctgctgactaaattcctcacagagctccgtgatcttcaagcatttgtgggtgagcgttttgatgcgatagatactcgctttgatgggatggatactcgtatcactaggattgaagatgatatgagcttcatcaggcgttgcttcgatcccacagctgactcttag

SEQ ID NO: 88278 - DNA, 1176 bp, Glycine max
  Peptide Sequence Number=SeqID_179963
atggctacctcaccaaaagaaacttcatctcctggttcaccctctgtaccatcatctccatcatccaccaaagcaccatcaaaccaggaacaacctgaattccatatccaacccatacaaatgattcctggtcaagcccctgttcctgagaaactggtccccaaaagacaacagggagtgaagatttctgaaaaccctagccttgcaacaagtcctagggaagtagacacggagatggataagaagatccgcagtattgtgagtagcattctgaaaaatgcttctgtccctgatgctgataaagatgttccaacatcctccaccccaaatgctgaagtcctctcttcatccagtaaggaggaatcaacagaggaagaggatcaagccacagaggagacccctgcaccaagggcaccagaacctgctccaagtgacctcattgacctagaagaagtagaatctgatgaggaacccattgccaacaagttggcacctggcattgcagaaagattacaaagcaaaaaggggaaaacccccattactaggtctggacgaatcaaaactatggcacagaagaagagcacaccaatcactcctaccacatccagatggagcaaagttgcaattccttccaagaagaggaaagaaatttcctcatctgattctgatgatgatgtcgaactagatgttctcgacatcaagagggccaagaaatcagggaaaaaggtgcctggaaatgtccctgatgcaccattggacaacatttcattccactccattggcaatgttgaaaggtggaaatttgtatatcaacgcagacttgctgttgaaaagtggaaatatgtatatcaacgtagacttgccttggaaagagaactgggaagagctgccatggattgcaaggagatcatggacctcatcaaggctgctggactgctgaagactgtcagcaagttgggagattgctatgaaggcttagtcagggaattcattgtcaacattccctctgacatatcaaacagaaagagtgatgagtatcaaagagtgtttgtcagaggaaagtgtgttagattctcccctgctgtaatcaacaaatacctgggcagaccaactgaaggagtggtggatattgctgtttctgagcatcaaattgccaaggaaatcactgtcaaacaa

SEQ ID NO: 88279 - DNA, 309 bp, Glycine max
  Peptide Sequence Number=SeqID_179964
atggggctagtggacctagccacgattgatgccttccttgcttatcaccatagcaaggaaagtccggtcgttgctgttttggccgatgcctataacacctttgaccgaagatgtgaaaagagtggtgcaaggattgtttgttacacaccagctctttatgtatggctggtctcacacctctttcgtcatgaaagtagacccgtctatcccctacaaggtcaccacatatgtgtcgagaaagggaaggccaattgggagcagctcttggctagtatggtaggggtgtccgttaattggttcccccaatga

SEQ ID NO: 88280 - DNA, 1125 bp, Glycine max
  Peptide Sequence Number=SeqID_179965
gtcgctctagaggatcccggtcggataaagggtggcggaaaccagattcaggccgttctgcgcgccggccacgccgaagcctatcaggaacacgacggcggccagcgtgtagacgtcgcccatcagatacccggtcgcgccgatcaccagcgcggcgcccaggtaggagacggccagcacgcggtagggcccgatccggtccatcagcagcgccatcaggatggcgcccagggtgccgccgagcggcaccatcgccccgatgcgcgaggcgtgggcgatatcgtaaccggcgtctttaagtatcgtcggcagccaactggtgagcaggtagaacacgaacagcgagcagaagaacgccgcccacagcagcagggtgcgcacggcgcgtccttcgataaacaggtgcgagatcggcgacttggcctgcgccgggcgctcgtcatcgacaatggttatccccgtccaacgttggccggtgatacgctcgaccacccggcgcagccgatcggcatgcctggcgctggcggccataaagcgcaccgattcgggcatctgccaggccagcagcggcagcagcgccaatggcgcgatgccgccgaccagcagcacgccgcgccagccaaatgcaggaatgatctgcccggccagcaggccgcccagggccaagccggcggtaaagccgctccagctcagggtcggtatcgcgcccccgaggccaatgccggtgatgaagcgcaacagggtcagggattcgatcgaatgcgtataggccgaagccagggtgcagccgccaaataccagcaccgcgacgagcagcacgcgtttgcggccgatggcgtcggcgatcggcccgaacagcaggctgccgatcagcaggccgaacaaccccgcgccgaaggcgggggagagctgcgagggctgcagaccccactcttcgcgcagcgccggggcgatatagccgatgatggcggtatcgaacccgtccagcagggcgatcaggaaacacagggtgaggatgaggatttgataaggcgagatcctggcgcgatcgataatttcgctgatgcgagcggtatctgggctcatgagggttccactgttattaagctggtgtgggctggctga

SEQ ID NO: 88281 - DNA, 246 bp, Glycine max
  Peptide Sequence Number=SeqID_179966
atggctcaacctccaccttgtgagaggactcttagggagatggctgcacctgatttcacttatgaaagcttgtgcattcaatatcctaatcaggcttttccatatgttctcaagactggactaatacatttgctgcccaagtttcatggtcttgcagcaagagacaagagtctccattcagagtctgacaaatcagatggggcagatggctactcagttgaaccaagctcagtcccaaaattctga

SEQ ID NO: 88282 - DNA, 198 bp, Glycine max
  Peptide Sequence Number=SeqID_179967
atgaagtttaatgacactgagtctgataaagatttgtcagagctagatgagtccattgcatatctaagactagacaatggtattaaagaaaaagtgtcttctagtcagagttcagaagctggagcacccactcaacatatggatgatcacatacaaccaaggtcatcacttagaccacaaggcaacactgcaagatga

SEQ ID NO: 88283 - DNA, 138 bp, Glycine max
  Peptide Sequence Number=SeqID_179968
atgtggagaagcaacatcacaatggaacatggcgcaggatatgggagttacaagtgggcaaggacaagcatcagtacttacaaagctattgtgtatggaggaaagggatatggaggaggccaaaaggatgggaaatag

SEQ ID NO: 88284 - DNA, 480 bp, Glycine max
  Peptide Sequence Number=SeqID_179969
atgtcagaactaggtcaattttgttcaaaacacagcaccgaaaacacccccagaggaactccagaacatcccccaaaaaagagacaaaataaaaatacagtaaatctcaataaagatgatgttattgagaaccatatgactaacgctgcacgaggaccgttagatgtaaatcagaaatggatatgtgaatgccacgtgtggttgtcgaggatatgcgacaacaatagcagcctacgtcagaggacgctgcacgcttcgattggtaggagatccgatatcccgaggtggtccagatctcgccctttatatttgattggacttcgacagcaaatgcttaaggaagctcctcctccattactaggtacaagatcaatggcaacagaatggagaaggaggaaaggtgattggaaacgccacttcaaggagaagatgagtcaagaacaagctcaccatcataggaagtcatggataagagtttga

SEQ ID NO: 88285 - DNA, 219 bp, Glycine max
  Peptide Sequence Number=SeqID_179970
atggagaaagacgcattgcacgtaggaccatggaatggaggcttcaatcccttcttctctctgatgttgggaaccctatcagagcaatcagaggaaaaaattgaggaatctcaggaattttctaaagatgccgctatttttgttgaaagacaagtgaacccgcttagagttgatgtcccaatgagaaatttctatgaaattgatgtgttcttctgttga

SEQ ID NO: 88286 - DNA, 315 bp, Glycine max
  Peptide Sequence Number=SeqID_179971
atgagacttacctgccaagcgctcaagcatttgatcaatgaaaggaaggggaaaatgatgttttttggttacctggttcagcctcctataatcaatgcagactcgccagctgttctgcactttggtggggatgagttcatcccattcattcttaatcactgtgaggcctatcttcttaggaaccacttggactggactcactcactggctatcagaaatggggtagatgattccagcttaatgacggggttgagtcaccgttgtggttgcctcactggcttggctccatcctctaaaagtatcctatgtatgtag

SEQ ID NO: 88287 - DNA, 186 bp, Glycine max
  Peptide Sequence Number=SeqID_179972
atgaaagcaccagtcacacttgctcagcctgaaggtgaagatggtgcacttagcaagttggccttcgctcagcgcctatatagcactcatctttcttccagaattgtccatgcgcttagccatcagatggggcacttcgtggatgatgcgcttagccagaagataagtggcttagcgagttcatga

SEQ ID NO: 88288 - DNA, 303 bp, Glycine max
  Peptide Sequence Number=SeqID_179973
atgataaatgcaggaatgatatgcccattacgatgccgtgaagagatgcatgatgggatcaaggaacaagccagagtaatacattgtggtgatagggactataagcgacaatgcatcaccaaaagaggaaaactctatatgaggtttcactgttatcaagcgagtcagagacccagcatgaccacagatcgacctccactccttatggctaacatagacccgggtatagggcctaatatctcaacatgcatgcaaaggtgtaggtgccatgtgtgcatagaacaaaaatatttccaactatga

SEQ ID NO: 88289 - DNA, 311 bp, Glycine max
  Peptide Sequence Number=SeqID_179974
ggatcacaagacacccagtggacccgaagcaagggatcgcgcccgcaagacacccagtggacccgaagaagtccaatagggtcctagggtttccagctctaattacgggcctctgtcagttctacggagtgccagtcgcccccagcaagttcatcaggccccctactaaccgagctttcatcaagaagtactgcgcccctaggcaggcgcagggcaaaacaccacagcagtctagggatggccggcagcgggcaacagacgcaccgccaccacctctagagttcacctcagctcatctacaaaaaggttag

SEQ ID NO: 88290 - DNA, 321 bp, Glycine max
  Peptide Sequence Number=SeqID_179975
atgggctacgtgggagtacgcgagctcagttggaggtgggcaacaggggatggtgggtttatgcgcgcattgtggatgtggaaaaacttgttgtgcaccatcgcccgaccgccacctagtaccacatgtgatggagtggtacctggagatatgtcgcgggggtcaggagaccttggggacgtcaggcgagctcctggcagtcaacagataaaaggaaaaccaagaccacaaagcaaggaggcttgtggtggctggccagctggggctaagatggtctctggtaatcgattaccaggggatgtaatcgattaccaggcttga

SEQ ID NO: 88291 - DNA, 180 bp, Glycine max
  Peptide Sequence Number=SeqID_179976
atgacgtcggccaggaaagatgaccgatccaggccgataatagttttttccggtagaggaggttttgttgttcggtgtcgcctacaaaacttacaatgtaggtcggctagggtttttcgtgcgagctcaaccgaggctgtgtttcggccgacactggcgtgttctcatttactcggctag

SEQ ID NO: 88292 - DNA, 741 bp, Glycine max
  Peptide Sequence Number=SeqID_179977
atgcagctaccgcaagagcccttgaacaagaaaccaagagggctcgcatggaagagcatggccgagacaaattccgtggagctttgtggggcagcaacaatgagctcaagcttcgaagggaagagagggaccaatcacgagtacatagcatggaaactcacaatagctaaaaaagcgcaaaggcacccctataacacccgatccaagagtaagatgggtaacgaagagggagtgcaagaacagatgaaggccaacatgtcgactttaaaagatcagatggcttctatgatggaagccatgttaaaaattcaaaaatcaatagaagacaacgctatggcagccgctaccaacacaactagggaagcggaaccggtgctacagcctgcaatgaactctagccgggacagaagcacgacaggtttcaattggagacttcactccccgtaccgctacagacaatttgagctaagcccctaccttcaaggggcaactccctcctcatgccgactaccctctagaggaagacgacgagggagatgcccatttgggccctttacttcccccaagggagccgacacccatgagttgccctggccaaacataatccaccatgccccgtctcaatccgcacccgttagggaacccgttcccatttcaaaagacaaaggaaagatcaatctgcttgaagagaggttgagagcggtggaagacctcggcaactatcctttctcggagcagtag

SEQ ID NO: 88293 - DNA, 1173 bp, Glycine max
  Peptide Sequence Number=SeqID_179978
atggctacctcaccaaaagaaacctcatcccctgtttcaccctctgtaccatcatctccatcatactacaaaactccatcaaaccaggaacaacctgcactcaatatccaatccatacaaatgattcctggtccaggccctgttcctgagaaactggtccctaaaagacaacagggagtgaagatttctgaaaaccctagctttgcaacaagccctagggaagaagacactgagatggataagaagatccgcagttttgtgaatagcattttgaaaaatgcttctgtccctgatgctgataaagatgtcccaacatcttccaccccaaatgctgaagtcctctcttcatccagtgaagagaaatcaacagaggaagaggatcaagccacagaggagacccctgcaccaagggcaccagaacctgctccagatgttcccaacatcaagagagccaagaaatcagggaaaaaggtgcctggaaatgtccctgatgccccattggacaacatttcattccactccattggcaatgttgaaaggtggaaatttgtatatcaacgcagacttgctttagaaagagaactgggaagagatgccttggattgcaaggagatcatggacctcatcaaggctgctggactgctgaaaactgtcaccaagttgggagattgttatgaaagtctagtcagggaattcattgtcaacattccctctgacataacaaacagaaagagtgatgagtatcagaaagtgtttgttagaggaaaatgtattagattctcccctgctgtaatcaacaaatacctgggcagaccaactgaaggagaggtggatattgctgtttctgagcatcaaattgccaaggaaatcactgccaagcaagtccagtattggccaaagaaagggaagctttctgcagggaagctaagtgtgaagtatgcaatcctgcataggattggcactgcaaactgggtacccaccaatcatacttccactgttgccacaggtttgggtaaatttctgtatgctgttggaaccaagtccaaatttaattttggaaactatatgtttgatcaaactattaagcattcagaatcttttgctgtcaaattacccattgccttcccaactgtattgtgtggcattatgttgagtcaacatcccaatatttaa

SEQ ID NO: 88294 - DNA, 219 bp, Glycine max
  Peptide Sequence Number=SeqID_179979
atggataaccacttgggtttctccgcatgtcatcggactcgccgtctctggatgaaaaaagactcgccgtctccggatgacaaaggtgcagaagacgacgttagtctctgcgtgtcaacgggctcgcttgcccctggttcacaaaaggtgcagatgacgacgttagtctctgcatgtcaacgggctcgcttgcctttggttgacaaaaggtgcggataa

SEQ ID NO: 88295 - DNA, 456 bp, Glycine max
  Peptide Sequence Number=SeqID_179980
atgactaggggcaatccaggtgatttacaaccctttgatcctaaaatagatagaagttttcatagattagttaggcatagtgtgcatcctagtcattctgtgcattttgagcattctgagcattctgttgaggttaattctgaatattctgattttcaacattccactacaaactttcatactgagaacatggctcaacctccacctcgtgagaggactcttagggagatggctgcacctgatttcacttatgaaagcttgtgcattcaatatcctgatgagggtgaagatcctcataagcatcttaaggagttccatattgtttgttccaccatgaatacccctggtgtccaagaagatcatatctttctaaaggcttttcctcattctctggagggagtggcaaaagattggctatactacctttctcccagcgtccattttaagctgggatga

SEQ ID NO: 88296 - DNA, 657 bp, Glycine max
  Peptide Sequence Number=SeqID_179981
atggttaagactagaggattagcccatgcgttagctagggtgttgccagaggtcttggggagaggggatggtgatgattttgacggtgctccccagcgccgaaggccgaccgcatcggcacaaaggcgacaggtacctatcattgttgacgatgttgtgcttacggtacctgtggactcacctgcagtaccagaggcagaggctgttgtagttggggatgagcccatggaacgtcctgagttgaagttatcctcccatgggaggaaggtgcataacttgggcatgcctgttcctgcaattgaggacatggttgctgggacaagattaagtcctttgatcgcgtgttcgataaacatcggtgatcggggacttatatcctcctttgttgagaggtggtaccgggagacttctagtttccatcttcttgtgggggaggtttcgatcatgctggacgacgtcgcgtctctttcccatctgtcgaccgttggcacattccatgacttccagcctctgtgcaccgacgaggcgatgctgctgttggttgagttgttgatggtctcagcagaggtgcccatggctaagacaggtcaatgtggtggaccatacgtacgcctgcagtggctgcgagacgtataccattgcagatgtcagacgtag

SEQ ID NO: 88297 - DNA, 312 bp, Glycine max
  Peptide Sequence Number=SeqID_179982
atgcgagacaatcattacggtgactggatggaatatcatgctgagtggattaatatctggaaaaacaaacgcaatgatgttttaactaggcaatgggttaaaggaatagtgacacacaccaacttcgatgcaccacattcgtttggagaacaaggacaaagttcctcagctgcaacaacccacattgaatatactgacatagaacaacaacatcatcatgatgtgggagaaccaatcatacaggaaagaagaaatccgcgacataatcgacgtccactgccctgtgggattggtcatcatcttggtcattga

SEQ ID NO: 88298 - DNA, 303 bp, Glycine max
  Peptide Sequence Number=SeqID_179983
atggccagtttgggttaccccattcttgaggataaggctgaagaggaacgtggagctggcggcgacgatgactgcaccgaagaaggaaacggggagcattggcgagatatcatggtatccagtttcaggataatgagatcaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 88299 - DNA, 267 bp, Glycine max
  Peptide Sequence Number=SeqID_179984
gatcggaatggtcaatggctgaagaaagacgcactccctcctcaagatgagcgtactccttcacctcccgctcagcgtgaagatacagcactcctgaatgaagtccttactgaattacgaggtcttcgtacttatgttggtgaacgtatcgactcattggatacacgctttgccggcatggatattcgcctcacacaagttgaagaagatgtctccttcatccgtacttgctttgatccaccaccaccgcctccatcatcctgttag

SEQ ID NO: 88300 - DNA, 321 bp, Glycine max
  Peptide Sequence Number=SeqID_179985
atggcagaagagcatgaccagaggattacccttgaggattactcaagatcacctaatgaagacccctatgcacacttggcaacgttcactgaaatatgcaacactgttaagattgccggtgtaccagacgaagccattaggctcggccttttctcattcccattggcaggagaagccaagaggtggctccactcattcaaaggtaacagtttaaaaacctggtgtcgcaacctacccttcggcgggagggcgacgcgagactcgcgtgatgcgttttccatgaaaggaatacgcgcggagtcgccaccaacgtttatttga

SEQ ID NO: 88301 - DNA, 516 bp, Glycine max
  Peptide Sequence Number=SeqID_179986
atgacattgaccattctagagcttttcttgaggctttaccaggttacatgggatgtcactgtgttcgaggtctttaatccagacttcccgctctacataaagcacaaagacctctctgaaatcgcacacggtggtcaatgtctcagcatatcagtgttacagttgtggattctgcatctgactgaaacaagtatgcgagcgaagaattctgatctgtatggattcctcgagctacagtccattcaagggtctgggcaatcgcagtttgagactgaaagttacataaagagttggatgcagagttcaaaacacgatgtctaccttggagactacctgaatggtggacactggcagatggtggtcatcgtgcccaaggaacacctagttgtctggttttgttcattgcataacaggccagacaactaccttaaggggataattaatagtgctttaaaaggtcttgatgatgctccacaacctaaatcaaaggttcctactaggtggattgtcgtcaag

SEQ ID NO: 88302 - DNA, 279 bp, Glycine max
  Peptide Sequence Number=SeqID_179987
ccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 88303 - DNA, 437 bp, Glycine max
  Peptide Sequence Number=SeqID_179988
atgaagaacgtcatgttgaaaacgatgctgctaggggcttttgtcttttcaggcgcaacagtcgcggcaacgcaaatcaatagtcaacaggcggacgccctgacgccgcgccaggtgattaccgttagcggtgccgcgaatctgagcgatgcggaaaagatgttggcggacaaaaccgccaaggcaggcgcccgttactacaaaatcatcgcgatccgtggccgaggtgttgatttcaccctgcgtcacgccatcgcgctgataagggtaataataagcgcccatgccgatgataaagtgactgttcaggctgccgccggcggcgacggcgcagccctacccctttggcgcgccggccctgcgttggcattggtcagcacgctgggcgtcgggagggccagcagggttatttgctggacaggaacattctccgaacg

SEQ ID NO: 88304 - DNA, 291 bp, Glycine max
  Peptide Sequence Number=SeqID_179989
atgttgtggaagcttggagggattgatggggacccggtgttgagaggaacgaggataagggctacgtgggagtacgtgatctcagttgaaggtgggcaactggggatggttgatttatgtgtgatttgtggatgtggagagtcgacttgcaccatcgcccaattgccacctaagtggtacctggagatatgtcgcgggggtcaagagaccttggggacgtcaggtggggtgttattgcccaaaaccaagcttgaccaatcccgacccaacccaggcatagtcagtcagtga

SEQ ID NO: 88305 - DNA, 54 bp, Glycine max
  Peptide Sequence Number=SeqID_179990
gtccgacgtgtctccacattgtctctggattccacctcttcccgtccttcatga

SEQ ID NO: 88306 - DNA, 135 bp, Glycine max
  Peptide Sequence Number=SeqID_179991
atgctacaagccattaaagaacgaccacgaacaagggaggacgaagatgcacggaggagagaagacgacagcggaggaaaagaattgaaaaacgcagaagaggaagctgaattgatgctggatttgaatgactaa

SEQ ID NO: 88307 - DNA, 698 bp, Glycine max
  Peptide Sequence Number=SeqID_179992
gcactcaagaggaagcagctgaagcatatgatgtagctgcaatcaaatttcgtggggtgaatgctgtcaccaactttgacatatcaagatacgacgttgagagaataatggccagcaacacccttctagctggagagctagctagaagaaacaagaacagtgagccaagaaccgaggccatagagtacaatgttgtgtcaagccaacaagtcataagcaacagggaagaagttcacgagactgtgaacaacaacaacaataataatagtgaaaatggttcatcatcagattggaagatgagtttgtatcatcatcagcaacagtcaaacaactgtgaccagaaaaccatcaagtgtgaaaattataatagaggtggtgctgctttctctgtgtccctacaagatctcattgggattgactcagtaggatctagccaaggcatgatggatgagtctactaagatagggactcatttttcaaacccttcctcgctggtcaccagtttaagcagctcaagggaaggtagccctgataaaatgggccccactttgctcattccaaagcctccaatggggtcaaagattgttactagccctactgttgccaatggtgtcactgttggctcttggtttccctctcaaatgaggccagtctcaatgtctcacttgccagtttttgctgcttggagtgatgcctag

SEQ ID NO: 88308 - DNA, 150 bp, Glycine max
  Peptide Sequence Number=SeqID_179993
atggcgaaacagtggctcaggttgatggaagatgatgaagggggcaagcttggccttcaagagaagaacctctccaactctatctatctacactttgtatacaaatctcacacgccctcaagaaaaggagagttgtacttaaaatattaa

SEQ ID NO: 88309 - DNA, 1167 bp, Glycine max
  Peptide Sequence Number=SeqID_179994
atggcccaagaagcttgcctcaaagagatccaggaaagacaaagcgttgaaggaaccagttccactcccgaatatgacagccatcgtttcaggagcgctgagcaccagcaacgcttcgaggccatccaaggatggtcattcctccaggagagacgcgtccaactcagggacgacgagtataccgacttccaggaagagatagctcgccggcggtggccattgctggttacccccatggccaagttcgacccagacatagtcctcgagttttatgccaaagcttggcctacagaggagggtgtgcgagatatgcgatcttgggtgaggggtcagtggatccctttcgatgcggatgccttcagccagttcctgggataccctttagtgcttgaggagggccaggagtgcgagtatggccagaggaggaaccaggccgatgggtttgatgaggaggccatcgctcagttgctatgtataccggggaaggattttgcctggactgctgttgggagacgggtgcggatcatgtgcaccaacatgaccaccctgacccagatatggatgacattgctgctcagcaacatccagcccagcgatcataattccgacctccccctgccgaagtgtcagctggtgtacgccatcctgacacggatgagcattcacgtggctcagttgatcgctgatgccctttatctatttgcaggtatggcgccgaccaggcaccctttggactcggataagtccaacagggccctgggatttcccgcattgatcacaggactttgtcagtcgttcggagtccccgtcgcacctagcaaggccggagacgcgccgccacctcatcaggctggcccagctgggtcatttgatttggagcagtatttacggcatgtggttcgccagcaggcggccaaccaccaggcgcacgtgcagacccatgactgtctttaccagctgagcctcagcctgcaaagccagggttttacttcttttccatgccctactccggatcagtttagggcagaggtcgcatggcccggagattggcctgaggcccaggcaggggaggcacccgcagaggctcccggcgaggcagatgaggcccgcaaggacgaggaaatgactgatttgcttgatttcttgggaaggagcggagccacatga

SEQ ID NO: 88310 - DNA, 255 bp, Glycine max
  Peptide Sequence Number=SeqID_179995
atgaagttttcgaaaaaacctgatagtggaggaagacctcctaaggatagagacatagggctaaagagagagccaaataaggatctttcgtgtataatcctgcataatctcgaatgttatcagttccgctactttcgaagtaacagaaagaaaagcaacgactggagtgggagagtcagagtcgaaaagaggattcctcacttctttctctcattcaaaaccgtgcatgagactttcatctcgcacggctcctaa

SEQ ID NO: 88311 - DNA, 162 bp, Glycine max
  Peptide Sequence Number=SeqID_179996
atggaggaggataaaagcaatgcatatataagattactacagtacctgctaaggaagaggaaatctggggtgcattgttcaagagaatcagtgatcagtcccaacagtaatataaggttaatgtcagttgagactgcattaggtacaaaggaaatatgtgag

SEQ ID NO: 88312 - DNA, 900 bp, Glycine max
  Peptide Sequence Number=SeqID_179997
atggaagggagtctctcacctttccttgtgaaagatttaggcgcgcaaggtctcaaggttatacaaagaatccacaaggcgtggaggagtccgttgaggaaagacaaggagcttaagggcatccgtaatggcgtcatcggaggttatgatggatggctaagaattcacacgcgagggttagattggctctccaaattgaaagttatcgatgaggagaacttcgaagctccggaggaagatgaagaagtccgagctctaaagttagagctagggaaggcgagactcgccaaggagaagttcaaatcagctgctacacacatccggaaggagtgcaccgagttacaagaagaaaacgcgaccactgcaagagctcttgaacaagaaaccaaaagggcccgcaaggaggaatatggccgagagaaattccgaggagcattgtggggtagcaacaatgagctcaagctccgaagagaggagagagatcggtcacgggtgcatggtatgatcttaaaagaagagttagttgcttgcgcgaggtccaaacagagtttggctcaacacttggaagccacggagcaaagcatgctagctatcatagggcaatacaaggaagagttgaaccagtctgtggcccatgaacaaaagctagtggaggattttgcacaagtgtacgccgaaaaagaagcaagagggagggtgattgatgcattgcatcaagaagcgactatgtggatggataggttcgccttgaacttgaatggaagtcaagacctcccgcgtctattagccaaagcgaaagccatggccgaagtgtgtacggcccccgaggagattcatgggctaatcaattactgtcaacacatgatagatttgatggcccacataattagaaaccattag

SEQ ID NO: 88313 - DNA, 546 bp, Glycine max
  Peptide Sequence Number=SeqID_179998
atgggtgaagtagaggaggtgcaagagcagatgaagaccgacatggaggccatgaaagagcaaatggctacaatgatggaggctatgatgagcataaagaagataatggaagccaatgcgattacagttgccgctaccagcgctgttgctaaggtgaacccaacacccccatctggcctcaaccaaatgaatcatccaacctcagatatggtaggcaaagatttgggaagtacgggcggcccccatgatgtgcaaattcaaaatgaccacgccttcccgccatatggctggcctcccaactatacaccacccaatgtggcatacactcccagtgaggatgtcaataactctgctcccatactcattgaaagccgacaacctcaaactgatcatgtagatgtctctcaaaccatgggagagacacatgaaattccccaccacaatctagccgacttcgagccttgcctcagatatgccactgaagggcaagcagttggtggctcaaggacattgaaggaggcgaagattatgcctttgctaacctag

SEQ ID NO: 88314 - DNA, 235 bp, Glycine max
  Peptide Sequence Number=SeqID_179999
atggattttcaggaagaagtagctcgccgacattggacatcgttggtcactcctatggctaagtttgacccagatattgtcctggagttttatgctaatgcttggcccacagaagagggagtgcgggacatgcggtcatgggtgaggggtcagtggattccctttgacacagatgccctcagccagttcctgggtgactcgctagtgttagaggaaggccaggagtgcaagttta

SEQ ID NO: 88315 - DNA, 51 bp, Glycine max
  Peptide Sequence Number=SeqID_180000
atgagtgtcgaaacctacccttcggcggaagggcgacgcgagggctcacgg

SEQ ID NO: 88316 - DNA, 306 bp, Glycine max
  Peptide Sequence Number=SeqID_180001
gtaccacaacatgtggaggatgagtcatctaaggccaccattccagagccatttgatttaggggaggaggcaggtgagacacaggtaagacatgtagttgctgccactcctgagagatctcttgaggccacttcagagcctcctgcaccagtggtggacctaccctcacctcagcatacaacagttccctccactcctattctagaggtaccaaaggaaccaaccacaccagtcctggctatggacacttctcctcctactactccagtacttcatctgacagatgaggaggatgttcagacatag

SEQ ID NO: 88317 - DNA, 859 bp, Glycine max
  Peptide Sequence Number=SeqID_180002
atgtgatgccctccctggagttattattaccgacagagacctagccatgatgaatgcagtgaaaattgtattccctgagtgtaccaacttgttgtgtaggtttcacatcgacaagaatgtcaaggcaaaatgtaaatccctaattggtcaaaaaaatgcatgggattatgtcatggatgcctggaggagtttggttgattatccttccaagcatcagtttgatgattgccttaagaagtttgaaattgcttgttcaccatggtatgctttaaatcagattgctgctgagtatgagtgtgtacattatgctggcaaaaatccttctcgttgtggatgtgtgatgagaactactcatggtcttctatatgcatgtgagctatccaaatatgttattggtaccatcccacttgattcaatccatatattttggcggaggctaagtttttcagtaactctaaagagtaaagtccaggaaatttcctaccctgatcaaaactctatgtgtcctcttctagaaaaggtcaacaccaaaggtgcacagaagaaaccgatgaccaaacaccaaagatcaacaaagtgtgatccgtcttactggaagtatgttgatgctttacattttgtgcaaaatagtaattcttcagtcaaacgtagtgcatcatcttctgaccaggccattccaagaaggaccatgccgatgttggatcgatttcatccgttcattcatgatctcattgaaaacattgtggatgttaaagctgacgaacttgcccaatggcctgatgagtatatcaacctttttggtggtatagacagatttgaggaattaaagaggtctctacttgttgatggattatccatg

SEQ ID NO: 88318 - DNA, 264 bp, Glycine max
  Peptide Sequence Number=SeqID_180003
atggaagaagctagtgatttttgtttcgagtacatggaaaagacaaaatctgttggggttctagagtctcagcatgatgagagagaggaagatgatgacaaaagtgatgacaaaaagctcaaaggtcaatcaaagaatgagttcaatatattcaagatagaatcaagaacacttcaagattcaagaggaaagttgatttcaagaatcaagaatcaagagatcaagattcaagactcaagattcaaaaatcaagagaaggcataa

SEQ ID NO: 88319 - DNA, 414 bp, Glycine max
  Peptide Sequence Number=SeqID_180004
agatccttcttaatcggtgtcattgtgatttcatcttttggttaccgtaaagagcatgatggctcttgggtaaaaaagggtgctcaacccattgatgaagaaggaaacttaccagtaggagaggattcctctcttcttcaaaggattttggataggttcgatggtcttcaaacctttgttggtgaaagggttgtcatcatcaaaaagggggagattgtagaagcaagcttcatgatgacgaatcaagttgattcaagtagttttgatgataacaaagatgatgacaaaaagcccaagagaatgatttcaagattaagtcaacaagattcaagaatcaagagaatgatttcaagattgagtcaacaagattcaagaatcaagataattttgatttcaagattcaagagaagatga

SEQ ID NO: 88320 - DNA, 396 bp, Glycine max
  Peptide Sequence Number=SeqID_180005
aaccttacggattgtgcatcagtattttcttttgatttccggcatgtcccggaacttcacaaattgcctatgatgggtgccaagcacctcacaaggaccaaacacaagttgcatgcatcaagcacagatagcaagaacaatgtttatacggataaccactcgggtatttccgcccgtcagcgtgactcaaatgtcagtatgacagatcttgtgagcgcggaagatgacacagcaaaaaacaatgtttatacggataaccactcgagtattttcgcccgtcagcgtgactcaaatgtcagtatgacagctcttgtaagcgcggaagatgacacaccaaaaaataatgtttatacggataaccactcgggtatttccgccggtcagcgtgactcaaat

SEQ ID NO: 88321 - DNA, 409 bp, Glycine max
  Peptide Sequence Number=SeqID_180006
atggctccgagaaagctttccgtgaaaagatctaggagggacgccgcgactgaagggaccagtgccgcccccgagtttgatagccaccgtttcaggagcgccgagcaccagcagcgtttcgaggccattaaaggatggtcgttccaccgagagagacgcgtccagctcaaggacgatgagtacactgactttcaggaagagatagctcgccagcgttggacgtcgctggtcacccccatggctaagcaccctctagacccggataagtctaacagggccctggggtttccagcgttgatcactggcctctaccagtcattcggggttcccgtcgcacctagtaaggtgattcagccgccgatcacccgagccttcattgagaagtattacacgcctaggcaggcacagg

SEQ ID NO: 88322 - DNA, 246 bp, Glycine max
  Peptide Sequence Number=SeqID_180007
atgaaagagaacaacggcggtttgtggtggctaatggtggttgtgggtgatggagaaagtgcttgggacgttggaaatggttttggaagaaagaaggagaagaaaatggcgttttacctaagctacttggactacaaggctcaaaatgcacaagtgaacaatgctctcgggaacagaaacttcgtgcacactccagacatcttctctacgatcccaacggtcagatcgtggaaaattgtcttatga

SEQ ID NO: 88323 - DNA, 351 bp, Glycine max
  Peptide Sequence Number=SeqID_180008
atgtcgtcttcaggcacatcacatatggagaagctcgaaattgaacaacggaagatctcgggaaattcaaatggtcataacttttcacacggaggcacatctgatatcgagacacccgaaattgaaccacggaagatctcgagaaattcaaatggtcataacttttcacagggaggtccgattcaggcacttaatatattgagacgctcgaaattgaacaacggaatctatcgagaaattaaaattgtcataaatttgcaaactggggttagattcatgcgtatatccaattcaagcgcattatatatcgagacgctcgaaattgaactacggaagctctcgataaattaa

SEQ ID NO: 88324 - DNA, 766 bp, Glycine max
  Peptide Sequence Number=SeqID_180009
gggatggtgggtttatgcccgatttgtggatgtggaaaacttgttgtgcaccatcacccgaccgccacctagtaccacatgtgatggagtggtacctggagatatgtcgcgggggtcaagagaccttggggacgtcaggcgagctcctggcagtcaacagataaaaggaacaaagaccacaaagcaaggaggcttgtggtggctggccagctgtgaattttgtgtgatatatgggttgtggcctctggtaatcgattaccaagggcttgaaaacgaggtcaggaagctaggggagcttctggtaatcgattaccaaggggaggaatgggtcactggtaatcgattaccaggctgtgtaatcgattaccagagatggaacgcctcgagataccccttttacttgcacccagtgatcgtgatggcggcgcagctaatccatgatcgagtagagatggaatgcctagagggagtttgggagaccctcgaaggcaacacaagagtggatactacccacgcctacaccatatcgtctagtggagccagtccaagtgatcgaggtgacgtcatccgaggaagaaccctgaggaggatccccgaggagctacctcctgagcctgctgcggatgctcttgactttctagagggtgatgaggacccacttcctgaggtggattctcccgaggaagtcatgtcggcatctgaggcagactctacggaggatagtggcctgagagagatggcgaccagtggaggctcttcatcatag

SEQ ID NO: 88325 - DNA, 300 bp, Glycine max
  Peptide Sequence Number=SeqID_180010
atggttaaagaattctatgccaatttatacagcccggaagaccagagctcgaagcaagtgagggtgagaggacacttaatcaggattgatgctgacagcctgaataccttcttagtgaccccagtggttttggaagagggtgagacactgcctagctattccagatttacgaggatgaggattgatcctcaagattttgttgtccgtctctgcatccctggtaggggttttattctgaatgcaaagggccatccttggaagcttatgaggaaagatcttaccactcttgcacagacatag

SEQ ID NO: 88326 - DNA, 705 bp, Glycine max
  Peptide Sequence Number=SeqID_180011
atgccatcagaaaagacatttcaggcatcaggcaacttagtggagagagcttgtatgagtactgggaaagattcaagaaattgtgtgcaagttgtcctcaccaccagatttctgagcatggagaggagtatgattgatactgctagtggtggagcccttggtgatatgacccctgctgaggctaggaatttgattgagaagatggcttccaactcccaacaattcagtgcaagaaatgatgctattatccttagaaaagtccatgaggtggccacggattcatcttcatctgttgaaaataaaaaacttgagggaaaacttgatgccttggtcaacctagtaactcaacttgccatgaatcagaaatctacatctgcccctgttgcaagagtttgtggtctatgttcttctgcagatcaccatacagatctctgtccttctttgcagcaatctggacctgtctcgcccttccagaatgctactggtccaagcaagccatatgttcctcctccaatgcaacaacaacagcagcaacaacaaagacaacaagcaactgaggctcttcctcaaccttccttagaagagttagtgaggcaaatgaccatccagaatatgcaatttcagcaagagacaagagcctccattcagattctgacaaatcagatgaggcagatggctactcagttgaaccaagctcagtcttaa

SEQ ID NO: 88327 - DNA, 255 bp, Glycine max
  Peptide Sequence Number=SeqID_180012
atggaattcaaaattgaaactgcaaaaggtttggccaagaaatttaagcaaaaatgtcttttttcaagagatttactctctggtaatcgattaccagaggagggattaagagatcgaggatctcttgttgtaaagaaatctgaacacaaaggaagggttgttcttgcgtggttcagaacttgtaaaggaattttgcaagatagtggaactctcaagcgggttgcttggagactggacgtaggcacaagggtgtag

SEQ ID NO: 88328 - DNA, 816 bp, Glycine max
  Peptide Sequence Number=SeqID_180013
atgaggtgcaaccctttgaaggcgaggacgtgtactcctctgaaggtgatggtgcatagccctctaaaggtgaggacgtgcagtcctcagaaggtgagggcgtgcaaccctctgaaggcgaagacgtgtagtcctctgaaggtgaggacgtgtagtcctctgaaggtgagggcgcgtagccctctgaaggtaaggacgtgcagtcctctgatggtgacgacgtgcaaccctctgaagccgaggacgcatagtcctctgaaggtaagagcgtgtacccctctgaaggtgaggatgtacagtcctctgaaggtgatgaggtgcaaccctttgaaggcgaggacgtgtagtcctcagaaggtgagggcgtgcaaccctctgaaggcgaagacgtgtagtcctctgaaggtgaggacgtgtagtcctctgaaggtgagggcgcgtagccctttgaaggtggggaagtgcagtcctctgatggtgaggacgtgcaaccctctgaaggtgaggacgtgcagttgtttgaaggtgagagcgcgtagccttctaaaagtgaggacgtgcagtcctgtgaaggtgatggggtgcaaccctctgaaggcgaggacgtgtagtcctctgaaggtgatggtgcatagccctctaaaggttaggacgtgcagtcctctgaaggtgagggcgtccaaccctctgaacgcgaggacgtgtagtcctctaaaggtaagagagtgtagccctctcaagctgaggtcgtgtagtcttctaaaggtgtgggtgcattgttctctgaaggtgaggacgtgcagtcctctaaggtga

SEQ ID NO: 88329 - DNA, 195 bp, Glycine max
  Peptide Sequence Number=SeqID_180014
atgaacattggtggtcaccatgagccactattgctagctgtcgaaccactgcacaaagatgaatgctttaatcaaagcggaatccttagaatccacctcaaggatttggtaaagaaacaggctctcaacccttctttcatggtttctttgagacatgaacgtgagaggcctctgagcaacatggaaaggagctga

SEQ ID NO: 88330 - DNA, 210 bp, Glycine max
  Peptide Sequence Number=SeqID_180015
atggggtgtagacaagaagcattattagacctagatcaaagactagtaattgaattagggaaataccggaaaaaaggagaaattttggaaggtgttgaagttgttgtctcgctaagcatggcccatgcgcttagcgagattcatccactaagcgagacatcagcccacttagcgagtaagaggaatcttggagagaatctgcctcgttag

SEQ ID NO: 88331 - DNA, 576 bp, Glycine max
  Peptide Sequence Number=SeqID_180016
attcattccataaaaagaaataggcttgagcacaagaggttgcatgatttggtgtttgtcaaatacaaccaacaattgaagcaaagatataatgcaagagatgaaattgatccaatttctcttaatgatattgatgtgtgcaatgaatgggtcgtgggagagatggatgaagatgatgataatgatgctggaaatgatttggtatttgaagatgatgatgcgctaaattggacaactgtgtatgaggcttcgggggttggagagtgtaggatgtatactaggtggaaaaaaagggaaagaaagcaaccaacaagtgctgctattagtcctactgctgctgttgctgcccacacttctaaaaaacaggcaatgggtgttggatcttcatcaaggaagcaaaatgtagtcgaagaaaatgacgaggatctagagtttggggatattgaacttgaatctgaagaagaagaaatcatggttaattttgaggcgtctaatggagaagagggagagggagatgttccactaccttatgataacaacgaagatgattatgttggggttggagaagatgactag

SEQ ID NO: 88332 - DNA, 850 bp, Glycine max
  Peptide Sequence Number=SeqID_180017
atgacggcggcaatggctatagtctgcgacggcaacatgccctcttctaaatggctgaaccatcatctaatgctgcagcctgcaacaaggaaaaataagacaggccttggttggaaagccaaagaacacttgattgggaagtctggtaacgttgcatcttgcaacaaaactctaccaaatgtagtcgaagagctgaaggaatatatggctaacaaaaaaagtgggaccacatacagtagttttggcagtggtaatgtggcaagtacaagagattttgaatttggtcaaccaattggatgtgatggaagtgaagatgagtttgcagactcttgcaatgctactgctttagccgcaaagacaaagtgtgggactaaaaaaggaccaatggacagattttgtaagaatccagaaaatgcaatcaatcggagaaaaatggagatgttgaggcaaatgaagatacgagagtcaatggataagaatgaagtattgaatgtgcatcaatatattgcttgcttttggtaccaagctggtttgtcattcaacctcattaaattgaaaagcattgagaatatggttgcagccattggtcaatatgggccacatttgcccattccaagttatcatgacatcagagttccactcctgaagaaggaagttgaatacactgaaaatttgatgaaaggccacaaggagcaatttggtacaatgtttttgaaatctgttgatggctctgattttgtaaagacaggtgaaaagctttttgagttgcttgatgctattgtggaggaagttgaagaagagaacattgttcaagttgtaactgataatgggagcaattatgttttagggg

SEQ ID NO: 88333 - DNA, 305 bp, Glycine max
  Peptide Sequence Number=SeqID_180018
atggcgaaaaatcttcacggaatcacccacggaaacgtttcagatgcgttacggaagcgcctcggcgaaaatgagggagcagcttgccacccagctcgcccaagcgagctaggttgcttcctccagaaggcatcgccttctggtggaacttcctggaaggcccaagtgcggtcaagcaaaggttgcatgccatcaaacaatggtccccggacgaaattagggtatgacacctggcatgtctgggtacgaccatgcgaagatgtcttgatattcttcaagaagggttaccaaaccttggcggatag

SEQ ID NO: 88334 - DNA, 477 bp, Glycine max
  Peptide Sequence Number=SeqID_180019
atggtgaagcatggtgctgcaaaggtagttggtgtcgagggttatggctacgttaatggtggtggagggagagaagctgcaatcctcgccgttgcggaaggtgggggcctcccagaagagagagagctccagggaaggacaactgacaataataatttaacgatctatggcttcaatgaatatctgcatgcgggttttccaataatggtaaccctcaccattgaaaatgggtgggaagaaggagacaaacacacaagagtttttatactggttcggcaacaacccgtgcctacatccagtccccaagcgacctgcggtcctcgagatttctttcaaccttgtaaaaatccttttacaagcaaagatccactagggatgtaccctcccttgttctctttgaacctagtggatgtaccctccactagaactgatccacaagagatgtaccctctcttgttctcagtcaaacccaagtag

SEQ ID NO: 88335 - DNA, 421 bp, Glycine max
  Peptide Sequence Number=SeqID_180020
atgccggaaccatcaaagaaacgcaaaggttcttcaagtagaggccaacgacactccgaggctcaggatattccaattccttcctccatttcctcctcctcattgttctcatcaaaagaacaatgtatatggtacacaaacctcttctcctctcattctatcattgaccctaagttcatagatatggatttcttttctgatgagagtttcaaatgcattcaagcatttcaaaactcaaatctcattccctttatgtctctaaaattgcctgtgtattttgaattggttaaatctttttattctaatcttgaaattcaagaaagtaccttgatttcagaagtttatgggataaagatggtcattgaccaatccctcttttatgatttgacccaattatctagtgatggtgtaccatttgaag

SEQ ID NO: 88336 - DNA, 684 bp, Glycine max
  Peptide Sequence Number=SeqID_180021
gctgaaatgcctgaggagagtgaagaggtgcaagctttgaaagctgagctcgaaaagacaagagtggcgaaggagaagttgaaggtggcagtcactagggttaggaaagaatgttatgagctgaaagatatcaacatgatcgcggatgaagcactagagcaggaaatgaagaagggacaaatcaaggatggaaagcctgatgtgaacctagctgctaatcacgggcagatgctagaagatgaacaggcaaaggtgtcggccttgtgggttgaaagggaagcgagagaaggggtgatagagttattgcataaagaagcaatgaaatggatggacaaatttgttctcactttgaatgagagtcaagagcttccaaggttgttagccagagccaaggtggtggctgacacatactctgctcctgatgaagccgacacggagaccatgaaagaccaaatgaccaccatgatggaggccatgatgagtataagaaaaatgatggaggtcaacacggctacagtcactgccacaagtgccaccattgaggtggacctgactcacccatctggtatcaatcaaagcaagcatcccttcccaccatatggcttgcctcccaactatgcaccacccaatgttgcacacgcacccgatgagaatgtcaacaattccactcttatacccatttag

SEQ ID NO: 88337 - DNA, 141 bp, Glycine max
  Peptide Sequence Number=SeqID_180022
atggatcccgttaagtacatctttgaaaagcccactcttactgggagaagagctcggtggcagcctatgcatccagaattccttaacgaggatattatggccctgtttaaggaggatgttgaagatgaagacaagagataa

SEQ ID NO: 88338 - DNA, 470 bp, Glycine max
  Peptide Sequence Number=SeqID_180023
ggtacatccattgtagtacaagtagagggtacatctacttgggtttgactgagaacaagagagggtacatctcttgtggatcagttctagtggagggtacatccactaggttcaaagagaacaagggagggtacatcccttggtggatctttgcttgtaaaaggatttttacaaggttgaaagaaatctcaaggaccgcaggtcgcttggggactggatgtgttccttttgagggcaccattgttgatgactgggaatttgattattctagtcatgatgctcgccgcatggtctgtaaattacttgctaggtcattgacttttgattgtcacatcatgcattatatcattgttcgcatttggcttccacggtcctcaaaccttgctcaagcctctaaggaggatttgattctgatgtgggcttttcaaaccggtcgacaaatcgactgggcccatttagtttggtactga

SEQ ID NO: 88339 - DNA, 207 bp, Glycine max
  Peptide Sequence Number=SeqID_180024
acacttcctgagcaggtacgagcagttatgcaagtgggatcagcaactttcattatcagagtaatcaagcacagcggaattggtaatggcgacagcaaaattctgcaagttgcaagtcgtttccaggatgtcaagacatctcacgatgtcaagacatcttacgtgacatctcctttctgctccccctgtctccatgctctagctgca

SEQ ID NO: 88340 - DNA, 829 bp, Glycine max
  Peptide Sequence Number=SeqID_180025
atggccagggatagattggcagatagtcaactagataatgtaaaattgagattgatagctggacgtgaaaaatatggtcgtacatacaatctcccaaatgtttctgaagttgttgccctgattgttggtgattttgatgcagactcaaaaagggatactattgttgaaactcaaaatggagaattacaaagaatccatgaattacagtctagctatctaggactacaataccctttactcttcccttatggtgaagatggatatagacctaatatacttcaccgttgtacatctagcagcagaaaaaggaagagaaatcgtctaacaatgagagagtggtttgcttatagactacagtccaggtcaaatgaagcacaaactttgttgcattctagaaaactattccaacaattcattgttgaagcatataccatggttgagtctgaaagacttagctacattaggaacaataaaaaaaaacttagagttgacaagtattgtagtttacaaacatcattggatgctggaagcagtaaagactcttctaaaggaaaaagagtgattttgccgtcaacctttgttggcagtccacgctatatggacctactttattttgatggtatggcaatatgcagccatgtgggttttccaaatctttttattactttaacctgtaatccaaattggcctgaaatccgtagagtacttgcacctttgaatctaaaagcagcagatagaccggatcttatctcacgtgttttcagattgaagtatgagcagatgctttttgacttaacaaaaaaacacctgcttggaaaagtagtcgcat

SEQ ID NO: 88341 - DNA, 363 bp, Glycine max
  Peptide Sequence Number=SeqID_180026
atgccatgccaacatgccattgcaacaataactcacaaaggatggaagcctgaggacatgtgtcatgagcggctttcaatagaagcttataataagacataccagcattttattgaaccagtccaaggaccacaatattgggcccagacacacaatgaacaagctttgaatgaggctgaagaagttgctgctcatgttcaacaagatccggtggagattaatttatctcagcctcatttgtcacaagatagtgacatggagttgatggtccctgcaactattgttccaccaatagcaaggaataagctaaccataacaagagccaaacaaaggaaggttgctgataaagatgatgcagtataa

SEQ ID NO: 88342 - DNA, 170 bp, Glycine max
  Peptide Sequence Number=SeqID_180027
ccgaagaacttggtccttgttctccaaccgaatgtggtgcatcaaactattgtaaagaagctaaatatgatgccactgaatttggtgtattcaaatcgacgccaaataaattggtcatccattcatggctggttacgctgactgactcaccagtctggccaaaagtttga

SEQ ID NO: 88343 - DNA, 216 bp, Glycine max
  Peptide Sequence Number=SeqID_180028
atgacggtgaaaacctctgacaacatgcagctcccggagacgatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 88344 - DNA, 156 bp, Glycine max
  Peptide Sequence Number=SeqID_180029
atgtcatcggaagaaaacagagttaatgacctgggagatgaaaaggaagaaggatttggtgctggtgggtcaccggatgtgtcgtggcggtgttggcctacagcgatggtggtggaggaggatccctttctcttcttcgaggattatgccatttga

SEQ ID NO: 88345 - DNA, 448 bp, Glycine max
  Peptide Sequence Number=SeqID_180030
atgggtcaacttcaacggcaagccttcgcaaagcctatggacttccagctagtgccgactgtgaaagagtttgaagaaatcctgggatgcccacttggaggaaggaagccatatctttcctctgggttctatccctccacgacaagagttgccaatgtagtgaaaatcttagcacaagagttgaaccaggcgaatgagctttcttttattgacatcttggcacttttgatctttggagttgtcctctttccgaatatggaagggttagtggacctagcagtgattgacactttcctcgcctttcatcatggcgaggaaagcccggtcgtcgccattttggccatgtatgacacgttcgaccggggatgtgaaaagagcggcacaagaattgtttgttgtgcactggctctctatgtgtggctggtttcacacccttttctccaagaag

SEQ ID NO: 88346 - DNA, 321 bp, Glycine max
  Peptide Sequence Number=SeqID_180031
atgcagaactatcaacatgcaaagagatgtgattctgcaaaagggaggaccaacagaaaacgtgttatgcagcagaagcgacatggtcatgctgagtcatcttcacaaccaacaattaattgcactttagaatataatataattgtttctgattcatcagaaagtgaaaattctgaatccacacaaggttcaggctctaattatatgactcccttcgaggattgtcaatctccaactaatcagcctgtaatcaacaccaaaggtaatgactataattctgatttccagtttcagatgctactctacatgttcttaagttaa

SEQ ID NO: 88347 - DNA, 733 bp, Glycine max
  Peptide Sequence Number=SeqID_180032
caaggtatatggaaagatctgggatctagcaatgatagaagtgtcagttgaagacattgcatctcttacccaatactatgaccaatcgttcagatgcttcacttttggggactttcaattaaccatagagaagtttgaggggatcttaggatgcctgataggaggaaggaaactatacctcttttctgggtactacccttctatggcaaaagtagcgagagtagtcaagatctcggaacgagagttagatcaactgaagcaaagtaggaatggagtagcgggaatactgaggaagtgcttagaggagaaggtggaaacccatgcaagccaaggaaagagagtatcattcatggacgtgcctaaggggagtgaagaggtgcaagccttgaaggctaagcttgaaaggaaaaaagtagtgaaggagaagctgaaggtggtagtcactagaattaggaaagaatgtgataggcagaaggatgtcaacatgtccgcagcgaaagcgctagagcaagaaacaaagaaagccagaaaggaagagtggagtagaaacaagtttcgaggggctttgttaggcagcagtaatgagctcaaacttagaaaggccaagagagacaaatcaaggatggagaactataaagagaaggtgaacctagctactagtcatgggcagatgctaagagacgagcaggcgaaggtgtcagccttgagggttgaaaaggaggcaaggaaatag

SEQ ID NO: 88348 - DNA, 405 bp, Glycine max
  Peptide Sequence Number=SeqID_180033
atggctaccaaaggttggagcttcaatggtggaggaagaagaagagaatggcaacgtgagagagagagggaaaaggcttctaaaatttttggggctgaaaatttccaggatgtcacacgtgtcatcacaaaggagagttatgttgatccctcatcgactgatccaaacacgggtgactcagacaaatacgtgttgtacatcgaaggaaatccttcccgcctggttgccctaggaagagtttatgagggatccacagcggttcacaacatccctttgtttcatggccaagtgaaggttggtgttgagaaggttaaagatgcagcggctcccgttcctgtacccactgacaagtcagttgtgtctccagcaaaacctccagataggccggatcaggggatcctctag

SEQ ID NO: 88349 - DNA, 423 bp, Glycine max
  Peptide Sequence Number=SeqID_180034
atgaggagtagaagagaaacccaagtagatgtaccctctacttgtaccacaaaggatgtaccctccaatgtgttaagacaaagatctctgactgttaaacctttgatactttgtgaatggggatacaaaagaattctcaggcgggagaagggagacacaaaagaattcaggcggttagtcctttgttcttttggaaaagggagaagagagacacaaaaagaattcaggcgattagtccttggcgaattctttttggcaaagggagaagagatgaaaagaatgaatagcacaagttttcaaggtttagaaaaccataaaactttgaaaagcttttggtacaaagaagaagaagaatttcaaagagattcaaggcttgtaaaggattgtaagagattgattggaaaagtattcaagattgaatga

SEQ ID NO: 88350 - DNA, 698 bp, Glycine max
  Peptide Sequence Number=SeqID_180035
atgtcctcaccttaagaggactacacgtcctcgccttcagaggacaacatgccctcgccttcagaggactacacatcctcccctttagagggctgcatgccctcgcctttagaagactgcacgccctcgcctttacagggcttcacgtgctcatcttcagaggactacacatcctcgccttcagagggctgcacaccctcgctttaaaagggctacacgccctcgccatgagaggattacacgtccttgcctttagagaactacatgtcctcaccttcagaggactaaacgtcctcgccttcagaggattacacgtcctcgccttcaaagggttgcacaacctcgccttcaaacggctgcatgccctcgccatgagaggattacagggctgcacgcccgtcgccttcagagagctacttgccctcacctttagaggactacacgtcttcccattcagaggactacaggtcctcgccttccaaggactacacgtcctcatcttcagagtactaaacgtcctcgccttcagaggattacacgtcctcgcctttagagggcaacacgccctcaccttcaaagggttgcacgacctcaccttcaaacggctacaagcactcgccatgagaggactacaggtcctcgccttcagaggactacacgtcctcaccttcagaggactacacatcctcgccttttga

SEQ ID NO: 88351 - DNA, 1158 bp, Glycine max
  Peptide Sequence Number=SeqID_180036
atggacatcccactgagaagcactaggaagtaccttttcaaaaaaacagacttgttgagattaagggagctagcatctttagtaagtgatccagtggattttcaaactcaccatgggaagttactcagaattcttagagtagatgttgaggaaggatgcctagagaccctggttcagttctatgacccgctctaccattgcttcacatttcccgattaccagcttgtccccacacttgaagagtactcctacctagttggcttacctgtgcctgacaagatacctttccatggttttgagcctacccctaaaccctccgacatcgcagccgctctccatcttaaaacctccatcatccaagcaaaccttacctctaaaggaggcctccaaggtcttcccacccacttcctctaccaacaagcctccatatttgctgaagcagctatggtttccttccacttacctcaatcccgtgccttcaagaccaatgatgataagctttcttggcctcgccgaatcatgactcttgacccatctgacattgtttggtaccaagcagctagtgatgttggagagattattgtgagttgtggtgaatatcccaacgtacctctttgggtatgcgtggcggaattagctacaacccgcttctcgctcgacgacaatttggatcattcgaacaaaagggaaagattcgcacaagcttggagcgctatccgcagactcaacagaagtcagttgggaaagaaatcagactatgtgcatgaatcttacacccagtgggttattgataggaccaagagctttggcctaccctaccgcttacctagatacctatcgtccaccatcccaccatcatccttgcctatcccctttgatactaaggaagagtttcatgaacaattaaccaaagaaaggcaagaaaaagaaacttggaagaggagatgccaggagctcgagcaagagaatgagactttgaaggggaagatagcccaacagagccgtgagctttttatccagaaccagaggatgattgagaaggacgacttgcttcgtcagaaagacgctttgctccaccgagatgctagaaggaagaggaggtttatggatttgttctcccgtgcacattcagattccgaggatccagctactccggga

SEQ ID NO: 88352 - DNA, 276 bp, Glycine max
  Peptide Sequence Number=SeqID_180037
gtagctgtgtctccagcaaaacctgcagataggccagatcctgaggttatgtgggatgctttcttgttcgggctgtttaattcagacttccctttgtacataaagcatgaagatctgtctgaaatagcacacggtggtcaatgtcttagcatctctgttatacagttgtggattttaaagttacatgaagagttggatgcagaattcaaaacgcgatgtctaccttggagcctacctgaatggcgcatactggcaaatggtcgtcattttgcctaa

SEQ ID NO: 88353 - DNA, 321 bp, Glycine max
  Peptide Sequence Number=SeqID_180038
atggcaatgcgaacaaagtcatacttgactcacactctactttggaaacacaagttccaaaatttcaattgcaagtgcgcagtttgtcttcaaccactaagtccccttctctccctcttccaacctttcttcattacccaagatgaggaagttgatgcaatcctaccccccaagggaatcttctcaaggaagcttctcaaggaggtgagcttagttattagaggggtgtgtgtagctaagctcaagcttctcaaggaagttttctcaaagaagcttctcaaggaagttttctcaagaaagcttctcaaggaagctacctag

SEQ ID NO: 88354 - DNA, 1122 bp, Glycine max
  Peptide Sequence Number=SeqID_180039
atgggaattgtatcagtagcaccaactcagactgtggtgtatttggtccctcggtatcctccatcaatctccacatatctctatgcttcttctcttaccaaggctaagaccattcatcaacccacacaatcttatgttcactccaaatcagtagaaactgcaatagagagtacatcacagttggtgccattcccattgttgacgaatgggaattacacagcatgcaccattccttggaggttcccttcagacgatccaagcattcccactcccaccgagctatcttggattaatctcctcctcaatactatccccaccttcaagaagcatgctgagaatgatacttctgttcctgatgctgcaaataaagctgaaaattttgctcaaaggtatgctagaatacttgaagatttcaagaaagatcctgcaagtcaaggcaggcctcttgatatccttattctatgcagacttcgtgagcaagtccttagagaacagggattcagagatatcttcaagaaaataaaggatgtagagaatgcaaatgccatatccctatttcagaatgttgttcatcttaatgatgccattgaagatgaagggaaacgactggagaatttggttagaggaatttttgcagggaacatatttgatcttggtgctacacaggtaatcatatttgtggataactctggtgcagatgtcattttgggtattctgccatttgcaagggagctccttcgacgtgggagtcaggttatattggctgctaatgacttaccttccatcaatgatgtgacttactctgacctaattgaaattataccaaagttaaaggatgaagaaggacgtctcacgggtgtcagtacttcaaatcttctaattgccaactccggaaatgatttacctgttattgatcttacaagggtgtcacaagaacttgcataccttgctaatgatgtagatcttgtcatcttagaagggatgggtcgtggaatagaaacaaatctttatgctcaatttaaatgtgattcccttaagattgggatggtaaaacatcctgaggttgcagaatttcttgggtcacgtttgtatgactgcgtgatcaaatacgatgaagtttag

SEQ ID NO: 88355 - DNA, 198 bp, Glycine max
  Peptide Sequence Number=SeqID_180040
atgaagaacgcaaagatcgaacctggcaccgctgtttacaaggagaatcggacattgacgacacaacaatactcagcggtggtggagaagacacttgcggaggaagagaagagactcatgaaagaagcacagattgaataccacacaaggatagggagagactcgcagaggaagcacgaaggaggagaagagatataa

SEQ ID NO: 88356 - DNA, 1203 bp, Glycine max
  Peptide Sequence Number=SeqID_180041
atggccaccgtgatccgcaatcctatcctctttccctccacctctcaccgccccaaccaaaaccacagcaacaacacattcctcattttccgcttccctcaaacctcacgctcttctctccactccaaatcccgattcgccttttcctgctcccaatcggagcctcctcctccttctccttctgcttctcctcgacggcgtcctccgtacatcccgaaccgcattcctgacccttcctatgtccgcattttcgacaccactctccgcgacggcgagcagtccccgggcgcctccatgacctccaaggagaagctggatgtggcgcggcagcttgccaagctcggcgtcgacatcatcgaggccggcttccctgccgcctccaaggatgacttcgaggccgtcaaaatgatcgcccaagaggtcggcaacgccgttgacgacgacggatacgtccccgtcatctgtggcctctcccgctgcaacgagaaggacattcgaacagcctgggaggccgtcaagtacgccaagaggcccaggattcacaccttcatcgccaccagcgccattcacatggagtacaagttgagaatgtccaaagacaaggtcgtcgacattgcccgcaatatggtcaagttcgctcgtagcttgggctgcgaagatgtcgagttcagtcctgaagatgctggaaggtcggatagggagtttctttatgaaattcttggagaagttattaaggccggggccaccacgctcaacatacctgacactgttggtataactatgcccagtgaatttggaaagttgattgctgatattaaagctaatacccctggaattgaaaatgttattatttccacccactgccagaatgatctcggactttctactgcaaacactatagagggtgcgcgtgctggtgcaaggcaactggaagtgacgattaatgggattggtgaaagggctggaaatgcctccctagaagaggtgagggtccattttctgttgcctagcctagttcaagttgtgatggccttgagatgcggagcacatgtcaatggcaatctctacactggaattaatacgaagcacatctttctgacgagcaggatggtcgaagagtacactggtttgcagttacagccacacaaggctcttgtgggagctaatgccttcgcccatgaaagtggcatacatcagagctag

SEQ ID NO: 88357 - DNA, 156 bp, Glycine max
  Peptide Sequence Number=SeqID_180042
atgatatcagcatatatagatagagagttagtgagtgagtgggtgcggagaaagagaagaaagaaggagggaggaggtgtcgaagaagaagaagaagcaggtgtcgctggaagagttgaagataacgtgatagagcaagtagcagaaggagattag

SEQ ID NO: 88358 - DNA, 138 bp, Glycine max
  Peptide Sequence Number=SeqID_180043
atggcggaattgaggccaaatcggagaacacccgaagaggcccagaggaagagaagagaaaggaaagaaggaaggaataataaagagaagccaaagccaggtattgagatgggacatccacacaagcaacgcgcctaa

SEQ ID NO: 88359 - DNA, 1572 bp, Glycine max
  Peptide Sequence Number=SeqID_180044
atggtgggtttggagaagaaggatggtctcacctggagttcatgtcagctaggagcattaaagttgacaaagcatgaagcatctgtggagaggggtgttaggaagtcccacattatatgtctcaattcccagggtgcaacttatatatctgttggacaacttcacttaatgctaattggttttaaaatgaaatctaacagaaacttaaaatgggtgaaacaacagcaggctaatttgtattttacccaaaaatatttttttttctcattggatctttctaattgtgagttgcaggaaacaattgtcagcatggcagtgactggtgcaattgttggggcagcagcaggtggttggattaatgacgtttatgggagaaagaaggcaaccctcattgcagatgttatctttactctgggagcaattgtaatggctgctgccccagatccttatattctcataattggccgtgttttggttggtttgggtgtgggtatagcttctgttactgctcctgtgtatattgcagaatcatcaccatcagaaataaggggagcattagtaggcataaatgtgcttatgataactggtggacaatttctttcctatctcataaatcttgctttcacacaggttcctgggacgtggcggtggatgttgggagtttcaggtgtgcctgcagtagttcagtttttccttatgctcttactgcctgaatcccccagatggctctttataaagaataggaaagaggaagccattactgtgctagctaagatctatgactttgctcgtttagaggatgaagttaatctacttactactcagtcagagaaagactgccaaagaagggatggcattagatattgggatgtttttaaatcaaaagaaattagacttgcattccttgctggagccggattgcaggcttttcagcaattcataggcataaacacagtgatgtactacagcccaacaattgtccaaatggctggctttcaatctaatgagttggctcttctcctttctctcatagttgccggcatgaatgctgccggatcggttcttggcatttaccttattgaccatgcaggacggagaaaattggccctatatagcttagggggggtaatagcatctctgatcatcttggccttgtcattttttaaccaatcatctgaaagtggtttgtatggatggcttgcaattcttggtttggccctgtacattgctttcttctccccagggatgggacctgtgccttggacagttaactcagaagtataccctgaagaataccgaggaatatgtggaggcatgtctgctactgtgaattgggtctcaaatctcattgtggtacagtcatttctgtcggttgctgcagctgtaggcactggccctactttcttaattattgctattatagccgtgcttgcgtttatgtttgtggttgtctatgttcctgaaaccaagggattgacatttgatgaagtggagctgttatggaaggagagagcttggggcaagaaccctgatgctcaaagccttcttgttcggactgaaaatcattcctag

SEQ ID NO: 88360 - DNA, 960 bp, Glycine max
  Peptide Sequence Number=SeqID_180045
atgattcaaacatacaaggaaagttcagattgtagcgaaatcaaatttgcattcgacgcagtagtaaaacgcgcgaggcatgaagagaataatgcagcagcacagaagttcaaaggcgttgtgtctcaacaaaatgggaactggggtgcacagatatatgcacaccagcagagaatctggttggggaccttcaaatctgaaagagaggctgcaatggcttatgacagcgccagcataaaacttagaagcggagagtgccacagaaactttccatggaacgaccaaacagttcaagagcctcagttccaaagccattacagcgcagaaacagtgctaaacatgattagagatggcacctatccatcaaaatttgctacatttctcaaaactcgtcaaacccaaaaaggcgttgcgaaacacataggtctgaagggtgatgacgaggaacagttttgttgcacccaactttttcagaaggaattaacaccaagtgatgtgggcaagctcaacaggcttgtcatcccaaagaagcatgcagttagctattttccttacgttggtggcagtgctgatgagagtggtagtgttgacgtggaggctgtgttttatgacaaactcatgcgattgtggaagttccgatactgctattggaagagcagccaaagttacgtgttcaccagaggctggaatcggtttgtgaaggataagaagttgaaggctaaagatgtcattgcgttttttacgtggggaaaaagtggaggagagggagaagcttttgcattgatcgatgtaatttataataataatgcagaagaagacagcaagggagacaccaaacaagttttgggaaaccaattacaattagctggcagtgaagaaggtgaagatgaagatgcaaacattggaaaggatttcaatgcacaaaagggtctgaggctctttggtgtgtgtatcacctaa

SEQ ID NO: 88361 - DNA, 897 bp, Glycine max
  Peptide Sequence Number=SeqID_180046
atgaatcaacaagaggatcagttggaacatgagtggtggagtctcagactggttgttggcggcagtgtagctgactgggcggaggtgtctcagactgagaacagagaaacactgggtagggttgagaagaagagcacctccggctgtccatttggtgaaggatgccacttcctgcattatgttcctggtggctttaaagctgtctctcaactgatcaatgttggtagcaatcctgttactcctcaagttgggagaaaccctgttccaccatccttccccgatggatcttctcctccagttgttaaaacccgattgtgcaacaagtttaatacagctgaaggttgcaaatttggtgacaaatgtcactttgcccatggtgagtgggagcttggcaggcctacagccccatcatatgaagatccccgtgttttgggacaaatgccaagcagcagggtaggtgggcgagttgagcccccacatccagctcatggagctgctgccagctttggagcctcggctactgcaaaaatcagtatcaatgcttccttagctggagctgtcattggaaaaaatggtgtcaactcgaagcaaatatgtcgtgtaacaggagctaaactttccataagggatcatgacacggatcctaaccttagaaacatcgagcttgaaggcagttttgatcagatcaaacaagccagtgccatggttcacgaagttattctaaatgttagttctgcctctgggcctccaatgaaaagctttacttcgcagacttctgcccctacaagcaacttcaagactaagctgtgcgaaaactttgccaaaggttcctgcacttttggggaaaggtgtcacttcgcacatggaactgatgaattgcgcaagtctggaatgtga

SEQ ID NO: 88362 - DNA, 1515 bp, Glycine max
  Peptide Sequence Number=SeqID_180047
atggtggcggaaatgggaatggggatgtcaatgagagcgggaagctcaggttacttggagatgcatcccgaacgcaaaatcacctttttccagaacccctacatcgttggtatcactttcgccgctggcctcggtggtcttctattcggctacgatactggcgttgtgtccggcgctcttctttacataaaagaggatttcgagctggtgaggaatagcagcttcattcaggaagtaattgttgggatggcgttgatcggtgctattttcggtgctgcaattggtggcgtaatcaatgatcatctgggacgcaagaccgccactatcattgcggacatatgctttggcgcaggctcagtaataatgggtttggcaggcaacccttacgtgatcatattcggtcgttttctggtgggtctgggtgttgggtcggcctctgttaccgctcctgtctacattgcagaagtatctccatctgaaatcagaggaggacttgtcagcgctaacacacttatgatcactgctggccagtttctgtccttcatcgtcaactatggcctcaccagagttcccgggacatggcgttggatgcttggtctctctggcttcccagctgtccttcagtttgtcctcatttcctttctccccgagtcccctagatggctctacatgaagaaccggcgtgaggaagctattcttgttctctctaagatctactcctctccccgcttggaggacgagattaaaattctagatgatcttcttctgcaggagcctgagagcaaggcctcggtcaagtatactgatgttttcaccaacaaagaaatcagagttgctttcacttttggggctggacttcaggctctgcagcagtttgctggtatcagcatcattatgtactacagtcccaccatcattcagatggccggtttcaaatcaaaccaatcagctctcttcctttccctcattgtttctggcatgaatgccgctggcacaatccttggcatctacctcatcgacctcgccggccgcaaaaagctcgctcttggtagcttgtctggcgtgcttgtgtccttgatcattctctccacatcctgctatcttatgggtcatggcaacacgggtcaaacacttggatggattgctatcttgggtttggctttgtatattcttttctttgctcccggtatgggtcctgtgccatggactgtgaactcagagatttaccctgaagagtatagaggcttgtgtggtggcatgtcagcaaccgtgaactggatttgcagtgtcatcatgtccaccagcttcctttcagtggttgacgccatagggcttggagagagttttatcattcttttggtggtatctgtcattgcaattgtttttgtcatcttcttgatgccagagaccaaaggattgacatttgaggaagtggcatacatatggaaggagagggcctatgggagggacaaaaccacagcgagccttgctgagaaagaagctttgagttcataa

SEQ ID NO: 88363 - DNA, 1029 bp, Glycine max
  Peptide Sequence Number=SeqID_180048
atggcaagcatgaacccttttgatttgctgggtgatgatgcagaggacccatctcagcaaattgttgcagaacagctcaaggctcagcttcctaccaagccactccctccctctcaggctgcaagcaaattgttgacttcttttgtgatagtgagggaagcaagaaatgtaaattcacgcggtggtcgaggaagtggccgcggccgcggtcgtggtggtttcaaccgtgacttgttcaatgatgaaaattcatttgctgcccctgctggtcaagttgcttttgaaggagaaagacctgcttatggtggccctcctggtccttatcgtggtagtcgcggtggtggtggacgtggagctttcggtaatggagaagctgctgaagatggtctcccacgaagaccatttgaacgtcgcaatgggactggacgcggaaatgaattcaaacgggaaggtgctgggagagggaactggggtgtacagactgatgaatttgcccaggcaactgatgaagtgaatgaaacttctaagaattttggtgatgaaaagccttcaggtgaggatgatgttgcggcaattggaaacaaggagaatcctgctaatgaagctgaagaaaaagagcctgaggataaggagatgactctcgaggaatatgaaaaagtactagaagagagaaggaaggctttgcaagcacttaagactgaggagagaaaggtagatactaaagtttttgaatccatgcagcagctgtcaaacaagaaagacattgatgacatctttattaagctgggatctgataaggacaagcgcagagagactcttgagaaggaagataaatccaaaaagtctgtcaacatcaatgagtttctgaagtccccagagggtgaaagttactataacccgggtgggcatggacgccgtcatggtcgtggacgtggtgcaagaggaggttatggtggctatgcaactgctaacattccagctccatcaattgaagatcctgggcaattccctactttgggtgtcaagtga

SEQ ID NO: 88364 - DNA, 218 bp, Glycine max
  Peptide Sequence Number=SeqID_180049
ctaatgagtatgtatctgaagcagaagcagatgatagtgggtgtggcattggtggtgttcttgttgttgatttcggtgaagggacaaagcatatgcaacacttgccctgcctttgctcttacaagaactccccactattgccttctctcggaattgatcctaagctcgccctccaactccctgccaagtgcaaccttcctcatcctcccaactgctaa

SEQ ID NO: 88365 - DNA, 330 bp, Glycine max
  Peptide Sequence Number=SeqID_180050
atggtgaaacccacacctaaaaaaggaaaaaggaagaaaggtaccatggtgattggagagatgggaaaggaagccggcgggagagcttttctggcggagcaaggaggaagcgaaggagggggggtggttgtggaaagatctttgctctttgcagggagactcagaagactctccggaaaagtagggactgggacgggatccaccaataagagaatcaaccgtgctggtgagaagagaaccgggggcggaaccgtagcgagtgaggccagcttgggtcatggactgagaggaagaggaggaggaggaagaggaagagggatacatggatag

SEQ ID NO: 88366 - DNA, 1305 bp, Glycine max
  Peptide Sequence Number=SeqID_180051
atggagagagaggaagagaaagaggtggttggtgtgagtgtgctgcacggtggtatgatcataacgatggacgaggagcagcgagtgtatagggacgggggaatcgtggttgaacatgataaaatcaaagcaatcggacaatctgctgatatccttgcggagttttctgatgtcgccgacagtattgttgatctgagcggacatatcttactcccaggatttattaacacccacgttcatagctcccaacaaatggccagaggcatagcagacgatgtggatttaatgacctggctgcatgagcgcatctggccttacgaatcgaacatgagcgaacaggattcgtacctctctactttgctttgtgggattgaactcattcactccggtgtaacctgttttgcggaagctgggggccagcatgtttctgggatggctagagcagttggcttactgggtttgcgagcttgcttaacccaatcaaccatggactctggccacggtttgcccccatcctgggccactcgaaccactcaccaatgcattcagtctcaaaaggacaattatcacaagtaccacaatacagcccaaggccgcatcagaatctggttcgcgattaggcaaatcatgaactctactcctcgcttacttattcaaacaagagatgctgcaacacaactcaatactggaatacacatgcatgttgcagagataccacatgagaaccaactagttatggatgttcacaaaatagatcacggaactgttacatacttggacaagataaatttccttcaaaacaatctgttagcagctcactcagtttggatcgataataatgagatatctcttctttcacgagcaggggtcaaagtgtctcactgtcctgctgctgcaatgcgaatgcttggatttgcaccagtaagggagatgcttgatgctggcatctgtgtctccctgggaacagatggggccccatcaaacaatcgcatgagcatcgactgtacatcaaaccctcaccagaccgtaaagttgcgggagtctcttgctcggatggagaatactgggcagtacacattctataaaataccaagacggggagtttatgctaatggaactacagatccaactgcattgcctgctgaaactattcttaggatggttactgtcaatggtgcaaagtcagtattatgggatgatgaactaggttctcttgaggttgggaaaaaggctgacattgttgtagtggatccttcgtcttggtctatggttcctgttcatgactggtacgaactcattacttaa

SEQ ID NO: 88367 - DNA, 528 bp, Glycine max
  Peptide Sequence Number=SeqID_180052
atgaaagggatcaagggagcgccatacaggggacgtttaggtgctctgacgatcacagacgtttcctggttgccctacagtgagcaccaggtagttaggggcttccagcttatttcatgctaccaggggcagctcagatggggtcatgttgtggtctacgtccgaccaaagcaggtgctacggcagttcggatacatccagaccatcccttcgccgccgatctctcacccatttgtcacgccgacccagaaaggcgatgagccgagacagctagctgccccagatgtggatgcatacgtcgagccacatgtgttggaggttccagtcacagatgatctctccagacattcagtggtttcttgtgaaggttgcgaagctatcgctgaaaggttgaagcgtatgctcaaccttaagatggtgattgcaggaacaaagttacatgagatcatgaaagattgcctgctgctcgctaagggagaggcctctaatggaagtcttaggatgcaacgtaggcagcgcatagattag

SEQ ID NO: 88368 - DNA, 390 bp, Glycine max
  Peptide Sequence Number=SeqID_180053
atggcaattggagttggaagtggcacatcgactatgtatcaaatggcattagaatgcacatgcaggtatattaaatcacctggggaccctaagtttatggaagcatttgaattgagtccagaggaatctgaggatgttcttttcaaggaggcttggctgacatatttttggagaagagccaaggctcatggtatagaggaggacattgccaaagaacgtcttcggttttggattggtcggagtgggcattcacctacctcacatgatgccgttgatgctgagcagggactttctgaactgaggaaattggggattgaacatcgactttgggaagcatccagaaaggaagttgatcaggactttactattgcacgaaagctgctgacttga

SEQ ID NO: 88369 - DNA, 219 bp, Glycine max
  Peptide Sequence Number=SeqID_180054
atggcttgggatttagggttcagggttcagggttcagggttcagggttcagggttcagggttcagggttcagggttcagggttcagggttcagggttcagggttcagggttcagggtttagggttcagggttcagggttcagggttcagggttcagggttcagggtttagggttcagggtttagggttcagggttcagggttcagggttcagggtttag

SEQ ID NO: 88370 - DNA, 519 bp, Glycine max
  Peptide Sequence Number=SeqID_180055
atggcatcatcatttgtgggtactttattacccaaccacttcacacaaaccaaacactcagctgttcctgcaagtagatcaggtgctccaagaaggaggagagtgcacttagcaacaacaagagcagagaccatgactactgtcatagaaaaactgggcattaagattgagaggaaccctcctgagtccaagctcactcaactgggtgttaggcaatggcccaaaattaacaagcctgaaattttcgccgccacagatagctggtttggtgatgtgaaagtaaatagccgtcaccgtcgccaccgccaccaccgccaccgccaccgatactgtaagttcccatggacatatgaagccaaagagacttgctatcttctggaaggaaaagtgaaggtctttcctagtgggtcgaatgagtcagttgaaattgctgctggtgacttggttgtgtttcccaaagggatgagttgcacttgggatgtgtctgttggtgttgacaagcactataattttgaataa

SEQ ID NO: 88371 - DNA, 855 bp, Glycine max
  Peptide Sequence Number=SeqID_180056
atggtaaacgttcctgagagaggagcaaggaagcatccacggggtgataacatacagattgacacaaagaatattctttttatatgtggtggagcatttattgatcttgagaaaaccatttcagagagacgacaagattcttcaattggttttggatcaccagtccgttccaatatgagaactggtggagttacaaatgctgcagtcacatcatctttacttgagtcggtggaaagtgctgatcttattgcatatggtctcatacccgaatttataggacgatttccaatcttaattagcttgtcagctctaaccgaagaccaacttatgcaggtcctcacagaaccaaaaaatgctcttgctaagcagtacaagaaattatttaacatgaataatgtaaagctacacttcacagagaaagctctgagattgattgcaaagaaagcaatggccaaaaatactggtgccaggggtttaagagcactactggaaagcattttaactgaagccatgtttgagattccagatgttaaagcaggaaatgaactcattggtgcagttgttgttgatgaggagtcagtaggatcagtaaatgcccctggttgtggaggaaaaattctttgtggagatggtgctttggaactgtacctagctaagatggaggatttatttttctgtgctggctgcctgtccaagttgccttgtgaaatccctgctaatagaggatttcatacagatgtttttcattcatttgcaacagtgatgaactatgagaatgtggctaacggtgccgtagctgagccagacttacaagaaggggaatcagagatttcatcaagagccgtgagcatgtaa

SEQ ID NO: 88372 - DNA, 1065 bp, Glycine max
  Peptide Sequence Number=SeqID_180057
atgggttcaatgaataaccaaaatgcaatggagctctttgagggtcaagctcttttgtacatgcagctacaaggccacctaagaactacgtgtcttaagtgggctgtccaacttggtattccagacataatacagaaccattccaaacccattactctttctaacttagtctctactctccaaattccaccatctaaggcttgttttgtgcagcggttcatgcgctttttggcacacaatggaatatttgatatccatgagagacaagaagatcatgaaccaacatatgctctcacctctgcttcaaagcttcttgtcagtggcagtgatcactgtttatctccaatggttctgttgaaaactgatcaacttctgacgagtacattccatcagttgggggaatggactcgtggggaggacgccacattatatgagacagccttcggaacaaacatttgggaattttttgagaaaacacctgcatattttagtctcttcaatgaggctatggcaagtgattcccgaatggtagacttggcactcaaaaattgcacttcagtttttgaggggctcgattccatggtggatgttggtggtggaactggaaccacagccagaattatctgtgacgcatttcctaagttgaaatgtgttgtgttcgaccttcctcacgttgtagcaaacttgctaggaaccaatcatttaagttttattggtggtgacatgttcaactctatccctcaagctgatgcagtgctactaaagtggattttacataactggaatgatgaaaattgcataaagatcctggaaaagtgtagagattctatttcaagcaaaggcaacaaaggaaaagtgatcatcatagatgcagtaataaatgaaaagctagacgacccggatgtgactcaagcaaagcttggtttggatataattatgtctgctatgaatgggaaagagcgaagtgaaaaagaatggaaacaagtgttcatggaagcaggattcaaacactacaaaatatttcccatctttggtttcagatctctgattgagctttatgcttaa

SEQ ID NO: 88373 - DNA, 222 bp, Glycine max
  Peptide Sequence Number=SeqID_180058
atgttaaccaaacacattaaaaacttcgtaccccattgcccagaggctctccgctatgcgaagagagatcatccgggtcatgatgttgcttgcaaatcagactgcataatgccatgccttcaggttttggaaggtgaagcttactgttactgtcttcactttgagatggattgcaaaggggttgttgacagtattcattcagcaaccgaagaattttcatag

SEQ ID NO: 88374 - DNA, 345 bp, Glycine max
  Peptide Sequence Number=SeqID_180059
atgaagtttctgcttaaaggatccaacttggtgggaatggagaaggtttcgttggtttgtagaattttgaatgttcatgggactatgagggagcatgtgaaattggtgcactctgtggtgagggttgagttgaatgaattggagggagatgagtttgcgctgcgaggacttggtgagtgtagttatgctcgtggtcgaaataatttggagtccatagggagcgatgatctgagattgagtcttgggggaatttttggaagggaatgcccaactgatgcttatttgagcagtggctactatgctgttttgaacttgacttttggaaagaattacgatgaaagctaa

SEQ ID NO: 88375 - DNA, 1185 bp, Glycine max
  Peptide Sequence Number=SeqID_180060
atggagaatggtcacgatgggaaattggccgataaattctcgggcttgaatatcaaccagcacgctcaacaacacgtgcatgatcaatctaacctctcttctaacaacaatgataacttgtatcaggtcatgaaggctgttgaagctgccgaggccactattaagcaacaggtagtactttggattcaacacgtgcttcgttataatggtcatggttcttcaccattcttgctaccgtgggaaattgcagacaaatgtggtcgatgctgccacagttgtggttgcgttaatgcattgagttgcagtggtagttttatgttggtagaagagaatagccggcttaggtctgaacttctgagcaaaattcaggaactggaaaaatataggcaagaagattcagtggatcaaaaatcacgtttggctgctcaatggaaggagcaggagcacggatcttatgaagctcgtcaatcggctccatctatagccagaagcaatacaggtgaccattctgagaacagtcaaataaatggaacattgagagtacagccaaatgaccagttgcctatggataatactggctactctcagttgtcttctccatctacaaggtcagtctctccaagcaggcttctaccagaaggagaccttgattcccgatttaattcgcctcggcaaggtttgatgcctgtggtggaaacgaatagtaataataatagcttattgaagcaggatctggccattaataaggttcgggaacatgaagaagagatcatcctattaaggaaacgtcttgctgattattctgtaaaggaaggacaaatacggaacgaaaaatatgtcttggaaaagcgcattgcatatatgcgtctggcctttgatcagcagcaacaggaccttgtagatgctgcatcaaaagctttatcataccgacaagacataattgaagaaaatatacgtcttacatatgcattacaggatgcacagcaagaaagatcaacatttgtttcatctttgctgcctcttcttgcagaatactccctgcagcctcctgttcctgatgcacaatcaattgttagcaatgtcaagcacttacatgtataccctacaaatatggcacctggatgtaatttgactctctctctgttgctgccaagaagaaaaatccttgaagctaaactattgtga

SEQ ID NO: 88376 - DNA, 1521 bp, Glycine max
  Peptide Sequence Number=SeqID_180061
atggcttccaggcgtttgagggcattcaagcggtggatgaagtcgaaggggctcgaatggagcgatgcactggagtttgtggacaccccagaagaaggagttgaagtgagagcattgtgccagttgaaggaaggtgatgttgtggccaagatgccaaaggaagcttgcctcaccacaaagaccagtggggcacgtaagatcattgaagaggctggtttggatggtcatttggggcttgcatttgctatcatgtatgagagaagcttggatggggactctccttttgctggctaccttcaactcttgcctcaccaagagtgtgtgccaattgtttggaccctcgatgaagtaaacgagcttttgtgtggtactgagcttcatcagacagtgcaagaagacaaggctctgatttatgatgactggaaagagaatattctacccctattggatttagcacctttaaaactaaatccaaagttctttggcgtagaacaatactttgcagcaaaaagtcttatatcttcacgatcttttgagattgatgattaccatggttttggcatggttcccttggcagatctattcaatcataaaacaggtgccgaggatgtgcatttcactgctatgtcctctaatgatgagtctgatactgatgttgatggctgtaacgatgatgagggcattgtcaaggaagaaacattggctcaaaattcctctatagatatgaccgtgttaaataatgggaactgcaatgttagtgactcggatagttcttcagttagtgatggtgatacttctatgctggagatgattatgataaaagatgtcagcagtggaactgaggtatttaatacttatgggctattgggtaatgctgctttgcttcatagatatggatttactgagcaagataattcctatgatattgtaaacatagatatggaactggtacttcaatggtgtacttctgtgttttctgaccgccacagtagagcaagagtttccctttggagaaagttaggctattctgcatgtggcagccaaaactctgaatattttgagatctcatttgatggagaaccacagattgaactcctcgttttattgcacatcatgttattaccagataatgcctaccataagttagacctatcggttgctggaaattgtgatgaatcaagtggaaccacctttctgaatggtaatatctttcctagtaaagcatttaatatgagcaagaaatccttgctgcctaaaaaagtttgtgatgtcctgtcgtcacttgctgatatgagggagagtctctatggcttgaaatcaattgaagatgatattgaggcattgggaaggtgtagtttagttagagagagaaagctgtatcattctttgatgctgcgcatcaatgaaaggaagatcctccagaggctcagaaattatgcttcacagccatttaaaaataaaatcactaaccatagttctccgaggaagaagttgaaaagaacaacaaagaaaacgagttga

SEQ ID NO: 88377 - DNA, 936 bp, Glycine max
  Peptide Sequence Number=SeqID_180062
atgtggaaggagagggagcatcaatggagtgagggtaatttagtcaaatgtagcattggggtcagaggtggccagctttgggggaccgatgtgtacacatacgattcagatcttgttgctggttactgtcgcccaacagcgtctccaccccatgcagccatacaagaattgcgtgcaaccgttcgtgtactacctcctcaagattgctatatttctacactgagaaacaatgtccgttcccgtgcttggggtgcagcaattggttgtagttatagagtggagcggtgttgcattgtgaagaaaggaggtggaactattgatcttgaaccttgccttacacatacatcaactattgagcccacccttgctccagtgactgttgagcgaactatgactaccagggctgcagcttcgaatgcattgcggcaacaaagatttgttcgagaagtcacaatacagtacaatctctgcaatgagccttggataaagtatagtataagcactgttgctgacaagggtttaaaaaagccactttacacatctgcacgtttgaagaagggggaagttttgtatttggagacacatttgtccagatatgaactttgttttactggagagaagatgctcaaggttacaccagcagccccgttgcatgaccctgccacagaaaagtctcaaaatcaccacccacattctgcaaatggtgaaaaaaatgattgtgagaatgtcatgattgacgcattccggtggtctcgttgtaagaagcctctgccacagaaactgatgcgtacaattggcatccctttgcctcttgaacatatagaggtactggaggaaaatttggactgggaagatgtgcaatggtcgcaagctggtgtttggattgctggaaaggaatataccctggcacgggtgcatttcttgtcaatgaattaa

SEQ ID NO: 88378 - DNA, 90 bp, Glycine max
  Peptide Sequence Number=SeqID_180063
atggcgtctttgtatcctggttccattagtgttgcacagccttttagacttgttttgatgatcttagcttctatcatgtgtggtggttaa

SEQ ID NO: 88379 - DNA, 231 bp, Glycine max
  Peptide Sequence Number=SeqID_180064
atgagcaaatcgattaggcctactaagactcgaaagttggatgaagtgattcacaaagttaacgccaagtttgacagtaaacggaagcagaaaagggttgtcaaaaagtatacgtctggctcattcttaacagctgctggggtctcttatttttgcttttcacggctctgcaaacttactgcaccgtttatagctgctctggttcctcaagacttggttgtcgagttatag

SEQ ID NO: 88380 - DNA, 294 bp, Glycine max
  Peptide Sequence Number=SeqID_180065
atgggtctctctctccgtcttcgcttgggtcactctttctctaacaccgcagaaggaagcagtgggcgatgggagcatcaaggttcgtcggaatcgacctcattcactgcttttcgttctctcttcaagcttccctcgctgccgtttgccggaatcgacgacaataatctgccacaccaaccgtccaccgaaggagaagtggcccaaagaaagggaagacaatgtgctgttgttgctcatgatgttggatggaagacaatgttcaatgagaaagatgagacattttcgccctaa

SEQ ID NO: 88381 - DNA, 412 bp, Glycine max
  Peptide Sequence Number=SeqID_180066
accacaggggttcagtgtgtcaatcgggcttggagcgttccacggtcttatacttgagattgctctgacgtttggtctgatgtacacagtgtatgctactgctattgatcctaaaaggggcagcatcggctcaattgcacccttagccattgcattcgttgttggggcaaacatcctcgctggtgggccgtttgatggggcatgcatgaaccctgctcgggcttttgggcctgccatggtgggttggagatggcactaccactggatcttctgggtgggcccattgattggggcagccctcgcagcactcctgtatgaatacgttatggtcccaattgagcctcctcatcatcaacctttagctgttcatatatgcaatttctttgatgctggtttgaagtatcaacactaa

SEQ ID NO: 88382 - DNA, 1182 bp, Glycine max
  Peptide Sequence Number=SeqID_180067
atggaggctttaaaaagtggttttgcaaatctgcgccatttaaacgcaattgctgctaacactataggctcctttggttctgaattggattggattgcaattgggtgcctcaccctgttttgctcaattgctgccactctacctgttcataattttgacctgacaagtgaactgccagagcaaacgacaaggtatagtactcaggacatgggctgcttcgtgtccactccaaaggattctggtggaaatagaaggaggccagggagtattggggaggtttctgtgtatgttcctggtctaagaattcctaaacctgttgattttgcacagtcacttggtgattacttgtccaaaaatatagtggaacgcctgtctgctctaagaactcgtatagttgtaatggctggccaagaaggtcctacaattacaagaacaaaaaggaaaagtgccacccaacatggaggttcaacactggctgatcttcagcaggctcttgaagactacttgcttgtacttttgggattagttgaaaatggaagccatttacaatacaaagtacaatttgcttgggtgaatcaagaggatgaagcagaggaaacaaccatgtctaatgcttggtatgaagtgttgtcggttttgcacttgatggcaatgctattgctgtcacagtctgatttattacttcttcctagaacatccactgatggtcatcagccaaaagtatcagaagaaagcagacgggcttctgttgatatcttcttaaaggcagctgggtatcttgactgtgctgtaaggcatgttcttccacagttgcctggcgaactcaggagaaatttaccagtagatcttgcagaaggagttcttcgagcactctgtctacaagcattgggacagggtgtagatattcaacttggaatggcaattgatagtaccaaagccactcttgcagtgaagcgtagacttgcatgtgagatggtgaaatattggcaacagcctttttcccctaagacaaaactttgtttcaattctatataccgtgctcaagataatattatgaaccttccattagcaaatggatggggtgaaaagcattgtctttttgtgaaatggaagtatattgaagcgaagaggctgaaatctgaaatacttgttcaagctgatggtgacgtctttgaagaataa

SEQ ID NO: 88383 - DNA, 933 bp, Glycine max
  Peptide Sequence Number=SeqID_180068
atgatgtgggctttctttcagctgccacaagctgtccacctcgaggacaaggctttctacaattgggctatagcaatttctgatcgggcaaagatgcgtggccgcacaaaggaagctgaagagctatggaagctggcaacacggaactatgaaaaagcagttcaacttaactggaacagtcctcaggcgctcaataactggggacttgctcttcaggaactcagtggcattgttccagctcgagaaaagcaaaagattgtgagaactgctatcagcaagtttcgtgcagccatacagttgcaatttgatttccatcgggcaatttacaatcttggaactgttctgtatggattagcagaggacactttaagaactgggggatcagtgagtgctcaagaagtttcaccaaatgaattatacagccagtctgcaatatacattgctgctgctcatgcattgaaaccaaattattcagtttatagcagtgccttgcggttggtgcgttctatgctaccattaccacaccttaaagttggatatttaactgcacctcctgtgggggcatcgattgcacctcataatgactggaaacgatcagaattccttttggatcatgaaaagcttcagcagatacccagaggagaatataaacaagtaccacctcaaaatctctcaggcagattggtagatgcagtgagtggagataagaagactatcaaagtagatatagcagatattatttctgtatcagcatgtgctgatcttaccttaccacctggtgcaggcctctgcatagatacaagttatggatcagtttacttggttgctgactcttgggaatcattggatggctggctggatgcacttcgtctagtttacacaatttatgtgcgaggcaaaagtgatgtactggctggtataataacaggatga

SEQ ID NO: 88384 - DNA, 369 bp, Glycine max
  Peptide Sequence Number=SeqID_180069
atggcagaggtagtaggtggcgacgataatggatttgtagttaaatcgttgacccaagtcaagtcacgcctaagggaggacgcaaggccatgcaggtcagttagtgacacactggttcgatcattgacccaacagtccaatgccttgacaagggcaaagtcaagttgcagtggtagtgacgatggtggtggaatggtggaagcgataatggtggtggtggcacaacgaggtgtgatagtggtgacaatgacagtaacagtggtggttgtggtggaatggtggcagcggagaatgtgtggtgatggtagcgatgacggtagtggttgtagtggaatggtggcggttaaggcaacaatgatgggatggtag

SEQ ID NO: 88385 - DNA, 1281 bp, Glycine max
  Peptide Sequence Number=SeqID_180070
atggctgaggaccaaggtgctgaatttgtatcatatgataccattaaaggagagtggaagatcaaggtcaaacacttcagcatctacaagctgataccctcatttatggacataatcactgacctcgccatgttcattactccgctatggattgcggttatcgtcggcgtcgtcgtgggctgggcgtggaagcccaaatgggcctttcaccccaaagacgctcttctcaagtttcgctctcctcgccctcccaatccccaaaacgacaccgcttttacctactccgccaccagttcctccgcgcgtgagaaagacgcgagtgggagtcctgtggtgacggaagacgatttgctgcatctgtggaagttggttgaggaaaaagacggagggcgggcatggattcagatgatggaccgttctaccccgaccatgacctatcaagcgtggcgtagggatcctgagagtggaccgccgcagtaccggagcagaacggtgttcgaagacgcgagtcctgagttggtgagggatttcttttgggatgatgagttcaggttgaagtgggatgacatgcttatacatgcttccaccatacaagagtgtgtcctcactggaacaatgatggtgcactgggtgcgcaagtctcatgttgatcttgtgcaattctgcctgcagtttcccttcttttgcagtgacagagagtatataattgggaggcgaatttgggacgcaggacgaatttactactgtgtcactaagggagtaccttgcccctccatgccaaggcataataaacctaaacgagttgatttattttattcaagctggtgtattcgtgcagttaaatcaagaaaagatgaccagctgacttcatgtgaagtgttattgtttcatcacgaagatatgggaattccctgggaaattgctaagcttggagttcgacagggtatgtggggagctgtcaagaagtttgatccaggactacggacatatgagaaacaaagggtttctggtaccccattgtcaccctgtgcacgtgctgctaagatcaacactaaagtaaccatggactatgtgaggtctctggaaaacacgaccagtgacttgttggagactgaaaatcaggattcttctgacaaaccaggtggaaggaacatacctaagcttttaattgttggtggagccattgcccttgcctgcactcttgatcaaggactactgactaaggcagttatatttggagtagcccgaaggtttgcaaaaatgggaggaaggaggttgtga

SEQ ID NO: 88386 - DNA, 1860 bp, Glycine max
  Peptide Sequence Number=SeqID_180071
atggggactgagcttatgagaatatgtgttaaagaagataatgatgattttccatcagttccaccaggttttgagtcatatacatctttctcattgaagaaggtagaaaacaatgaaaaacaagatgataaaaatatgaccagttgttcggcctctactagtgcttctgaatcaccatcaactcaggcggaaaatgatgttcaagttggtgatactgcaaaggttcctagatcccttcgacgaagaccatggattaattatggacaatatgagaacatttcagatgaagaccctgactgtgagcggcatgatcaaaatttctcctcaagaccttgtcttcctcgaggagtcatccgtggatgtccagattgcagtaattgccaaaaggttgttgccaggtggcgaccagaagatgctcgtaagccaaatattgaggatgctcctgttttctaccctactgaagaggtctcattcaattcctatgacacatttgaattcacttctgtccatgagtttcaagatactttgaaatatatatcaagcattcgctccaaggctgagccatatggaatttgtcgcattgttccgccatcttcttggaaacccccttgtcctctcaaggaaaaaagtatatgggagggttctaaattttctacccgtgttcagaggattgacaaacttcagaatcgtgattcaatgagaaagatgtcaaagattcaaactaatatgaagaggaaaaggagaagatgcacaaggatgggggtggataatagcactagaacaggacctaatgcaggattttgtgaagttgaaaggtttgggtttgaacctggtccagaatttaccctggaaacatttcagagatatgcagaagattttcagctcaaatacttcagaaaaaatgagaatgtatctcatttgggtgctaatacaacaattttaaatggtacctcagagccttccgtagagaacattgaaggtgaatattggcggatggtcgagagtcctactgaagaaattgaggtgctttatggagctgatctggaaactgggatttttgggagtggtttccctagcaaatctagtcaagtaggttctgcttcacatgaacagtacataaaatctggctggaatttaaataactttgcaaggctacctggctctctgctctcttatgaaagcagtgatatatctggtgttctagtgccatggttgtatgtaggaatgtgcttttcctccttttgttggcatgtggaagatcatcatttatattcattgaattacttgcattggggagctccaaaaatgtggtatggtgtccctggaaaagatgcctgcaaattggaagaggccatgcgaaagcatttaccagagctttttgaagaacagcctgacttgcttcataagctggtcactcagctttctccatctatccttaagtctaaaggagtaccagtttataggtgtatccaaaaccctggggactttgttctgacatttcctagagcctaccactctgggttcaactgcggcttcaactgtgctgaggctgttaatgtagctcctgttgactggctgccccatgggcatattgctatagagctgtaccaggagcaggggcgcaagacttctatatcacatgataagctgttgcttggggctgcaagggaagcagtacaagcccaatgggagcttgatttgctgaagaagaatactttggataatctacgatggaaggatgtctgtggaaaggatggccttttggcaaaagcactcaagttattagagaatcttatgattcacaatacaaatcctatgataaaacctatcgatttctattctaagatgaatctcaaatga

SEQ ID NO: 88387 - DNA, 2988 bp, Glycine max
  Peptide Sequence Number=SeqID_180072
atgatagtgcgtattgttgttattggaacaggtgtgaggtgtctcatctcagctggaattttgcttggtctgtctgtacgtctctgcttccactccctcacatcgcacacttttccgaatttcgattcaatggatccatcatcgtcaccactccgccaaaacgacgtcgcttccttcgaccgccaaacttcttctagaatatacttgcactcctcctcttccgacgacgacgtttcgccctcccactctatccaatccaccaaccgccgtctcgattacatgctccagttcctcgaccggaagctctcctccgaccacgcccaccgccgccactcatccggctcccgcgccgcgcaactgccggagttcgtcgcgaagggcggcggcgctggcatcttccgcctccctgctcgcggcgcggtgcacccggcgcggccgccgagccttgaactgcggccgcacccgctgcgagagactcagattggacgtttcctgaggaacattgtttccaccgagtcgcagctatgggcggcttcggagtgcggggtaagattctggaacttcaaggatctgtacgcgtcgtggtgcggcgtaggagaagaagaaggagtggttgcgaggaacggcgacgaggagagtgcgccgtttcgagagtcggtgtggacctcaccaacgttgtgtttggttgcggatgaggggaacaggttggtttggagtggacataaggatgggaagattaggtgctggaagatggatgatgatgacgatgataacaacaacaacaactgcgattggagcaatcggtttacggaaagcttgtcttggcatgctcaccgtggacctgttctttcccttaccttcacctcttacggggatctgtggtcgggttcagaaggaggaggtataaaaatatggcctttggaggctgttgaaaaatctattcatcttacaaaggaggaaaggcacagtgctgccatatttgtggagaggtcctatgttgacttgaggagccagctatctacaaatggcttcagtaacatgctaacttcagatgtaaagtacttagtatctgataattcgagagcaaaggtgtggagtgctggctatttttcatttgctttgtgggatgctcgtacaagagagctactgaaagttttcaattcagatggacagattgagaatcggttggatgtgtcctcaattcaagacttttcagtggagcttatttcaagttcaaggaaagacaaaacacaaagttccattgggttctttcagcgttcacgtaatgccataatgggggcagcagatgctgttcgtcgagttgcagcaaagggaggctttggggatgataaccggagaactgaagcactagtggtaacaatagatggaatgatttggacagggtgtacaagtggcttactggtgcaatgggatggaaatggcaatcgcatacaagattttctctaccattcatcttccattcagtgtttttgtacttttggcatgcaaatttgggtaggctatgtgtctggcactgtccaggtattggacctcaagggtagtctgattgggggatgggtggctcatggcagtccaattgtaaaaatgacagttggcgctggttatgtatttgcattggctaaccatggtggcattcgtggatggaacatcacctccccaggacctcttgatagcatattgcgttcagaattgggtggcaaagaatttttatatactaaaatagaaaatataaaaatattgagtggtacctggaatgttggacaaggaaaagcatctctagattcccttacttcatggctaggttctgtggcctcagatgttagccttgttgttgttgggttgcaagaggttgaaatgggtgctggatttcttgcaatgtctgcagctaaagaaacgggaagttctgttgggcagtggtggctggatatgatagacaaaacattagatgaaggttcaacatttgaacgtattggatccaggcaacttgctggcttggtcattgctgtgtgggttaaaaccaacattagatttcatgttggggatgtcgaagtggcagcagttccatgtggctttggacgtgctattggcaataagggagctgttggtttgagaattagagtgtatgatcggataatgtgctttgttaattgtcactttgctgcacatttagatgcagttggtcgtcgcaacgcagattttgatcatgtataccgaacaatgtccttcagtcggccaacaaacctcttaaatactacagctgctggcacttcatcttctgttccaacgtttcgtgcattgattcttgagattggtttccagtctgcagaagggatgcccgagttatctgaggcagacatggttgtgtttcttggtgattttaattatcgacttgatgacatttcttatgacgaagcaagagattttgtttctcaaagatgctttgattggcttagagaaagggaccaacttcgagcagaaatggaagctgggaatgtcttccaaggaatgcgtgaagcaattataacatttcctcccacatacaagtttgaacggcaccaagttggtttggcaggtcagtctactgttacaggggatcagaaggctactaaccatcagttgagaggttcctttggcttcccaaggtggcttgaggtgagtcctgcaactggtataataagaccagatcaaattgttgaagtatcagtgcatcatgaggaatttcagactctggaagagtttgttgatggcgttgtacaaaattcttggtgcgaagactccagagacaaggaagctattttggttgttaagatagctccaggcatatccaaggaactgtactacaccgatctgatttccaaccattcagcagttcctgtgatgtggttgaccagctacagaaattgcatagcccttgaatctgcagttaacggagcttgtggtccaacttgtaatcatccagctgattga

SEQ ID NO: 88388 - DNA, 1539 bp, Glycine max
  Peptide Sequence Number=SeqID_180073
atggaaattcttagtttgaaagatagtgttgagaaagacaccttcttccgcaagcttccaaatttggcagaacagcttcctcagcagattgtgttgaaaaagttacttcctttattagcttctgcgcttgaatttggttcagcttctgcccctgctttgactgcattgctgaaaatgggttccagtctttctgctgaggagttccgtgtcaaggtgcttccaacaattgttaaactttttgcatccaatgaccgagctattcgagttggccttcttcaacatattgatcagtttggggagtcattatcagcacaagttgttgatgagcaggtttaccctcatgttgcaactgggttctctgatacatctgcttttctgagggaacttactctcaagtccatgctaattctggctccaaagctgtctcaaaggaccttttcaggatcattattaaagcatatgtcaaagttacaggttgatgaagaaccagctatacgaacaaatactaccatcttattgggaaatattgcaagccacttaaatgaagggacaagaaaaagagtgttgataaatgcatttacagtccgtgctttacgtgatacctttccccctgctagaggagcaggcattatggctttatgtgcaaccagttcctactatgacatcacagaaattgctactcggattcttcctaatgttgttgtactcacaattgatcttgatagtgatgtgcgatctaaggcatttcaagctgttgatcaatttttgcagatggcgaagcaacattatgaaaaggattgttgccatgggcatacagctgaagacttacctaatacaaatacagcagaggctactgagggtacagccattggaatctcttcacttccaggaaatgcaggtttacttggatgggctatgagctccttgactcttaagggtaaaccttctgatcatgctccagttgcttctgtcagttctagtgcacgtactccaacatcttccaatgccagcccagctgtagatgctccttcaacagcacctgttcgtgttagctccacaccagattttgctgaacaccttgtccctacatccccaacgtcaacagatggctggggggaactagagaatggactaggtgaaaatgacaaggatgggtgggatgatctggaaccacttgaagaaataaagccaactccagctcttgtaaacattcaagcagctcaaaggaggccagtttctcaacctgtttcacagataaaacaagcctcaagtttgctatccaaaagtacgccaaagttgagcaaggatgaagatggtgatttgtggggttccatagcagctcctgctccaaaatcatcaaaacctttaagtttgaagtcaactgtaactgacgatgatgatccttgggcttccattgctgctcctgcacccactactaaggccaagcccttatcagctggtagaggaaggggtgctaaacttgctgctccaaagttaggtgctcagcggataaaccggacaacatcatccgggatgtaa

SEQ ID NO: 88389 - DNA, 1467 bp, Glycine max
  Peptide Sequence Number=SeqID_180074
atgaccttgttggtgatatgggcagtgttgtcaactttgctcgtagatcttacaaagcatcatgcacagcgttgcggatgggaggcgaaacaggatcttcacttcgcagatgatggaattagggaagacgttggagcaatgcgagaagtgttccatttgggttgtgagggagtcgattgggcatcaatgagggcaaagggaggtggcgagaggatggtggcacgaggagaggggggcgatggaggtgggatcaaaaagaaagggaaagaagaatatggaagagggatagagaatgagaaagctttttctgttgctgatacaaagagtagaaaatcatgtctttatgccatcttcccagcagcttctttaatttgtgttgttttatttttcatgacctcggccttcacacaagagccgaaactatcaagctggaaaatggacacagcagtggacgcagatcagaatgtaatagtggacccagtaattgataaatgcaagaaccagtgcaggcctagtggaagtgaggcattacctgcaggcatagtctccatcacttccaatttggaattgcgacctttgtggaatcctcccatgcctaagaagggtcgtcacacaatagaacttaaggtaaatgcatcaaccaatttgtttgcaatggtagttgggataaaacagaaagatcttgtgaacaagatggttaaaaagtttatagacagtaatttcgtcgtgatgctcttccactatgatggtattgttgacgaatggaaggatctcgagtggagtagtcgtgtcattcatgtgtcggcaattgatcaaagcaaatggtggtttgccaaacgattcttacaccccgacatagttgcagaatatgattatattttcctttgggatgaggacctaggagttgagcattttcatccagataagtatgtttctatcatcaaacgtgaaggactggagatatcacaaccagcactggaccctaaaaaatcagaagtgcatcatcagattactgcacgtgggaggaggtcatcggtgcacaggacatatagagctagtaatgatggtaaagggtgtgataaaagcagcactgccccaccttgtacagggtggatagaaatgatggctcctgttttctcaagagctgcatggcgttgtgtttggtatatgattcagggtgatcgaacaaaaaaagttggtgttgtggatgctgaatacattgtccactacaatcgtcccacccttggaggcatagataagactatgcacacttcttatctagcatgtgtgtctcttattctatcttccttgaaactgagacttatctgtgacttgcaggtttcatctcaggaaaaggatcatagagttgatgtgaggagactttcttaccaagaattagatatctttagaaaacgttgggaaaaggcagttgaggaggataaatgttgggtagatccatttcaatag

SEQ ID NO: 88390 - DNA, 426 bp, Glycine max
  Peptide Sequence Number=SeqID_180075
atggccaggctcctctcgcagccgatgtttcgccaccgcatgacgatggcgccaaggagatattcgtgccgccgctcaacttcgtcatggtcgacaacggcactaatttttagggttggctttcccgattctgccaacttcgaattcctgaaatcactccgtctccgttacgtaatatgtttgtgccctgaaccgtatccagaaacgacttttgaattttttaaggccaacggaataaggctttatcagtttgggatcaatggttgtaagcaaatgaagttgttaattggaacaacagaggtaatgagaagaaaggaaagttttttattgctacaaccaatgtccttggagataaacaaatatatattcttaataaattatggaaaaggaggtagaattagtttcgtatgggtatatggaggttag

SEQ ID NO: 88391 - DNA, 867 bp, Glycine max
  Peptide Sequence Number=SeqID_180076
atgggtgcctctccctccggcgactacagcttcttcctctaccagtgggccttcgccatcgccgccgccggaatcaccagcggcaccatcgccgagagaacacagttcgtggcttacctcatctactcttctttcttaaccggtttggtttaccccatcgtttcgcattggttctggtcctcagacggttgggccagcgcggctcgtagcaacggaaatgttttgttcgggtctggagtcatcgactttgcgggctcaggcgttgttcacatggttggcgggatagcgggcatgtggggggctttaattgaaggcccgagaatcggccggttcgaccggacggaccggtccgtggctttgcgtggccacagcgcgtctttagttgtgcttggttcgtttttgttgtggttcgggtggtacggcttcaaccctggttcgtttatcactatagcgaagggtattatgcttgccgcgaaggtggagtacgatgatccactggaggcggcgcagcttcacggcgggtgtggcgcgtggggagtgttcttcacgagattgtttgcgaagagagtgtacatggaggagatttgcggcgttggaaggccgttcggggcgttgatgggcggcgcaggtgattcagatattggtggtgtgcgggtgggtcacggcgaccatggcggcgttgttcaaaagatgaatctgttgagaatttcgagggatgaaattggagaggggattgtgctcagcactctcgtggctgccttcaccgtcaccacatggactcgccggagcatcgaacacggtcgtgggaaccctaattggaggaggggaacggggagaagtaaaaacatgatgaaattggagaaataa

SEQ ID NO: 88392 - DNA, 915 bp, Glycine max
  Peptide Sequence Number=SeqID_180077
atggtttcagcttcgcttcaattctggtcttggatagcacctactcctatatcccaccgttacacccataaatttgcttccctaacctcactcaaattagccactcctgtttcttctactaataccgtttatcttcccaagcctctagttgtgcgttttgctctaactgagtccgactcgcccaaatccatagaacctgaccctcaaactcttctccaagaaattgctgacagttttgatcttccttccgattacttttcaaagcttcccggcgatcttcgattagacctaaacgacgcggcgttcgacctttcaaacggacctgttttagatgagtgtggccaagagttgggagagactttgctgaatctctctcgagcatgggaacttgctgacacatcaacctcccactctttagtgaaaaagctccctttgattgaggccaagctgacgggttatgccaaatcagcacttggaaagcgtttggtatctgccggaagaaggtttcaatcaatgggacagtatggccaaggtgagctgcaaaagattgcaaaagcaatgattgcagctggtagagttctgactgctagttcaacgtcagcagtgatagttgaagaacccaaagaggaagctaggtttggagaattgcaggttgaagtaaccccagataaggccaatattggggctgtaattgggtttctttttgggattctttgttggcaaatagcgcggggagttcaaaacgttcctgacagttcattgcagtatgcaaatgacaatgctttgctgcttgctaagtctttaaagggagcattgcttgctatattctactcctcaacgttcttgtctgcatttacctcggtgggacttgttctacttgggttacagctcaaatcaaagaaaaataaagattga

SEQ ID NO: 88393 - DNA, 2301 bp, Glycine max
  Peptide Sequence Number=SeqID_180078
atggaaatcactcctcctcctcttcttcttctttttctgttgttgttgttctttctttgttatcttgttctctgtgcttctgccaccgacgtagattttgacaactgcaactgcgatgatggggaagggatttggagcatacatagcatactcgttggccaaaaagtcagcgattttttcattgccgttgcttatttttccatacccattgaactcctttactttgttagccgttcaaacgttccattcaaattgctcttccttcaatttattgccttcatagtgctctgtggcatgacccatttactcaatgcttattcttatcatggccctccttccttccaattgctgctctccctaaccgtcgctaaattcctcactgctcttgtttcctgtgcaaccgctttaacccttccccctctcatccctcttctcctcaaaatcaaagttagggagcttttcctgaggcagaatgtgatggagcttggccaagaggttgggatgatgaagaaacagaaggaggcaagctggcatgttaggatgctcactagggaaattaggaagtctcttgataagcacaacatcctctacactacccttgttgagctttctaaggcgttggatttgcataattgcgcagtttggatgccgaatgaggaccggcgagagatgcacttgactcacgagttgaaaaccaactctgccaagaattttcagaattctattccggtgaacgaccctgatgtattggagataagaaagaccaagggggtgaagattttgaggcccgattctgcaataggagctgcgagtagtggtggctctgcggagttgggtgctgtggcagctattcgcatgccgttacttcatgtatcaaatttcaaaggagggacaccccagttggttgagacttgttatgctatacttgttttggttcttccaagttcaagcactagggtttggacctaccatgagatggagatagttgaagtggttgctgatcaggtggctgttgccctgtctcatgcctctgttcttgaagagtctcagcaaatgagacagaagctggaagagcggaaccgagcgttgcaacaagctaaaaagaatgcaatgatggccagccaggcaaggaagtcatttcaggaggtgatgagccatggaatgcggaggcctatgcattctattttggggatgctttcattgtttcaagaggataatttaaggtctgagcagaagattattggtgatacaatgttgaaggttggccatgtgctctccagtttgattaatgatgtaatggagatttcagaaaatgaaaagggaggctttcggttagagatgaaacctttccttctgcattcaatgatgagggaagctgcttccattgccaagtgtttgtgtgtttatgaaggctttggttttgaaattgatgtccagaagtctttgcctgaaacagttatgggtgatgaggcaaggactttccaagtaattttacacatgattggctatttattgaacatgaatgacaaagggactctcaattttcgagtttttcttgaaagtgatggtggagacagggatgataaaaatattggaatatggagatcaagcagtcaaaatgagtatgtacatataaaatttgattttcagattactgagagttctcagtcagacaaagcaatttcaacaatacattatagtagtaggaggcagtactacaacaatgaacctaaggagggcctgagcttcagcatgtgcaaaaagttggtacagatgatgcaaggtaatatatggatatcaccgaactcccttggtttggtgcaaggcatgacacttcttctcaagtttcagataggaccatcacttggaaaatccatatttgcacctaaagattattcaagctcacagttcagaggccttaaggttttgttagccgaggatgatggtgtaaacaggaccgtgaccaagaagctacttgagaagcttggttgtcaagtaattgctgtttcatcggggtttgagtgcctgagtgctataagtggtgctggtaactcattcagaattatcctgttggatcttcacatgcccgaaatggaaggctttgaagtggcaaagagaatccggaagttccacagccgtagttggcccttgattatagctcttatagcaagtgcggaagaacatgtgagggagaaatgcctacttgctggaatgaatggattgatccaaaaacctatcgtacttcatcagatagcaaatgaacttagaacagtcctacaaagagcaggtgaaaaactgtga

SEQ ID NO: 88394 - DNA, 666 bp, Glycine max
  Peptide Sequence Number=SeqID_180079
atgagtgaccttgggctttggcctcttcctcttcttctcatagctaacacctctcgcctttgcctgaaaatcgcgaacatcgcgcaggcggccgatgagggcgtcgaggctgccccaggcctgtcggagcgggcagggacacggggcaggtgggttggggagaccgaagaacgggcatgggtggttgtgaaccttagtcttcccgaactggtcgaggtagtggaggaattccagcacgtgcgcgccgctgcaaagggacaaggagagtgggggacggtggttcctcaagtactggcagaaggtgttccagtcccttcgcttttggttctcgtagcggctcggagtagtagtgctcccgctattgttgcttcccgaagacggagacgacaccgccgccgtcgttggattcgtggttggcgtctccatcttgtacctgctgctgggcctgatgagattgggaaagaaagattgcctgagaaaagtgggggtgttgctggaaagggaagaccgagaagagagcaacctgggcaaatggttgctaaaaaggatgttggtgtagtggtaattggaatgattcctggggagagagagaaccgaaggttacatgaaggagaggaggctgttgtgcccaaagaggacaaagtttggcagtatgcagtgatgatg

SEQ ID NO: 88395 - DNA, 276 bp, Glycine max
  Peptide Sequence Number=SeqID_180080
atgagcgggttttggatgtgccgtggtgaagggactatgaagattggagttggttgtgaagggattgtggaggggctcgaagcaatgaaggtgaagggacaacgaagggtggaggtggttgtggacggggtgtggcgtgaaggtggagggatcaagaaagttgttagtttgtgggtaagagaagaagataagcggaccatttcgtcatttgacttaagatgtgaagcattagttaacgtggtttcattagggaagaccaaagaaacgcaaaaatga

SEQ ID NO: 88396 - DNA, 356 bp, Glycine max
  Peptide Sequence Number=SeqID_180081
atgtgttcttcctttatccctgacattcacactacaattcctagcactggcgcttccacatcatcgtcgacaccttcttctaccagtgcctctatctcctcctttgccccaatcctcaccttcacgaaactagcgcacactatagggaatctcgacagtgtcatcaactttaagaagcgaggtgaaggttactgtaacggtgaggcaccggtggaaaagaggattaaggacgccatggttgagaaagggaatcccttgatcttggaggttagggtttgggtccagagcatggccaaaggcgggttgcaagagggagtagagacgacgaatattaagggattcactgtggtttggag

SEQ ID NO: 88397 - DNA, 225 bp, Glycine max
  Peptide Sequence Number=SeqID_180082
atggctacaagaaagctgcgccatcaacagcagctcaagtcaattctactaccccatggaacaagcctcaaacacggtttcctcaagttcaatgtggacgcagcaagttttgaggaccagcaacacttcggtattggcatttacatcagagacaaccaagcccaattcgtaaaagcaaaaacaattttcctgccaggtttgcctgaacctagcgagagaagctga

SEQ ID NO: 88398 - DNA, 327 bp, Glycine max
  Peptide Sequence Number=SeqID_180083
atgggtaacattcatgaaaaactaaaatcacttacactatccaagaaaaacaaaatatgcatttaccttaagactccaaataacttaagttggactatagtaactcattggggtagggtgagaacagggaaaataagaagtgtaatgtggaacagctttacagggtgtgaaaccatggccttaggatctggaaaaaacataaaagggagatgggtaatgctcgagaaggaagagaaatttgaaaagaggttgaggaaaattggcggggaaagtaaatcggaaatagaagacgaagggcaaggagaggagaggaagattgggaattag

SEQ ID NO: 88399 - DNA, 729 bp, Glycine max
  Peptide Sequence Number=SeqID_180084
aggtggcataatgaaactagcagtttccatcttcctgttggggaggttaccatcaccctggatgatgtggtgtctctgcttcatcttccaattattggcaccttccataccttcgagcctctgcacatcgatgaagcagtgttgatgtttgtggagttacttgaggtctcaggagaggaagctagggctgagacaacacagtgtcatggggcatacagtataagctatgcatggggagctgccaccctaatgcatatgtacgatcatttgaatgatgcttgtaggagcggcaaccgacagcttgctggttacatcactctgttacaatgttggatatatgagcattttccttcagttgcggagtgtttgactgatccggactacgatgacctttcaccacgtgtatgtcggtggattgctacaaaggcttctttgaagtccatatctgcatcgacgtataggaaacgtctagatggactcaggattcctgatgtttgctggatgccttatggtgagcatcgagccgttcgtgagtttgatttgatttcatgcttctccggtcatctacgatgggagcccgtcgtcgtgagacaccgaccagagatggtcatgcgccagttcggatacgtgcaaagttttcctgtagaggctacagattcctgggtgtcatttgaggaaattgacgacaggtggatgcactactcagaccattttgcactagcgggttag

SEQ ID NO: 88400 - DNA, 399 bp, Glycine max
  Peptide Sequence Number=SeqID_180085
atggcgaccgtagctgctgctcctgctttaactgcaaacgattcccacaaaaagtacagaattcaggtttccaacactaagaaacctcttttcttttacgtcaatctcgccaagaggtacatacagcagcacgatgaggttgagctttctgctcttggaatggctatagctaccgttgtcacaatttcggagattttgaagaacaatggacttgccactgagaagaaagtattgacatctacagttggcatgaaagatgagaacaaaggtcgtctggtacagaaggcaaagattgaaattgtgctggggaaatctgacaagtttgacaatctgatgtctcctcctgcaccaactgaatcagaagcagcagctgctgatgatgatcatgacaaaaagtga

SEQ ID NO: 88401 - DNA, 153 bp, Glycine max
  Peptide Sequence Number=SeqID_180086
atgttcggaattagaggagggagtgtgctcaaacgaagaggggaatctcttgaacacacgaaatttctcaacatggagcaagccaaaatggaggaagacatgccaaagatcttatggggagtatacggtgaaggcgtttcgttttgttgttga

SEQ ID NO: 88402 - DNA, 324 bp, Glycine max
  Peptide Sequence Number=SeqID_180087
atgagagagagaaagggtggtgagagagggagagagagggtgagtgtgagaaacgtcaatctgagagtgagggagacaggcagggtgagagaaagagagggcagaccgagagagagagtagacacaaagagagtagttaggtatgactaccaccgcaggggtcttcggagcaaaacacggaactgctggtggactgatgacgaccacacgcgacgtcaacgtggatcatcctcatggattgcttacgacgacacgtatcagtcaggctgcaacacaaataacggtgactgggttgaagtgacacgcaagaagaaactgaacaag

SEQ ID NO: 88403 - DNA, 1665 bp, Glycine max
  Peptide Sequence Number=SeqID_180088
atgaaattgtgtggaagtatatggttatggctgatacttctgctggcttcagttcaatcactgggatctgagaggacggatgtggcatacgtgactctattgtacggagatgaattcttgttgggtgttcgagttctcggcaaatcgatacgcgacacgggatccaacaaagacatggtcgttttggtctctgatggtgtctctgattatgccaatacccttctccaggctgatgggtggatagttgagaagattagtttactggcaaatcctaatcaagtacgtccaaagagattttggggtgtctatacaaagctcaaaatatttaacatgactgactacaagaaagttgtttatcttgatgctgatactattgtggttaagaatattgaagaacttttcaaatgtggaaaattctgtgctaatttaaagcattctgagaggttgaattccggagtcatggtggtgcagccatctgctactgttttcaatgacatgatgagcaaagtaaaaactctaccatcttacactggaggggatcagggatttctcaattcatattactctggatttcccaacgcacatctttttgagccaaatttgtccccaaaaatgttggatactagaccagttcctgaaatggagcgactttccacactttataatgcagacgttggtctttacatgctggctaacaagggggatacttgtgtattattttctagtaatctgaacagagaactcttctctgtagaagtctatgactctaggactgcaaatgctgctgggggaagtaagatcatgatgtttgtgaacgagaggttgaatgaattggaagagaaactggaggggatggaagccataatcgaggcttggtggatggtggatgagaacgaactccgtgtaattcattatacactaggccctcttaagccttgggactggtggacatcttggcttgtgaaacctgttgatgtctggcagaatgtaagggaacagctggaggaatcccttcctggaactggagggggccaaaatcctaaagataattatcttgtgaagtttctttttctgctaccattttgtgctgtgctgttctgctgctatcgttcatttctaaagggatactttggttcctgttatagaacctcactatgtgatcatgtcagacacctttattacaggattaaatcaggggggccacttgcatatactaccatttctacctcaactctcaattcccctcataagctcataaatggtgctcagtacaaggcgcctgcatatatgggcagtatttctgtctgtgtctgtttattggctgcagtggtgtctcttggattagctctcttgatagtaccacggcaagtggctccatggactggtttgcttttgatgtatgaatggacattcacaatcttctttatactatttggaggttatctaaatttgatttatcatcgtggaaggattatgacatcacaaacaccttcctcattgtctcatcatgaatattctgatgatgattctggaaaagttcatcagcgtcagatgtcatcatgtaatgctgctacgtggttctatggattagggatggccttcttggccattgctactccatctttgccttttctttttgggatcactgcattgtttttacggtaa

SEQ ID NO: 88404 - DNA, 2115 bp, Glycine max
  Peptide Sequence Number=SeqID_180089
atgtctttttctcctctccactcaccacttcattttccccagcgcccacttttcacttccattcgccccattccaaaccgaacattcatctccaacccccgccgaacgccacgaaccccactctcactcgctcctatcaccttcgccgccaagtccacaccctccccgaacgacgacgttttgttcaaacgcctcgttcgcgcgctgttctgcttcgccgttggtttctccgcgctcggcgcattccgcgctcctcctcctgcattcgcaattgccgctccatggacttattggggaaagagaggcgccgagaaagagagagccaagagtcatcagtactcagactgcaccgataggctgcttgagacggtgtcgtttctgctgaaaaccgtggacgaggttcgggaaggcaatggtgaggtgaacgaggtggaggcggcgctggagtccgtgaaatcgaagaaggaagagttgcggaaagagattaacgggaggctttacccggcgctgaagaggttgaggagggaaaggaaggcgctgtggaaacggtccggggagatcgtcggcgagatattgaaggcgacggcggagtacgagaagttgaaggtgaaggtggcggggaatgagaaggagaatgcgaggatgaaggagttggaggagagcgtgggagtgatggaggatgagtacaatggtgtgtgggagagagttggggagatcgaggacaggatttcgagggaggagacggtggcgttgagttatggagtgagggaaatcaatttcatagagagggagtgtgagcagctggtggagaggtttaaacgggagataaaaaacaaggacttcaaaagtttgcctactggctcagttaccaggctctcaaaatctgtcattcagaaagatttggaaactgtgcatagaaaacaagcagaacaaataattcttcctagcattttggatgttgaagatctttggccattctttcatgaagactctattaattttgcccaacgtttaacaagaagtcttaaagactccagggagaagcaaaggaatttagaggctcagataagaaaaaaaatgaagaagtttggcaaggaaaaacacagtattatttattcaccagaagaagaggtggttaagggttttcccgaagttgagttaaagtggatgtttggaaataaggaggttgtgcttcccaaagctgttggtctccatctttaccatggttggaagaaatggcgtgaagaagccaaggcaaatttaaaacagaatttaataaaagatgctgagtttggcagacaatatgtggctgaaagacaggaaagaattcttttggatcgtgacagagtagtgtcaaggacttggtacaatgaagggaagaatagatgggagattgatccggtggctgttccttatgctgtctcaaaaaagctaatagagcatgtccgcattaggcatgactggggtgccatgtatatcacattaaagggggaggatgaagaattttatgtagacataaaggttgtagctgagtatgaaatgctttttgaagatttggggggatttgatgggctgtatatgaaaatgcttgcctgtggtattccaacagcggttcatctgatgtggattcctttctcagaattgaatatccgccaacagtttctattgatattaagagtgtctcgtgggattttgagtggcttgtggagttctggagttgtcacgaatgtgagaaattggatctttaagaatattaaggatacaactgatgacataatggtggtgatagtgtttcctattgtggaatttttagtcccttacccggtgaggatacaattggggatggcttggccagaggaaatatatcagacagttgactccacatggtacttgaaatggcaatcagaggcagaattgaattttagatccagacaaacaacaacagatgatgatgaagaagttccatggtttttttggtttcttgtcagagctgctatatatgggtttgttttgtttcatgtgttgaaatttacgaggagaagacttcctagtcttctcgggtttgggcctttgcgaagagatccaaatatgcagaagttgcagcgagtggtataa

SEQ ID NO: 88405 - DNA, 732 bp, Glycine max
  Peptide Sequence Number=SeqID_180090
atggaaaacactactgtgacatatcaaactgatctcaacctcaaggcaacagagcttagactggggcttccaggaacagaagaaagtgaggagaaaacactgtctgcaggtgctagaattaacaacaaaagacctttaactgaaacctctgatgagtgtgcttcaaatggtacttctagtgctccacatgagaaaactgaaacagcccctcctgccaagactaagatagtggggtggccaccaatcagatcctataggaagaacagccttcaggagagtgagggtgctggaatttatgtgaaagtgagcatggatggagccccttacctcagaaagattgacttgaaggtctatggaggctacacacaactcctcaaatctctagaaaatatgttcaagttgaccataggagagcattctgaaaaagaaggttataagggatctgactatgcacctacatatgaagacaaagatggtgactggatgttagttggagatgttccatgggacatgtttgtgacttcttgcagaaggctaagaatcatgaaaggatcagaggcaaggggtttgggttgtgcttgtatgcttttggcatacctttatacgaagttatactctgaagcaggagaagatggaagatacggtgcagtttcttcctcaagtttggcaacttttctggttattttgccatctgtggttggatgctacatgctatgctgttgtttccactga

SEQ ID NO: 88406 - DNA, 1074 bp, Glycine max
  Peptide Sequence Number=SeqID_180091
atgctttccccgttggtttcttggatcttgtctccctcctcttcctcctcctcttccgaagaagaagaagaagagatccttgacattatcacagataatgacattaaccatgaaaatgaccaaaagctcaatgtagaagatgacgagtgtgatgtggacaacaccattcccgttgcacttgctgttcccaatgcctcccccgccgtgacagtggccttcccggccaatgacgaaagaaacaccatcccagtcaccgccactgccaccactgtcgtaacatgctcaaaagggcagcgcaacgccaagtattccggaatggtgagacaataccaaaggctgtggacgaaggaggatgagatggaactgttgaagggataccttgattacgtcaagcggcatagaaaggaaaccaccaccctccaaagcgtcgtagcctcgttgtatgatcacgtaaggcccaaactgaacgtgagtttcaacaaaaatcagcttgttgagaaactgcgtaggttaaagagaaaacacaagttagctttggacaaagacaaggacaaggaggttccctttagaaacccccaggagcaggccatttttgaaatttcccacaagatttggggcattgacacggataatataatagaccaagatgccttggatggttatgaatcaggacacactcctgaaagtcatgatcatgttggcaacatcaaggtgaagattgaacaacttgacaacaatgatgaaatagataatagagtgccaaagcggttgcggctagatgatgcagatgatgtgaacaaaacaaatgaccaaaacaatggtgatagcatacaaggcttcattgaggagaccatgaggtcatgtttcccaccattgctgaaggaagtgttgcatgatgcacatgaagagccacttcctgagttggagccaatcccaatgccactatgccctggggaagtggaccatgaacaatggagaaaacggaggattttggagttggaggtgtatgtgaagcggttggagttgttgcaggatcagatcaagtctagattggaagagttgcgatctaactga

SEQ ID NO: 88407 - DNA, 909 bp, Glycine max
  Peptide Sequence Number=SeqID_180092
atggagccacagtgtagaatcaagaaggatgccactgaattgatagggaataccccaatggtatatctgaacaacattgtggatgggattgctttgagcatgattgaagatgctgagaaaaaaggccttattacacctggaaagactgttctggttgagtatacaagtggtaacaccggcataggattggcattcatagcagcattgaggggttataaacttcaggtgactatgccgtcttacgtgagtcttgagagaaaaattatactgcgagcctttggagctgaggtatatcttacagaccctgccaaaggaattgatggggttattcagaaggcagaagaactaatagccaagacgcctgatagttttatgctcaaccaatttgaaaatcctgcaaatccaaatattcattacgagacaacgggccctgagatttggagggactcgggagagaaaattgatgctttggtttcaggaataggaactggggggtcaatagcaggagctggaagattcctcagggagaaaaacccggatattaagctgtatggtgtggagccagctgaaagtccagttttgaatggaggacagccaggtaagcacctgattcaaggaattggtgctggtatcattcccaaagttctggatgtaaatctcctagatgaagttattcaggtttcaagtgaagaggctatagaaactgctaagctgcttgccttgaaagaaggtttgctgatgggaatttcatcaggagctgctgcagcagcggcaataaaggtggggaagagaccagaaaatgcaggaaagctcattgttgtgattttccccagttttggagaacgttacttatcttcaccactgtttgaatccattaggaaagaagctgaacaaatgacatttgactaa

SEQ ID NO: 88408 - DNA, 105 bp, Glycine max
  Peptide Sequence Number=SeqID_180093
atggcggatgagggtgttcagctcaagacccttcaaacaatatcaataatatttcaatcacgtttacaccctgaaaacgagctggacctgggagttgtccggtaa

SEQ ID NO: 88409 - DNA, 621 bp, Glycine max
  Peptide Sequence Number=SeqID_180094
atgagtagagagagaaacagtgggtgggagagagttaggagcagaggtaaggcaatagagagggatagagtgagcttcaatgaggatcctcgatggacacacgccggaaacagggatggacaacagcaaggctacaatcgagcaaattggagggacaagaaggacatatcatccttctatttcacacgattttctgaggatgtcacagagaaggacctgtggtaccatttcaagaagtggggtgatgtgagggagactttcatctctaaacaaaaaaacaagaacggaaggagatacgggtttgctagattcaaaggagtaaaggacgtgcataagctagaaaggcaactggatcagattgtcatcggtggtcagaagttgaaggaaacatacaacgatcaccacagccgtgttgcctcactatcatcagtataccttgacataccactgaacgacaagaaatggttcactgaagcttgggtaaggcgtttgaaaaaccttgcatggtttgatagagtcgaagacgacccattgtgggattttggagcagacataactccaaagtacatgggggatgacatgatactgttacttgggctcacggatgccaaagcagaatga

SEQ ID NO: 88410 - DNA, 1128 bp, Glycine max
  Peptide Sequence Number=SeqID_180095
atggctccgaaacgacgtcctaagaaaggcgagtcgcgaatggacgcagcactcgacgccatgaaaccctacggcttccccaacagactcgtccgaacaaccgttaacagtctcctcaaagtttacggtggcaacggtggctggttcttcatcgaagaatccgcgtactctctgctgatcgagacgcttcttgaaaaacaagccaattcttcacctcaggatgctgaattttcttactcaagacttatcccaccttctcatggtgaatatagtagtcaaaatcctgtcataaaagatctctcattcactgccctggaagggactcctaaccagctagaaaatttgctatccttgtctggtacttctctgtacaaagggactcttggaatgaatattgatcgtaactcattcgaaataaaaggaacgggcaaggcccctgtgcgttacaaaactgtggaaaataaacctcctgagcttaaaagtactcaaaacaataccattcctggtcaatccccagtgccattgatgtggaagaatcatcatgcttataatgaagatggtttgatagaggctaatccagatggtcccaatgaggtaacacctgctggatgctcaaacagtgcccttctagcttgctctaacacacaaacttctgatgatacactgttaactaatcaggcagcggacactgtatcgtcatccagtggaactggtattcaacttcccatcaatggtgtggacactgtatctgcaaaaactgagattggtagtgaacttcccatcaagtctgtagacatttcatcagtacccagtgaacctgctaatcaacctttaatcaaggctgccagtgaaactcccattgaggcatttaaagaatcaggttatcaatgcagaaaaagaaatgaggctgccagtgaaactcccatggaggcagaaaaagaatcagagtttcagccagtaaaaaaattggctttggccgaaaatcatgtatcaaagtccccacaacttgggacgggacttagtgacaaaaggtataaaccttgctatggctggatatctaatgatgacgaggaggaagaagagctaatagagctacctctagctccgtggttaagtggggtaaattag

SEQ ID NO: 88411 - DNA, 1920 bp, Glycine max
  Peptide Sequence Number=SeqID_180096
atgcctgttcctaacggagaagagcaggttctgttacctgaaaatgcaagtgaggtttcagagtcaccctcattgaatttgaacccagattcagttgatgggtccccacctgtttccaccgtttacactgacgtgggtgtcgtgccagaacaccaaaagaacgagcttgagcacttgatatccaatttagaaggagaaatcgaggaactgaggctcaagcaaaagaaattggataaaaagcggagagaagcattgagcaagatattggacatcaaagggagcattcgagtattttgtagaattcgaccgaatctggttacggagaagagaaaaatttccgaaccggtatcggctggaccagagaaaattcaggttaagttcgggggaacaaggaaagattttgagtttgataaggtttttaaccaagaagcaagccaagaaagtgttttcgttgatgttgagccaattctaagatctgcaatggacgggcacaatgtgtgtgtttttgcttacggtcaaacaggcacaggcaagacattcaccatggatggaacaaacaaggagccaggaataattccgcgtgctcttgaagagctctttcgtcaagcctctttggataattcatcttcttttacctttacaatgagcatgttggaagtttatatgggcaatctcagggatttgttatctccaagaccatccggtagaccacatgaacaatatatgacaaagtgcaatctcaatattcaaacagatccaaagggattgattgaaattgagggtctctcagaagtgcaaataagtgattatgctaaagccaaatggtggtacaacaagggcaaacggtttagatcgacctcatggactaatgtgaatgaggcatcaagcaggtcacactgcttgacgaggataagcatatttcgacacggggatgctttggaagtcaaaagtgaagtaagtaaattgtggatgattgatcttggagggagcgaacggttgcttaaaactggagccaaaggactaacacttgatgagggcagagccattaatctttccctttcagctttagctgatgttgttgcagctttgaagaggaagaggtgtcatgtgccttacaggaatagcaagctgactcaaatactgaaagattctcttgggtatggctcaaaggtattgatgttggtgcatataagcccttccgaagaagatgtttgcgaaacagtttgttccttgaactttgcaaagagagcgagagcaatagagtccaacaaagaaatgccagtggaagtgaagaagcaaagggagaagaagattatggaactagaggaagacatcaaggaagccgtaaaacagcgccagaatttaagggaacaaatacagaagattgagttgaagttaaatgagtgtaaaaagctcgcatcaaccacatatagtgttgtggaaagtgatgacattgcaacctcaactagcctcaaagatgatgtcaaagaggtcattgaaacccctaaaacatccaagaagtccattaaaagaaatttctccaattcaacgcctcgattcatgacttcaactgttgcaagtcgccaaaggcaaagtgctgcagaacgagacattagtactgtgagattgaaaagttttagatctattatctctaaaagttccaataattattcatattcccaatcaatgagttactcagatatccgcatcaaagcaatactacgaagttcaaatggaaaatctcggtatgctgaagcagatagtgttccaattccaaacactgttctcacagaaaagcctaaatgcaatgatatggaatcaaaagtgactactcctcgaagcaagatggttacatcatcagaccaaaactttagagtttcattgggtcgtcacaggagaaggatgtctgatctgatctaa

SEQ ID NO: 88412 - DNA, 861 bp, Glycine max
  Peptide Sequence Number=SeqID_180097
atggtttttgaaatcagtactgttgtttcaaaattgcaaacgttatccacctcagaccatgcctccgtggtctccatgaacttatttgtggcacttctttgtggttgtattgtccttggccatcttcttgaggagaatcggtggatgaacgagtctatcactgctcttttgattggtgtttgcactggcatagtcattttgctgtttagtggtggcaaaagctcgcatattcttgttttcagtgaagatcttttctttatataccttctgccgcctataatatttaatgccgggtttcaggtgaaaaagaagcagttttttgttaacttcatgaccatcatgttgtttggtgctattggcacattaatatcttgtaccatcataactttggcaattggtgcaatatttgctgcaacggattctgtttgcacattgcaggtgctaaatcaggatgagacacctttgctgtacagtcttgtatttggggagggtgttgtgaatgatgctacatcagtggtgcttttcaatgcaatccaaagctttgacctcaaccaaatcgacccttcaattgctgggcactttttgggaaatttcttgtatctatttattgcaagcacaatgcttggagtgttgacaggtctacttagtgcttacattattaaaaagctgtacattggcaggcactctacagatcgcgaggttgctcttatgatgttaatggcatacctctcctacatgcttgctgaattgtcctatctgagtggcattctcactgtattcttttgtgggattgtcatgtctcattatacctggcataatgtgactgagagttcaagaatcactaccaagtatgtcttctaa

SEQ ID NO: 88413 - DNA, 558 bp, Glycine max
  Peptide Sequence Number=SeqID_180098
atggacaaaagagaattccatcttcaacctatgggcatctgttacaggctctatcatttcctcacgaaagctctggcttcgcaagcgttgaagacagtgactttagggtgttcaagacgtgatagttcacgctcaagtgcagtaagaagttcggattctaatgctaaaaaggaggtacagtcagagacacaatgcaaagttgatgatggcaagaagcttccaccaactgaaggtgtccctggtgactctatttcttctgtacagcagcaagctgaagagaagagtaagccatgcatgaatgttgataaaatggaaggagagaatgctgcattaacattgccaacgccaagtttggcaccaacgcggtctataaagaaaaccgtaagcataagtgagaacgtggaagagattcccccacctaagaagttgaagaggaagtggagcaggtccttccaaaaatcattttctttggatcaagaggaagaaccaatatctcctccgcgatcaattctgaaagtgggttctgatctgaacgacaagtccaatcccttttcttaa

SEQ ID NO: 88414 - DNA, 825 bp, Glycine max
  Peptide Sequence Number=SeqID_180099
atggttttctttctctatgtgcctattcttctttcactttctttctcgttccttctccatgtgtttaagaagcatattcacatttccttattggatcttgtcaccaccttcaactctaccaacataatgattgacaactacaagctttatcccaatcagattggttttattgaagatgttagtgaagggattgaagggtttatgacttgcaccaaaaatcttggtttccaaagcattgatattagtgataaaatcgatgataatgacaataataatgatgatgaggatgaagataattgttggaggaaaacaagggtgacagaaggtaaaggaaactttcctccaccactttcgtcgttgaatgggaatggacaacctagtttcattcttgtaccggtaaggaaaaatggaaggttacaactcagcaaagtaagaattaagaaaccaaaaattctctatgctacccgacaagatggacgattgaaattgttcctcgttccagatcaatgtgtaaaggataatgcacaagaagatgagaaagaacaagaacaagaactagtagatgacatggaggaacatacagaggaggaagaaggcatgatgatagtagaatcaatggaggaagaggaagaagaagatgatgatgaagtggttgaagagattacctattatgagcaaaaggattttaggattggagagtggaagtttcctaacgaaagatctaggaagtgtcatgaagttttgaatcatattcaaagccatcatcatcatcatggtcatgggagtcatcaccacctacatatgtatggatttagcattgcatga

SEQ ID NO: 88415 - DNA, 3672 bp, Glycine max
  Peptide Sequence Number=SeqID_180100
atggtgtttgagatggtgaagggaaaagaattgggtgctgatctagtagaggctcggttggacttcttgaatgacttccatcctactcaacatcttccttctctaatcaataaccgtcctttgcccattttaatcacttacagaccgatatgggaaggaggagagtatgatggtgatgaaagccagcgacaagatgctctacgtctagccattgaattgggatcagagtttgttgatgttgagctaaaggtggctgatgagttttacaaatccattggagggaagaaggctgagagtgtgaagatcattgtgtcttcacacaacttggaaagtactccatccgtggaggaaataggcaaccttgctgcaagaattcaggctaccggggcagatgtggtcaagattgctacaaccgccttagacatcacagattgtgcacgtcttttccaagtcctagtgcactctcaggtcccaatgattggaattgcaatgggtgagaagggatttatatcacgggtactctgcgcaaaatttggaggatttctcacgtttggttcaattgaggccggagctatatcagctccaggtcaaacaactatcaaagaattgttggatttgtacaattttaggcagattggggttggcaccaaagtgcatggtgttataggaaatcctattggtcatagcaaaagtcctcatctttataatccagctttcaagtcagtgggatttgatggaatttacttgcctttgttgatcgataatgtctcagattttctcaacacttactcgtctcctgatttcgttggatacagctacacgattcctcacaagcagaatggacttagatgttgcgatgaggtcgatcctattgccaaggcaataggagctattagttgcatgattaagagaccaaatgatggaaggctaataggctataattttgattatcttggtgccattgcagctattgaggaacgactacatctacaagattcaaacggaagatccatatctggttgttcacctttgtatggcaaactgtttgtggttatgggagctggaggggctggaaaggcactagcttatggtggaaaagaaaagggtgcaagagtagttgttgccaatcgtacatatgccaaagccaaagaacttgccactaaagtgggaggagaggccattactctatctgaattagagagcttccacccggaacaagggatgattcttgcaaatactacatctgttggaatgaaaccaaaaattgacctgacacccataccaaaggaagccctgaaacactactccttggtatttgatgccatctacacacccaaattgacaagactccttcgagaagcacaagaaactggagctgccatcgtctatggtacagaaatgttcatcaaccaagcattcatgcagtttgaaatgttcacaaagttgccagtacctgtgattgtgattgtgattctgatcgttcaatctatgtttggtggtctgctagaacctgggtggttggattttgatctcaattctcccatggaatgcaacaaggacgaggctttgagggctaggcaaattgctgaagccagaatgcaaagaggtgaatttgcggaggcactcaggtttgctaccaaggccaaaagactgtatgccgacgttgaaaacattgcccagattattacggtttgtgaggttcacatcgctgctcagaaaaaactctctggctgtgacatggactggtatgcaattcttcagattgaaaggctggctgatgaagcaaccgtaaagaaacagtacaggaggcttgcactgctacttcatcctgataagaacaagtttgctggtgcagaagctgctttcaagttgattgggcaagccaatgggctcttgtgtgaccaagcaaaacgttctttgtttgacaagaagtttggagcctccgtgaaaggtgctgcgcctaagcctaagacctcgcacaattattcaaatgggaatgtgtttgccgctaaacataatgcaaatgcaacaaagactcagaagagttctgattcgcaccatttctcacatgggaatgtgtttgctgcaaaatgtggcgcaaacgcaacaaattatcagaattcttatccgaactccactggtttcagcaaccaaggtgcacagatgacattctggacatcttgccaacattgtgatgctaagtaccagtacccgatccgatttgtaaatgcaaacttactgtgtcaacagtgtaagaagccatttaaagctcttgctaatggttttggaatcatgggtgcggcaacagtgcttacttcagtaaatattccgaaggaggctccaatgcatggtcccccaaaaccagcctcagaaaatactggtcgaaaaccccttggtagagaacaagctggtacgtttgtgcggtcaaatcctacatctatgaaaaaatgtgctgctggagtcggtagacgttgtggaggtgaaaagagtaaagatggcaacattcctgcatccagtgatatggagccacagacctctcaaaattttggaagtaaaagagtaaggcagtcagcaccagattcaggagaaagtttcaaagccagaaatggtgatgataccaaagctgccaatattcgagaaaatgctgttgattcttcaaatacaaggagatcttccaggaaaaagcagcatgtttcatatattgaaacctctgaagatgacgattttgagattccttccaaaaagccacgacaaagtggaccacttaatgctgatgaagctgaggaacaaaacgtgcctgcaagtggtgagtcgtctgataataatattccagctactcccggtgcgactgatcagaacaaagagaaggtatccgagtcagatattggtcttggaacgtcaaaggaggataagcgctccccaaaaaattcaaaggttccttctcgtccacggatatttcattgtcctgtttctgatacagatttcaatgattttgagaaggataaggaggaggattgttttgctgttaatcagttgtgggcagtttatgatagcactgatgcgatgccaagattttatggtcttgtcaagaaagtggcctcccctttccagttgaagattacttggttggaacctgacccagatgacaaaggtgaaattgattggaatgatgcagaattgcctattgcttgcggtaagtttagacttggtggttctcagcaaactacagatcgcaccatgttctctcatcaggtgcggtgcataaaagaaaccggcagaggttcttatctggtatgtcctaataagggagaaacatgggcaattttcagagattgggatatcaactggagttcgaatccaaaaaatcatctgaagtatgacttcgaatatgtggaaatcctatcagatttttctgagaatgttggcatcgcagttgcttatatgggcaaagtgaaaggatttgttagcctttttcagagaacggagaagaatggagtaaacatattttatatcgaacctaatgaactatacaggttctcacatcgaattccttcttataagatgaccggttatgaaagggagggtgttccaagaggatcatttgaatttgatccagcggccctgccgactcatctctttgaagttggtgattctggtaatgtaaagatgtga

SEQ ID NO: 88416 - DNA, 4119 bp, Glycine max
  Peptide Sequence Number=SeqID_180101
atggcggaggaggaggaagacgacgagagcttcggcgagttcacgttcgcgtcgtttccgagtcaaccaacctcaaacgacaccaatcccctcgacgacgacgattggggcgacttcatgaaccattccaaccggatcaacggacccttcgactcgttcgggcttcccacggatcccacgaacaaacacgtgaacgacgacaaaggcgttgccgttcaggccgaggcagcgaaaaatcccaagggagctattccgctttcgatcttcggcgaggaagagggagaagaagaggagaaacccgcttctgccaatgttttctccaacggcggcggtggtgcggtgaaaaggggatccggttcgaacgggtctgttggaatcagtgatttgatttccagtttgtataatcagcagcgccctcaggtggattctcacaacaacggatcggtttcggtatccaatgttgctgctcccaatccgacgtactcgaacggaagcaaattaaattcggatgaggatgaggatggatgggaattcaagtctgcggaatgggaaactggaaccaagagccaggatgttaaggctgaaacaccaaagcatgataatggtgctcttgatgttggtactgtgttggattcatccaatgggattttagacaaagctggcagatggcacgtggagtttgagttcagtccacattctgcatcgcaagatcatgttaacccacaaccaagtccagaaagtgaatcaaatgacattggaactgggtttgccatgttcagtcaaaattttggggagtttagttcagggtcagggccaaatcaaaatttggaagtactgaagaaggctgacatttatcccactaatatggaattactgaaatttgaaggtgcaactccccatggtactattgattcatctctcacatcagaatctaatcaacctgatggatggaactttggatttaatttcaattctagttctgtgggtgaagacaatcatagttcagattcatatttcaaaaccaaaaacaatcaggatgataacaacagaaacaatgcttccccaactaatataaatgttgattcacatgtcaatttctttgaatcagagagtgatgttacaaaacatgagaagcccctaacaagctcagagaatcgtagggaagccatgcctctgtcaatttttggtgatgagacaccagatactgataaacatcctgtgactcaagatttatctccctatacaccaacatccccaataaggaacagcttcaacagccctggttccaacttttctatcaatgacatatggaatttatataatcaagctgaaaaccaaagttctcctaatatgacaccaaaagcaagtgaaaatcagattcatgcctcccctgaagtattgggctccagtttggttaccagtaatgataatttagatgatgacttctgggactataaggatgctgcaactgaaacaagatttaccaatgaatctgcacagaaaacttcttcaccacaagtcaatgagaatgtgttgcagtcttccccaacatttttaaattctgatttgaccaacggtgatgatgattttgtggatgattcatgggtgtttaaggatgctatctctggaacaataagtcaagatcacacaccttctctcgatcacagagatttaccacagttatcaacaaaactagagcaggttgattatgcagagttttatagcaaagtgaaggatgaattgtgcaattatgttctgttccatcttcagaatctcaagaaaactcaaaatgttgctgctctttcgggtgaagatgccaaagcaaaagctcttctggaggaaattcaggggattctctccatgggggtaatgggagaatctggcggtaggtctttcaggatttggcacaaagaattctccaagatactgcatcaggataatatgagcatccccaatgaatatctctctgaggattattgcccaagaaatgtctgctttaatgaacttcttgaagttttgaaggaacctaagttccaaccttttgagtcagaataccaactagcatcaaggttgttgatggccgagaaggatattaaatgtgttatggaacttttgaaagatacagtatcaacattaagaattctcaagctgggatcaacagaagaacaatctaattatcttaccatatggtccaaaatagcctttgtttgttctcaagagctgaaacatggtgcttatgtttggaagcaagctgtactacagaatacccatgaccagatattatctagcccgaaaggtaagctacatgattatgtcatgcctaatgtatatgctgctgatgtggatgaacttaagcagtctgaaataacctcttccttttctggcataggtgttcagtttatccttgcactcggagaaatttatagagtggcagaaattattggaacttcagccaaacttcacaaaccttggatgttatcaggtgccacagatcacaaaagtttgtgtgcccttttgaacgaatgttatggcatatggttggcttcaggacttgaagaagctattttgagtatatcaaattggaataattttgagccagatggcatttcaagggaattagttgaatccatcaagtatattcacgagcttgatgaacatgcacttcagagctttgtcatctctggagaacaaactacttgccagttgtcagccttgccagctggtttcataccagtcgttgcacaagtgagggaggttgaaggcggcgtgagaagcatgttggacatcaacctattcagagaggagaagggccacaaccctgaattcatccgcgaatcccagcgccgtcgtttcgccagcgtcgaagtcgtcgacgaggtcatcaatctcgacaaagaatggcgaaagcgtcaattcgagttggagaatctccgcaaagaatttaacaagatcaacaaggaagtctccaaactcaagcgtgctggcgaggatgcaactaagttcatcagtgaatcagaggaaaccaagaaatcgataggggagaaagaggttgaagttcgggaaactctgaatctcttgaattccaagttggaaactattggaaacctcgtccacgattccgttccaattagccaggatgaggccaacaatgttgtcgttagatcgtggggagagaagagagtggagcctaagctgaagaatcatgtggatctagttgagcttctcgggatagcagatacaaagaaaggagctgatgtagctggaggtagaggtttctatctcaaaggagatggtgttcgtcttaatcaagctctaataaactttgggcttgattttttggaaaaaagggagtatactttattgcatactcctttcttcatgagaaaagatataatgtcaaagtgtgctcaactagcccaatttgatgaagaactttataaggtaactggtgaaggagatgacaaatatctgattgcaacagctgagcagccactctgtgcatatcatttagatgattggatccaccctacccagctaccattaagatatgctggatattcatcatgctttcgtaaagaagctggatctcatggtcgagacactctaggaatattccgagtccaccaatttgagaaagtggagcagttttgcctcactagcccaaatgacaatgattcatgggacatgcatgaggaaatgctgaagaactctgaagatttctacaaagcgttaaaccttccctatcaagttgtttccattgtatctggtgctttgaatgatgctgcagcaaagaagtatgatctagaagcatggtttccagcctctcaagcttacagagagctagtgtcctgttcaaactgtacagactatcaggccagaagattagaaattcgatatggtcagaaaaagagcaatgagcaaatgaagcaatatgttcacttgttgaactctactctaacggctactgagaggaccatttgctgcatactagagaacaaccagaaggaagatggggtagagataccagaagccctcaggccattcatgggtggaaagactttcctacctttcaagaaccaaccatctaatgaagccaaagggaagaaatcgaaggcctaa

SEQ ID NO: 88417 - DNA, 954 bp, Glycine max
  Peptide Sequence Number=SeqID_180102
atgacgacgaaagcgggagaagacaccatcaacaaaaatgatgaagatgaacaaagggatgaaggaggggagactcacggcgcaaccaaggaagcacgattacagaaacacaagagagaggggatgggacattacacatccatcgataaccaaaaggtttcaggatctgtacctgctgttgagcccccaccattcaaattctcagattcaaatcttcagacatttcctccgtctggagcacaaggcaagattagtggtggctcgagacctccacgtgatgttgatgatacattttcaaaatcagggtctggttctgatgaaccccagcgacagagtggttggtttcaggctttctcacttgcttcttacaaaccatactttgatgttgacactatagatgttctagacaggattaaagactcactttgtccattcagtggaacattcaatgaaaaaactgcttcccaccctgatttgtatggaccgttctggatttgcactaccttaatatttgtagcagcatctattggcacatttgtgacatacatagctcacaaactgaaggaccaggaatggaactatgacataaatctggtgacttggtctgccggcttgttttatggttatgtcaccgttgttcctctttgtttgtatgtaatcctcaagtacttctctgtaccatcgggctttgtccaactactatgtctctatggatattccctgtttgtctttattccagcactgtgtatgtctgttgtgccattggagatattcagatgggtggttgctggtgtggctgggttcatgtcagcaacttttgtggcacttaacctccgggcacatattatgtcagcagttggctctagctgtagcactaaaggtctacctcttcacagtaacagtatgagaggaaagtggtattatcatcattcagcatcaatgaattgtagataa

SEQ ID NO: 88418 - DNA, 621 bp, Glycine max
  Peptide Sequence Number=SeqID_180103
atgatagaagcaactcaaaggcattctgttgaacgcaagggtgtggtggcagacaatttggtgcgtggttctgttttcgtgggtgagcaatataagagcttgcttgaatggtcgaagcctttgactcggttggtgcttggtgggggacatgattcacgtgtgcccatgcagctttggagaactggaatttacacttcgttgactagtattgggatgggccctcagaaacaggtcaaactctcgaatcctccacgaccacaagccacccgcaacgcagaccaacacgaatgcaaaccacgccgatttcttcttcgtcagcctcctgttggcggttattttccctctccggccaccgacgagaaggctcagagtctggcaatcgccgcgcgcgatttcgccggcgagggagttgaagggctccggcaggatcttgagattgaacgcgacggtggaagccagttgaagaattttccgattggatggttgggaccagccgccgcgcctcttagcgcagaggattgtgggagttggatgagattgcgaaaggcgaagagaaataggattgaggaagcgagaatagatgtggattacggagattgggaatggaagggggtgatctga

SEQ ID NO: 88419 - DNA, 849 bp, Glycine max
  Peptide Sequence Number=SeqID_180104
atgtcgttgcccaggcaaaggttgctaccgttgataacctctgtgcacaagctggttgtgctcaaccatgagacattgttgatggagcttcgaagtgcaaatagcgacatattggaaaaccaaaatggcatagaatgcttaaaagattccgaggttttcaagaagcattatgccacggtttctgatgctatgctacaactgaggcaacgcaatacttacagaggaaactctctgccaccctggatgaagccacaagcaagtttcaatgttcacgatgatcttcctggtatgttggatagttctctaacacaagagttagggtcaactgttgttcaagttattaaaggatccaggctaagggcacatgcaatggtagatgctgcatttgaggcattgtctttgacaaaggaaggtgaagatgccttcataaagattgggcaagcattggattctataaatcatcagcagttagcctccaagtctaggttacctgtgatcaggtctcaagagcaagtgaatgtgaatggcagtttttatcatcttagtcattcaactagcggtgtatcagaacctatactcaatgatccatcagttccaaaaccacataattattctgacaaatttgatactgaacttccgtcagatcttatcgcttcatgtgttgccacattaatcatgattcagacttgtactgaacggcaataccctccagctgatgtggctcagatattagattccgccgttactagtctgcatccatgctgtcctcaaaaccttcctatttacagagaaattcaaatgtgcatgggaagaatcaaaacccagatgttagctctcatccctacttga

SEQ ID NO: 88420 - DNA, 171 bp, Glycine max
  Peptide Sequence Number=SeqID_180105
atggacgatgcgaacgtggtgaagtgtcatgagatgtacgatcagaacagcgaaatccaggtgctgctggagttcatggacggagttgtgttcccctccatggacgttgcagcattcacaagtgggtgttccccttcctctgcaagcgtagccgctgtgatcttctactaa

SEQ ID NO: 88421 - DNA, 483 bp, Glycine max
  Peptide Sequence Number=SeqID_180106
atgggtatggcagtgcaacccaggtttggggtatggaaaccaattcgaataccacaatgttccggcgatgatcctttcagaggcatcactagttttcttcttggtttgccaccacaaagtgggcgtaatctgaagctggacgtgctttatcccattggaggctacagccgttgcgttgacacaaaggaaggattctacgctgctaagaaaagagagatggaacgatcattggatccccctccgctgaatcaacggcggcgttctaacatcaatgaaccggttgttgcatttggtccccccgcatttggggggccagatgaggtgggtgaagcagtggttcgaagcataacaggatcagggcaacttgataaaatcaagtttgagaggatttcgttagaaatgtcaaatactacgaactggagttcagagttgagagtccctcgtttaggcggcacaatgtttccgtctgctgcgctcgtggtg

SEQ ID NO: 88422 - DNA, 1717 bp, Glycine max
  Peptide Sequence Number=SeqID_180107
atggataacgcgcgatcggccaacggcgaggagaatgcggcgggaattccggacgatttgcggtgcaaaaggtccgatggtaagcagtggcgctgcacggcgatgtcgatgccagacaagaccgtctgcgagaagcactacatccaggccaagaagcgcgccgccaattccgcaatgagggccaacctcaagaaagcgaagaggaagtcgcattcactgtcgttgaacgagtccgataatgtttatttggagagcaagagcgatgatttcgaccttcctctctcctccattggcctctcgcagaagaagctctccaagaacgagtttcgctacgagcctgagcgcgacgcgcgaagaggctcgtctgcgagacgcgcttcgaacctcaacgatgatgatgatgatgatgatgatgatgttgtcgtggatgtggatggggatggggatggggatgcggcgctctatgaggaagagaattgggtctcctatgattccccgccggattcttcacgcaagaggtctcggaggagcttggaagctaatgctgtgagttggaatattcggatggaacatccggttcgtctgacgaggacaccggcgggcagacttgtcaccagtgccggaggaatgaccgcgatcgagttacttggtgtcaacggtgtgataggaggggatattgtgatagctgtttatcaacatggtactcggacatttcattggatgaaattcagaggatatgtcctgcttgccggggtatatgtaattgcaagacttgcttgcggagtgataattccattaagtgaattttctgctttttctgggactaaggttcggatacgcgagatacctgttcttgataagttacagtatctccacgtgctgttgtcgtcggtgcttccggtggtaaagcagatccaccatgagcagtgttttgaagttgaacttgaaaagaagttgcgtggtgctgaaatagatcttccgaggataaaattgaacacagatgagcagatgtgctgcaatttctgtaggatacctattactgattatcatcgacgctgtccaagttgctcatatgatttgtgccttaattgctgtcgagatcttcgagaagcaactgcagatcacaataaagaacctcaaacagagcaagcaaaaacttctgatcgaaatatattaagtaaatttccgcattggagatccaatgacaacggaagtattccatgtccccctaaggagtatggtggctgtggttattcttcattaaatttaagccgaattttcaagatgaactgggttgcaaagttggtcaaaaatgtagaggaaatggttagtggctgcagaattagtaatgctgatgatccaccggaaactgggcggaatgatctcagactttgccaatattctcatagagaagccagtgatgataattatctttattgtccagcatctgatgatatcaaaactgatgggattggcagttttagaaagcattggaaaactggtgagcccattattgttaagcaagtatttgatgggtcatccatttcaagctgggatccaatggtcatatggagagggattctagagacaacagatgagaaagcaaaagatgaaaacaggatggttaaggccatagattgcttagatgggtctgagattgatattgagcttgctcagttcatgaaaggatactttgaagggcatattcttgaaaatg

SEQ ID NO: 88423 - DNA, 192 bp, Glycine max
  Peptide Sequence Number=SeqID_180108
atgaagggttgtagtaaaaatattactaggttaaaaatcgtgcaccctttgacgaactcctttgaagttgacacgcgtcagtcaacgggccactgtgtcggtcatgtttggatctgtcaagagcagccagagttgaagcttaccagccacgatgccctaggtgttagcacctcctactcaaccgcaagttaa

SEQ ID NO: 88424 - DNA, 366 bp, Glycine max
  Peptide Sequence Number=SeqID_180109
atgggttgtggaaatctcaaacctgtaagtgttttgcctcgttgtcctcacctagttgattttttgaagcaagggtgtcgtcctatttgggtgtcagaagtggtggttgaaaaacgtggtcattgcctgaagcatgtcgtcaacgacgccattcccatggaaaggagttcctcattgtacaccttagagccctggagttgcgtgatgtgtttgtgtaacgtaaaggttccactggtgatatcgtggactaaggataatctagggaggcatttttatggttgtggtctatacaaggtaggaaagggtggaattattttgagtgacacgatccagttgcaaacagtcgttagaagagaatcattatag

SEQ ID NO: 88425 - DNA, 1860 bp, Glycine max
  Peptide Sequence Number=SeqID_180110
atggcgagagcaagctctggtctgcaatacccagagcggttctacgccgcggcctcttacgttggattcgacggatccaccaaatctctcacttccaagttctccaactccaccgctcttcttctctacagcctctatcagcaggctagtataggaccttgtaatgtcccagaacccagttcatggaaacttgtggagcatagcaaatgggccagctggaaccagcttggaaacatgtcttccacagaagccatgcgcctttttgttaaaatattggaggaagaagatcctggttggtattcaagagcatctaactccgttctagaccctgttgttgatgtgcaaatgaatcacaattccaaagttgagccagtaattgagaatgcaaacgcatatccagagataaaaaccatttccactgaaaatggaagtcatgttggaactcaggataaggatgttgtcattgaaggctttggctcagttggagtatatgaccaatgggttgcacctccagtgtctggtcaacgtccaaaagccagatatgagcatggagctgcagtcgtgcaagataaattgtacatatatggtggaaaccacaatggtcgttaccttaatgatctccatattgaagctgaggttgttgaatctactaactcatcctcaataacattcccttgtgctggacattccttgattccatgggaaaataagctcctatcaattgctggtcatacaaaagatcctaatgaaagtatacaagtgaaagtgtttgatctgccaaacgctacatggacaactctgaagacttatgggaaacccccgaatgaaaaaggaagcatgttaatgcttgatgctaaagaagtcttaattggcagtggggtgcctccttctccaaggtctgatcatgctgcggctgttcatgtggagcgatacttgcttatctttggtgggggttcacatgcaacttgctacaatgatttacatgttctcgatatgcaaactatggaatggtcccggccaacacagctaggtgaaataccgacacctcgtgctggacatgctggtgtgacagtaggggagaactggttcattgttggcgggggtgacaataagagtggggtctcagagactgttgtgttgaatatggctacactgacttggtcagtggtaacttctgttcaagggcgtgttcctgttgctagtgagggctcgagtttggttgtaagctcttatgatggtgaagacatacttgtatcatttggaggatacaatggacattacaataatgaggtctatgtccttaaaccaagccacaaatcaaccttgcaatcaaaactaatagaaaaccccattccatacagtgtttctggtgcgcataatgccgcaaatgctacccgagatctggattctgaagcaggccacaaagggattatcaaggaacttgtcatggacagtgttgattcaataaaatcaaaaggtgatgttataacagttctaaaggtcgagaaagaagatttggaatcatcgctctacaaagagaagttgcaaactcttcaactaaagcaagagctttcagaaactaaaactcgtaactctgatctttgcaaggaactccaatcaatacgtggtcagcttgcttctgagcagtcaaggtgtttcaaacttgaggtggaggttgctgaattaagtcagaagctccagacaattgggacactacagaaggaacttgagctcctgcagcggcaaaaagctgcatccgagctggctgccctgaatgcaaagcaaaagcagggttcaggtggtgtatggggttggcttgctggtgctcctccccctacccagaaagaagatgatgggtga

SEQ ID NO: 88426 - DNA, 921 bp, Glycine max
  Peptide Sequence Number=SeqID_180111
atggactttggaaacatcgttttggccataataggcttctccacgtcgttcttattttgcgtgcccataaagagatggcagaggaaacaagtggccgcagagaaactaaaaatcgttagcgaggcgttggaagctgcagaagaaagagcagtgagattccaagaaagacatgacacaatattgagccaaatatgcgcgtcttacttgaccaatacagaggtggttgaagcactagcgggtgctcgagcaaccatgagccaggcattggactttgccgttgaattgagggaaattcagtttagaatcattgcttctttccccgatgcaatcgatggtattgaagagcctaatgagtgtgcccttggagctggcggttgcaagcaacctgccatcgtgcgtgagtgcaaaacacgcgattcgggaatcatgagccatgatgaacttggttcttttagaggccactttgagatcggcgaagttgtagacgaagatcttgtgggcgaggacgacgacgattcggtcgcggcggaggcggacgcccttgacctccgagcggaaggagagctcgccgatgcagcgggacaggtggtcgtcccagatcatgaccttgttgggagggtagcgggggtcgggggaggagccgccgccgacgaaggcgaggatgttgcagcggaagagcatgtggacgaggccgacgccgccgccggggccgaagtcgcggcggaagatctcgcggaaggggtcgcagttgtagatgcggaagccgcggtcggtggcggcggcgaagcacccggagtcctgattgaaggagaggtggaggagggaaggggtttgggtggcgtgggtggtttgcggcgcctcatcggaatcgagggtttggggtggggtctgagacattattattgggaatcgaatgaatga

SEQ ID NO: 88427 - DNA, 2265 bp, Glycine max
  Peptide Sequence Number=SeqID_180112
atggatggcaacaagacaagttcggcccaagtcattgcagaaatgattggaatgggttttgattataccgatatcatggaagccataaaagtagcgggtccatctattcccagcgccgtggaacacattctcaactctactgcccgcacccccaaattgcatgcacacaacgggaggaagaagaccgttctcagaaaacaaccttttcgctcgtgccgtcaagttcgacagtccaagatattcgaccatttccactccaatgatgccaaggaggaatcccctcaaatgggagttgatcccaatccaattgtgctttcagagccatttgaagctcaagatttggatattgcatatgattgggagcagagagttagccttctgatgcaaaagcattttggtttttcatccttgaagacttttcagaaggaagccctctctgcctggcttgctcataaagactgtcttgtcctcgctgcaacaggatctgggaagtctctgtgctttcagattcctgcattgttgtctggaaaagtggtggttgtgatttcgcccttgataagtctcatgcatgaccagtgtttaaagctaacaagacacggaatcagtgcttgctttcttgggtctgggcaacctgacgatactgttgagcagaaagcgatggggggcttgtatagtatagtgtatatttgcccggagactgtattaagattgattgaaccactgcagaagcttgcagaaagtcatggtattgctttattcgccattgatgaggtacactgtgtttctaaatggggtcatgattttcgtccagattacagacgactgtctgtgctgagggaaaatttcagtgctagcaagctaaaatccctgaaatttgatatacctctgatggccttgacagctacagctacaaaaagagttcgagaagacatcttaaaatcattacacatgtcaaaagaaacgaatgttgttcttacatcattttttcgatctaatttgcgtttcatggtaaagcatagtcgaacatcacaggcttcttatgcgaaagattttcatgaattgattcaagtatatggtagaaagcaaaatatgactggaaatgaaaagtatttcatctcagatgattcagatcatgtttctaatagctctgatgccagtagtatctctgatacagacagtgtttcacctgatgacaaccaagatgattatgcttataaagatattaatataatgcactcaggaaacacagacgattttttaacaggaagagaattgtctgttgatttcctggaaaatgatgttgatgcctttcagagtgtggataactcagatgttacctgtggtgaattttgtgtacaacctgctcacaaggaatgggaattatctgagacaattgatccaccaaagaaaccagaaggaagacttaaatttcttaaaaagcctttggaacaaggaccagcaatcatatatgtacccaccagaaaagaaacactgagaattgcaaagtatctatgcaagtttggtgtgaaagccgctgcttataatgcaggagttattgttgctacaatagcttttggaatgggtattgacaaatcaaatgtcagaagaatcattcactatggttggccacagagtttagaaacctactaccaagaagctggacgggctggtcgagatgggaaattagcagattgcattctgtatgcaaacctggcaaacaagccatcgcttttgcctagtcggaaaagtgaagatcagatgaaacaagcatatatcatgttgtctgattgtttcagatatggaatgaatacttcatgctgtcgagcaaagatactcgttgaatactttggagaggatttcagtcatcagaaatgtctcttaggtcttgctcgaattttggaggttaaaggatacatcggggaaggagatgacaagacccatgttcaggcaaaatacctggagccaacagaattgggattggaatttgtgaagtccatgagtgagcaagatttctatgtttaccctgaggcagatatgttgcttgcaaggaaaactaacaaaccattttcctcattctcggaatggggaaaaggttgggctgatcctgagatccggcgtgagcgcttagaaagaatgcgagtcaatagaaagccagggatgctgccaagtcccaagaagcaacgtaagagaaaagctagaaaaggttgggctggtttgaggacttctcgtggtagactggcagcaaaactctcaaaacacaagtga

SEQ ID NO: 88428 - DNA, 393 bp, Glycine max
  Peptide Sequence Number=SeqID_180113
atgcattttgcggagaaaggggaagggccagtggtgttgttcttgcatggcttccctgatctctggtactgctggcgcaaccagattctgaatctgagcgaactgggttaccatgcagtggcccccgatctccgaggctacggtgacacccaagtcctaggccacgatcatgataaagcgagcagatacacagttctagagctggtggagtcgaccaagtgccggttaagttcattacaggactatatcttcaacggtggtttcaagcaagatgtgccatctttggaggaagtgaaagtgcttcctggggttggacacttcagcatcgcagcagaggcagcagacagagtcaacactgaaatttataactttattcacaagttcccaaactga

SEQ ID NO: 88429 - DNA, 1056 bp, Glycine max
  Peptide Sequence Number=SeqID_180114
atgggcctcctcgatcacttgtgggatgacaccctcgccggtcctcgcccggagaacggcctcggcaagctccgaaagcaccactccttcgctttccgatctgcctccgccaagggcggttgttcgttgtgtgattttggtggatcagaatcagacagcggaagcgtgaaatcgtacggtgaggattcgcccaagaatgcggtgagagtgacgcgaagtataatgatcgtgaaaccacctggtaaccagagtcccagtggatccgctccggcttcccccgccggttctactcctccggtgtctccgttttcgggaggtcgttttcctcccttcaaatccgaaggtggtgctcccaaaaatggtcctaaagatttgactctttgccggatttttcgcaaaaagacttgctgcgatgtaacccatactcatcctgcacttctgtctgtaaggaagcttgcttctactggggaagctacccaagagtgcttacacttatgggaactgttggagtgttccatatgcgatccacgtgttggtactcagcctggaccccctcttatttgtgcatctttatgcgagagaatttatgaggcatgctcaaatgcttacttctctatggatgtgaaaacacaagtacatggatggctggctgctgaatgggtctccaatggtacagatctttgtcttgctgcaggttttcgagtgaaaccatccgatattgtagatattgcctcagaagaaacttcttgctatggcgataaagcaagtctaggttctgttgtcgattcatggaaggcttcacagtttgagttgaccgagaaaggtgagagcttgaggatgttggatgatttccagcaatgggcaagggaaatgccatttggtgaaagagtttcttgggctataggggggatggttctaacagcaggcttgatgtttataaggtcagaatgtagtcctttgtctttccaattattgagtagctgtgcatttttgtatgctcctatcaatgtcaggcaagtcaaaaagacaaaacatgttggaaatgtggattattag

SEQ ID NO: 88430 - DNA, 2862 bp, Glycine max
  Peptide Sequence Number=SeqID_180115
atgtcggagaatctcgacggttccgaaatctcgccgagtacttcctcccaaagtctcggcgagttaccggaaatcgccgcgataccattcggaatcgatctcgtgtcggcggccaggcgaaatatctggttcctgaggacagtggcagattctgtgtggcttcaccacacccccattatggtggaagccgtgagaaggtaccatgatttctggatgccgttgattgctgatctcacgctgccctactcttcccctcccacgattcttcctccccttgacatccactgggtttggttctgtcacactttaaaccccgtaagttacagggaatactgtgaaacgagattctcgaagctgattgggaaagcgggaatctttgatgaagagaacagagagtacgcgttgatgcggtgcagggagatttggagcagtagatacccgttggagtcgtttgagaacgaggcgagttcggattcgcaggatttggatactgtggttgttgttggggggtgtttgaaggagagtgtgtttaaggaagttgaaaagcagagggtgttgctgtgttccatgtttgtagagccgtacaggtccgaggtggtctacttgatagctgcgagacagcgatacaaggctttcttgtttatgctgctgaggttcgcgcgtgacttctcttcgcgtttggttcctacttcggacatcctcttaatgtggttgacccaccagagctacccaacagtgtattgtgaagatttgaaagcattagctatagaaggtgatctggagaaggtggcaactctgtctgaaaaggtgaaggaaaaggagtttgaagaaaccaagaagttgtgggatagggcgttcaatcaaccttatgagaaagctggtggagaggtgcctttgacgttggagggtgttatctcaatcaaatcccctgtctattgggaggattcgggcaccgatgcctgtgtgtttgtgaggcttaagcaaagaataacaacatcgcagaaggatgtaaaccgtgattttctacgtctccaaataattaggtgtcatagtgaactaaagttagataaagccttctccaatttcaccaatgattcgtggaaaaaagcttggcacttttactgtgagtttgggactaagggagttatgtttgactatcgtcgtcatggtggtaactgtctaagaggaagtagcctgctagatactgtgtcgttccgctggaatgatttattgagagcagattctttaactttggaaaaggaagttagtcaacaggttaatgttgttacgtcaataaccccaccagttcaagcaccatacttgttgaaatgtgtgcctgatcgagtcactgatgattctggggctatgatatctgatgtgattctgaagatgaatagttatcgtccacaagaaggccgatggttgtctcgcacagttcttgatcatgcagggagagtgtgttttgttattagaattagggtaggaggaggattttggagaagagggggtgaagctccttcagctgtaaaatgggaagataggattatagagatacgcgaaggatcttggtcttatgttgccggttacattggtagagcccctgaaaaggtggtggccactgcaacaccaaaggaacctactgaacaatgtaaagctgcatggtgcttttcaacaggagatgaactgacaatacaatgggactcatcacaatcagtgtcaggtctcacctttagcttgctaaatcaaacatctccagagtcatcggtactgctattgagagggaggcagatgcaatatcaagtaaagaaaacaaagtcaaagagaaaaggtgaagacatgaaaaccgagttagaggagaaagaggttgacgaagaggaagacgaggagagttttataacagtagtacgtttcacagaagataacccagatggaaaagcaactgctcttctaaattggaggctattggttgttgaagtattgccagaagaagatgcagtactgatgcttcttctttgcctttcaatactcaaaagcgtatcagaaatgaagaaacaagacgtgggagggttgttggtgaggagaagattaaaagaagcaaggcttggaagtagggattggggttctgtgatacttcatccatcttcatggtcctcgtccattgattcaacttatcttcaaccttggcattggaatgctggggttttgatgaaatctgatgcagtagatcagcttaaaaggtatccaacattaagtcaatcgccagtggaagctgtagttggaaaaggttttgttgcagtgaacataacatttcgcaacactgcggcgtccagcaagcatcaagcggtggctgtgagaaacggggcagacatgtccacgttctacagttgtagttttgaggtggatttcatatttggcaatgcagcggcagtactccaggattgtaacatgtatccaagacttcctatgcaaaaccaattcaatgcaatcacagcacaaggccgaaccgatccaaaccaaaacaccggcgtctccatacaaaactgttgcacaatagcagccagtgacttgggtgatgctactaacaattataatggtataaagacatatttgggtcggccttggaaggagtattcgaggactgtttacatgcaatctttcacggatggcctaattgatccaaagggtggagcgaatgagtttgctaactggggacctggttctaacactagcaatagggtaacatgggaagggtaccatctcattgatgaaaaggatgcagatgatttcacggtgcacaagtttattcaaggtgacaaatggctgccccagacaggagtgcctttcaaagctgggtttcagtga

SEQ ID NO: 88431 - DNA, 162 bp, Glycine max
  Peptide Sequence Number=SeqID_180116
atggagagatctcaaagctataaaggtcgtcctagagcaagtgatggaagatcgttggcgacgtcatctgagatgggtgttaaaaaagagaaaacattttgcaacttatttgagtgggttaatgttgtcgtgaatgtcgaaatagaagacaaccaatgttga

SEQ ID NO: 88432 - DNA, 2043 bp, Glycine max
  Peptide Sequence Number=SeqID_180117
atgtcgtatcgcccaagcgggaactccaggaccgaggtccgccgcaaccggtacaaggtggcggtggacgcggacgaaggtcggagacgacgagaggacacgatggtggagatccgcaagaaccgcagagaagagagtttgcagaagaagaggcgcgaaggattccaacctcagcagatacctgcgtccgttcactctagtttggtagagaagaagttggaacacctaccatctatggttactggtgtttggactgatgataataacctgcagctcgaggcgacgacgcagttccggaagctgctttcgattgaacgtagtccgccgattgaggaggttatacagactggtgtggtttctcgctttgttgagtttctcatgagggaagactttccacagttgcagtttgaggcagcctgggctttgacaaatatagcttctgggacgtctgaaaacaccaaggttgtcattgatcacggggctgtcccaattttcgtgaagctacttgcttctcctagtgatgatgtccgtgaacaggcagtgtgggcattaggcaatgtcgcgggggattcacctagatgtcgtgatcttgttctcagtcatggggctttgcttcctttgttggcacaattaaatgaacatgccaagctttctatgcttagaaatgctacctggacactttcaaacttctgcaggggcaagccacagcctccttttgatcagttgcaaagtatgcttttaggcactgaaactaatgtctatgttaggagaaataaggaagagaagggctgtgagggaggaagtagtgaaggggttaaacctgcacttcctgctcttgcccgtcttatccattcaaacgatgaagaagtattgactgatgcatgttgggcactgtcatatctttctgatggcacaaatgataaaattcaagctgtaattgaagctggtgtttgtccccgacttgttgagctgctgctgcacccatccccttcagtgctaattcctgctcttcgaactgttggaaatattgtcactggagatgatatgcagactcaggttatcatcaatcaccaggctcttccttgccttcttaatctgttgaccaataattataaaaaaagcatcaagaaggaagcttgttggaccatatccaatatcacagctggtaataagcagcagattcaggctgtgattgaggctaatctaattgctcctttggtcaatctgcttcaaaatgctgagtttgatatcaagaaagaagctgcttgggctatctcaaatgctacatccggtggttctcatgaacaaatcaagttcctagtaagccaagggtgtattaagcccttgtgtgatcttctcatctgtcctgatcctagaattgttacagtttgtctggaaggccttgaaaacatcttgaaggtgggagaagctgataaaaacataggaaatactggtgatgtgaatctatatgcccaaatgattgatgaagctgagggattggagaaaattgagaacctccagagtcatgacaacacagagatttacgaaaaggcggtcaagattcttgagacatactggttggaggaggaagatgagactatgcctccaggggatgcttctcagtcagggttcaactttggtagcagtgacgctcctgctgtgccgtccggagttttggttggtctatctgtgaagtcctcctttatgacacgacagcagttgggggacaagtcaacgtcttgtcattgtcctaatgtccttgggttgtacgaggtccagcaaaaaacatgctgcaattattgtgtagtctcaaaagatatatttattctcggggctattatccgttccatgctagttatatgcactcgcctgattttttctcacaaatccttgatttacgtttgcactgaccttatacctgatgttgctgggagggaaaacgcgagatggattccaactgttaaaatctcgttgatgatggctttaaccccatttttggtatggtggatagaaataataggatgtttgggagaggagaaataa

SEQ ID NO: 88433 - DNA, 2685 bp, Glycine max
  Peptide Sequence Number=SeqID_180118
atggagatccagaaaaaacgtttcaagggaagcttccttagcttctttgactggaatggcaaatcacaaaagaagctgctttgtgacaggcctaacttacctgatgtttcaaagcaagggaaggaaaacatggacagcatgccaaagtcacaggacaataggataaaaatggataacaatagagtaaatcctagcaataatgcaagttgtgatattgattgtgccatatcaattaatagtgatgaagggtgtggggctaaagtcccagggttagtagccagacttatgggtttggattcattgccagtttcaactgtctctgggctctcctcctcatccacttcattatatggctccaactctcttggatcttctcattctcctgacgatgatgttcttcactcaatggttgactgctgttgccctgtggatcccataaatatgcgacttaagccagagaaatcttcttgggctgccatgcaatcaagggctcagaaagtgggaaacccggccatgaagagatttcagactgaaatgttgcctccaaagtctgttaaacccattccagttactcacaacaaacttttgtctcctatcaagagccctggttatacgcaacctaagcatgcagctcatgtaatggaggcagctgccaaaataattgaggcaagttcccagccatgtaggaggaatagaatgtcttcatctggatcttcatctgttcccttaagaattcttgatctgaaagagaaattggaagctgcacaatatgaattcaaattcatggatacgcacactgctaaccctctgaatggcaaacctagtgagaggagaaacaatttatataaatcctcttcaagtttcaaaggttcaagggattcagtaaagaacagttcttgtcagttggcaagcaaaggaaaatctgcttcccttgcaatgccatctaaaaccaatgctcagagccgtgatgaattgactttgaatggtaataggagatatatgaggcagaacaaacagaatgatgtaaaatcaaaccagtttcccaggagccagaagaaacaaattgtagaccgggccagggtcatgcagcagagagcttgtacaggccagagtagcaatgtgcttgggaagaataaccaaaagcagaatagtgtaaccaacaaaggtggttcagcttcaaaagtggactccaataagccaacacaaacttggtcttcagaaagttctaccggcgccaagaagactacaaaaaaggttgttgtaaatgccaacattgagcccaaaaggtttggcacaaggatcactgataccataaaggagtttcctgtttccaaaaggaagggtattttccaaaagaaaaactatagtagtagcgatgttcacaatgaggcaagaggttctaatagtgcagctaatacttatgaaaacaagtccgtaaaatgcaatattacaactgatagaagtattgaccaggatgcatttagcatgaaagggagcaatggtgtgatttcatttacatttacatctcccttgagaagaaacatgcccgagttgcagtcctctactgagcaagtgatgggaacaaggaacgaaattgaggtcaattcttgtaatagtgataagctttatccccaaaagtcatcattttctcctcccaggttacatgtaatagatggtgatgctttaagtgttcttttggagaaaaagctgcaagaattgacatctagaattaacccacctcagtgctccctcacgacagaagggtcttctactggtttaagatctagtttggaagacaaatgtcaaagtgtgttaagcaccacagtaagggaacaagacagaatctttcgcaataaattggacagcatgcatgataattgttcttcaagtgatattatgatgcttagcatgaatcagcaactgcagacatcagaatcaatggaagagcctagctgtagcagcaacagtgaaagccaaaatggaagttacttacatagtgcatatggcagcacaatttattcttccatgcaagatgaggaggtatctaatttttctccaatgaatgaatctctgtcactcgaaaacaaggcagaatggtctgagcaaagctcttccatagtgatgggggataacatggccagtgagcagttaagtttaatgtcaaattcggccgaatatacaagatcagcaaggaacatggagcttgaatatgtaaaggatatattcagcaatgcagagttgatggcagaagaatttgtggtgggtgaaacagacaagatcataatggaaaatctctttgataagttggagaatgaaggccttggggcagaaaactatgaagagtactctaagattgagaggaagattatatttgacactgtgagcgagtgccttgaattaagatgtaaacaagtttttgttggaagctgcaaagcatggcctaaatgggtggcttcagttcagaggaagaagtgtttagcagaagagttttacaaggaaatgctgagctttagaaatatggaagatggggtagaggtggatgaacttgtcagcaaggacatgagcactggatggggtagatggcttgactttgacattgaagcctgtgaggagggttcagaacttgaatttgatattgtaacatgtttgattaacgaattggtttctgatttgttgtacgtttaa

SEQ ID NO: 88434 - DNA, 999 bp, Glycine max
  Peptide Sequence Number=SeqID_180119
atggcgaatcgcacggatccagcagctaagagcataaggggcacgaaccctcagaacctggtggagaagattctccgatcgaagatataccagaacacctactggaaggagcaatgtttcgggttaacggcggagacgttggtggacaaggccatggagctcgaccacctcggcggcacctacggcggaaaccgcaaacccacgccgttcatgtgcctcgtcatgaagatgctccagattcagcccgagaaagaaatcgtcattgagttcataaaaaacgaggattacaagtacgttaggattctcggtgctttttacttgcgtatcactggttctgacattgacgtctaccgctacctcgaacctttatacaatgactatcgcaaacttagacgaaagctcgctgatggacagtttacattgacgcacgtggatgaggttatagatgaacttctcacaaaggattattcttgtgatattgctctgccacgcgttaagaaaaggtggactcttgaatctttgggttcgttagaacctagaagaagtgcacttgaagaagattttgaggaggaagaagagaaagaggataatgagcagcctgttgatgagattgaagataaggcctatgagaaggaccattatcgtgggagaagccctactagggaaagagacagggatagaaggcacgatagtcatagacacagtgtaggagtgtatctggactgtttcccatttctcagtctctattatatccctttgtcagtacagtctactaagggttcctataatatttcacatccttcttcacaacttgtggttgtgaagaagacactaacaaggatggttctagcaagatcagtaagccatgcaaatactataacagttcaaaggcttgccacgttggttttgattgttgctatcagcatggtatgccagtctggaggatgtaaatcttacacgacgtttctgatggtggagaccaaagactataacccttag

SEQ ID NO: 88435 - DNA, 507 bp, Glycine max
  Peptide Sequence Number=SeqID_180120
atgactgctaaagatgcctatcaatattttgtactgaaggctcaaaacatagctcttacaaaaaattggagtccagtaaactggttgggccctggggtttgtccaaaggctgttgcaaaaggtttcaggtgtattttcagtaaccaaggtgtatggtatcttaactatctaaatgtaccttgggatgatgtctatactgctgagccgctagaaggaatacggaaagcttcggaacaaaaacttgtacttggaggagaagtctgtatgtggggtgagacagctgatacatcagatattcagcaaacaatatggcctcgagcggcggcagcagcagaacgcttgtggagtcagagagattctacttcaggaaatgctaacataattgcattgcggcgattgcattacttcagatgtctcttgaatagacgaggggttccagctgctcctgtcaataattttaatgcaagaactgctcctgttggtccaggctcatgctttgaacaataa

SEQ ID NO: 88436 - DNA, 984 bp, Glycine max
  Peptide Sequence Number=SeqID_180121
atggcgagtgaagctgagatcgaatacgaagaggcgagtgaagctgagatcaaatatgatgaggaatacgtttggaattctcgaggcttgaagctttttgcatgccgatggcttccagcgaatggaagtccaaaagcgttaatcttcctctgccatggctacgccatggaatgcagcatcaccatgaaaagcacagcaacaaggctcgcaaaagcgggttatgcagtgtatgggattgattacgaagggcatggaaaatcagaaggggttccaggccttgttatgaattttgattttgtaatcgacgattgctccgaacatttcaccacaatttgtgagaaagcagagaacaagaaaaagatgaggtacttgatgggggaatccatgggaggagctgtggctctacttttgcacaggaaaaagccacaatactgggatggggcaattttggttgcacccatgtgcaagatttcagaagaaatgagacccaacacagtggtggttagtgtattgagtgcactcagcaaagttgttccctcgtggagaatagttcccatcccagatatcattgatgtcgcctttaaagtgcctgaagtcagagaagagattagagccaaccaatattgctacaaaggaaaccctcgtttgagaacagcctacgaacttatgagggtcagtacagaaattgagcaaagtctgcatgaggtatcactaccttttctagttttacatggtgaggaagatcaagtgactgataaagcagttagcaaacaactatatgatgtggcggcaagctcagataagacactaaagttttatccaaagatgtggcacggtctattgtatggagagccaccagaaaatttgcagattgtattctcggatattattggttggatagagcagaaaactcaccatggaaattcaagattggagagagagctaaaagaagaacacgaacatttggtcaagtctgatctctag

SEQ ID NO: 88437 - DNA, 1044 bp, Glycine max
  Peptide Sequence Number=SeqID_180122
atggcggggatgcagaagctgccatacggcgacgttgattccagtttgagggccttggccggtcgcgccgagggtttcggccgcctcgccattggtggcctccacggtcctctctatttcgtcaccactctttcagatgatggccctgggtcccttcgcgaaggttgtcgtagaaaggaaccgttgtggattgtgtttgaggtttcgggtacgattcatctttcatcgtacctcagtgtgtcctcatataagacaatagatggccgagggcagagggtcaaattgactgggaagggtttgaggctcaaagaatgtgaacacataatcatatgcaaccttgagtttgagggtggcaggggtcatgatgtagacggcattcaaatcaaaccaaattctaggcatatatggattgatcgatgcacccttcgtgattacgatgatggcctcatagacattacaagacaaagcaccgatatcactgtatctaggtgttgctttgggcagcatgacaagaccatgctcattggagctgacccgactcacattggtgatagatgcatccgggtgaccattcaccattgtttctttgatggaacacggcaaagacagcctcgtgtgagatttggaaaagttcatctgtacaacaattacaccagaaactgggggatatatgctgtttgtgccagtgtggaatcccagatatactctcagtgtaatgtatatgaagcaggaactaagaaaaagacttttgaattttatactgagaaggcggtagataaagaggagcagaagtctggcttcataatatcagaaggagacatgtttctgaatggtgctgagccaagcttgcttacagaaaacagagaagagtccatgtttcatcctagcgaatattacccaacatggactatggaagcagctggacattctctcagagaggtcctcctgttatgtacaggactacaccttctggtttatgtgggaaccattgacattacatcaagcacatttaagattgaaggttcactttgtccgttattttaa

SEQ ID NO: 88438 - DNA, 750 bp, Glycine max
  Peptide Sequence Number=SeqID_180123
atgatctcaaactcggaccttgtagaacctgccacggcaaccgccaccgccgtcgcaacaaccgcctcttcttccaatgaagatcaggctgcaccgccagcggcaccaaacattgtgatgtccttaggatcacgattctctcttcagcgccgaaatggaaggttcagctatggatattccagtttcaagggtaaaaggtcatcaatggaggatttctttgagaccaaaatatcagaggctgatggtcagacagttgcattttttggtgtttttgatggtcatggaggttcccggactgcagaatatctgaaaagtaatctgtttaagaatttgagtagccaccctgactttatcaaagacacaaagactgctatagttgaagcatttaaacagacagatgttgattacctcaatgaggaaaaggggcatcaaagggatgctgggtccactgcatcaacagctgtgttgttgggggaccggattgttgttgcaaatgttggtgtgattccagagtggttgcatgtagagctggctcaggttgatgccatgtcagttatgtgtattgttcctttgtccattgatcacaaacctgatagatccaatgaacgtcaaaggattgaacaggctggtggattcataatttggaccggaacatggagagttggtggtgttcttgctgtttcccgtgcatttggaaacaaacttcttaagccctatgttgttgctgacccagaaattcaggttgcctaa

SEQ ID NO: 88439 - DNA, 4374 bp, Glycine max
  Peptide Sequence Number=SeqID_180124
atgcctgtttcaggacatgaagagaccggggtaaagtcctatgctgggaaatttagtggtttaattgcaggtgtgcctatcaagaaaaggaggtttcctacgattcagccttcttctgcacctgtgtctgaggaaccatattctctcactgaagaaaccgagttacaacgtaaagaaaattcaagcacttctcaaggaccaactttaccaaatgctgcaggtgcaccaatcaagaaaagaaagttcccatatcttcagccttctttggaagaggcttcacgttcagaagaaagtgatcccttgcgaaaggaacattcaagcacgtcaccgggttcaactctttctcccagttcttctggtttatctgatgctaatggaatccctgcgcttgaagataagaaagcaagtactgatgttaccaatgctaacatggttcaaagcaactcttgcttccttactcccaaacgtgagcaatcaaatgtcagaactcaatcatgtactttggacgtcatggatagcaaagagaagattctcagtcaaggtagcaataaaaaattggaatcccaaattatcaaagggaatcctgaactcttattggctgcaaaggaaggtcttgctcttagcattggagctgatgtaagcaaacaaaatgtccaagatatttgtaaacaagagactcctttagtttcaggaagtcctggtttatctttaagcttaaaggagcacgtcttaccagctgttgcaagtatggagaatgatgggaatcgtcaaaaaacagagaaagcagaatctgtctcgttggaattatctttaagcaaagaagactgtagtactcacagtttaaatactgatgctaaaactgatagtgacacaacttgtgttcaatctaacagggcaaactgggatctgaatactacaatggatgcatgggaagaatctgggactgaagctggcttggttaaaacaagtattgatgggctgaaaattactgatggttcacttgatgaaaagcagttagtgtgctctacagggatgacgctgccaacaagtgttgtgtctgtaaagccaatgtgtgaagagagtcataaagaagctttcacttttccatctggaccgtgtggacagcagtttaaatttctcgactcaagtattctatctcttacacctattcagaaatatactgaggaaccctcaagattatctgttaagctgaattctggtagtgctattcccaatgtgagcttgtcaagtttggcttcaactgtgggtgatgcaaatacttctagttttaggttggtaaaaccagaaccatttgatgagagctcaaaaaaggatttgaaggaagctaatgcctctcctgtgggttcattagatagtgttgctgttaaacaagaacttgttcagccttccactgccaactcttcaaagttgtcaaatgttagcaatttaatgaaagttgatgctgcctctgttaaactggaaccaaatcacgagggcagtcaggaaggatccaatgctgcattgagtaaaatggatcagttgaataaagatttgcgacaaggatcggataattcttctccttccttggcgatgccagttatgccagagacaacacaaatctctgccgaggcagattgtgctccagtgaaaccattgtatacaaaagagttatcaaccagtgaaaacatagtaagccagattgaaaattctagtcttacggatggagtcgatgttgagaaagtttgtcatggtgtttgtttaaatgccgagcaggttaccatagaaacagttgctatgcctatggttggtaatggttcaaagttgaatgatcctggtctgcaaactttttctgttagaactgaggaagaaaatgctgctgatcgtgatgcttgcagactgaaactcatgaatgagcctccacctgtcccacgaggcaatggtgaaggctgtgtaagtgatgaagaaaagataaccctatctactgatatgttagaggatgattcttacggttctgattgcgagtcagatgagaatcgtgctgtaactattggtgtggataccgaacggtatgttgaagatgatgattatgaagatggtgaggttcgagaaccactggatccttccacagcagaagacaccatatgtgaggtaagagaagtagagcatcctgactgtagtaattttgtaaataaacagatggaaaaaggaatggtgagtggcgattgtcccacttcatatcagttggtggaaaatgacaatattactgcaattcaaagtgaaataaataatgaagttgttgatatggacattgaaatgcatgagaggtctggtaaggtcattgataaaagtgtgtgtgtgcaagagtcattggatgatgagaagtctaacattgctgctcatggtgctaatgttttgcaaatgaaagcattagatcttttagatgggaaaaatgtctgtgaagctctggtggcagaatcaccttccaatcaagccactaatggaagccatggggttgatttccagtgtgctgatgaggttgtcaaaacagctgacatagttaaacaaactgacttagattttgaaactatggaagtgtctgcaaatgctgatgatgcagccaaagatgttaataatggtggtaatccagggagaattatagttctgtctcgagctactagttcttcatctcctggtaaaactaggcccatttcaggcaggtcactgtcgtctcgagctggaagagatgtattgtctgactcacttgatggggataaattacacagaggaagagatgaagttttcattgatggccctcacaaattttctagagaaagacatcaagatatctcccctagaaactctagatttaactttgtgcgaggtagaggaagacttaatagtcgattagactcagttcgtagtgaatgggaatctgaccgtgaattttctggtgagttttacaatggtccaagtcagtttcgtgggcccaggcctaagtatgcacctgcttttgccgataccgatatggagtacaataatgttgcacctgatgggtcatatgttggtaatggtcgattaggcagaaagccattgaatgatggttcttacattgcaccgaggaggcgttcaccaggaggaagagatggcatccaaattggtcatagaaatccaagaaacattagtccaaatagatgtattggagatggttcagacttggttggagtgaggcataatgataaatttatgagaggcttgcctgaggataatatggatgctatgttcacccggtcccaaacatttgagggaatggatggtcggtttacgagagggagtaggaatttttcttccatgcagagaaggggtcctcctcgaattcgttccaagtcacccatcagatctaggagtcgctcacccggtccatggtcatctccaagaagaaggtcgcctagaagaagatcccctgatggttttggtggacatccagaactatcccatagaagatcaccattttacagggttgacagaatgaggtcccctgatcgtcctgttttccctgcggagagagtggtgaggaggcatggctccccctcttttatgtcaagaccttctaatgatatgagggacattgattctgcaagggaccatggtcatccgaggtctggtcgaattttaatcagaaataggaggtttgatgtagtagatccacgggaccgtgcggaaaatgatgatgaatactttggggggcccatgcattctggtaggttacttgagcttagtggtgaaggaaatggtgaggataggagaaggtttggtgagagacgaggacctgtgcgttctttcaggcctccctataataacaatgttggtgagaattttcaccttaatgctgaagacggacctagacattatagattctgttcagatgattcagattttcatgaaagaggaggcaacaacataagggaaagggactttgacagaagaatcaagggccggccagctaatgtgccacctagaagaacaagaaatatggatgaacaagaagagaatttcaggcatggtggtggtggtggtggacagcctcctggggaatgttggaggattatggaattcatatttgcagctttagtttttaagcccattgaagtaatgattgtaaaagcatgcatcaagtgtggccaagattgtaggggaagatgtaattggggaatgaaggtcgctgaacgaatgatggagagtggtgatgtgcatgcgagggaaacaaatggcattttcgtttttaataatttaatggaacgaagttattggttctttggacttgccttttcctaccagcaacggattattcagtccgctaaaatgatatttacatag

SEQ ID NO: 88440 - DNA, 288 bp, Glycine max
  Peptide Sequence Number=SeqID_180125
atggaattgtacatgccaatcacgaaaaattgttctgaatcttcttctctgaataggtctgcaattccaagcaattaccacctttcatcaaacgacacaaacatcaacatattgtttctttccattgctagtggtatgtcccctaacgacccaccagtgttcttcttttacaactacggagaaactcgaatctatttgcatcccggaaagcctttcactaaactcgccaattttgatcgcaaagtcattctaatgtattgggatgtattgtgtgtggggatcctctag

SEQ ID NO: 88441 - DNA, 374 bp, Glycine max
  Peptide Sequence Number=SeqID_180126
atgctcaatttatcagcaggaaaaaagaagaagaaaagggaccaaaagatgaaattcttgatacgggtagggtttgggtttcaaggaaatgggtatggcgaaacgagaaacacgacttcagtgtttgaaaagaaagagaagttgaagagagagaaagtaagagaagcatggggaagagaggaactgactgagaagaaacgaggttgtagaatgggccaaagcaaatttcaaggtagtgcaaatactttgctcaatatgcaaaatggccgatatctggcgagaagcgccagagagtatctgtatgcaaacacaaccagaagaaagtacaaaccaaatctaccagagtctcaggttaacctctttacgggaaacac

SEQ ID NO: 88442 - DNA, 240 bp, Glycine max
  Peptide Sequence Number=SeqID_180127
atgaagtggtgttggggacgagctgggcatgttgggattgcagacttgcatggtacaaagggagacaaaggagtgagttgccatgaaatggctcaagtggggttacatgggtgttgggcaatgttgcaatccgggaactgtgtaatgccgaagcaagaactctctgcacaattacctttaactggggaagctttctggggatccatctttagtaaagaactgagaagcatttccttttga

SEQ ID NO: 88443 - DNA, 586 bp, Glycine max
  Peptide Sequence Number=SeqID_180128
atggaattgaaagcagaagcagaagggtgggttcagaaaacaatagagcaggatctaagcgtactgaaaacgcagagacagagacaggtcacaagggcgttgtgtttggtgaacaaagaatataagagagagaggttaaggggtgtttggagtttgaagagtgtattgagagttggagcggaaaatgggggtgaaaaagaaaacttgtttcaagtgttgaagtcgaagttgtcgtttttgggtgctgttattttcggtctgcctgatgttgctatggttaagccaacaattcttgttccggagctgttgctgcttgccggtccctttgttctctctctcacaccttgtgccgggggtatcgttggcgccgttacattggaggcggccgctgcagtctccgctggcgcaggaaaagacggtgccgaagtaggcgcagccgctgtaggcctagatgcgatcggaccagtgggcatccgggatggggatggattggtgggtgagggtgaggccgccggcggcgaggacgggatggccggcgttaggctagatggcgggccacacgatgtagttgcagttgttgacgagg

SEQ ID NO: 88444 - DNA, 1521 bp, Glycine max
  Peptide Sequence Number=SeqID_180129
atggtggattccccggtcctttccccctccccctccgtattgaggaaccggttactaacaagaactgactccatgcgcttcttttcttcgagaggagtcatgagttttgcttacggtttcacgttggcttctatcttgttcatgctcttcttcgttcttaatccttctagctaccaacaattatctccgaggctcagaaatgccttccaatcttcacgtggatctcatttctctaacgtctttgctcacattttccccaactctccttcctcttcccatgacagctttcatcatccaagttccaattcccgtgaagaattttccgatcataggctagggagtgcttcttctccttctcaaatttcgagaaaggaaggttctggactcataccaaaggattctcaaagtgaggaacatagaatacaggcaccacagcaagaaccttctctcactgcatggtcaccgtcaccaactgcttctccaaatgaacagcaagattggatggatatgtggaagaattgtgatatgtatgaaggttcatgggttagagatgattcatacccactttacaatgctggctcttgtccctatattgatgagcctttcaactgtttccgcaatggtaagcgtgaaaatatgtatgagaagtaccgctggcagcccaagaattgcaacgtgccaaggtttaaagctaatgaaatgttggagatgctaagagggaaacgtttagtttttgttggtgattccctcaataggaatatgtgggaatctctggtttgtgttcttagaaattcagtgaaagataagagcagattgtttgaagcctctggcagagaagaatttcgaactgaggtgtttcttgttcaagagtgggagattccagaccagaagggatcaacgaaagaaacacttcgtcttgatttgcttgagagatcttgtgataagtacaaagatgcagatgttcttatcttcaacacaggtcactggtggactcatgagaaaagaatagaagggaagggatattatcaagaaggagatcatatctatggacaaatgaatgttgaggaggcatttcataaagctttgttgacatgggcacagtggatagattccaatgttgatcctaagaaaactacagttttcttcaggggctattctccgtctcacttcaggggtggagaatggaattcaggtggtaagtgtgacaatgagacagaaccaatggaaagtgagtctgacctagaaactcctgaaatgatgatgactattgactctgtaattaagaaaatgaagactccagtcttctatttgaacatcacgaaaatgacttatttcaggcgtgatgctcacccttccttgttcagaaacgagaatatgacagaagagacaaaaagatatatgctctcacaccaggattgtagccattggtgtcttcctggtgttcctgatttgtggaatgaattagtgtatgctcaccttttatataacttgaatagaaacaagaacaaccccccaaaataa

SEQ ID NO: 88445 - DNA, 237 bp, Glycine max
  Peptide Sequence Number=SeqID_180130
atgactttcatggttctgtatgaaaaaggtccattgttcgatgcctacaatcctcatattcatgcagacccaaatgacttacaaaatcccatgtataatgtaaacattgagcaaatacttccagcaagaggtcaacaaggcttagaaatttggcctggcacccaggcacctagtgtgacaaagcaagctatcctcttgtggagcgcattctattctatgtcgcaacgcaagttataa

SEQ ID NO: 88446 - DNA, 120 bp, Glycine max
  Peptide Sequence Number=SeqID_180131
atggatttggatccgatgattgcccttactcttaggttctttgggatgcacttggatcatcagacgctgcctgttgcctgtcttaaggttgacaactatggaatggaagctacgaaatag

SEQ ID NO: 88447 - DNA, 1143 bp, Glycine max
  Peptide Sequence Number=SeqID_180132
atggctttgaagcttgtaaatctagggtttcactcatcgattccgtgttctccgaggcccttgaaagatcggttcgtgcttcggtcttctaaagtggagcaaatatcgtttacggaatctgagaactcactcatcgaagcccttcttggcatccaaggacgcggacgttcttcttctcgtcagcagctcaatgctgttgagcgtgctgttcaagtcctggagcggttagggggtgtacctgatccgacaaaatcaaacttgatcgagggtcgctggcagctaattttcaccacaagaccaggaactgcatcgcccattcagagaacctttgttggggttgacttttttagtgtatttcaagaggtttatcttcgaacaaatgatccacgcgtatgcaatattgtgtcattttctgatgctattggtgagctcaaagtggaggcagcagcatcaattgaagatggaaaaagaatcctttttaggtttgacagagctgccttttcttttaaatttcttccattcaaagttccgtatccagttccatttaggctgctgggagatgaagcaaagggttggttagacaccacatatttgtcgagttcaggaaaccttcgtatctcaagaggaaataagggaaccacatttgtgttacagaagcaaactgagcctaggcaaaggttattgacagctatttcctcggggaagggcattaaagaggcaatagatgaacttatttccttaaagcagaatactggtcaagaagatccagaactagaagagggtgagtggcagatgatgtggaattcacagactgtgacggatagttggatagagaatgctgtcaatgggctgatgggcaagcagattatcaggaagaatggaagaataaagtttctggttgatatcttgcttgggcttaagttctccatgagtggaaattttgtgaaggtgggtcttcggccttggacaaagatattaaagcccaagggcacgcatctgtcacctccagagagtacatgttctaaaaatgtgttaaggcttcaaggtaaaggaattttaagggaatctcaggaattgagattgagtagaagtaatatcagaacctgggagaatttctgcgggggcatcaatgggaatgtgtag

SEQ ID NO: 88448 - DNA, 618 bp, Glycine max
  Peptide Sequence Number=SeqID_180133
atggagaagcaaaggttacggtggtttgagggtgagaaggaaggggaaaagacaaaacccaagccatattcttttatgacgaacaggaagaaagtggcgaacgaggaggaagaccatacaatgatggaggggatgcatgtgagggactctgttggggagtatgcgcacatttttgaaaccctcattgcccaaaccaggggctttaccggaagagcaattgttggggtgcataacccaaaggagatattgcgagcagtggagatagcttgtgcaattgagtgggggagctcttggaagctcaattatggagtgggtcggaaaagagagcaaaagctggctaaaagagaagctggaaccatagatagaagtcaggacatagctcggttacaagagttctacaagagttatagagagaagcataatgtggataaattacgtgaggaagaaatgaagttacgggaatctggtgctttcagccgggatcttggcgagttggagcgcaagactgtgaagaggaaaagggtttttgctaccttaaaggttttgggaacagtacttgagcagctgagtgaagaaattcctgatgaggttgggttcttaccttctgggcactcttaa

SEQ ID NO: 88449 - DNA, 1932 bp, Glycine max
  Peptide Sequence Number=SeqID_180134
atgccagagcttcgtagaggagtgcgacgtgggcgtggccgtggccagaaagcatcggaaccggcaaggaaggagttgaaggctcgtgcggcgccgagagggagacctaggactagattggcggcgaaggaattggagcgccaggagccgttgatcccgataccgataccggaaccgttgatcccgataccggagccggcgaaagaagagaaaaagaaagttggtgtgggggtgaatatgggtgacgaaagcggtgggttgagtggtaataagcctgaggaggatgccaccactcctccttttcctgatagggttcaagtgggaggatcgcccatgtacaaggtagagagaaaattgggtaaaggtggatttggtcaggtttttgttggccgtcgggagcgtgcaacaggtgctggagctgtggaggtggctctgaaatttgaacataggaacagtaagggctgtaactatggccctccttacgagtggcaagttatggacatacttggtccaagtttgtgggatctctggaattcctcaagccaaatgatgtcttctgaaatggtctcatgtatagcggttgagtccttatcaatacttgaaaagatgcactcaaaaggttatgtgcatggagatgtaaaaccggaaaactttttacttggtcagccagctacagtgcaagagaagaaactgtttcttgttgaccttggattagcaacaaaatggagagacacctccagtggacagcatgttgactatgatcaacgccctgatatgtttagaggaactgttcgatatgctagtgttcatgctcatttggggagaactgctagtagaagagatgatcttgaatctcttgcatacacactagtattccttcataagggccgattaccatggcaaggttatcagggtgatagcaaatccttccttgtttgcaaaaagaagatgggaacatctcccgagacactgtgctgcttgtgccctcccccttttagacattttcttgagactgtagtgaatatgaaatttgatgaagaacctaattattccaagctaatatctttgtttgacggtgcgattggacccaatccagcattgcggccaattaatactgaaggtgcccaaaaggttgggcaaaagcggggtaggttgaatgttgaagatgatgattcacagccaagaaagaaggtccgtttagggattcctgctacacaatggatttcaatttacaatgcaagacttccaatgaaacaaaggtaccattacaatgtgtctgatgcaagattagaacagcatgtcgagagaggggttgcagatggccttcttattagttgtgtgtcttcttgttgcaatctttgggcccttattatggatgctggaactggttttacagctcaagtttacaagttgtcaacctttttcttgcacaaggaatggattatggagcagtgggataaaaacttttacatcacttctattgcagggagcaacaatggcagctctcttgtggtgatgtcaaaaggtacgcagtatactcaacaatcttacaaagtgagtgaatctttccccttcaaatggataaacaagaagtggagagaaggttttcatgtcacttcaatggctactgctggaagtcgctggggtgttgttatgtctcgaaatgctggattcagtaaacaggtggttgaacttgattttctctatccaagtgagggcatccataaacgttgggataaaggttataggattacagcaaccgcagctacattggatcaatctgctcttatattaagtattccgaggcgcaaactcagtgatgaaactcaggaaactctacgtacatcgcaatttcccggcacacatgttaaggaaaaatggtcaaaaaacctttaccttgcctgtttgtgctacggacgcacagtatgctga

SEQ ID NO: 88450 - DNA, 255 bp, Glycine max
  Peptide Sequence Number=SeqID_180135
atggcttgctggagtagccgggagaggtcccacaacctgtatccatctcatggattcccaccacaggccaattatccttttacagttgaaaaagagatgacccacctcctcctgctcttggccacagagaggacaaacagcctcctggatgatcaaacttcttcttatgaggttggccctagtggggagcctatctttaagaagcctccaagtgaagactgcagcccttggggggattttcagcttccaaattaa

SEQ ID NO: 88451 - DNA, 315 bp, Glycine max
  Peptide Sequence Number=SeqID_180136
atggatgaagatgatgataatgatgttggaaatgatttggcggaaaaaagggaaagaaagcaaccgacaagtgctggtattagtcctactgctgctgccgcccatacatctaaaaaacaggcaatggttgtgggatcttcatcaaggaagcaaaaagcggtccaagaaaatgatgaggatctagagtttgaggatattgaacttgaatctgaatctgaagaagaagaaatcatggaagctgcaaacaatgataatgggaaagcacctcattcctcgtggaggaattatgatgattttaatgagtatttctggtaa

SEQ ID NO: 88452 - DNA, 1392 bp, Glycine max
  Peptide Sequence Number=SeqID_180137
atggttaatttggtgggtggcactaacttggagaacctggaaaaaggattcgacaatccttttcatcaatggtcaagccatatcagagaaggggatattgctgttgagagtaaagatactcaagatgagctttgggataggatttcccgagatgattatatgatgtatgctgttcaggagtgttactatactattaaattcattttgacagagatattagatgatgtgggaaggaagtgggttgaaaggatatatgatgatattaatgctagtatcacaaagaggagtattgatggggacttcaaactaagtaaattggctgttgtgatatcaagagtaactgcattgatgggaatcctgaaagagactgaaacacctgaactggaaaggggtgcagttagggctgtgcaggatctgtatgacgttatgcgacatgatgtccttagcataaatctgagggagaattatgacacgtggagtttactgagcaaagctagggatgaagggcatttgtttgaaaagttaaaatggcccaagaatacagatttaaaaatgcaagtcaaaagattgtattcactgctgactatcaaagagtctgcctcaagcattcctaaaaaccttgaggccaggcgacggctgcagtttttcacaaattcactttttatgaagatgcctcgtgcaaagccagttcgggagatgttatcctttagtgttttcactccttattattctgagattgtgctatatagcatggctgaactcctaaagaaaaatgaagatggcatttcaattttgttctaccttcagaagatatatccagatgagtggaaaaactttcttgcccgaattggccgtgatgaaaacacacttgagagtgaactttatgataatcctggtgatattcttgaactgcgattttgggcttcatatcgggggcaaacattggctaggacaggaaagctcttatgcttcagacctatttggagaggacaactgctggaggctgcaataggttgtgatgaagtaactaatacgcatggctttgaattatcccctgaggcacgtgcccaggcagatcttaagttcacttatgttgtgacatgtcaaatttatggtaagcagaaagaagagcaaaagcctgaggctgctgatattgctttacttatgcaaagaaatgaagctcttcgggtcgctttcattgatgttgttgaaactttaaaagagggaaaagtgaacacagaatactactcaaagcttgtgaaagctgatatcaatgggaaagacaaggtgctattcttctacactttttgtatatacagaagcattttctactttttgtatgtatactttagttatgattcaggacatagggttcttcttaagtctggttga

SEQ ID NO: 88453 - DNA, 1200 bp, Glycine max
  Peptide Sequence Number=SeqID_180138
atgggggctgattttctggaggaaatacaagctattaatataaatctccagcaattggacaaatgggtatggacaaatgataccactggaaaatacacagttaaaagtgcataccaattactggacaagaactcaaaagatgataacacaaatggaatttttcatgccatatggaagctaaaaataccaaacaaggcagatatggtgggaatccttgtcttggatcaacatggtgggatctttttcgcaacacccaaggcagaatttcatgcagcactcattctgcaatgcacatcttggtatcaagtcacaaagatggttaatttggtgggtggcactaacttggagttggaggttgcgcttttgttgatagtatatcttgcttatggctataatgaaggtggtgcactctcatatattcttttgagtataagcagttggtttatggctctatcctggttgtttgctccatatttattcaacccatctggatttgagtggcaaaaggtggtggaagatttcagagattggacaaattggctactctaccgaggtggaattggtgttaagggagaagaaagctgggaagcttggtgggaagaagaactggctcatatcaggagcttgggttcaaggatagcagaaaccattctgagtcttagatttttcatctttcaatatggtatcgtgtacaagcttaatgtgaaaggaacaagtacttcactgacggtttatggtctctcatgggtagttctggctgtgcttataattcttttcaaggtattcacctttagccagaagatatcggtcaatttccagcttcttttgcgctttatacaaggaatctcccttttagttgcactggctggtttagttgtagcagttatattgactgaactgtctttaccggacatatttgcttctatgttggctttcattcctactggttggggaattctgtcaattgctgctgcctggaagccggtgatgaagaggtttggactatggaaatctgttagatcaattgctcggctctatgatgctggtatgggaatgctcatctttgtacccattgccttcttttcgtggttcccatttgtatcaacattccaaactcgcctaatgtttaaccaggcttttagccgagggttagaaatttctctaattctagctgggaacaatcacaatactgggatatag

SEQ ID NO: 88454 - DNA, 333 bp, Glycine max
  Peptide Sequence Number=SeqID_180139
atgacatcagaagagtacaagtatattggttcaaagtggggatgcaaagtgtacaaggggagacacttggtgtcgcgaagacagaaaaataaagacgtagacaagaggtgtcgaaccacattaaattcttgtgtttgttattatttttcctacggtataatctttgttgtattctcacgatcctttgtgggtgtgagtaattttatttgtgggagcgttgattacccaacaagaatgagattggttcttgctgcggtgttggtggaagcgcgtgggtcgagagataagtgcaattgtgggaataagaagaaggcgatccattgtagaggctag

SEQ ID NO: 88455 - DNA, 627 bp, Glycine max
  Peptide Sequence Number=SeqID_180140
atggagctagacacatccacatttggactttcgtgtacaacatcatccgcatattcatgccggatttttaatgtgaacaaagttgatgattccaaagtaggtccagtgtcagcaatagaaacagatcttgaaaaccattcagctgaaccagtggttactgcagaggatctttcacaggccaacgatcatgtaccaaaacaaaagcagattatgaaaccattgaaaccattagtacaaaagctcaatctaaaggttcttttagcaactgcaacaatcggatcgattcttggtctaataattggtgtagttcctccattccaaaagatgtttgttggagatgatgctcctttaggtgtgattgaagactctgcatccatgctgggggacgcatccattccggcaatcactttgttacttggagcaaatcttctgaatgggttaaaacggtcaggaatgaagctttcacttgttgtgaggatcattatagttagatacattgtcttaccaattttaggtgtggccattgtaaaaggtgcaattcattttggtattatccagcatgatccattataccagtttattttactccttcaatacgcccttccgcctgcaataagcataacttga

SEQ ID NO: 88456 - DNA, 1875 bp, Glycine max
  Peptide Sequence Number=SeqID_180141
atggaaaatacaggcctatggattcagaaagagggccatggaagaaaagattcattgcgtggcttattgaatgatagggaaatatcagaggaagaagactcttcaaaatcacagttaaagaagttgatcaaaagatcaaactctcatcgggcaatagttgtaaatgctatccaatcacaaatcagcaaagttttcttaaaggatttattcgttcaacgtgtccatggactagacaataggattccgaagcatgtggtgagtgtggacgagaaatacatccaccgctgccttgaattcatacataacactgcattaaaagcagctcaattcaacatacctgagagcttaagagccactaacatggagactttatcagaaagcttgaatacagctaaattttttggtggaaatgcatgtggttcgggacattttgtctttgaatgtcctgtggtcaccgagactgggagagtagttataagtgctaatgcaggggaccagtggactttaggtacaataatggggagcaagagtatgataaatatattgaatagtactcttcttcagcagtttggtgcttcacatagaactgacaatttgaataggatgaacttttctgatcctgaaggattggtatgctatgattttatggactctcctagtgatttatgtatctcttcttcatataaactagaaaaggaaaaacagttagtgcgaagtcataagtatggccccatttctgttcacaaaaggcttgtttcaacttctagcaccacctctacttgttctgattggttgtcttcaacatcttctaatctatctcagggaatgatccaatgtacatggaagcaagggattcctcattttgttttttccgcagatgatcagaaggaggtctatgtcacaaaattgaggaaggtagactcaacagataataaggctttggactatgtgtatgagtttcacttgaacaagggtggccaaaagggtcgtgaaattcctgatggtgatttgccatttgttgggaagatgcatgtatcaacgagtttcaccctttgcccgaacaattgtagaataagggagacggagtttacattattccataacattgaaatttctgacaaagaaatgtccgcatcagagcatgctcacaggaagagcaaggggctgtcgaagaaggtgtcaaaagtttttaaaactagcccatcatcaaaacgcagaacactctcaaagtttggtgggtcaagtgccatatcggagagttgtccgtgggagccatatgctctaggtgggaccaatttactagatactgatgttcctccaaatattgagatggctgccgttgttgtgaaaaaccatcttccttgtaaaaaaccagagaaagtaggagggtggggtttaaaatttctcaacaaatcaggtgaaaatcaagtcacattgccttctgaaagttgtaatcaaaataatgggaactgctcaactagcacgagcattctaattccggcaggtcttcacggtggcccaagaaccagaaatggtgggccatccagtctgatagatagatggagatctggtggtcattgtgattgtggtggttgggatgaggggtgccctctgacagtgcttgaaagaagatctaacaaagctgatgttatgtctaaaatagacacacaagatgagtgcaagtcagttgatttggttactcagggttcaagtgattacagccccaccttgaggatggtaaatgttcacgatggtctatattatattcattttcatccacctctgtctgcactacagtctttctccattgtggtggcaataattcatgcacaaagtcctacacttcagcccaatggtgcaaagaagctgtcataa

SEQ ID NO: 88457 - DNA, 1305 bp, Glycine max
  Peptide Sequence Number=SeqID_180142
atggagcgtttagagaacgtgatttcagacacaatcctctacgatccctccaacatagggttaggttccttggtggacactctcctctccgacttggaccaaaccatgtcgttaccctcacactaccatctctcatcagaccttcccgatttcgccaccaccgtggaagaacactccgggatacgactcattcacacgctgatgacgtgtgcggattccctgcaacgtggccacttctcattcgctgcctccctcatccagaacatgcaaggcttgttggcgcacgtcaacaccaactgcggcatcggaaaagtcgccgcctgcttcatcgacgccttgcgccgccgcatctccaacaagtttccagcatcatccgcttacgagaacgacgttctctaccacaactactacgaggcgtgtccttacttgaagttcgcgcacttcaccgcgaaccaggcgatcttggaggccttcaacggccacgattgcgtccacgtcatcgacttcaacctcatgcaggggctccagtggccagcgctgatacaggcgctggcgctccggcccggaggaccgccgctgctgaggctcaccggcatcgggcccccctcggcggaaaaccgcgacaacctccgcgaaatcgggctgagactcgccgagctggcgcgctccgtgaacgtgcggtttgcgttccgcggcgtggcggcgtggcggctggaggacgtgaagccgtggatgttacaggtgagtccgaacgaagcagtagcggtgaactcgatcatgcagctgcaccggctgacggcggtgaagtccgccgttgaagaggttctgggatggatccggattctgaaccctaaaatcgtgacggttgtggaacaagaagccaaccacaacggggaagggtttttggagcggttcacggaggctttgcattactattccagcgttttcgactcgctcgacgcgtgtccggtcgaaccggacaaggctgctttggcggagatgtatctgcagagggagatatgcaacgtggtgtgctgcgagggaccggcgcggctggagcgccacgagccgctcgctaagtggagggatcggctggggaaagccggcttcagagccttgcatttgggtttcaacgcctacaagcaagccagcatgttgctcactctcttctcagctgagggtttctgcgtccaagagaatcaaggctctttgactctgggttggcatagccgccccctaattgcagcttcggcttggcaagccgcgcctctgggagacgacgaaacgctgcgttttgagcattga

SEQ ID NO: 88458 - DNA, 519 bp, Glycine max
  Peptide Sequence Number=SeqID_180143
atggccacgcactttccatttcccctctccgctgctcaggttgggacttactttgtggggcagtactaccatgttcttgagaccaaccccgagttggtgtatcagttctattctgatgccagcacaatggtacgcatcgatggcaacgccagagacactgcaactgcaatgctgcaaatccatgcgcttgttatgtcactcagttttattggaattgaaatcaagacagcacaatctctggaatcttggagtggtggagttcttgtcatggtttctggttctgtgcaacttaagggctacaatgtgaggaggcaatttatgcagacgttcttccttgcaccccaagaaaagggcttcttcgtgctcaatgatgtttttcactttgtggaagaggagccagttcatcatcaccaacctgtatttttagctcaaagcaatcttgattcaaaattgaatgctcctagcacaattaacaaaccaggcaagttctatttccgcctccgggttcttgagttttga

SEQ ID NO: 88459 - DNA, 2373 bp, Glycine max
  Peptide Sequence Number=SeqID_180144
atgaagacaaatgatgacaagtctgaggcaaatgtggtccaaaactttgaagatgaagacttgtatttggcaactactaatgaggttgctaaatcaaaatggataatggattcccctgcttcgaagcacatttgtagagatcgagcgatgttcgatactttgaaaactaatggggagtttggtcatttcaacttaggaaatggtgagaaaatgaaggttgaagtcattgagactgtgagaatgaaactccacaacaacatcattcaaacttttcaaaatgtcagatttgtaccttctgctactactaatgtcatttcattgggagagatgacatcacctgggtataggtatgttggtttaaattggggatgcaaggatagtccatattctcaagaggataaacctttgtcttcatatttatcttacattatcccttcagtcagctttgatggatcgaagacaaacaagaatcaacatgaacttaaaccaattcaatcaacttctgctggatataattatgagaattttgagtatcaggatgttccatcggataattatgttgactgtactaacatggatttgttgaaagatgataatgataatattaatgaagatcctatctctagaaggaccagtagcagtagcagttctgaggtttttgaagaagcaaatgaacagcaaactccaaatacttcaaagaagtctcgactcaatcttactgatgactctacgtttatatctcctgaattgtatgaatttttggaaatatgcctccctaatatagtgaaaggacgccaatgggtcttactttatagtacgttaaaacatggagtatcacttcgtacacttattcgcaagagtgctgagctttcttgtcctggtgtcaaccgatactactacatgtgtttgaatggcctacttgcacttggtggtgggggtaattatgctttatgcttagaagaagatttgttaactggaactagtggaccttctgacacatttggaaacaaatgtctagctcacagtccagagtttgagttgaagaatgttgaggatgtttttgatcagccactgccaccaaaggccgaaccacaacagcaacttccccttgatgaaatttcaagccctcttagtgctcgaatcttcgaactttgtaacactgatttttttccagaggctttgcagaattctgaggttacttccagctcaaactgttgttacgaggagaactcctcatatgccacaacaaatatatctgtaactgtagatgtagacaataagttgaatagcaatagcaacacagtcaccaccccaactagcactaccaccaccaacaccaacaacaacacaaccaacagtagtaacctgtctattttctttgactcccaagaagagattgacaatgacatttctgcctccatagacttctcactctctccatctttcaatgttcccccatttctcccagtctcatcccagcaagaacagtttgatttctcttctgtgcagcatcaggtccaactagcagcatgttcggttgtggagggcttcactcagtatcccactgacgctgttgcacctccttttatgggggctccattaccttctgtttttgaagaggactgcatatcttcagtcccttcttatatgcctcttaacccctcatctccttgcacttatctcagtcctggcatgccaccatacatgcctcatggcccccttactactgccttatcaactgatagttctggaatatttggtgggaacattcttcttggttctgaacttcagacacaagaattggaataccaaggagaaaatggaagaatgtattgtacagattcaattcagcgggtgtttaaccctccagaccttcaggcacttggtactgagagccagcaactagtacccggggctggtggttctggcactctaacaccagaaatctcaaacttagaggactcctccttcaaggttggaaaactttctgttgagcaaaggaaagaaaagatcaatagatacatgaagaaaagaaatgaaagaaacttcagcaagaaaattaaggtattccttgcttataaacaaccacttgttattgcatactttcaagttcaactaatgatgcaaccaaatatgcagtatgcctgccgcaaaactctggcagatagccgacctcgagttagaggaaggtttgcaaagaatgatgactttggagaaaccaatagaactactagtagcaatcatgaagaagatgatgaagaagaagtagttatgaaagatgaagatgatatggttgattcctcagatatctttgctcatatcagtgggctgaactccttcaaatgcaactattccatccagtcctggatttga

SEQ ID NO: 88460 - DNA, 969 bp, Glycine max
  Peptide Sequence Number=SeqID_180145
atggggtttcccagaaaatcactattccttcttctgttcctgattctcttcacaaaccttgctgaatctgcttctgactacaccaccttggtctacaagggttgctccaaggaaacattcacagatccaaatggggtatactcacaagccctttcatcactctttggctcattggtctcacaatccaccaaagccaagttctttaaggccactgcagggagtggccaatcctccatgactgggctcttccaatgcagagatgacctctccaactccgactgctacaactgcgtgagcaggctcccggtcctgtccgacaagctctgcggcaagaccaccgccgccagaatccagctcctgggttgctacatgctgtacgaggttgtagggttcacgcaaatctcggggatgcagattttgtacaagacctgtgggggaaccaacgctgctgggagagggtttgaggagaggagggacactgctttctctgtgatggagaatggggtggtcactggccatggcttctatgccaccagctaccagtctttgtatgtgatggggcaatgtgagggagatgttggtgattctgattgtggggagtgtgtcaaaagtgctgtccagagggctcaggttgaatgtggaagctccatttcaggccaggtctatttgcacaagtgtttcattagttatagttattaccctaatggggttccaggaagacactcttcttcagcttcatcatcttccaattcctattcttcttcttcttcttcttctgggcaaaatacagggaagacagtggctataatagtaggaggggcagctggagtggcgtttttggtcatatgcttgatgtttgctaggagtttgaagaagaaacgtgatggtaggtgttatgttatacatggctatatggaatggatggctcatattattgacagtggaagatggttgattgaggaggcataa

SEQ ID NO: 88461 - DNA, 1674 bp, Glycine max
  Peptide Sequence Number=SeqID_180146
atgaaaagccttggttttgtccccgacccatttaccttctcgagcgttcttggtgccctgtcgttgatagctgatgaagagaggcattgtcagcaattgcactgtgaggttctcaagtggggtgcactctctgtgccttctgttttgaatgctttgatgagttgttatgtttgttgtgcctcttcgtggttggtggactcttgtgtgttgatggctgctgctaggaagctatttgatgaggtgcctcctggtcggagggatgaacctgcttggactaccatcattgctggctatgtcaggaatgatgaccttgttgcagcgcgtgagcttcttgaaggaatgactgatcacattgctgttgcatggaatgccatgatttctggctatgtgcaccgtggtttttatgaggaggcgtttgacttgttgaggagaatgcattcattgggaattcagctggatgagtacacaccagtcattttgttttatgtgaataatgttttgattactctctacaccagatgtggtaaattagttgaggcgagggagatgccggagaggagcctgttaacgtggactgtgatgatatcaggcttagcgcaaaatggctttggagaagaaggtttgaagttattcaaccagatgaagttagagggactagaaccgtgtgattatgcatatgctggagcaattgcctcttgttctgttcttggatcattagacaatggacaacaactacactctcagataatccgattaggtcatgattcaagcctctcagttggcaatgcactgattacaatgtattcaaggtgtgggcctgttgaaggtgctgatacagtgtttctcacaatgccgtatgtggattcagtatcctggaatgccatgattgcagctcttgcacagcatggacatggtgtccaagcgattcaactttatgaaaagattgcaccaatttgggaggctcttcttgctggttgttggatccatgggaacatggaattaggtattcaagctactgaacgactcttagagcttatgccacagcaagatggaacctacataagcctttccaatatgtatgccgctttaggtcagtgggatgaagttgccagggtgagaaaattaatgagggagcgagtggttaagaaggaacctggttgtagttggattcagatatctggagcaatggtacatgaaatgaggaaattgggttatgttcctgatccaaagtttgtattacatgatatggaatctgaacaaaaggaatatgctttgtctactcatagcgaaaaacttgctgttgtttatggaattatgaaactgtctttaggagctacaatttgggttttaaaaaatttgaggatatgcagggactgccataatgcattcaagtatatttctaaattagtggaccaagagataattgtcagagataggaagaggtttcaccattttagaaatggtgaatgttcttgtagcaactactgcctaaaggatggaaatttgccttctgctaatccactactcttgcacatggacgatagagttgattattgctatatcaagtcattaaccatttacaacttttgcttcaagcgtttgttagctttaacaattgcgtcaagcactgcaattcaactcagtggtgctcagtttaaatgcccaggcagatga

SEQ ID NO: 88462 - DNA, 321 bp, Glycine max
  Peptide Sequence Number=SeqID_180147
atgtcgccgaaaactccaccatcaccgccatcgacagctgcaactcctcaatttcggacagcggcaaccaccattgtccctcttataaacgctaatttgaagaagaaaaagcaaatagatagaggctatggaaacctaagaaattgtacgaatcactcttcgaccaactcaactccaccttcggctgtggccaattgttcaagacctttctctctcttgatgtcgcccaacgtggcggtttgcgcttccgcaactttctctccgacgttgacttggagcttccttcttgcccttcgtatctatgcgcgctgcttgaggtag

SEQ ID NO: 88463 - DNA, 1236 bp, Glycine max
  Peptide Sequence Number=SeqID_180148
atggcaccaccatcctctcctccgctcgtcgacaattccgatgccgagcgccgccttcgcgaagcggaggagcgcctccgcgacgccatcgaggagctccagcgccggcagcgccgcgccgccgctcacgcccagcagcaccgccacgtggactcgctgccttgcgatcacggccccgacgagtcctgcgtggctcacgccattggcaacctctgccagaccttcctcctctcctacggcgtcagagtcggcattggcatactcctccgcgccttcaagcttgttcgaggccaatcctactcctctctcctcgatctcaagcaacttgtttcagaaaaagatctgatagtaagggaagaagcatgccgcattggtcttctttttggtggtttcactggatcttatcatgctcttagatgcttgttgcggaaattgagaaagaaagagacaccggctaatgcagttttagcaggttctatagctggtttctcgattatggcattgaatgattcaaataggagacgtacactggctttatacctgttggctaggctagcccaggttatgtatgcctttgtaatgcgtcctgagagcttgccaaaatcctatcaagacttcattcaaaagaccgggccagttgcagagcctgtatacaaggctgtaagggatagctgtagaggtcatccagttgatgttgcgtcactgcatgcttatttatctcgtgtaggaagatctgactatgtaaagttggaagaatttccctccattattccatgttccattattcatccagcaacaaattcatgcttagctcatcaaggaaatgcaacatcattaacgtttaagaaaacatttccgctttacttctctttgacctttgtgccttttgttgttctgcacctacagaagttcactgatgctcctttccgcactttctggcttgccattaaaggtgctgttcgctcgacaacctttttatccgcttttgttggaatctttcagggagtcatatgttcacatagaaaagttttttcaagagatcacaagcttgtatattggatagcaggtggaatagctgccctatctgtgctattggagaaaaaagctaggcgtggtgagctagctttatatgttcttcccagagcagtagattcattgtggtatatcttggtgaacaggcaccttcttccaaatatcaggaatgctgaggtatgccctctagttactttgcactga

SEQ ID NO: 88464 - DNA, 2352 bp, Glycine max
  Peptide Sequence Number=SeqID_180149
atgatcttccctacgaatttgaggtttgcttcgtctccatcttcgcaacattgtgctggtgaggttgattgttatggtgaggaaattgattggaaggaggagggttgggtgatggagaggggaaagttaaagaggcaattgaatggatggacaaaggggtcaaagctggtgctagttgcttttaggagtggtctcacgttgaacagcaaggtgattgaaatgtatgggaattgtaaaaacacgattgatgcacgtatggtgttcaatcatatgcccaacaagaatatggactcttggcacttgatgatgcgcggctatgcaaataacacctatggagatgaggccttgcagttgtttgagcacatgaatgagctcggttcttatcaattggtatcagagccttccaccatgtctctcagctacaaacgagcaacatgggtggtgatgttggcattgcagtgttcactcgggaatagtcaaagggccagtgcacatccatcccgtgtgggcgctggggctgcaaatcgtggtggggtgttaggatccaattgccaggccaaagcttcgggaagaacttctgcagaatatcgcaaaatgggcaacgaaattggagccgcaattcttaagaattacaacaacatattaaaatcttgtaatgctctggattatcatgacttgatcagctgttctgtgaagctacttagtgattttcctgaagaatgtcaggattcatggaaagctattgttatagatgagttccaagatactagtgccatgcaatacaagtttctaaagatgcttgcatctcatcataaaataacaattgttggtgatgatgatcagtctatttacagtttcaatggagctgacatttctggatttatttcctttcgcaatgattttccaaactacaaagagattaggcttaacaaaaactaccgatccacacgttgcattgttgaggccgcatcttctcttattcaaaataattccaagcgatgtcagttgaagaatgttcttactgataactcttctggatccaagatagttatgaaggagtgtcacaatgaggatgcacaatgcgcatttgttgttgacaaaatcatagaaatttcatcaaattattctgcagctaactgttgttatggcaacattgcaattctctaccgtaggcagatatcaggtaaagccttccaaatggctttccgtgataggaaaataccatttaacattcatggtgtggctttttacagaaaaaagttcactttgaatgagaccttgttcatccatggcttgaattgcacctttcttcaggttcttcaatacctgttagatgacgtctctgagtttctatccactaaattagttgaagtaaaagaggaaagggaaatatctgaagataagggctgcatttttgttctaaaagcattcattgattatttacttgagcgtgagaaagaaaattttggtgctcggaggaaggacaatgaaaactctgtgacgttgactaccattcatcaggcaaaaggtttagagtgggatgttgtcttcatagttaaggcaaatgactctgagatccctctattacatgatttcaagggcaccgtaaaggacactgcagccttacttgaggaagaaagacgattattatatgttgcaatgactcgtgctcgggagaagctttttattcttcatgttatgatggactcaaactggcagatgcttcaaccttcaagatttttgaaagaaatccctcgtcatcttacagaagttcagggtgaaataagttttcaagaactactgataaagcaagaagctcttcaaaaggaaactgcccattgtaccactgacttgttgataaaagagaaacaatctgaagcagatgtgatccctatgcctcatgaaatacttgataatcattctagtgagacttccaatgagcttgcacaatttgcagaggcaaacaatagaaatgatttcttaagaagatttagtgttgagaacaggtctattgtttcccatttattccatcagtgggccaaaaagaaagcatttcaagatccaaagagattgcttgacaaggttttgagatgggagcagattcctgctgataaacgtgctcatcttatgagagaaaaacaggaacatttcctgaaattaaagattgagaatgcaatgggttcggcaacaccaactgacaagcaggtatgtgtaggaagcagtccgattaggtgggcttggattgctgattctgctggcaaggaagcgacggatcaagcctcgaagaaatggggccatggtttctggttcgtgttccaggctatgcctactactcaatctcctccatcataa

SEQ ID NO: 88465 - DNA, 1908 bp, Glycine max
  Peptide Sequence Number=SeqID_180150
atgggagagggttcacgttttgggggtgatgttgctattcaattgatagggactcacaagcttggtgagtttgcgggtcttgcacgaggtgtggttgttggtattgctgtaggaaaatcattggtaatggtgactcagctggtgaaagagggatcgacagtggctatagattttttattgggaatggtggagagagaagggagggagaaaatcaggaaaggggctgaaaaaatttttgaagcttataaatgggtccaagatcatcggcatgaattcaataaggaggtttacggcccagttttattagaggtgaatgtctcaaataaggatcatgctgcatatctagagggtcaagtggctcattacacttggaagtccttcataacacaagattctggtgatcgagatcttttggcgaaacacctacggttctttgatgtaaatgttctaaattatactggcggtgatggtccccaaagagagccttttgaaatttctgaagataagcgtgctcttggcatctactcccggctggatcaaatttttgatgctcctattgctgtgaaggagtatattggatccgaaaaatctgatcagaatgctggtgaggtccggaaattgggaatcctagatttttggacacctgagaatcactaccattggtccaagtctagatatgcaaattatgaatctgcagtcgttaatcaagtgcaacgcccacaacttttattgaataatttgaatgttggtgaaattgagaagctgagttccgagcaaagggagcttgaagaaattgttgctaatttggaggaaagtgttaaaaggtttcacgacgaagaaagaagcttactgaatcaatctgctaatcttcgtaaacagtgggaggacattagtattacagtacagaatgagcaaaagaaacgtcaagcaatcattagccgtattgatcaaaagaaaaagttcttgaaactgatggaggaacgggatgatctagatactgagatagcaaagcttgttgatcaggctacaaaatataacattcggcgtttccataatgcaatggaaattaaggatcttcttgttgaagctgtgagttacagacggatttttattgaacaacgtatggctttcattgaatttgatgcaaaggagatgatgaagtcaggaactgcaaaaatggaggccaatctgaagcagcatgagaaatttgccctgcaagcatcattgcactttgataactgtaagaaagaatctgagaattgtagacaggatcttacagattccttgaagtatgctaaatcaattgctcggcttacacctgagctaaagaaggaatttcttgagatgcctactacaattgaggacctggaagcagctatccaagataccacttctgaagccaattcaatcctttttgtcaatcataacatattggaacaatatgaagatcgccaacaacagatagaagatcttgcagcgaaactggaagcagacaaaaaggaatctacacggtgtttggctgaattaaataacattaagggaaaatggcttccaacattgagaaaccttgtggcaaagataaatgaaacattcagttttaatttccaagagatggctgttgctggagaagtttcactagatgaacgtgatatggactttgatcaatttggaatacttataaaagttaaattcagagaaaatggacagcttcaaaatctcagtgctcaccatcaatctggcggggaacgctcagtttcaactattgtttatcttgtttcccttcaagatcttacaaactgcccatttagagtcgttgatgagatcaaccaagggatggacccaataaatgaaaggaagatgttccagcaattagtgagagcagcaagcaagccaaatacaccccagtga

SEQ ID NO: 88466 - DNA, 207 bp, Glycine max
  Peptide Sequence Number=SeqID_180151
atgtccacaaatttagatgctccaaatgaagacgtcttaattgaagcaagagaagattctactgcagtgccacacttgtcaggctttctgtttgcatcccctgttgcatccactggaatagaattgtcagccaccgcaaacgatgaaaacaacgatggagggggtggaggaggattagaagatgcggaaaccattgttaatcactaa

SEQ ID NO: 88467 - DNA, 360 bp, Glycine max
  Peptide Sequence Number=SeqID_180152
atgtcgtcgcggcaagtggtgaagcgtgccaaatacaaaaccactgtcaaagaccctggcacccccggcgtcctcaaattgactcaagataagttcgttttcaagccgaatgatcctacctcgaaaaccaagctcgatgtggagttcagatttattcagggtgttgcccttaacaagcaagtgcctggagaagctacaaaagttatttctgaggaacagctgagccctgctgaaatggcactgaagataaagctattgcaggaagatagcaagttgcagaggcttcataaggaacttgtggctagtggtaagcttacagaatcagaattttgggctacaaagaaggtgaagatattctga

SEQ ID NO: 88468 - DNA, 3003 bp, Glycine max
  Peptide Sequence Number=SeqID_180153
atggcggaaggtagctccagcgccgatatccagagaatactcgcagccattaaatcctctgaggcaagctttttcctcttcttattatcactgtttctatttttaaactacattttgtcactgtggtctcagattttaggcttgactttttgggagaacttcacatgtttggatgtgacccagtgcatgctcaatagaagcattatacacgtagctttgagctatatggattttaacccatccagttgcttaccacaatttctcactcttggagttaaggccagtgtctggtgtggcaagcatttaaagatgagtcttttgtcgactgaagactctgaggaagatgaacatagctctgtattttaccagcttcttatggagatcctaaggttttctgcatcaactttttcaactttgttgaaattcactgattttggtgacaaggaattgatggacactgttgaaatctttattttagaagcattaaatctgaccaaagattctatatcagatgctaagaaaattcaatcatttgggtcagaaatattgaaggttgcacacatggtcattgatgctgtggtaaaattatgcaagacgcgttctgaattaataaaccaggagggaggtgatgaaaaatggttgaggcttgacaagcctgctacttttgaccatgttatccacataacgaaatgtgcaatagaaaagctgtctcagattggtgtccttgctgcaaatgatggtggcaactctgtcaatattcttaatgtctcctggaaaggtgttgtttctttgcttcaaggtggtggtggacattttacagaagttaacatagcaaatatagtgttaactttgcttgcattgataacggagcctctgaaatgtgctgcccaggcttggtcttcctcactgaatgaagccatttctgtgactgaagctaaaaggatctttgtgccagtgaaattttacctaattaatgctgtaaaaatatgctcactgtatcctcatcaggcctatacagtgtacaaggaaattacgctgtgtgttctcaagatcaaatgtttttggatttttgtaagtaacgaaaaccttctgaaatgtgcatctgtgataattactgaattactggaggaaacaacattgaatttgctattgtctttgctaaattctcataaactgaaactggaacagaggcttcaggtgctagaatggttgttcattaataaaggggattgtcattctggccttgattgtccaaccttaagtgattgtaaccttgcatgggttaatgaaatcttttgcaatagttatgaaagtatgagcagatcaaaaatactaatacttggtcgagttgtattgtttattaacttcctcagacattcgcttgagcttgatggagatgtgagaatagcaataactcagaagctttattggtttttggatgttttagttgaggaagatgtctattctcatatacttgttttgcaatttcctttattgtatggctctggaaaaacagtggaactcttgtggcagcctatgtttactttcctcttgcaagcattcaaaaccttcatgatcgtgatctcttcaagtacagcttgggaggagttggagtctttcttattagagaatttctttcatcctcactttttatgctgggagattgtgatggaatgctggtgctttatgctgcgatatgctgaaacacaaatggcaaacagcattcttggaaaactatgttcattacttaagctgtcggcatcctcatactcagttttcctgccttattcttccttcagaaagttggcaagatcaatatgcatgcttttaaccgatggtgcacaatcaatggttaacgtggtgtacatgtctcttgttggtgatgggaaatcccatttgtcatcagttttttgtttggctttgttcatggaaggttttccttttgatttactgacagatgaattgagaaagacttctattcaaagaattatatctgactattttgacttcatagacaactttgatgaagcaccattgatggcatgctcctctggtttgtttggtgttccagtttttattctttctgtttctttgcaatcactccaggatggactatctgatattgatgaaagggccttgaagtttttggttgcaatttcttctaattacaaaagtactgtagacaaagtaatcaaggaccgttttcttcagcttttcagtgaaactctagggatcatctcctatttgaaaaaactgtatacctcaaatgctattgaacaagtcatcatggagattcaaaatatctttttgtctgagcctccagcccttttggacaaatgcaaaccacatttggcccaattccttgcaggacttgttcacatggaaatttccgaaagtgatgatgatgctaagagctgtgctgtgtgggaattatatcacttgctcttgaaagagcggcactgggcactcagtcacttggcaataactgcatttggatattttgcttctcatactaggtgcaataagctatggagatttgttccagaagatgcagcactttcatatgatacagtttcaggagtggagtcagatcagcaaagatttatggttgagtttggaaaatttcttaaaaaggaaatagctcttcttacacttgaaccaagccctgaacagcttgatcttctagggagagaaggttttgtgttgaaacagatggtccaaaagatttcagccactgctgaagagagagagaaatgtgagatcatggatgttgatcacaagaaccaatcaaataaaaagaggaaacttcctgatggaattagcagaggattttctcaacttgaagacgtaattactaactttgaggaattgaccggcagcggtgagcattcgagtacgaaatctgtctacgtcaagacaaagttgcttatgtaccgcagcaatgtcttcactttaaatgaggaggtgagaagtgagataagaagaaaggaagatagaaagtga

SEQ ID NO: 88469 - DNA, 819 bp, Glycine max
  Peptide Sequence Number=SeqID_180154
atggagatggaacacccaagaacagtagcagaaattcttgctcggagaaaacaggatgaggagagacaaaacagaatttctaagatgaccctgattgatgatcttcaggcacaagataatcatccgtatgcaccactctgtatcaaggatcctcgtgactattttgatttccaacaagctaatgctgtaaaaactttggatgattctcaaactggaatggagcaaatgaaatgcagtttgggttctgaggaagcctatggctctttgagggcatcaatatctaaaataaaaactacaggattaagggatcctctctttagtcctgatgttgctcttaaggtccttaacggattgactaaaaatatctcaagtcccaaatatcatcttgggagaagttctcaaggtagtgtccttgatatattgcccaatacaactaaggagacactactagatcattgggtgtgcagtcaggaattgctgaggcacttttggtcttcatatccaattacaacacagaaccttgttaataagatgttgggaagtcccacatcgctgtctcatatatctgttggacaacttcacttagtgccaattggttttaaaatgaaatctaatatgacacgaagactgaaagaatccatatcacaaatatattctaaacttgaggacataaaggtatctgctgagtcagacctgcgacaccatgtttcccttgttgtccatcctatgcagcaggctctgaatgctgccttgttacactatgaggctgacattaggaaaagaaatgcaagaggacagaagcctaacggttatgtttag

SEQ ID NO: 88470 - DNA, 1500 bp, Glycine max
  Peptide Sequence Number=SeqID_180155
atgtaccgctttgcaacctccctcgcctccaaagctagaattgccaggagcagcactcaacagattggaagtagggtcacttggaacaggaattatgcggccaaagacattaagtttggtgtggaggctcgggctctgatgcttaagggtgtcgaagagctcgctgatgccgttaaagtaacaatgggccctaaggggcgtaatgtggttattgagcaaagttttggagcacctaaagtgacgaaagatggagtaaccgttgctaagagcattgaattcaaggacaaagtcaagaatatcggtgccagtcttgtaaagcaggttgctaatgctactaatgacgtggctggtgatggaaccacttgtgctacaattcttactaaagcaatatttacggaaggatgtaaatcagttgcagctggaatgaatgcgatggacctgagacgaggtataaatatggctgttgatgctgtggtgacaaatctgaaaagcagagcacgtatgattagcacttctgaagaaattgcccaggttggaacaatatctgccaatggggagagggaaattggtgagttaattgcaaaagctatggagaaagttggcaaagagggtgtcatcacaatctcagatggcaagacattgtacaatgagttggaagtcgttgaaggaatgaagctcgacaggggatacatttctccatatttcataacaaaccagaagaaccagaaatgtgaacttgaggatcctctcattataatccatgaaaagaaaatctcaagcataaatgctatcgttaaagtattagagttagctttgaagagacaaagatctttattgattgtcgccgaggatgtggaaagtgatgcccttgcaactcttattctaaataaacttcgtgctggaatcaaggtatgtgccatcaaagctcctggttttggtgaaaaccgtaaatctggtctccaggatcttgctgttcttacaggaggtcaacttatcaccgaagagcttggtttgaatcttgaaaaagtagacctggacttatttggctcttgcaagaagataacaatttctaaagatgacactgtcatccttgatggagctggtgataagaaagcaattgaggaaagatgtgagcagattagatcagcaattgaaaatagcacttcagattatgacaaggaaaagttacaggaaagattagccaagctttctgggggtgttgcagtactgaaggattttatctggcacttcatcctatggttttgtcatgataaaactaacatctgtcacttttgcagattggagggtgctgttggtgaatatgttgatatggttaaaactggaattattgatccattgaaggttattaggaccgccttggttgatgcagccagtgtgtcatctttgatgacaacaactgaagctgttgtgtctgaactcccgaaggacgataaagatgttcctgccatgggtggtggcatgggtggcatggattattaa

SEQ ID NO: 88471 - DNA, 768 bp, Glycine max
  Peptide Sequence Number=SeqID_180156
atggattacttcaacggtaatcagtgcacatgcacgagtccaaggcctaataagtccctgaccttaaggattatggcaattacatggactgaaacaaacacaacaacaacaaaacaacctgggaatcaacatcataaagaagtgcgcatggaggaccagaccaacctatcctcaatggtgaggaggttgcaggcgcaagtgtcagatatgtgtcgacatctcgccgaagaaaccatggtccttcaaaaggagaatgcacaactacgagaggcgaagtcaacaaccgttaagatgtcaaaggccaccaatgttagtgctcaacaagacatacaccccgagtctgtaaacacgttgcagttagagcagtacaagaatccttttgtccccgacatcatggagactacccatccttccaactggaagaacttgaatattgaaaagagaagaaagtgtcacttcaaatttgtgaacaacttatgcaagaaacctacttctgacatggatgagttgcgacaaagaacaaccaagtatatgcatatggaagaattgaccaaatacgagaaccaagttcaagccaaggctacaaggaagtcagcaagcccaactttaacaagactatggaggaaggatgaaggaatcgaccgccttgagaacctcgttacacccattaaccccccctaccacaagcaaatctcacatcctgaattaagtcttgtccaccaaaattctagtcataccaagcagaatcaacactctgtccaagactga

SEQ ID NO: 88472 - DNA, 248 bp, Glycine max
  Peptide Sequence Number=SeqID_180157
atgaacggtgtcggtgtagctgagcaatggagcgacgtgccgtttaggatggacgacgcggacgacatgatcatcttcaactccctctgcgacgccgtttcacacggttggtctttgtccgattccaccacaacaaaaccagaaaacgacgccgcggatcagagaccagctcacgaaataagttactccgattgccagaacgacgattccaaagctgccgttttggcgcagaagatgaccatgggaac

SEQ ID NO: 88473 - DNA, 969 bp, Glycine max
  Peptide Sequence Number=SeqID_180158
atgggagttgcaacttgcactcaaatcgccagtgacagttgcaactcccctttaggcctgcaccccctccaaaagcctgcaaaagcctgccctaactcgctagtcatggtggcaacttccacctgcaggcaactcgccactacgagtggcgtttttcatgccacgtggcttcgcacagcaaactcgccattgacaataacggtttgctatagaacccatgcaaagtacgtagaaaacaacccccatgtaatatttttcaaaaggaccccatttgggaaaatattttgtaaaagcaccccatctggggaaatttgcctcatgttcctctttacaagatttggtgaaaaaacccttacccgttatgagcgagttttgcgaagccttagtgagtgttcaaaacgtgatagtgagacatttctgaatgaggatcaaatcaaagaactagccactgggttagaactcattggcttacctttcattttggttttgaatttcccatccaatctctctgccaaagctgagttggaaagagcattaacaaaagggtttttggaaagagtgaagaataggggagtggtgcacactggttggtttcagcagcagcttgcactgaagcactcaagtttggggtgctatgtatgccatggtggctttagttctgtgatagaagctttgattaatgagtgtcaactggtgctgttgcctttcaagggtgaccagtttttcaattctaagctcatagccaatgatttaaaggcgggcgtagaggtgaataggggtgatgaaggtgggttctttcacaaagaggatataatagatgcaataaaaactatcatgatggaggataacaaagagcaagggaagcaaacaagagaaagccacatgcaatggagcatgtttttatcaaatcaggaaattcagaacaaattcatcacagatatggttgcccagttgaagtctatggcttag

SEQ ID NO: 88474 - DNA, 207 bp, Glycine max
  Peptide Sequence Number=SeqID_180159
atgactctcactagatatgctctctatatatatccaacatacatgattcgggctattgcaagtaatgcctcggacaacatttactgcactcttcttgctcatggtgctgttcatggagctatggctggatatactggcttcacagtcgggcctgtgaacagtaaacaggcttatatcccaattgccgtgagtggttcattccattag

SEQ ID NO: 88475 - DNA, 657 bp, Glycine max
  Peptide Sequence Number=SeqID_180160
atggaagaagtgaaggttgcttcagacttgttggtgggtgaccctgcttcactggagaagaaaattgatgcaattcgtttgggtggtccccagaagcttcaggtgattgctgattttgatgccacgttaacaaagttttgggttaatggaactcgtggccaaaccagtcatggtcttttgcagcagggtaatccagaatatgatgccaaaaggcagcagttatatgaatattaccatccattagagttttcgccgactattggacttgaagagaaaacgaagctcatggaagagtggtggggaaaaacacacggtcttcttgttgagggaggacttacatatgattcaataagacaatcagttgctaatgccaacatagctttcagggaaggtgtttctgaactttttgagtttctggaggaaagagatattcctgtgttaatattctcagccgggcttgctgatatcattgaagaggtcctaaggcagaaacttcacagatccttcaagaatgtgaggatagtatccaacaggatggtatttgatgatgatggccgccttgtatctttcaaaggtgattctgtgtttcctacattcattagctacatatttgttggtttatcatctagcttttcatatccaaatacatctttttaa

SEQ ID NO: 88476 - DNA, 780 bp, Glycine max
  Peptide Sequence Number=SeqID_180161
atgaacaacagcaccagcaacaaggaagataatggctttgatccaagtgagtttacatatggtgtagcttttgtaattggcttggtcttcttacttgtcaccatagcttttgcatgtgtgcgtcttcgcatggctcgtggtcctaacatgctaaacattttggctggtattccaccatctcgccaagcacgatcagaagaagattcagctgaacaggggcttcatcacattgacacaagttttgagagctatccgaagttgctttactctcaagtagagaagggttcaagtagttcaagtgttgtttcttctagctgctccatatgcttaggtgactacaaagaaagtgacacgttgaggttgcttcctcactgtgaccatcttttccaccttgcttgcgttgatccttggcttagctttattgttctaacccttatagttacactcacagcttatgtgtgctctaataacattccacgcactattccatctgtgcctggtggtgccacacactccaacaacaaccacaccataatcactgtggagacacctgagccacgcttagatcacactagtgtcagaagctatcctagtctccaattctccaaggccaaattgtgtagtagcaatagtaatagtagctcttcaagttgttccatatgcttgatggattacaaagagtgtgattccttgagagtgcttcctgcttgtgctcacttcttccatgtcaagtgtgttgatccttggttgagaatcaatttgacatgcccgggcgcttga

SEQ ID NO: 88477 - DNA, 723 bp, Glycine max
  Peptide Sequence Number=SeqID_180162
atgcctttggttaggtatgaaggccagcgtgacatgctgtacaatcagacgttcaatctcgatcaagttcaatttgctgctgagggcattaaagatgctcaacaaactatgacagctttgaagtctgccaacaaggagttgaagggaatgatgaaaactgtgaagatccaagacattgataacttgcaagatgagatgatggacctcatggatgtaagtaatgaaatccaagagactttgggtagaagctataatgtgcctgatgacattgatgaggatgaccttatgggtgaacttgatgcattggaattagacatgggaaatgagactgaagctgatggggtcccatcctacctccaacctgataaagaacctgatttggatgcagaacttaacttacctccagctccaacaggacaaacagctgtgccacctggcagatccaatgcgcagttgttaactgtacttaaaatgagggggttggtttggaggggggacttagtcaagtctcattgtgaaaaacttggtgttaaaacaggaattagaatattgaaaattagcatagcagggttgctagaaattgaagccgttgacctcaagcacttaaactggctactgaggatgagctgggtttacctgctgtccctcaggcatccatacgcggttaaagaatgctttctatatcttggcgtagctagtgcagtcacgagcatgcccttgtaa

SEQ ID NO: 88478 - DNA, 3483 bp, Glycine max
  Peptide Sequence Number=SeqID_180163
atgcggcaagttctttacgcagaccaaggcaatgcaggagaatcactgtctgatagacaacccactttaagatctgagattgatcatttgacagcacttatgcgttcaagaactgtcaatgcacctgtcagggaagaggagaaggggacagaaatggtcccctcagaaccaatgttgctgagtggacaaaaggaatatcccaaaacacctgcactagaaaatgggactaaaaatggtcttgttgtaaccccacatgttgcttcaagttttcctgttgaggatgttgcttcacctgcagagcttgcaaagtcttacatggggagcaggcctaccaaggtatcctcttcaattttaggcatgcaaactcttgcactcagggaggatccaactcttgtaaacagtgaaaacgttgctctgaaatcccctattatgtccattgtgccaagggctactagacatgctgcagttcatgaaaatggttttgtgaccgcaagatctcgtggcagatctgtgatatataatatggctcgaacaccgtatgccagaatttatccaacatccactctcaagggtggggggcgtgctgttgaaggtgagccatcgtcttcaagtcagtttgcattggatcatgatgtgcattctggatctaaactagggtctgtaaaacatagaagttcagtattggataatgatataggatctgttggtcctgtacggcgaattcgtcagaagtctaatcttctatattctataggctcatgctcacctatttctggtagctcttcatctgttgctaggggcggaatggttaaggatgctgctcagcaacccttgtcttccatgcagaagcctgcaaaagaaaatgtggatgacattatacctagttcgagcttcccctctttaccctcaaaatccagtgaagtggcttcaaaaatactgcatcaacttgataagttggtttctccaaaagaaaaatcatctgaattaaggctaccaattgtgaatgataattcaccaacaaagttgtcgccttccatgttacgtggacaggctcttagaagcatggaaatggtggattcatcaaaattgctggacagtgtacatggtaataaaatagatggcccatttggaaatttgtcaactagtgctcagaatcagaagtcaaattctcagagagataagattgaaaatggtccattgaagcttgttgctccttctgctggattgcttccacttgtgacagctgcagatgctacaaagccaaggaatcaagtcttatctagtgcaaaatctggggattcttttatgataaaatctgtttctggccctccacaaaagaagagggcattccatatgagtgcacacgaggattgtctggatctggatgatgatgcttatccaaatggagctgtcgcttctttttctcctgttcagaaagaaatgacaaactccactgctgtgatggagaaaactacttctggtactgaagcaattgcagaggagaatccatcagcattatctgtaacaatgccacctaaaagttctacaatagatggtgaggctcatgttgggactgccgatgagtctagggttggtgagaaagttgatgcatatatctctacgacatcatctatccttgatccaatcttcaagccatttacatcagctacacaaacaagttttggttttatcaagcctgcttcaccaaatggatcaattgttaaaccttcctttacttttgggaataaagtggtttcgtcgacggagtttatggctcctggtgctccatcaatggagataaccaaatctggtccaatatttggattggaaaaagttgtttcattaagggagcctgttgctgatggtccattggttgactttggctccaataaaaatgttaacaaggttccatcaatgccatttactgctgcatcatcagttggtggtgaatccccttttctaaaatttggtgtttcttctgactcaaatctgggaagttcaattggctctactattgttactggtgtgactgattctatgccaaaagttcgtgaatctgataatggcaatactgagactaataaagatactggatcttctgttagggcatcagaactagctatttcatctgctccatcaacattgttggcatcatccaagagtttatccaattttggccacaattcaaatcaaaataacgggtctcttttttcaagcccttcattttcttcttttccacctcctgtatcaaatatactcagtagttcatcatctgctgccccaagcagtggcgttagtgccgctggaaattctactagcatgggagctatcacacctgccacaattgcatcaagtaatagcagttcctccacagtggtggcatcctcatcttcagcaacttcctttttcaaatttggatcctctcctgtccgatcagtaggtttacctgtgtcatcttctggtggttcagaaccaccagaaattaaaagcaggcaggatgcaggaaccggtggtcttagcagcactgcctttggtagctcatctgcagggagtggtatttttggcttcagctcttcagcaatgacaactgtaaatagcagccagtctcagagttctgccgttggtgctagcagtggttctgtgcttggtgcccaggcttcatttaccagtgggtttgcaacttctactcagacccagtctgtttcatttggttcatctgcatcttcctcatcttttggattgtccgggaacacacctttttcaagcagttcttcatttccttcgtccagccctgcagcaagtgcagcttttctttctgggaattcgttgtttccttcttcaagtcctgccacatcttttggacttggcacctctgcttcctctttggctgtcaactctgttagctccaatagtggtccaagttctactttatttggatctagttggcagcccagcaagtctccatttggttccacatttagtacatcattgtcatctgggtttttgttcggaacatccactgcttctgttacttctgccagttcaccctcaatgtttttatcaacctccagtgcatcaattcctcaattctcattcactccggcagcagcagcctctacctccacacaacctgcttttgtaagtcctaatcctgccttcacattcggttcagctactgttaataatggtcagatgagtatggaggacagtatggctgaggatacaggtcaagcaactccacctgcgacttctgtatatagtcagcaacctgccccagttcaatcaaattttgtatttggagcatcaactccatcaggaggcagtcctttccagtttggtagtcaacagaatattgctccacagaacccttctccttttcaggcttctggcagtctaggagggagtttctcattgggcacaggtggaggtgacaaatctgctagaagaattgtgaaagttaaacataaaccacgcaagaagtag

SEQ ID NO: 88479 - DNA, 1821 bp, Glycine max
  Peptide Sequence Number=SeqID_180164
atggtatttagtcctgtgacaaaggggagggggacagggagaccaagaaggacattggggaaggcagaggcaaaaatacttaaagggccacatgaagacttggaaaactatcttgaagcaatagataagttgagaagcaacattcagttttttggtagtaagaagggtttcaagagtagtgatggcattgtcgtgcatgctaataatttgctagctaaggctatttcaaagctagaagatgagtttaggcagttattattatcttacagcaaacctgtggaacctgagcgcctctttgactgccttccaaactcaatgcgaccttcatcacctggccatgagggtgatcctagtggcaagaatcaccattctgagtctcacaacaataatgctgaggctgttgtatacacacctcctgctcttataccaccaagatttttgccactgctacatgatttagctcagcaaatggttgaagctggtcaccaacaacagttactcaaaatatacagggatgcccgttctaatgtattggaagagagcctccaaaaacttggagtggagaaactcaacaaagatgatgttcaaaagctgcagtgggagattttggaagccaaaattggaaactggattcatttcatgcgtatagcagtgaaattgttgtttgctggtgagaggaaagtttgtgatcagatatttgaaggctttgattcactcagtgaacagtgctttgcggaggtgactacaaacagtgtctctatgctactcagttttggagaagcaattgccaaaagcaagagatccccggaaaaattatttgtacttttggacatgtatgaaataatgcaagaacttcattcagagattgaaactctttttaaaggcaaagcttgctctgcaataagagaagctgcaactagtttgacaaaacgtcttgcacaaacagctcaggagacctttggagattttgaagaggcagttgagaaagatgctacaaagactgcagtaacagatggaactgtccatcctctaacaagctatgtaattaactatgtgaagtttttatttgaggtggagcatttcacattccctgtaatactgggacatgctttgctagtggggaaaaatttgtcttcaaactaccaatccaccttgaagcaactttttcaggaatttgaaggtggtgatgattcttcacagctagcatctgtaactgtgcgaataatgcaagctttgcaaaccaatttagatgggaaatcaaagcagtataaagaccttgcgttgacacatctttttctcatgaacaatattcattatattgtcagatcggttcggaggtctgaagccaaggatttgctgggggatgattgggtacaacgacataggaggattgtgcagcagcatgcaaatcaatacaaaagaaatgcttgggcaaagattcttcagtgcctatctattcagggccttacctcatcaggtggtgggagtggtactgctggtggtgacagtggaactggaagcagtagtggtgcttcaagagcaattgtgaaagacaggtttaaggcattcaatattatgtttgaggaactccatcagaaacaatcgcaatggacagttccagactccgagttgcgagaatctcttaggctagcagttgctgaagtcttgttgcctgcctatagatcgtttgtcaaacgatttgggcctctagtggagagtggaaagaatcctcagaagtacatcaaatactcagcagaagatctagaccgaatgttgggtgaattttttgaaggaaaaaacatgagtgaaaccaagcggtaa

SEQ ID NO: 88480 - DNA, 2568 bp, Glycine max
  Peptide Sequence Number=SeqID_180165
atgagaggaggtatttgtagcatacagcttcaggctcttacacctgaagctgcaactgttgttaagcaagctgttaatcttgcaacaagaagaggccatgcacaagtgacacctcttcatgttgcaagtgccatgcttgcaacttccacaggccttctccgcaaggcttgtcttcagtgtcactctcaccccctccagtgcaaggctcttgagctttgtttcaacgttgcactcaaccgtctaccagcttccacttcaagccctcttctggcacctcaatattccaccccttcactctccaatgccttggttgcagccttcaaacgtgctcaggctcaccaacgccgtggttctattgagaaccagcagcagcatattctggccttgaagattgaggtggagcagctcgtgatttcaattcttgatgatcctagtgttagcagggtcatgagagaagctggtttctctagcacccttgtgaaaacaagggtcgaacaagctgtttcaatggaagtttgttcacaaaaggctcaagcaaaagaaaatatcactaagcctcatcatcaagttgttcttggtggtagaaataatgtgtctccatctggaccttttggtcaagttggtggctccttcatgaagcctaatttggaccatgttaacaatgatgatgtgactagtgtgttgagtgagttggcaaagagaagaaacacagttattgtaggggagagtgtgaccaatgctgagggtgtagttaggggagtgatagagaggtttgaggttgggaatgttcctggagacttgaggtatgtgcaatttgtgagccttcctctcatgtgcttcagaaacattagcaaggaggaggttgaacagaagcttatggaggttagaaaccttgtgaagagctatgtgggaggaggggttgttctttacttgggtgatctaaaatggctgtttgagttctgggctaattttcgtgagcaaaaaacaaactactgttctgtagagcacatggtcatggagcttaaaaaattggtatgtggtagtggggagtctagtagattgtggcttatggggatttcaacttttaagacatacatgaagtgtaaaatatgtcacccatccctagaaaccatttgggagcttcatcccttcacaattcctgttggcatcctcagcctaagtttaaatcttgacagtgattttcaagctcaagagagaaacaaggtatttttcaaggatgtggcttttgaagatagagcaggagtcagaaaccatctaacttgctgcagggattgcacaataaattttgaaaaagaagctcagagcataactagcactataagtaagaaagcttgcactactagtagcttgccaacgtggctccaaaattgtaaggaagagagaagtgacataatggaagatcaggaaaatgcaaggcttaaggatctgtgcaagaaatggaactcattatgcaactcaatacacagacacccttccattaatgagaaacaagttttctttgtttcatcatctccttcatctcccacttctgtttcctcacatgaaagaaagtccaactttcaccacagccacctaaattggccaatcatttctgaatcagaaaagtcaccaaaagaatgtgagttatacactgaaactggtgatgatggctatgatagcaactttataatgttcatgccagatagtgatgtccctaaaccagatcttctgtcaaatcccaactctagccccaactcagcttcttcaagcgaagcagtggatggtttggaaagcactcaaatgttcaaagaacctaatgctgagaatcataagattctgtgtgatgccttggagaaaaaggttccacagcataaagaagttattccagagattgcaagtaccgtccttcattgtagatcaggaatgagaaagagagatcagaaccactcgatgaagagagaagacaatcaagaaacatggatgttctttcttggtgtgaattctcaagccaaagagagcatctcaagagagctagctaaagttgtttttggctcttatagcaactttgtcacaattggcatgagtagtttctcttccccagaagatgatgatgattccactgatgaaaaatccaaaaggaagaggccaagagaagagttgaaaagcagttatgctcaaagattcggggaagcagtgaatgagaaccctcacagggtgttcttcttagaagacttggatcaagttgattacttttctcaaaagggtgtagagcaagcaattcaaagtggaagcataacacttcctggtggtgaatctgttcctctcatggatgccattgtcattttcagttgcgaaagcttcttctcttcaccaaagctgagaaaatcaccatgtgctgaaaacaaagggaaagagactgtggaagatgaaagttctagcctctctttggatctgaacatagccattgaagatgaaagtggaggtgtggcattcggtggagacaatgctacacttagtggggtcgggggaaagaaagacatgaatggaaaagttatattagagatatag

SEQ ID NO: 88481 - DNA, 102 bp, Glycine max
  Peptide Sequence Number=SeqID_180166
atggctcatctcatcttgatagccaatggtgcaactgcaatctacgagttccagtccaaccaagcagctgtctgcaaggacaatgtagtaagtcatcattaa

SEQ ID NO: 88482 - DNA, 828 bp, Glycine max
  Peptide Sequence Number=SeqID_180167
atggaatatgtatgtagcccacttggttgggaattctaccaccaggaagaggggttagaggacttgagacattctcttctgtacacaaccttggagctagaggcaacaattgcatcagctaaggaggagattacaagaagagaatgtgaattgattcgtgtgaatgacctcttaagcagggtcatgaaggagagagatgaggcacaagcaaaatgccagaagctaatgctggaaaaactagagctccaacaagaacttcagcataagcaacaactagaacagaatcagcaccaacaccaacaccaacttgttcaaaaacatcaaagagacaccatatcacaaagtgaagaggagctgcaagaagggttatccgaaaagcattctgcttcttctgactgtgaagaaaacagcagcatgccctcttctggtggaagttcaaccccacatcatacaacaccactgcaggtggtactggagttggcagaaaagaaaccattgcctgaaaaagggaaactcttaaaggcagtggtggaagctggaccactgcttcagacccttctcttagcaggaccactcccacagtggcagcaccctcctccacaactcaactccattgagatccccccagtggccatttcaccccaaaactcttcttctaccaaaagtgcttctttccctttcaataagaagagggaccttcttgtcctctctccaggtaccggttgcccagtttcaaagaatagaaaggtcattcagcacatgccaacacctaccactaccactgcttctgcttcacatcattccctaccacacccatcattttcataa

SEQ ID NO: 88483 - DNA, 2025 bp, Glycine max
  Peptide Sequence Number=SeqID_180168
atgttgcttgctgtggtctggaatgtactggaaatccgagttctggttttattcagtttgatcttgcaaataatccttatagtttgtggcaaccaaagaaagtacaaagcaggttgggtgctacaattcggtgtgtggtttacctatctgtcagcagattgggctgcgacctttgtgctgggcattctttccaaagacagcaaaaatccttcaacagaccccaccaactccataatcatggccatctgggcacccttccttcttgtgcatcttggtggccctgacacaatcactgcctactccctcgaggataatgagctatggctacgacactttcttgggttaatctcccagctatttggagcagtttatgttgtttacagttcatggaatgacagaaaccttaactatgttaccattccagttatggtggcaggaataatcaaatatactgagaggactttgtccttgtggttgggaagcagcaaaaagttcagagaatccattcaccgtccaccagacccaggaccaaattatgccaaattcatggatgactgcactgcaaaaatagctgaaggatataaagttgaattgaaggttgaatctactcccatattgtcggatcactctctagcggcaatagcaaatgaaagtgtaccagatgctttgcgtttgcactatggattctatttccttgaaattttcgagtgcctatttgcagatctcatccttggttttcaagaactccaagaaagccaacatttctttcagaacaaatcatgggaacatgcgtataaagtaattgaggttgagcttggattgatgtatgataagctatatacaaaggcagtggtaacatactctcgccttggccttttcctcaaaattgtgacctttttctgcaccctctctgcatttattgcatttttatgtctgatagataaagcacacatagattgtgaccaaattataactgttgtgcttttcgctggggctatttttcttgagatatacgcaggcatcgttttactttcttcaagttggacaatgcattggttaagcaagcataagaattggatcgtgaatcttctcatctcatgttttcaaacatgctataaactctcacatgctaagaggtggtctaatcttatatcacaattcaatctcataagtttttgcttgaaaggtgagccagcaaaacgcatcaaaatctggaattaccaattcatgtatcagattttcaggatactttaccaccaagaccaagaaactgtccccgagaaattgaaagaactcatttttgaacacattcgggagaagtctaagggtgcaaaacacattaaggcatgtaaaaacttttgcgctcacaggggtgatcaagttcttaacaaatggaagtgccgttccattgcctggagcactgaggtggagtttgatcaaagccttctgatttggcatattgctacagatctttgttgttattcagataaagattgtgacaagctcaaaaattatgaaataagcagattgatgtcagattatatgttatatctccttgttaaatgtccttttatgttacccaacggaataggacagatcagatttgaagacacgtgtgccgaggcgagtgaacttttgcaagaaaggaagtacatatcgcaaacagatcaagtttgcgaagtgattggtggagtgagtgtagatgaaaagttcctaccgtcaaaggttaaaggagatagaagcaagtctgtgctgtttgatgcatgtaggcttgcaaagtcgataaagtctttagaagaggaaaagaaatggtcgaaagaacagaaatgggaaatgataagtcgtgtttgggtggagatgttgtgtcatgcagcaagccagtgtagagggtttcatcatgccaagcagcttagcagaggtggcgaattgcttacccatgtctggtttttaatggctcatttaggtataactgaacagtttcagatttcacaaggtcacgcaagggcaaagttgatacacagctaa

SEQ ID NO: 88484 - DNA, 1998 bp, Glycine max
  Peptide Sequence Number=SeqID_180169
atggctgcaggttctgctggtgatcgactcaaacttgtaacatgtgcaattgtgctgctaccattccttgtcacaatagcctcaagtgctgatatattccttgattggcacgtttccactgacattaatttaaagcctgtgtctactgatcaaccagtagggatcatagcctttgatctattcatctttttatctgtctttagtcatgcattgtttcctaatttcattgctgatatgattggcaggaatggcatacagcaaaggctagattcatgggaagatggagtgtctggcacaaactgtcccatccaaccaggcaggaattggacttatgaattccaaaccaaagaccagattggcacattcttctactttccttccatcaatttcctcaaagctggtggagggtttggtccaattcgagtcaacaatcgacccgtgataagtgttccttttccaaaacctgaggcagagtttgattttctaattggtgactggcacagcagtagctacaaggatattaggtccaggttggatgcgtcggatgttcttcctcctgattggatgctaataaacggaaaaggaccatatatgaacaatttatctctatcatatgagaccttcaatgttacacaaggtaaaacatatttgctcaggatatcaaacgtagggacagcctggagcttcaatttcaggattcaaaaccatcaaatggttttggctgaaactgaaggttcttatgtcaatcaaatagagttggagtctcttgatgttcatgtaggccaatcctactcagttcttgtcacagcaaaccaaagtgctgctgattactacatagtggcctctcccaaaatgagtaatgccacaaataataacactcttgtcggtgtcgctgtgcttcattatgataactctaccacaccggctactggttctctgccaagtggtccagatccatttgatctgcaattctccatcaaccaagcaaaatccattaggtggaacctcactactggagctgcaaggcctaatcctcagggaacgttcaatgtaaaaaatgtggcaatatctgagactttcattttccaggcatcaacagcagtggttgatggtttatatcgctacactgtcaacaatgtgtcttacttgaccccaaatacaccactgaagctagctgattacttttctaacggaactggagtatatgaacttgatgcttattctaagaacagttcaaatgttaatgctgtgcgtggagttttcgtagccagtgcattacataaagggtggacggagatagtgctcaaaaacaatttagacatcattgatacttggcatttggatggatacagcttctttgttgtcgggattggggaaggagaatggaatccagaatcacggtcaagttataaccttaatgatcctgttgctcgctccactgtgcaagtgtaccctggagggtggagtgcagtgtatgtgtaccctgacaaccctggaatgtggaacctgcgatcacagaacttgcaaagctggtatttaggtgaagagctctatgtgagggtttatgatgctgatcccaaccctgccaaggagaagccacctccacagaatctccttctatgtggcttttttcaaccttcacctccaccattaaacgaacataatccaaatgctccttcagtgtccccagcaccaaattctccatcatccaaagcatgcaagcaaaatgctccttcagtgtccccagaaccaaatgctccatcgcccaaggcatataatccaaattctccctcagtgtccccagcaccaaatgctccatcgcccgaggcatataatccaaattctccctcagtgtccccagcaccaaatgctccatcatccaaggcatataatccacatagaacaaggctaatatgtgttctttgtaataacaacaataggtctctgattgctgtgatcaccactgccttgtgtttcctctatattggtctccattaa

SEQ ID NO: 88485 - DNA, 1497 bp, Glycine max
  Peptide Sequence Number=SeqID_180170
aatgaagatggtggttggggattccatatagagggtcatagttcgatgtttggatcagcattgagctacattgccttaaggatactcggagaagggtctcaagatggtgaggaacgagcaatggacagagctagaaaatggatccttgatcatggtggtttagtggctattccatcatggggaaagttctgggtcacggtacttggtgtttatgaatggtcaggctgtaatccacttccaccagagttttggttgctacccaaatgtagtcctattcatccagggaaaatgttgtgctactgtcgcttggtttatatgcctatgtcatatttatatgggaagaagtttgtgggccccatcactagcttaatcagatccttgagagaagaagtatacaacgagccttatgatcaaatcaactggaataaggcccggaacattgttgctaaggaggatctctactatccccatcctatgatccaagatatgctatggggatttcttcatcacgtgggagaacgtgttatgaattgctggcccttttctatgcttagacagaaggcattagaaatcgcaataaatcatgtacgttacgaggacgagaatagtagatacctttgcattggaagtgtagagaaggtgttatgtttgattgcgcgttgggttgaagaccccaactcagaggcatacaaacttcatttagcccgaatccctgattacttttggctggctgaagatggcttgaagattcagatgtgggatgcagcatttgctattcaagcaatacttgcttgtaatgtgagtgaagaatacgggcctacacttcggaaagcacactccttcgtgaaggcttcgcaggtccgtgaaaacccatctggtgatttcaaagcaatgtacagacacatatccaaaggatcgtggacattctcaatgcatgatcacggttggcaagtctccgactgcacggcagaaggactcaaggctgcactcctattgtcagaaatggctactgatctagttggggaagaaatggaagcagagcgattatatgacgctgttaatgtcatcctttctttacaaagcagtaatggtggtttccctgcttgggagcctcaaagagcataccgttggttagagacaccctcattgagatggagtaagattacagtggcacaattgacagacatgttgcacctgatcactacattgaccaactttggcactgactatgttcattgttacatgatgtcaaataggtatgtggaatgcactggatcagcaatgcaagtgggactaacagcctgtggaaagaactaccataatagtccttccctacgcaaagcttgcaaatttttgttatcaaagcagcttccaaatggtggatggggagagagttacttgtcgagccaaaacaaggtttatacaaacttagaaggcaaccgtgcaaacttagttcaaacttcatgggctttgttgtcccttattgatgcaggacag

SEQ ID NO: 88486 - DNA, 861 bp, Glycine max
  Peptide Sequence Number=SeqID_180171
atggagggagtagttaagaagaaggaagtagtaaaaatgatgttggtgaagttaatcaagtgggaaattttctttagaccaaactctcaaccgcttggactacttgccagcttcaccttcttgtctcaattcttcaccctattcttgaaagtgagagataatcatggtggaattattctgatttctggctcattttggaagctgcaaaaagaaaaagaaaacatgggttctgattcaagagttggaagtagcaactacgattactcctttaaggttttattggttggtgattctggtgttggcaagagtagtcttctcctcagcttcatctccaactctaactccatcaatcacctctcccccaccattggtgtggatttcaagataaagctttttactgttggtggtaaaagattgaagcttactatttgggatacagctggacaagagaggtttggaacagttataggttcttattacagaggtgcacatggaatcattcttgtctatgatgtgacacggcgtgagacatttacaaacctcatcgatatatgggcaaaagaagttgagctttattcaactaatcatgatagcatcaaaattcttgttggcaataaggtggataaggagagtgaaagagctgtaagcaaagaagagggtatggctcttgcacagcaacatagatgtttgttcctagagtgtagtgctaaaactagagaaaatgttcagcaatgctttaatgatctcacattaaagatattagatgtgccgagtttaagggaaagggggtctgttgcagtgaaaagacaaaagcagaaacacatatatgagacatctaaaagcggtggttgctgttcttag

SEQ ID NO: 88487 - DNA, 467 bp, Glycine max
  Peptide Sequence Number=SeqID_180172
atggtgataaacccttattttatgcatcacatggtcaaagagcaagtcgcgatcatgaacaaaagacaagatggcagcttgtggcttacatgcaccagtagctctacttgcgattggcaacatatcagaacttcgatgacaacatctatcagatcaaccaaggaagcagtcaacggtgtggcaatggtggtggttaagggtgctgatagtgctaccttggttgtttgcacttctaaaggtgccaaaaaaatcctggatggctgtggcaagaaggaagtgttgctagaggaagcaagcgagtttctccgcattattcagcagagcgagttcaaggtcattgagcagctcaacaaaaccccgaccagggctttggaggactcgtcaataatatcactgccaacaactatctcgtcttcgtctaagaagaaatccctgtcgaggggagagggcatagcagggctttgcat

SEQ ID NO: 88488 - DNA, 183 bp, Glycine max
  Peptide Sequence Number=SeqID_180173
atgattggtgcgaagtcgatgatgaagttcgagagtgggtactctgtggaaatcatgttcgatggaagcaagcttggaattgagccttatgcagttgaggtgttacctaatggggagcttttcattctggattcaactaatagtaacgtttataggatttcgtcctcgctttctttgagctga

SEQ ID NO: 88489 - DNA, 2160 bp, Glycine max
  Peptide Sequence Number=SeqID_180174
atgtcaggagagcaaatcttgtcatccaatgaagaatataataaatctcagcctccatttggtagcaagagtggttacgattcaagaacaggcatctatcactctctaattaagcttgtcaccaagcatgaaatcccaacaaggcctgatcttaacactgccaattttgtgctgtcacagttcccacagacacaccttgctgaggcaagaattgcattcattgattcaggtactagtaggagtgtaagctatggtgagctaaaaaggtctatttactcccttgcatcagctttgttccatggacttgagattaggaaaggtgatgttgtatttgtattgtcaccaaactcaaccttgtactcagccatatgcctagctgttttatcagttggagcagttcttaccactgccaaccccatcaacactgcaacagaaattgcgaagcaagtgcatgattcgggtgctaaactagccatctcagcacctgaggagctacacaaattggtcccaactggggttcctataattctcacttctcgtccttctgatggcaacatgttatcagttgaagagttaatagaaggctgttgtacttcaccagagttgcctcaagttcctgtggcacaatcagacactgctgctatactttactcttcaggaaccacaggggtaagcaaaggtgtggttctgacacatgcaaatctcatttccataatgagactactcttttggtctgctgatgtaagtggatcccaagatgatgttttcttggccttcattccaatgtttcacatctatggacttgtgttctttggattaggattgttgtgtgttggtgtcacgacaattttgatgcagaaatatgacttccaaggcatgcttgatgcaatccagaagcacaaggttaacaacatagcagcagtgccaccagtgatccttgcactagtaaaacaagcaaagaaaactaggtgtgacttgtccagcctaagaagggtggggtcaggtgctgcacctttgagcaaggaagtggcacaagagtttagaaggatgtttccttgggttgaactaaggcaaggttatggcctaacagaaagtagtggtggagcaacattttttccctcggataaagatgctaaagctcatccagattcatgtgggaagctgattccaactttttgtgcaaaagttgtagacatcgaaacggggaagcctttgcctcctcataaagagggagaattatggttcaaaagtcctactattatgaaaggatatctaggaaatttggaggcaacaagtgcaactattgattcagaaggttggttgaagactggtgatcttggttacattgatgagaagggatttgtttatatagttgaacgaataaaggagctaatcaagcacaatggttatcaggtggctcctgcagaactggaatctgtgctgctaagtcatccccttatagttgatgcagcagttataccggttgaagatgaagaaactggacagataccaatggcatatgtggtgagagcagctggttctgaactctcagaaaaccaagtcattcaatttgttgcaggccaggtggctccatataagaaagtgagaaaggtgagtttcattgtcactattccaaagtcagctgctggcaagatattgcggaaggatcttgtttctcaaagcaaatatcaacttgtctccaaggtggggtcaggtgctgcacctttgagcaaggaagtggcacaagagtttagaaggatgtttccttgggttgaactaaggcaaggttatggcctaacagaaagtagtggtggagcagcattttttgcctctgataaagatggtaaagctcatccagattcatgtgggaagttgattccaactttttgtgcaaaagtgatacgcattgaaatggggaagcctttccctcctcataaaaaaggaaagttatggttcaaaagtcctacaattatgaaaggatatctaggaaatttggaggccacaagtgcaacaattgattcagaaggttggctgaggactggtgatcttggttacattgatgagaatgaatttgtttatatagttgaacgaataaaggagctaatcaagcacaatggttatcaggtgctcaaaaccataaatgtttcagttttcaactag

SEQ ID NO: 88490 - DNA, 1002 bp, Glycine max
  Peptide Sequence Number=SeqID_180175
atggctttcccaattctcttccttctcttcatttcccttcccttctcctccgcaaagctcaacgtcgattactacaaaaacacatgcccagacttcgaaaaaatcgttagggaaaacgtcttcaccaaacaaagcgctagcgtggccacagcaccgggtctccttcgcctcttcttccacgattgcatcaccgatggctgcgacgcttccctcctcataacttccaatgcatacaaccctcatgcagaacgtgatgcggacctcaacctttctctctccggtgatgccttcgacatcatagttaaaatcaaaaacgcattagaacttgcatgccctggtgttgtgtcgtgttccgacatcgtggcacaggccacaagagaccttgttaagatggtcggtggtcctttttaccccgtgaggctggggagaaaggatagcactgaatcagatgctgcgagagtgagtgcaagccttccaacaccaagcatgaccatggaccagatcattgagaagtttacctcaaagggtttcactgttaaggagatggtggctttgactggggcacacaccattgggttcacacactgcaaggagttcatccacaggatctacaacttcagcaagacctctgatgctgaccctatgatgcaccctaagctggtccaagggttgaggtccgtgtgccagaactacaccaaggactcctcaatggctgcattcaatgatgttaggtcaccagggaagtttgacaatgcctactaccagaatgtcatcaagggtttggggttgttgacctctgattccattcttgctgttgaccctaggacaaagcctcttgtggagctctatgcaaatgaccagcaagctttcttcaaggactttgctgatgccatggagaaactttctgtgtttagagtcaaaactggcgacaaaggagaggtgaggaacagaggcgaaaaacataagacttgtgatggagaagatccagttttacccatctga

SEQ ID NO: 88491 - DNA, 2709 bp, Glycine max
  Peptide Sequence Number=SeqID_180176
atgacgatagatccccagtcattgatgttggttactgtgatttggaatctacagaagttgggttatgtttttaagatatttgcagtagggcatgggaaggcccgctcaatatgggaaaacataggtggcagaatctgtcctttgagtacagagcatcaaggcctgatcgattggtcaatttttgaaggtatcattgttgactccttagaagcaaaagtagccatttcaagcgttatgcaggagcctttttgttcagtaccattgatatggattattcaagaagatagcctttcaagtcgccttccagtttatgagcaaatgggttgggagcatattgtttctcattggagaagtgcttttagcagagccagtgttgttgtgtttccagattttacttatccgatgttatatagtgagcttgacactggaaacttctttgtgattcctggatcaccagtagatgtgtgggctgcagaaagctatcataagacccatgcaaaggagcagctaagagaacttagtggatttggtaaaaatgatatgctggttctagttgttgggagctcagtcttctttgatgacctatcttgggactatgctgttgcaatgcattctgtagggcctctgctgacaagatatgcaaggaggaatgatgcaactgactcatttaaatttgttttcttatgtggcaattctactgatggttatgatgatgctttacagggagttgcttcacgtatgggacttcgtcagggttccataaggcactatggcttgaatggtgatgtgaatagtgtgttactaatggctgatatcatcctatatggttctgctcaagaggtgcagggttttcctccattattaatcagagcaatgacatttgaaattcctgtcgttgtacctgatttttcagtgttaaaaaaatatattgtggatggagttcacgggatatttttttctaaacacaatcctgaagctttgatgaatgctttttcacttttgctttcaaatggaagactttctaaatttgctcaagcaattgcatcatctggaagacaactagctaaaaatgtactagctctggattgcataactggttatgcaaggcttctggagaatgtactcaattttccctcagatgctttactgcctggtgctgtttctcagattcaacaggggtcatgggaatggaatttattccagaatgaaatagacttgtcaaagatagattccaatagaaaagtttccattgtttatgctgttgagcatgagttggcaagtcttaattattcaacaagcattgttgagaatggaacagaggttccactgcaagatgaactaacccaattggatttggatactttgagagaaattgaaatatctgaagagaatgaaatgtttgaagtggaagaggctgaagagagaatggagaaaggtgttagtgtatgggatgatatatatcgtaatgctagaaaatctgagaaactgaagtttgaagtcaatgagagggatgaaggggagcttgagagaacaggacaatctgtgtgcatttatgagatatacaatggtgcaggagtgtggccatttttacaccatggttctctctatcgtgggttaagcctttctagaagagcgcagagacaaacttctgatgatgtggatgcagttggtcgcttgcctcttttgaatgacacatattatcgggacattctctgtgaaatgggaggaatgtttgcaattgcaaatagggtggatagcattcacaggaggccttggattgggtttcaatcatggcgtgctgctggtaggaaggtagcattgtcagcgaaagccgaaaatgtcctggaagagacaatgcaagagaattttagaggagatgtaatatacttttggggacgtttggacatggatcagagtgccataagaaaccacaatgcaatttctttttggtacatgtgtgacatcttaaatggaggcaactgcagcccatttgaaaaatatgaaacttcctctaaaagaaatatgtttggaggttcagaactggaatttctagaagttggactttggagtttggatattgtaataattgtttttcaagatggcttccgccagatgtatgcattgcccccccatgcggaagcactgccccccatgccggaagatggtggttattggtcagcactgcacagctgggtgatgccaacctcttctttcttggagttcataatgttctctcggatgtttgttgattccattgatgctaagcacagagactccactaaatacagcctgtgcttgttaggctcttcagagattgagaagaagcactgctactgtcgcatgttggaacttctcatcaatgtatgggcttatcatagtgcacgaaagatggtatatataaatcctaacactggttctatggaagagcagcaccctattgaacaacggaaaggttttatgtggtcaaaatacttcaatttttcattgttgaaaagtatggacgaagatctggccgaggctgcagatgatggtgaccatccaagggaaatgtggttgtggccaatgacaggggaggtacactggcaagggatttatgaaagggagagggaagaaaggtacaggctaaaaatggataaaaaaagaaaaacaaaagaaaaactatttgaaagaatgaagtatggttacaagcagaaatcacttggacgataa

SEQ ID NO: 88492 - DNA, 860 bp, Glycine max
  Peptide Sequence Number=SeqID_180177
atggatggggatcgtgttccttctggagattcagtccggcgattcacagttggttgtgcttctgttgtggttgctgttatactcattgtactactgggtgtgttacttggatttgtgaactgtattgtccctctgaattggttcattcataactctgggaagaggaatttcactgccttgtcttgggaaaggtcaaatatgttctcttcaagagtaagacggttttgcagccgcctgaaccgagccccaacatttctccgtggtaagataaagcataatgcttgtgctaggaggtttattcttgccataatatttgctgtgggggttggattgatgtgcataggagtgaaaaatatttatggtggtaatggttcggaagagccttacccgttgaaagggcaatattcccaattcaccttactaacaatgacctatgatgctcgactttggaatttgaagatgtatgtgaaacattactcaagatgctcttctgtgcgggagatagtggtggtgtggaacaagggagtccctccaaaattgagtgatctagattctgcagtaccagtaaggatcagggaagagaaaaataactctctgaataatcggttcagggccgatccattgataaagacacgagcagtccttgagcttgatgacgatattatgatgccatgcgatgatatcgagcgaggttttaatgtgtggcgtcagcacccagatcggattgttggattctatcctcggctcattgatggaagcctgttaaaatacaggggagaaaaatacgctcggatgcataaggggtacaacatgattcttactggtgcagcttttattgattctcaagtggctttcaagag

SEQ ID NO: 88493 - DNA, 186 bp, Glycine max
  Peptide Sequence Number=SeqID_180178
atgatatatgaatatccatatgctctagcaatgccaagagagggcctcttttggtctataacaactcagcagccaggcatagggacacttaatgtcatattcactgtgcaaacaggcacatgtggtgtgtgttcggaacaactatccaacccacatgtgaagaggatcggtggacacaaaacatga

SEQ ID NO: 88494 - DNA, 754 bp, Glycine max
  Peptide Sequence Number=SeqID_180179
atggtcgctgaagcttggattgtgaagatgggtaaccaggtaagcgccaatctcaagcacgctcttcttcttgaaccttccgcaaggagaaaacacaaccccaaaaggcaagataatagtaccagcagtaaagaagtaattgggattctttctttcgaagtagcaaatgtaatgtccaaaaccgttcacctccacagatccttgtcggagcccgagatcgtgaagctcaggaacgagatctcgaactcacagggtgtccaaaaccttgtttcctccgaagagggttatctcctcgagctggctcgagcagagaagctcgaggagctgaaccgcgttgcaaacgtggtttctagattggggaagaagtgttccttgcctgctttgcaaggctttgagcatgtttatggggacattgttagtggggtcatagatgtgaaggaattggggttcttagttaaacacatggaaggaatggtgaggaaaatggataggtatgttagtgctaccaggagtttgcacagtgaaatgggggttttgaatgatttggagcaagcagtgaagaagtttcagcatgaggagagcagaagggcgtttgagcagaaactcacttggcagaagcaagatgtgaagcatctaaaggagatttcgctttggaatcagaactttgataaggttgttgagttgttggccaggacagtttgtaccctttatgctagaatctgtattatcattggtgattctacatggagaaaaa

SEQ ID NO: 88495 - DNA, 552 bp, Glycine max
  Peptide Sequence Number=SeqID_180180
atggacactggtatcatcggcaagcctcattctcaaggagaaggtcttgcagcagtttttggaaatggattatcaacagcatgtgttgtgaatattggtgcccaggtgacatcacttatatgcattgaggagggggaacttgatgctgttgcagtagttcattcctatgcggaaaaagtgccagctgtgtctcacaagacaaggctttctgctcttaatgttcctcctatgggattgttctatccaacacttttaactcctgatgtgtatcctcctccgccccgtacttggtttcacgactatgaggatatgcttgaagatacatggcatattgacttttcgcggaggtctgacatgccagatactttctatcccaatgttaatggaggattaccaatgtgggaaagctatccagttttttcaactaagccaaaaaaagaagagaaagttggccttgcagaggctattactaactgcattctctcaactggtcgcatagacatccagagaaaattattttgtagcatacaattggtgagttttacatgttga

SEQ ID NO: 88496 - DNA, 444 bp, Glycine max
  Peptide Sequence Number=SeqID_180181
gtcaaggaactagctgcaaaggcacgtgctggcaaattgaagccacatgaattccaagggggaacttttagtataagggtggatgtggatgtagccaagtggattgtgaatctaccatgtgcagaacatacgcttgatgaaaacatgctattttggaagatttttcagagtgcctggtttactagtctgagattagttacccaagttgttgacccttgtgagcaggactgtaaaatgtccaaagcttgcattcttgctgtagggagaggcaacaaagttgtggaaccagtaattggaactgatggaattgagaagccatcaattgccactaagttgagcttaacattgtctgctgatcatcgtgtttttgatggcaaagttggaggtgcatttctctctgctttgcaatcaaacttcagtgatataagacgactgcttttataa

SEQ ID NO: 88497 - DNA, 447 bp, Glycine max
  Peptide Sequence Number=SeqID_180182
atggagcttggtttgggactgggattgggattgggagagggagcggatgcggccgtgcacggcggcgatgttgctggagatgccgttgcaggagaccttcatgaggacgatggagtcggcggagtcgatcaggtcacggtaccggttgccgacgagttgccggagttcctccttcttgtcctcgatctgcttccgcgtcgccgcctccgtcttccggatctcggcgatgggcttcgagcggaagagggactcggcgtcgcggctgccgagggtgaagatgcggtgctcgtcggccggcttggcattgatctctccggcggaggacggtggaggaaggagagtggaaaatttggagaacggtcacttggaagaggggaaagagagaaattcaaggagagtttcgaaaaggataattttttatgtgaacgacgtcggttttacggttga

SEQ ID NO: 88498 - DNA, 312 bp, Glycine max
  Peptide Sequence Number=SeqID_180183
atggcgtgccatatggaggcggcgccgccagcggagagaaagagtttgcaggcggtggaatggcggcgacggggcggcggcgaggcggaaggtgagagaggggcatgggataggcgaggaagggaggcgtggacgagggagaagagccaaggtttggagcgagtggcgcagagtactccaagcatgggtgatggagggctatcgtgcgctaggtttgttggttgttatcctacgcacgttgttcaatcatcaatgcttccaattttacggctgttgtttttctccgcggttatttgcagtttgacatcatga

SEQ ID NO: 88499 - DNA, 1614 bp, Glycine max
  Peptide Sequence Number=SeqID_180184
atgggtgatccttatgggctaccggaggatctccggcggcttataccagccagaagtacccatttgaacccttcagacacacacctaattgaaccactttgtgttcaccatggtctcagtagtgctgttgctgctgctactgctagtgctactccacccatcacctatgacgccaacatggttggggacgttttcttccctcgtggtttcactcatcactttgctcatcaccatgactattcttcttcctctggcgtaaaccccgttgctactactgctactgctactgctactactactgtctcggatcatgcattctgcagcatggaaagtgcagagaaagggtggtttgggtttgattccgggaacaacaggtggcctagacaggagaccctttctcttctagagatcagatctcgtcttgattccaagttcagagagaacaatcagaaagcacccttgtggaatgagatttctaggataatggctgaggaatttgggtaccaaagaagtggaaagaaatgcaaagagaaatttgagaatttgtacaagtattacaagaagacaaaagaaggtaaagctagtagacaagatgggaagcactacaggttcttcaggcagctagaagcaatatgtggagatcaagcaaataacactcatgctcatgcctcaacttcagataaaacccatcgtgctggtggaaacactgctgctactattcaaaaacaaaccttcacaaccaaccaagaccacaataatggtgattctaacaataaccccaaatgctcagagagcctcagcatctcaaattcatctcaattcgagacatcctcatcagagaacaacgatgaggatctttcagctattgcattcatgatgaagcagtcaagggatgagaagcagaaagggttggatcatactcataggccaagtgatcataggagggtgagaaaaagctggagaacaaaagtggaggagatagtggattcccacatgaggaagatcatacagactcaagatgcttggatggagagaatgttgagtgttgttgagcaaagagagcaagagatggcatctagggaggaagaaaggaagagaaaagagtcaatgtggtttgaccaacaggtgcatgaactgtgggccaaagagaaagcatgggttgaggcaagagatgctgcattgatagaggttgtgaggaaacacattgggatagggataggacttgaagcattgccattggtcgaagaagaatcaccgaataagaataagagccagggaagtattgatgccaatgagtttccctctgagggtgttgatcctggtagaagtagtagtagtaggtggacagaaatggagatttcaaatttgatgcagctaaggactagttttgagcaaagattcagagaaaataataatgggtacatggagaatggggtttgggatgaaatagcagcaaaaatggcttgtttggggtttgataggagtgcaagtgagtgcaagcaaatatgggaagagatcagcatctctctcagaaggacagtggatgagtgtgatgatggtgcaaaaagaaggccttggtatttgggacttaagctgacggatgatgatctttga

SEQ ID NO: 88500 - DNA, 3261 bp, Glycine max
  Peptide Sequence Number=SeqID_180185
atggaggaaggggtggatgcagatgaagtggtgaggtcagtgagcagcttgaggatgagcatagggtctatgagcaggaggagttgggtttcagcaagtgtttctgagatgtggggtgctggacatggtggagatgtttttgaaagaagcactagagtggatgatggtgataatgatgaagaggagctcatgtgggctgccatagagaggcttccaacatttgagaggcttaggaaaagcatagtcaaaagggctttggaagagagtggaaggttcaattatgaagaggttgatatatccaatcttggttttcaggacaagaagaaactccttcatgccattctaaggaaggttgaagttgacaatgaaacatttctccgtaggataagggagaggattgatagagtcgctatagagattccaaaagttgaagtccgatttgagcatttgtttgtggaaggagatgcatttaatggaaccagagcactgccaaccttagtgaactccaccatgaatgcgatagaggtatccggaagagtcacttactgtggtcatgaattatcagaatttgttcctcaaagaacatgtgcttatattagtcagcataatcttcatcatggagagatgacagtccgagagacgttggacttttctggacgctgcttgggagttggaacaaggcatgaactactactagaactgataaagagagaaaagcaatcaggactcaaaccagatccagagatagatgctttcatgaaagccacagcagtggaaggtcaagaaacaagtctcattacagattatgttctcaaggttcttggattggaaatatgtgctgatactttggtaggagatgagatgaggagaggaatatctggtggagaaaaaaagaggttaactactggtgagatgttggtaggacctgcaaaagttttcttaatggatgagatttcaactggtttggatagttccacaaccttccaaattgtcaagttcttgaggcagctagtgcatgtcatggatgttacaatgataatctctcttttacagcctgcaccagaaacatatgacctttttgatgacatcatcttgctttcagaaggccacattatctaccaaggtccacgtgagaatgttctcaatttttttgagagtgtaggcttcaaatgccccgaaaggaaaggagttgcagacttcttacaggaggttacttccagaaaggagcaagagcagtactggttcgcaagggacaaaccataccgttatgtcagcgtgcccgagtttgtagctcacttcaacaattttggcattggccaacaactttcccaagatcttcaggttccttatgaccgtgccgaaactcatcctgctgcattggttaaagataaatatgggatctcaaaactagaactctttaaggcatgctttgcaagagagtggctactgatgaagcgcagtgctttcgtatacatatttaagactactcagattatgataatgtctttgattaccatgacagtgttttttaggacagaaatgagaagtggtcaccttgaagatgggagaaaatattatggtgcactgttctttagcctcactaatataatgttcaatggaatggctgagctttcattgactatttttagacttcccgttttcttcaagcagagagattcattattttttccagcatgggcttttgcaattcccatatggatctttcgaattcctctctcttttgtggagtcaggattatgggttgtccttacttattacacagtagggtatgctccagctccaacattcttctgctctcatcaaatgggtatgtctctgttccgattcattgctgctcttggaagaacactagttgtggcaaacacatttggtttctttgtactgctacttgtttatgtgcttggtgggttcattattgccaaagataaccttgagccttggatgaaatggggctattatatttctcctatgatgtacggtcagaacgccattgccatcaatgaatttctcgacgagagatggagcgctcccaacacggaccatagaattcctgagcccacagttgggaaggctcttctcaggattagaagcatgtttactgaagactattggtactggatttctattggtgctctactaggcttttctctgcttttcaacatttgctttataattgctcttacatttctgaatccatatggagattctaaatctattattctggaggaggagaatgagaaaaagggaactacagaagacagttctgcttcaactgataaatcatttgaaagcactgcaacaaccaagaggggaatggtgttacccttcaagcctctatcacttgcttttgatcacgtgaattactacgtcaatatgccaactgaaatggaaaaacatggagttgaagggagtcggcttcaactactaagagatgccagtggtgctttcaggcctggagtactaacagcattagtaggtgtaactggtgctggaaaaaccacattgatggatgttctagctggacggaaaactggtggttatattgaaggaagcatcagcatatctggttacccaaaaaaacaagcaacttttgctcggattagtggatattgtgaacaaaatgatatccattctccacgtatcacagtgtatgaatctattctgttttctgcttggctgcgtcttggtaaggaggtcaagagagagataaagaagatgtttgtcgaggaagttatgaaccttgttgagctacatccagtgagagattttcaagtaggccttcctggaatagatggtttatcaactgaacaaagaaagagactcaccattgcagtagaattggttgccaatccttctatcatctttatggatgagccaacctccggccttgacgctagagctgcagcaattgttatgcgtgctgttagaaatacagcggatacagggagaactattgtctgcacaattcatcaaccaagcattgacatatttgaatcttttgatgagctgcttttgatgaagagaggaggacaaatcatatataatggtcccttaggtcaacaatctcagaatcttatagcccactttgaggctttcccggaagttcctagaatcaaagatggttataatcctgccacatgggttttggagatcagtactccagcagttgagagtcagcttagagtagactttgcagaattctacacaaaatcagaattgtatcagttaagtgttgattga

SEQ ID NO: 88501 - DNA, 1059 bp, Glycine max
  Peptide Sequence Number=SeqID_180186
atggcgtcgataactggaccacagattctactgcactctggttctccatggttgaaacagacgatgaaaccctcgtcatcaccctttctcctcttcccaaaacacactcctcgtcgcaccttctgctccatcaattccaattccaagggttcgagttccatcgttcccgacctcctccattacctgaaccactcctggacccaattccacgccacagccgaagctaaacgacaattactcgccgccggtttccacatgctcgacgagaaccacgactggcacctcaagcccggcggacgctacttcttcacccgcaacatgtcctgtttggttgctttcgccatcggagataagtacaatgtgggcgacggctttcacgtgatagcggcgcacaccgacagcccctgcctcaaactgaagcccaaaacggcgtcctgcaagtgtaactactccatggtgaatgtccagacttatggagctggcttgtggtacacttggtttgatagggatttgagtgttgctggcagagtcattctccgaagtagccataattcttatgtgcataagcttgtcaaaatcaatagacccattttgcgcattcccacactcgccattcatcttgaccgcacagtgaaccaggatgggtttaaaccaaatctagagactcatcttcatcctttactctcaatgaagcctgaggacacttctttggaatccaactccaaggagaagaatagtgcattgtcatccaaagctcatcatcatcggctgcttatgcaggtactgtcagatgagttaaactgtgatattgatgacatagtgaatattgaactgaatgtttgtgatactcaacctagctgccttggaggtggaaacaatgaatttattttttctggaagattagataatctggcctcaagttattgtgcattaagggcacttattgactcatgtcaatctcctggtgacttagcaagtgaaagtgcaattcgaatggttgctttatttgacaatgaagagatgtcagattttgttccatttttgcttgccaacaaataa

SEQ ID NO: 88502 - DNA, 918 bp, Glycine max
  Peptide Sequence Number=SeqID_180187
atgtttatttatggcctttctcgtccctccacattgaaattctcaaaccaaaactcaaccctctccctcactgctctctctcaccaaatcaccatgcagaaaacatactctttctcctgcatatcctcttgtggaagtgatagtgcctgcttagaagctgacgaagttaacaatgaagattccatttccctctcccttggccctcctagtcagcacaaattcaaatccagagcctctaacccaaaacactcttctactatgcgtgatcatcagcaaaaacctagctccgatgacctgagtggtgtaacagtggccctccacattggtcttcccacccccaccgatgccaccaaaccttcttcccctccaattcacggtcgatattggatccctactcctcaacaaatcctcattggacccacccagttttcttgcacagtctgtaacaaaaccttcaaccgtttcaacaacatgcagatgcatatgtggggacatggatcccagtataggaaaggatcgaattcattgagagggtcaaaagcaggttctctaatgctgaggctaccctgctattgctgtgaagaaggttgcaaaaacaacataaactatccaaggtcaaagccactgaaggatttcaggaccctcaaaacacactacaagaggaagcatggagagaagccattcgagtgcaggaagtgtcacaagccatttgcagtaagaggagattggagaacacacgagaagaattgtgggaaactttggttctgcgtctgtggttctgatttcaagcataagaggtcccttaaagaccatgttcgtgcattcggcaatggccatgcttcacataacttgagtgaagaaagaggggacgaaggtggagatgatgacagtgaagtggctgtttttactttcaaataa

SEQ ID NO: 88503 - DNA, 759 bp, Glycine max
  Peptide Sequence Number=SeqID_180188
atgttgcagaggtttttgccttcagagtttgggcacgatgtggacaaagcagatcctgtggagccaggcctaacaatgtacaaggagaagcgattggttaggcgtgtggttgaggaatctggggttccattcaccaatatatgttgcaattccattgcttcttggccttaccatgacaattgccacccctcacagcttcctccacctttggatcaattgcagatatatggtcatggcaatgtcaaagcttactttgttgatggcattgatattggaaagttcacaatgaaagttattgatgatgtaaggacagtgaacaaaaatgttcattttcgaccatctaacaattgttacagcgtcaacgagcttgcttctttgtgggaaaagaaaattggccgtacaatccccagagtgaccatttcagaagatgatcttctagcagtagctgcagaaaattgcataccacgaagcattgtggcatctttcactcatgacatattcatcaaaggttgtcaagttaacttcaacatagatggacttggtgatgttgagattagcactctctatcctgaagaagcattcagaagcttggaggattgcttcgacgcctttgctattatgatcgatgacaagattcataaaggggaaaataaaattgccggcacagagtctgtagtggaagcagtgccattcaaagcttcctgtggagaagagccacctcctaaaaaatgttccaaatttgttgttaccaattactag

SEQ ID NO: 88504 - DNA, 369 bp, Glycine max
  Peptide Sequence Number=SeqID_180189
atggcaaataagcatgatgaaggatcagagacggtaaagagaacactgtctccatatgatctgagtttgaatgataatcctggaagtgtgatcacccaagtccaaacacagggtgtttatcaaggccgtgggagagacataagtgtgcgtgcaaatgctgcccagacttctaatggaggaacgattctgccagcgataaatacagacaagggagagctaacagatttgaaacttcttcatgagctgaaggttgtgaaaggatgtcctgtgggactaccaaatggagaacaagctgtcgcaactaaggaaggaactgtaactcttgaagaaggcctgaagcttatcaatatatgtcagaagaaatcttaa

SEQ ID NO: 88505 - DNA, 1067 bp, Glycine max
  Peptide Sequence Number=SeqID_180190
atggaggttaggggaaatgagcatggactcatagtagctgcttccattgcagccctcacagttaagcagctgaatgtgaatgacacaagatcagaacgcggtgaagcaaggattagaaacgatcaagatgaggctacagaagaggcgcaggtcacttgttctattgatggtcacaccgagaagagggaagaggaagagcaagaggaggttaagctaatcaacagcataatcaatcaaactgatgattttgaagatgatattctaccagaatttgaaaaacttctatctggggagattgattttctatcacttgatgagaagactgataaggagaagaaagggggagtttatgaaactgaaatggctaacaataccagtgaattagaacggttacagaatctagtgaaggaattggaggatagggaagtgaaacttgaaggtgaattgcttgagtactatggtttgaaggagcaggaagcagactttgtggagttacaaaggcagttgaaaattaagactgtagaaattgatatgcttaaaatgaccattaattccttgcaggaagagagggagaagcttcaagaagagcttgcacatggagcttcagccaagagagaacttgaggcggccaaaggcaagatcaaggaactgcaaaggcagatacagcttgaggctaaccaggcaaaaacccagttgttgttgctcaaacaaaaagtttctggtctagtgtcgaaagaagaggaggccgccaagaaagatgttgaaattggaaagaaattgaaagctctgaatgacttggaggttgaagttgtggagcttaagagagaaaacaaagaacttcaacacgaaaagcaagaattaacagttaaactcaatgctgctgaatctagaattacagaactctccaatgtgacagagaatgaaatggttgccaagaccaaagaggaggtcagtagcctaaggcatgtgaatgaagacttgcttaagcaagtggaaggactccagatgaataggttcagtgaagttgaagagcttgtatatcttcgttgggtcaatgcatgcttaag

SEQ ID NO: 88506 - DNA, 324 bp, Glycine max
  Peptide Sequence Number=SeqID_180191
atgacgctccgaagtctattatgcatttcttacgtgattgagaaatccttgaagagacataaacaatttgattttcctctcaacttgctgcacaagattaaagcccgtattgctttcgttgactttggatcaccttatatttctgccataatgttgcttcccaagatgcgtattcatgtttcctgggagctcaaccttcatcatgtgatctttgagatggactcgcttgcggtggttcacattgttccccgtggttctttcatatcagccttgttaaagccattgttcaagggtattttgaatcagcttttgatgagagtttga

SEQ ID NO: 88507 - DNA, 1173 bp, Glycine max
  Peptide Sequence Number=SeqID_180192
atggtatgccgcagttgtgtaaggtctttggttgttcaagctggaaccttcgccaacagagtgagaatcaacggatttgggaggagtttgcaggcagttcagagtttttctcattggccaattcgtgaatacaagacaaccacaaggatgatggttgatacgggttctatgtcaagggctggaccccttgttgatacgatgccagagaaagatgatgatggtcggtttgccagtggagggtggaaaagtgacgatggaagacttagctgtgggtattcaagttttaggggaaagagagtgacaatggaggatttttatgatattaagacattgaagattggtggccaatcaatatgcttatttggaatatttgatggtcacggtggttctcgtgctgctgagtatttaaaggagcatctttttgataatctcttgaagcatccaaaatttttgacagatgccaaattggctataagtgaaacatatcaacagactgatgctaattttctggattctgaaaaggacaccttcagggatgatggatctacagcttcgacagcagttttggttgataaccatctttatgtagcaaatgttggagattctaggactataatatcaaaagctgcaaatgctctctctgaggatcataaaccaaatagaagtgatgagcggaagagaatcgagaatgctggtggtgttgtcatgtgggcaggtacttggagggttggaggggtgctagcaatgtctcgtgcctttggtaaccgtatgctgaagcagtttgtagtagcagaacctgagatccaggtgatccttgattactgtttgcaacctgaaagattgtctattcgagttgcgacttctacagttctacctctttctgggacatactatgctccaaggaaagtagcccaatatggaccgagtagttggaaaaaaggaacctgtgagacattatgtaacatccaattctccagggtgcctgatgtggatgctgtttctcttgcccgcacggaagaggagcctgaggcagctgcacgaaagttaacagaagcagcattttctcgtgggagtgcagataacattacatgcattgtggtgcaattccaccatgagaaagcagaactagctaatcctgacaaagcagaagcagctagtgctcagcatgagtag

SEQ ID NO: 88508 - DNA, 237 bp, Glycine max
  Peptide Sequence Number=SeqID_180193
atgggtgccaagcacctcacaaggaccaaagaaaggtcgcatgtcatcaagcaaaggtccccggacgaaattaggagggtacatcctttgtggatcagttcaagtggaaggtacatccacttggttgttcaaagagaacaagggagggtacatcccttgtggatctttgcttgtaaaggattttacaaggttgaaagaaatctcaagaaccggtggttgcttggggactggatgtag

SEQ ID NO: 88509 - DNA, 219 bp, Glycine max
  Peptide Sequence Number=SeqID_180194
atgacacttcaaggagaagatgagtcaagaacaaactcaccaccaaaggaagccatgcataagagcttgaaggtaggagaagatgagtggaaggagagggagaaaggggggcacgaaatttatgcatcaaatgagctatggttcagcccactaatccaagatcaagtccaagattctcaactaagtgtgcttaggtgtcatgaggcatgtaaaacatga

SEQ ID NO: 88510 - DNA, 231 bp, Glycine max
  Peptide Sequence Number=SeqID_180195
atgtacaaagataattggacccaacattggcccatgggctcagaaatctaccctgaggttcatgagaaccctagagccttcttcagcagctctagctcaatcttcttggagcctcttgctcatggttctagtgactggtcccttcctagggaggattgcatcaatctattcttgtttgtgcttttagaggaagctatgaaaattgctaaggatgaggatggacttgtttga

SEQ ID NO: 88511 - DNA, 382 bp, Glycine max
  Peptide Sequence Number=SeqID_180196
atgatgataacaaaagatgatgacaaaggtgatgaaaaaaagctcaaagatcaatcaaagatcaactcaagtaaatcgaagatcaatcaagaagaattcaagactcaacaagaaagtctagagtcaagaatcaagattcaaggttcaagatctcaagaatcaagatcaagattcaagactcaagattcaagaatgaagagaagactcaatcaagataagtacatctacttgggtttgactgagaacaagagagggtacatctcttatggatcagttctagtggagggtacatccactagggtttcaaagagaacaagggaggacatgaacgtgagaggtctccgagtgatgcagagaggagctgatggagggatatcaatgg

SEQ ID NO: 88512 - DNA, 324 bp, Glycine max
  Peptide Sequence Number=SeqID_180197
gaatttaaagatgtcttttccaaggagattcctcatggactgccaccttcaagaagcatagaacatcaagttgatctccttctagaagcttcattgcctacaagccaacttacaacagcaagcccagagactcagcataaggatgcacaggtcaaagttgagtatgtgaaaagattgtatgaccaagtgaaggagggaatgatgagaatcatgaaactggccaaatacaggctaaaggcccaagtggagaaggacgaaagcctaagtggagaaggacaaagcccccgagtggagaaggatgaaggcccaagtggagaaggatga

SEQ ID NO: 88513 - DNA, 1336 bp, Glycine max
  Peptide Sequence Number=SeqID_180198
atgacccgctcttccccttccgcctcgccggtaatgcggctgatgaattgctacggcggctcgcttaaccagtatggtacctacagtacggcgcagatcgcctgcgccatgccctatacctacggtagcaacgacggcaacagcacttcggatattgaaaacagtaaactggtggtaatgttcggcaataacccggcggaaacccgcatgagcggcggcggcattacctggtacctggagcaggcgcgtgagcgctctaacgcccgtatgattgtcatcgacccacgctataccgataccgcggccgggcgcgaagatgagtggatcccgattcgtcccggtaccgatgccgcgctggtcgccggtatcgcctgggtattgattaacgaaaacctggtcgaccagccgttcctcgataaatactgcatcggctacgatgagaaaaccttgccggccgatgccccggccaacggccactataaagcctatattctcggccagggggacgacgctaccgccaagacaccgcagtgggcctcgcgtattaccggtattcccgccgatcgcatcattaagctggcgcgcgaaattggtatgaccaaacccgcctatatctgccagggctggggcccgcagcgccaggcgaacggcgaactctccgcgcgcgctatcgccatgctgccgattttaaccggcaacgtcggcattaacgggggtaacagcggcgcccgcgaatcgacctataccatcaccattgagcgcctgccggtgctggagaatccggtaaaaaccgccatctcctgctttagctggaccgacgctatcgctcgcgggccggagatgaccgccacccgcgacggcgtgcgcggcaaagagaagctggcggtccctattaaattcctgtggaactatgctggcaacaccatcattaaccagcattccgacatcaataaaacccacgatatcctgcaggacgagagtaaatgcgagatggtcgtggttatcgaaaactttatgacctcgtcggcaaaatatgccgatattctgctgccggacctgatgaccgtagaacaggaagatatcatccctaacgactatgccggcaatatgggctatctgattttcatccagcccgccaccacggcgaagttcgaacgcaaacctatctactggatcttaagtgaagtggcaaaacgccttggcgacgatgtgcatcagcgcttcaccgaaggacgaactcaggagcagtggttacagtatctgtacgccaaaatggtcgccaaagatccggcgctgccgggttatgacgagctcaagaaaatgggcatttacaagc

SEQ ID NO: 88514 - DNA, 510 bp, Glycine max
  Peptide Sequence Number=SeqID_180199
atgcattctgaagctgaagcactagaacatacgaagaaaagagatataggtcatcaaagtgtgtcattggagaatatgacaagagattcaactgtgctgaagataggagattcagttaaagttgtgataaaacaagacatgaagggaagaaaacataaatatgggtttaacaacaataaacgtgagaagacagagaagaaaaaggtgatggatgatgaaactggcgacaaacatgagctgtatatgttggaccttgtggcctcaataatcttaagagggataggcttagaatgcaaaattgattgcaataacataaatgagataagggaagagagaatgcaaacacagttttatactggttcggccacttcccgtgcctacatccagtactcaagcaacccacttgagatttccactatctttgtaaatcctttacaaagtctgaaccacacagggacaacccatcccttgtgtcagatgctttacaacaagagacttacagtctcttaa

SEQ ID NO: 88515 - DNA, 351 bp, Glycine max
  Peptide Sequence Number=SeqID_180200
atgcatctcactgaaacatgtatgcaagtggggaattctgatatctatggattcctcgagccacagtccattcagaggtctgggcaatcgcaatttgaatctgaaagttacataaagagttggatgcagatatcttggagcctacctaaaagggttccactgcaacggacactggcagatggtggtcatcctgcccaaggaacacctagttgtctgcctaaatcaaaggcttctgctaggtggattgttgtcaagtgtaatagacaaaaaggaagtactaagtgcggctactatgtgatgcactggatgtccaccatcattttaggaacttttaggaataattgggaagcg

SEQ ID NO: 88516 - DNA, 168 bp, Glycine max
  Peptide Sequence Number=SeqID_180201
atgaccaaacttggtctctgcttgtcatcgggcccgccgcctctggatgacaaaagggtgcggataaccggtcagtatgacaaagattatggtgcggtcgacaaaagcaaggctcttgctcctacgtatcctccaatgaggaactcagacctacgtagttctggatag

SEQ ID NO: 88517 - DNA, 294 bp, Glycine max
  Peptide Sequence Number=SeqID_180202
atggatttttacaaggttgaaagaaatctcaaggaccgcaggtcgcttggggactggagggctaagttatcgtactatcacgaggaatcggggtgcgataagttagttgtgtatatgtgttttaatgcggtcctgattgagtttagtcttacaagaggaatctgcagacgatgcttgatcaggattaggctaaactatcatgaggaatcagggtttagtatcttaggagacaccataagaacacatgggcattgttggatagagaatatcttttcagcatcaggcacctattag

SEQ ID NO: 88518 - DNA, 519 bp, Glycine max
  Peptide Sequence Number=SeqID_180203
atggctctcactcttatccaaaagaaagaccaaggtcaaggcatcttaggggtgacaccttctaagcccaaatatgataaggggaagacaatagaagagcaaccccttaaggctagtatgcaagagaagactagctccatgaagtgctttaaatgtcttggaagaggacacattacttctcaatgccccaccaagaaaaccatgattatgaggagccaagaaatttatagtagccaagatgaggctactacttcaccttcctctagtgaaagtgaagaagcaaaagaggaagaatctagtgaagaaatctacccccaagaagaaggacaacctttaatggttaaggaggagtgtaaggaggtaagtgtctcctccaagaggttagctaagaaggaaaggcattttgaaataaagacaaatattaaagaaatttcccctcttagacaacctccacattttctcctttgtaaaaagacacttgttagcaatcgaattcctgcagcccgggggatccactag

SEQ ID NO: 88519 - DNA, 495 bp, Glycine max
  Peptide Sequence Number=SeqID_180204
gaggatcctgaagtagcaaagtttagagagcaaggcctcaaattcttacttgagatggaattcctttttaaagattcaagacaatatgaaggattcaacacaagaacagaagagacaaataataacattgatgataacactgacatggaagtgaatgagcctgagatagacacgacaactcagaacacgtcttcggcaaaggaaaatggacagaggaagagaggaggagagggtgataaaagaattggggttggtgccaagctttcctcacaattagatcgtattattcaaacatttgaatctagtgtatctgctcaagacccaactagcattactgcatgtgtagcaaagttgaaagatctaccaggacttgagcgtgggagtgaactattttacaaagccactaaacttatgaaaaaaagggcaaacaggatcacctttgttgctttagaagagcctgagctacaacttggatggatcaagtctgaaacttaa

SEQ ID NO: 88520 - DNA, 405 bp, Glycine max
  Peptide Sequence Number=SeqID_180205
atgaagaatagtgaagaatcttcacgaaatcgctcacggaaacatctcagaagcgttacagaagcacctcggcttggttttttttcacggaaatttttttcctcactaatttcgagagaatcctcaaataacagaagggctgaacaatttaccgccttctgttggaaccccttggaaggccaagagggcctgaatgttgcgaaactttacggattacgccacgatgctctttttgacttctggaacattgcgaaactttatggattacgcaacaacgctctttttccttccggaatgtcgcgaaactttacaaattacctaacgacgggtgttaagtaccttgaagcggtcaagcaaaggttgcatgccaccaaacaatggtccccgaacgaaattagggtataa

SEQ ID NO: 88521 - DNA, 711 bp, Glycine max
  Peptide Sequence Number=SeqID_180206
atgacattgaccatcccagagcttttcttgaggccttatcaggttagatgggatgccaccgtgttcgaggttgttaatccagatttccccttgtacataaagcacaaagacctctccgaaatcgcacacgatggtcaatgtctcagcatatcagtgttacagttgtggattctgcatctcactgaaacatgtatgcgagcagggaattctgatatctatggattcctcgagcctcagtccattcagaggtctggacaatcgcagtttgaatctgaaagttacataaagagttggatgcagagttcacaacgcgatgtgtatcttggagcctacctaaatgggttccactgcagtggacactggcagatggtggtcatcctgcccaaggaacacttagttgtctggttttgttcattgcataacaggccagacaactaccttaaggggattattaatagtgctatcaaggtcttgatgatgctccatagcctaaatcaaaggctcctgctaggtggattgtcgtcaagacaaaaaggaactactgagtgcagctactatgtcatgcactggatgtccaccatcattttaggaagttttagaaataattgggaagcgtattttaacgaccctagaccattggagcccgagagattaaaagcattgcggattcagtgggcacaattttatctccgagttagagatcaggcctag

SEQ ID NO: 88522 - DNA, 255 bp, Glycine max
  Peptide Sequence Number=SeqID_180207
atgggtaccccggggctcctccatgataagcacacgttgcatttgagtcgtatccttggaaaaatggaggttgaggaaccttggctggggttatggcaaccattgaattatcgagtagatatgggagcaagtcagcatagggtacctgttagtcggttaattaggcaagctttgaaaaatgttgtttttcacattctcgctaagccaatctgttggcttagcgagtgtccgctaagcgtaacactcatgggctaa

SEQ ID NO: 88523 - DNA, 510 bp, Glycine max
  Peptide Sequence Number=SeqID_180208
atgggacctctccaaatgcaagtcttctgcaaggcgtacagaaagattttagatttgaccatagcagagatatccacagaagccattgtatcactcacccaatactatgaccagcctttgagatgcttcacgttcggagacttccgattagtacggactgtcgaagaatttaaggagattctaggatgtcctcttgggggaaggaaaccgtatcttttctccgggtttcttccctccttgagcaagattgcagttgtggtcacccccttcggcaagagaattggatcgcgccaagcaagggatatggcgaatgaagaggagtgggtcccatttatggacgtattagcattgctaatctttggggttgtcctctttccaaacatggatggtttggtggacctagccgcaattgatgctttccttgcatatcaccatagcaaagaaatcccggtagtggctatcttggcggacttatttgacacatttgaccgaaggtgcgacgaagagtag

SEQ ID NO: 88524 - DNA, 838 bp, Glycine max
  Peptide Sequence Number=SeqID_180209
acaactagggtaccccatgaggggagcgccaaccgaagaaagtctttcgcctttcctggtgaggaatctaggcgcacaaagtctcaaggcgatacaaagagtccacaaggcgtggagaagtccgttgaggaaagacaaggagcttaggggcatccgtaatggcgtcatcggaggttatcatggatggctaagaattcatacgtgggggttagattggctctccaaattgaaagttatcgatgaggagaacttcgaagctctggaggaagatgaagaagtccgagctctaaaactagagctagggaaggcaagactcgccaatgagaagttcaaatcagctgctacacacatccggaaggagtgcaccgagttacaagaggaaaacgcggccactgcaagagcccttgaacaagaaaccaaaagggcccgcaaggaggaatatggccgagagaaattccgaggagcactgtggggtccaaaaggagtttggctcaacactttggaagccacggagcaaagcatgctagctatcacagggcaatacaaggaagaattgaaccagtccatggcccatgaacaaaagctagtggaggattttgcacaagtgtatgccgaaaaaaaagcaaggcggagggtgattgatgcactgcatcaagaagcgactatgtggatggatagattcgccttgaccttgaatggaagtcaagacctcccgcgtctattagccaaagcaaaagccatggctgaagtgtgtactgcccccaaggagattcatgggctaatcaattactgtcaacacatgatagatttgatggcccatataattaggaatcgttag

SEQ ID NO: 88525 - DNA, 738 bp, Glycine max
  Peptide Sequence Number=SeqID_180210
atggatgagaagagaaagaaaaaactagaggaagctactcaattcggaagcactgacaccatcattgatcctccatctcccatcaaacgacacgtgaagtggaagctagcccgcaccaagaaaactagtgacatgacatatgaagcagcaaaggaaattactgacaagattgatgcgcttgaggagcaggcctcacagggttcctttgttacccatggacgtcatgatatactggctgctgccattaggcgaccagaacaccctgttcgtgtgcatgctgtaggagccggtataaccatcaagcaatactttggatcagcttcaaggacctcctccattgctcccgaatacttgcaacagttgacgcaacaaatcaaggaccaactagaggattcaatcacagaaaaagtcactcgacggctaatgttatccctcagccaaatgcaattacagggactcgcactgcctcctgaacctgatgttggtccttcagctgctcgtgtcagcacaaaggagagttatgttgatccctcagggaacgatccaaacaccgatgactcatacaaatgcgggttgtatattgaagaatatccttctcgcctggttgccctaggaagagtttatgagggatccacaaccattcacaacattcatttgctgcatgatcaagtcaaggttggtgttgaggagattagagatgcagatgctcccattcctgtacccactaaagaggttaag

SEQ ID NO: 88526 - DNA, 2181 bp, Glycine max
  Peptide Sequence Number=SeqID_180211
atgaaacagcaaaccgcccgtcagcactggctttcggtgctggcgcacagtgaagccagcgcgctggccagccactggcagtcgctacagcttacacccgccttcgagcgcctgcgcccggcagaaaccggtttaacccgactgcaggcgcgcatgggcggcagcgggaaacgcttcgtcatgggcgatgccaccgtcacccgcgcggtgatcagactgcacgacggcacgctgggttttagctatgtgctggggcgcgataaggcgcatgccgaacgctgcgcgctgattgatgcgctgctgcaacagccggaaacccaggcgctgctgcaggaaaaaattattgccccgctggcggcactgcgtgaagagcagcgccagctgcgcgcgcgggagatcgccagctccaaagtggatttctttacgctgcgcgccttccgccgcattctcaaagcgatgagcgagccgggcgtgatggtctcgctgccgctggcgcagggctggggcgatctctccccggccgcaacggcggtgctgctgacgctggtcgatcaggagagcgcgctgtggctggatcgccgcgtggacagcgatatcctgcgcagcaacctgcgctttcacaccggcgtaccgattgtcgatgagcgcgatgccccgtttgcgctgacccacgcggcggccaatcccgatcccgcctgcttcgctgccggtgacaatctgtcccctgagaagagcaccacgctgattgtcgaagtgccgtcgctcaacggcgggctgacgctgcgcctctccgggcccggcctgcgtgagccgcgcgccatcgcgccgcaactgccggccgccattctgacctatctgcgtgagcgcccgcatccgttcccgcagggggtggatctgattttcacctgcggtgaagcgatgagggcgctgccacgcaccaccgacgtggaggcgattgccagcgcccatcagctgcaggccgatatgcgccgtggcgatcgcagcgtggcggagctgggctgcggccaggtggcgcaacagctggggctggcggtggaccgggtgatgaccgaaggcggcatctttgacacacagctggcggccttagccatcaaacaggccagtggtgatttggtcgaggcgattttcctgctgcgcgcctaccgcaccacgctgccgcgcctcgcggacagcctggcgctggaaaccgcggaaatgcgcatcgagcgccgcatctcggcggtttacaaagatctgcccggtggccaggtgctgggcccgacctatgactacagccaccgcctgctggattttaccctgctggccaacggcgaaacgccggccgccgcgcgtgacgatcaggcgctggcgcagcgttgcccgcatgtgttcagcatgatgacgcgtgaagggctggctgcgcgtgaagaggatgacggcagcgagccgtgtgacatcacgcgccagccgccgggttatccggcgtcacgcgccgcccgcttacagcagctggtgcgcggcgacgaagggtttctgctggcgcttggctattcgacccagcgcggctatggccgcaaccatccgtttgccggtgaaatccgcaccggctatctcagcgtgtcgatctgccccgaagagctgggttttgagattgaaattggcgagatcctgctgaccgaatgcgaaatggtcaacggcttcaccacccaaggcgacagcgcgccgcactttacccgcggctatggtctggtgttcggacgcgcagagcgcaaggcaatggcgatggcgctggtggaccgtgcgctgcaggcacccgagtatcaggagcgcattgccgggccggcgcaggacgaagagttcgtgctgtcgcacgccgataacgtcgaagccgctggctttgtctcgcacctgaaactgccgcactacttaaccggctacaacaacggctacctggatgagcagaccaaacgcaccatccgccgcgccattctgaaagcggtcgcgatccctggctatcaggtgccgtttgccggccgcgaaatgccgatgccgtatggctggggcaccgccggcatccagatcaccgccagcattataggcgacagcgacgtgctgaaagtgatcgatcagggcgcggatgacaccaccaacgcggtctctatccggcgcttcttccagcgc

SEQ ID NO: 88527 - DNA, 303 bp, Glycine max
  Peptide Sequence Number=SeqID_180212
atgaccggtcacgattggtcacatatcatttggctcttacttgtaggttcaagtaggcaaacactaacccataaggaaggaggggacatggttagctcgcctgggcaagctgagctcgcctgggtgagcaacccctgcacccaaattataaaaaaacgagggaggggaacgcttttgcatccaaaaacttccccccctcatttaaaagaaagaacacgaaggattgaggttcttgctccctcaagccacttccggttgccttttgctttcatttttggtgttattattcactccaacaagtaa

SEQ ID NO: 88528 - DNA, 81 bp, Glycine max
  Peptide Sequence Number=SeqID_180213
atgaaactatcctcatggttgtgcgcggccctgctgctgagttcggcatccgcactggcagcgccggactcctgcgagcgg

SEQ ID NO: 88529 - DNA, 858 bp, Glycine max
  Peptide Sequence Number=SeqID_180214
atggtagttgcagacatagctatggtagttgcaaacatagcttgcttcttgctaagagggcctagttgctgggacaggactaagtcctctgatcgcgtgttcgaggtgacaatcacgctggacaacgtctcgtctcttctgcatcttcccgtggttggcgacttgcatgcctttcagcccttgcacgtggatgatgcggtacagatgttggtggacttattgatggtctctgcagaggctgctaggactaataaagggaagtgtcgtggaccgtacgtacgcctaaaatggaccgggaagtacgcctggggagtagctgcactagtccatatgtacaaccacctcaacgatgcttctatcagcaccagccgacagcttggcggttacatcatgttgcttgttggatatacgagcactttccctcaatcacggagtccactgctgatccggactacgacgaggattcaccgcatgcctggagcacctggaccgactccggattctggattccggatgtctgttggatcccatatggggagcaccgatcgggtcatgcggcaatttggatacacccagaccattcctgctccgcctgtcgattcatgggtgtcgtatgatgatatacacgacgggtggatgcactattcagatcatatggttgtagcagagacaaatatccctcacgtgccgaagccaggagcaccatcgacatctgcaaggcccgttgtggatgagcctagacatgcaatggtaaaagtttgctatgggattgctgagaggttggagcgccatctgagcctaggggtggtcacgccaggctcatcgacacatgaggtgatcgaagaatgcctcaggatg

SEQ ID NO: 88530 - DNA, 510 bp, Glycine max
  Peptide Sequence Number=SeqID_180215
atggctcgcacatatcttcttcaccttctgggttgcactctgtttgctaacaagagtgcaaccaatgtccatgttgtctacttggaggcccttcgtgacctcaatatgacggagaggtatgcttggggagtggctgctttggtgcatatgtacgaccagctgaacgatgcatctgtgagccacaaccgacagctcggcggttacatcacactgttgcagcactttccgtcggtcgcggactccactgctgatcaggagtacgacgaggattctccgcgcgcgtgtaggtggattacgaccaagaagatcatgaagagcattcgtacgccggcgtacagggagcgcctggatcgactccggattccggatgtctgttggatcccttatggggagcaccgagaggtccgggacttccacgtcagatcatgctattccggtctcttgcgctgggggcctgttgttgtttattaccgaccggaaagggtcgtgcgacagtttggctacacgtag

SEQ ID NO: 88531 - DNA, 330 bp, Glycine max
  Peptide Sequence Number=SeqID_180216
atgcgaggcgtgtggggccgaaacaagttccgaggggcattgtgggacagcaacagcaagctcaagcttcgaagggctgagacagaccagtcgagagtagaaggtatgatattagaggacaagttgaaggcttgtcaaaggtcaaagaggagtttgtccgaacaattaagtaggacggaagaaaacatgtgggccatcattgaccaatacaaagagaagctaagtctagctgcaacccatgaacaaaggctagaggacgagtatgcaaaggtatcggtcctgcaagcaaaaagggaaacaagagagagagtgatcgattcattacactga

SEQ ID NO: 88532 - DNA, 405 bp, Glycine max
  Peptide Sequence Number=SeqID_180217
atggcatttctaggagaaactaacagtcagacgattgtcaactcaaggttggctttcatttatccaaatggatcgattattcacaatgatactggggtttacttccaaacttcaactccggtgcccattcgagtaccaaataggtgtcattttgcaagcctaaaaaccagaatacacaatacccttcagctatccgacaaacaatttttggatgaaattcactaccggaagccattcaccgatacaggaaaaaatcctaagaaatttgaaattccttcaacatgtaccatcgatgaactgaagaatttaatcaagcaagttgcacctaaagggattccccctcttggaatttcacgaatcacaaacggtaagacgattgtttttccgccaaccagctcggtttga

SEQ ID NO: 88533 - DNA, 369 bp, Glycine max
  Peptide Sequence Number=SeqID_180218
atgtttgcacattcgattaaaggctgtcgtcccttgggacggacgtgtggggtgctaataccttccccgtgcgtaaatacaactcccgaaccatttcacttaaaagttcgtagatcgcgtcttttccggtttttccgacattttcctcaaataaacgttggtggcgactccgcgcgtattcctttcatggaacacgcatcccgcgagtcacgcgtcgtcctcccgccgaagggtgaattcaagaaaacaaacaagcaaaaagcaggaattttgaagagcaaaattagagatactaggctgcctccttggagcgcctctttaacgtctttagccgaacgcgagataatgattgatcgatcatgggcctag

SEQ ID NO: 88534 - DNA, 264 bp, Glycine max
  Peptide Sequence Number=SeqID_180219
atgacagacattgtctgtgcggagaattacttgtgtatctccgcacgtcacctagcttcacgggtcagtatgacagacaccgcggaagacgacgtaaatctccgcgtgttaacgggctcgttggccgcgattgacaaagggtgcagaagagaagacgacgtgtctccacatgctagtggactctcgggtcactggatagcaaagggtgtgtgtgggttaccgtcgggtgtctccgcatgccatcgaactcttgggtcacggtag

SEQ ID NO: 88535 - DNA, 336 bp, Glycine max
  Peptide Sequence Number=SeqID_180220
atggtgataacaaaagatgatgacaaaggtgatgacaaaaagctcaaagatcaatcaaagaacaactcaagtgaatcaagaacaattcaaggttcaagatctcaagaatcaagattcaaggttcaagatctcaagaatcaagatcaagattcaagaatcaagagaaggctcaatcaagataaagggtacatctacttgggtttgactgagaacaagagagggtacatctcttgtagatcagttctagtggagggtacatccactaggttcaaagagaacaagggagggtacatcccttgtggatctttgcttgtaaatggatttttacaaggttga

SEQ ID NO: 88536 - DNA, 144 bp, Glycine max
  Peptide Sequence Number=SeqID_180221
atggcggaggtctccacggaggccattgcatccctcgctcaatattatgaccagcctttgaggaattggaccgaggaaagcaagtcaaaaatggggtggttggagtactcttctaaggcttttactatgttgttaagagaataa

SEQ ID NO: 88537 - DNA, 615 bp, Glycine max
  Peptide Sequence Number=SeqID_180222
gagtttaatccttacaatcattatgaagaagaaagagctcttgatcttgaaagtgtgtttgaagaattcatggcatatcatgctagctctaaagctaatcaaaattcaatgcaaaatcatgagattcattttggcaaaagctattctttagaagattatcaaagggaagaagagttacaaacctactatcaaaaggaggcagaaagagaagtgactcaagctgtgggcagaagagaagaagaatttgtagaggttgaagctcaagagaaaagccttgtaaatgagcatgatttaaaagaagaagataaagagaaagtgcaacaatgggagcaatgctcacaagtacacactcaacaagaaaataatctccaagttaacacatttcctcatcaactgattgtcaaagaagaaaggcatgaagaccatgaggttccaatcattctaggacaaccctgtctgtcaactgctagttgtgtattagacatgggtaaaggtaaattggaactaagtgtagagacattggagctaagtgtagatcagaagatctcctttgatttatttgaagcaatgaaacacccagatgatagtgagcatgttttgaagaagaaacgttga

SEQ ID NO: 88538 - DNA, 294 bp, Glycine max
  Peptide Sequence Number=SeqID_180223
atgcatgctttgttagggtcattcaacagtggaaactggtctgactctaaagtccttgatagtgcagggctgagttgtcgtgctttcgcgaggaatcagggtgcgataagtcagttgaaagcaaagcttcatggtgaatcaaagaacaattcaagagttcaagataagaatcaagaagaattcaagactcaagaagaaagtttagagtcaagaatcaagattcaaggttcaagatctcaagattcaagaatcaagagaaggcttaatcaagataagtatgaaaagtttttctaa

SEQ ID NO: 88539 - DNA, 240 bp, Glycine max
  Peptide Sequence Number=SeqID_180224
atgcttcactcccctcacaaagatgactatacttttctggattttaatcccatttttcatcacttgcaccaccaaagcaatactcctccaaatttggcgcaccaagctgaccctacttcccgtcctagacctgtggcgtcaacagacccacctcagcccactcactcctctactttcggtactgtcacattgcatgctcttgaccaacatcctggttcgcccccttctttccctatgtga

SEQ ID NO: 88540 - DNA, 228 bp, Glycine max
  Peptide Sequence Number=SeqID_180225
atggtctcatcaaactttctttttcccgaagggaactctattaataggcctcctatattcaatggtgtgggttatcattactggaaaacccgtatgcaaatcttcatagaggctatagatttaaacatctgtaaagccattgaattcgatccttacatccctactatggtagcaggaaatgttggatcgagtggcctcagaataattaagaagggggggttgaattaa

SEQ ID NO: 88541 - DNA, 210 bp, Glycine max
  Peptide Sequence Number=SeqID_180226
atggcttccaatggtggtgagcttgtgcttgactcatcttctcctttaagtggaatctccaatcatctttcttccttctccattcagctgccattgaacatcaagaagcaaaggactccattgatgaagaagatccaaggcctacaagctccacatggagctacatcatgtggtattagagcatcttcgtctaggttcttcttagagtag

SEQ ID NO: 88542 - DNA, 507 bp, Glycine max
  Peptide Sequence Number=SeqID_180227
atgaaaggaactttttatccagaactagtcaaggttttctacacctatgcatgtgttgaccttgaaggtaaccttttctccattgtaaatgaagtagatatggtcattgatgctgctatgtggaaggaagtagttggtctggacatgggtgaagaacttgatgaatcgcttaggagttggtggactgactgcataagacaaaatgttggtttacctcattacctaaattctcactctgagatgaactgggtactactgattaaaggcattatgctgaagagtcatcgtctggtggattatgaatttccttacgctgtggttgcctcaaaattcattgactacttcaatgttgatgtctctaatgagattgtagactttactgaagcctctagtgagaatactaaaaggcatctcaagaagcttgaaataaagtttgttgatcatgaatggataatgactagacagtcgacagctggaaactttaaccagatggaagatgttgctaaa

SEQ ID NO: 88543 - DNA, 153 bp, Glycine max
  Peptide Sequence Number=SeqID_180228
atgacaaacctgtggctaagcaagtgctatctcgctaagcccagatggcaaccaggaaaagaaaaagctcagcttccaaacctcaagctcagtatgatactaggcgattccaatctttggaagcttggaatagatacacgggcaacattctag

SEQ ID NO: 88544 - DNA, 321 bp, Glycine max
  Peptide Sequence Number=SeqID_180229
atgaagaaacaacaatggaggagaagattcagcggaagacaaatgagaagaggtgagaggaggtgccatccactagggaataagccatggaagaaggagcttcaccaccaagaatgtgtcttggataagaagcttggagaggatgcttcaatggaggaaaagaaagagagaaggggggagcacgaaattgaaggaataaaagagggagagaagtggaactttgaagtgtgtctcataagactttcattcatcaaagttacaataagtgttacacatgcttctatttataaactaggtagcttccttgagaagctttcttga

SEQ ID NO: 88545 - DNA, 204 bp, Glycine max
  Peptide Sequence Number=SeqID_180230
atgaagacaaaaactcgcagcagaatcactaacaatatagtaagtgaaattgagcaagaggctccataccaagatgatgagcttgtagggcttcaagaagtgttggaacttaaccctaatgtcattaatgaatctcttgcggatgttgatggaggtggagaaaatttgatgaaccactccaagttagttgaaggtgttagttga

SEQ ID NO: 88546 - DNA, 642 bp, Glycine max
  Peptide Sequence Number=SeqID_180231
atgggatcaagtcaaaagccttcgtttaaaaagaggttctatcaagtcaaaatcaagagcttagaggtcactagtttacgagagttggggcaattaatgggtcaacttcaacggcaagccttccgcaaagcctatgccgttgaggtgcttcatctttggggacttctagctatcaccaatggaattagaccgccaaaggcaagtcgaaaatggggtggtcggaataccgagaaaatatttggagcggtcgacgtttttctcgcctatcataaccacaaggaaagtccggttgtcgctatgctagccgacctatatgacaccttcgaccgaagatgcccgtctatccgctacaaggttaccgctcgtgcgtcgaaaaaggaaaggcgaattgggaccaactcttggctagcatgggggggcgacagagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagctctaaaggcagagcttgaaagagcccgagtagtcgaagagaagttcaagtccatagccatcaaagtctga

SEQ ID NO: 88547 - DNA, 1014 bp, Glycine max
  Peptide Sequence Number=SeqID_180232
atggccaagttcgaccccgagatagtcctagaattctatgctaatgcctggcccatggcggagggagttcgggacatgcgctcgtgggtgaggggtcagtggattccctttgacgcagatgccctcagccagttcctgggcgacccgctagttttggaggaaggccagcagtgtgagtttagccagaggaggaacagggccgacgatttcgatgaggaagccatcgcccaactgttgtgcataccggggcaggatttcacccgaaccactgcagggaggcgggtgcgaatcatgcgcaccagcatgaccactttgacccagacatggataacactgctggtcagcaatgtcttgcctagtgatcacaattctgacctccctctacctaagtgccagttggtgtatgccatcttgacacggatgagcgtcaatgtggctcaggtgattgctgatgccatttatatgtttacaggtatggcgcctactaggcaccctctagacccagataagtccaacagggccctggggtttcccgcgctgatcacgggcctctgccagtcctacggagttcccgtcacccacagtaaggtaatccgaccgccgatcacccgagccttcatcgagaagtactgcacgcctaggcaggcacagggtgatgcacatcaggccgcaggcgcaccaccaccacctcggcaggccgatccagctgggccactaggcgtggagcgttatctagagcatttggtttgccagcaggcagccaaccaccgtgggcaggtgcagatacatgagtgtctctaccggttcagcctcagtcagcacgagcagggttccgcccgttttgtatgccctaccccggagcagtttggggctgaggtcgcatggcctggagactggcccgatgcccaggcaggggaggagcctacaggatcccccggtgaggcacatgaatcctgtatggatgaagatatgactgacctgctcggtttcttgggagggagcggagccgcgtga

SEQ ID NO: 88548 - DNA, 330 bp, Glycine max
  Peptide Sequence Number=SeqID_180233
atggagttcggtctcaggtgcgatgcgttaaacaacagcttgttcaaagtagccttgggcatgacattgagggaagagccattgttgatgagcactttggccactatgtggtccaaacatttgacaaaaacgtgcaaggctctgttgtgtcccctgccctcgacgggtatctcttcgtatgcaaaagaactcggtcacctcctcagtggatattcccttcttgctaaagtcgttcccttcctcggcaatctttccaaccaagacctcgtcatttggggtcaagcccgccttatcgctctcgcccacatccgcctttgctttcccttttag

SEQ ID NO: 88549 - DNA, 1095 bp, Glycine max
  Peptide Sequence Number=SeqID_180234
atggtagaagtccccatagaggccattgcctccctcgcccagtattatgatcagccgttgagatgctttacctttggggacttccagctgtcacccatggtggaagaatttgaagagatcctaggatgtcctctagggggaaggagaccatacctcttctcaggaaaatgtttggaggcaaaagcaagaaccttggcaggtagaggcgaatgggccccgttcatagacattctcgcactgttgatcttcgaaggagtcctctttccaaatgtggatgggttggtggatctagcagcgatcaacgcttttctcgcctatcatgaccacaaggaaagcccggttgtcgctatgttagccgacctatatgacaccttcgaccgaagatgtgagaagagcaagaaaggaggggcaaattgggaccaactcttagcaaccaaacaaggagcatctgtcaactggttccctcgatggaatgaaggaagaaccggggttcttatttcatgcggaggatttccaaatgttcccttaatggggacgaggggttgcatcagctacaatcccgttcttgctataagacaacttggctaccctatgagaggggcaccactaggggatgagctcgcacctgtcatttcacgaggcttcaataagaccaacatggagacacttcagaaggtccgcaaggcatgggaggtgttaaccgctaaaagaaaggaagttgaggcactggaggaagacgcagaggtgcaggcccttagggcagaactcgagcaagcccaaacaatcaaagaaaggttcaaatcagcagctctgaagatccgaaaggagaatgccgaactaagagatataaatatagctaccaccaaggccttggaacaagagaccaagagggctcgtagggaagagcacggccagaacaagttccgaggggctctgtccaaaagaagtttgtctcagcggttaggcgagagagagaccaacatgttagctatcatcaccaagtaccaagaagaactaaatctagtcgcggcccacgagcatagagtggtggatgagtatgcccaagtgtacgcggaaaatgaggctagaggaagg

SEQ ID NO: 88550 - DNA, 686 bp, Glycine max
  misc_feature (661)..(661): n is a, c, g, or t
  Peptide Sequence Number=SeqID_180235
taccctcgtcttcagagggctgtttgccctcgcctttagaggactacacgtcctcaccttcagaggactacacgtcctcgccatcagagggctacacgtcctcgccattagagggctacacgcccttgccttcgtagggctacacgccctcaccttcaaaggactacacgtcctcgccttcagaggactgcacgtcctcaccttcagaggacttcacgtcctcaccttcagaggactacacgtcctcgcctttagaggactacacatcctcaccttcagaggacttcacgtcctcaccttcagaggactacacgtcttcgcctttagaggactacacgtcctcaccttcagagggcttcacgtcctcaccttcagaggactacacgtcctctccatcagagggttgcacaccctcactttcatagggctgcacaccctcacctccagaggactacacgtcctcgccttcagagggtcatgtaccttcaccttcaaaggactacacgtcctcgcctccagaggactacatgtccttgccttcagagggctacatgccctcgcctccagaggactacacgccctcaacttcagaggactacatgtcctcaccttcaaagggttgcatgtcctcgtcttcagaggacttcatgtcctcaccttnctgaagcctacacgccctcgccttc

SEQ ID NO: 88551 - DNA, 498 bp, Glycine max
  Peptide Sequence Number=SeqID_180236
atgtggattgtggcctctggtaatcgattaccaaaggtgagtaatcgattacaaggcttaaaaattgaggacaggaggctaagatggtctctgatcgtgatggcggcacagctaattcgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgttcaagtgatcgagagggtgatgaggatccacttcttgaggtggattctcccgaggaagtcatgtcggcatctgaggcagactctacggaggatagtggcccgagggagatggcgatcagcggaggctcttcatcctagtggacagctctatggattggttttatattttgagggtgggtgtatctag

SEQ ID NO: 88552 - DNA, 321 bp, Glycine max
  Peptide Sequence Number=SeqID_180237
atgaaaaccatgattatgaggggccaagacgaggctactacttcaccttcctctagtgaaagtgaagaagcaaaaggggaaaaatctagtgaagaaatctacccccaagaagaaggacaaccattagtggttaaagagaagtgtaaggaggtaagtgtctcctccaagagtttagctaaggagggaacttatttttcaataaaaacaaacattagagaaactttccctcttagacaacctccacattttctcttttgtaaaaagacacttgctagcattgccacacctcttgggcttgagtttattcctcaactaaagtag

SEQ ID NO: 88553 - DNA, 231 bp, Glycine max
  Peptide Sequence Number=SeqID_180238
tcagtgtcctcgacaccgtcctgatcggctgcaagggcccatttcctcgtgaggacttggaggacctatgggctagagcaaggaaagccaaggaagctcttcaacaagtgttgtccatactatttgaatacaagcccaagtttcaaggagaaaagtccaagggcccaattggcaacctaggcatcagccttttgggagaccaaatggtggctgacttgttggctgttgggg

SEQ ID NO: 88554 - DNA, 863 bp, Glycine max
  Peptide Sequence Number=SeqID_180239
aagagcgtctgtcaactggttccctcgatggaaagaaggaagaaccgagattcttatttcgtgcggaggatttccaaatgttcccttgatgaggacaaggggttgcatcagttacaatcccattcttgctataagacaacttggctaccctatgagaggggcaccattagaggaagagctcgcacctattattgcacgaggtttcaataagaccaacgtggaggcacttcagaaggtccgcaagtcatgggagatggtgcaaaagaaggacaaagaactcagaggcagtaacaatgggcccatcgacggctttcgtaagtggttgaaagcccacatgcaaggtttggattggctcccgagtttgagaaccactaaaggggaggaagttgaggcaccggaggaagacaaagaggtgcaagcccttagggcagaacttgagcaagcccaaacagtcaaagaaagtgagcttaagctccggagagaggaaagggaccaatcacgagtagacagtttgatcttgaaggatgagttgaagatttgcctaaggtccaagagaagcttgtctcagcgtttatgcgagacagagaccaacatgttagccgttatcagcaagtaccaagaagaattaaaactagccacggcccacgagcacaaagtggcggacgagtatgcccgagtgtacgcggaaaagagggctagaggaagggtgattgactcgttacatcaagaggcaacaatatggatggaccgatttgctcttactttgaacgggagtcaagaacttccccgattgctagccaaggccaaagcaatggcagacacatacttcgcccccaaggagatccacagacttctcagctatt

SEQ ID NO: 88555 - DNA, 1128 bp, Glycine max
  Peptide Sequence Number=SeqID_180240
atggggacaaatcaaaacggcaaaagcttttatcaagtcaaggttaaaattctagatgtcaccagcctcaaggaattgggacgattgatgggacctccccaaaggcaagcctttcgcaaagtgtacgaaaagattctagatttgaccgcggcggaggtatttacggaagctgtcgtatccctcgcccaatactatgaccaaccgttgaggtgcttcacgtttggggacttccaaatggtaccgactattgaagagtttgaggagatactaggatgccctcttggggggagaaaaccgtatcttttctccgggtttcttccctccttgagcaagattgcagctgtggtcggggattcagcaagagagttggatcgcatgaagcaaactcgcaacggcgtagtgggcctgccatggaaatacttggaaggcaaggcaagggatatggcgagccaagataagtggggcccatttgcggatatactagctttgttgatttttggggttgtcctctttccgaacatggacggtttggaggacttagccgccattgatgctttcctcgcatatcaccatggcaaggagagtccagtggtggctatcttggcagatttgtttgatacctttgaccggagatgtgagaaaaacagtgcacggattgtctgttatttacccgctctctgtgtgtggttggtttcacacctattccaacaagacacaagacacccgtgtccgcttcaaagctatcgctcttgcgccgaaaaaggaagagtcgattgggaccaacatttggctggaataggaggcaacgcaatcaattggtttcctcgttggaaggaaggcaaggaaggagttctcttctcgtgtggggactaccctaatgttccattgatagggactagggattgtattaattataatcccgcactcgccataagacagctagggtaccccatgaggggagcgccaaccgaagaaagtctctcacctttccttgtgagggatctaggcgcgcaaagtctcaaggtgatacaaagagtccacaaggcgtggagaagtccgttgaagaaagataaggagattagaggcatcccgaaaacggtgtcatcggtggttatcatggatggctaa

SEQ ID NO: 88556 - DNA, 711 bp, Glycine max
  Peptide Sequence Number=SeqID_180241
atgtcggataaagccctcggcgcgctgcgcctggcggtcgcggataacgaacacctgcgcgatgtgctgcgcatgtcggaagatccaaaacggccggagcgcaagattcagttctttatcgccgtttatcagcatctgcgtgaacgtatccgtcaggacatcattcgtaccgacgatccggttgaagctatcgagcagatggagattgagctgaaccgtctgaccgaagagctgacggcgcgtgagcagacgctggcgatcagctcgcgcagcgcggccaatatcatccgcaaaaccattcagcgcgagcagaaccgcatccgtcagctgaaccagggcttgcaggcggtgagctttggccaggtgcgcagcgtgcggctgaacgtcaacgtacgcgaaacgcacgccatgctgctggatacgctgtcggaagagcatgaacagcatcaggatctgtttaccagcaatcgcctcacgttctcggaagcgctggcgaagctgtatcagcgtctcaatccgcagattgatatgggccagcgcacggcgcagaccatcggtgaagagctgctcgactaccgcaactaccttgagatggaagtggaagtgaaccgcggctcagacggctggctgcgcgccgaaagcggggcgctgtcgaccggtgaagcgatcggtaccgagctgggaagaggagtcacggcgtctgcgcggtaa

SEQ ID NO: 88557 - DNA, 501 bp, Glycine max
  Peptide Sequence Number=SeqID_180242
atggacaagttgcaagaacgagccaaaggatacatccaaatagaggagatctcaaggttaagaaatgaggtccaacaagctggacaaaagcgtgacaagagagaaggagttaccaagattgactcacacaagtcggacaaaaggcacaagtcgtacaattgcattactatccttgaagagttcttcaacgcggaggtacccataaagctacctccaccacttccttgcaagctggggttagacaagactaagtactacagatatcatcaccgttatggttataatatagaagattgttgggccctgaaagacaaaatagaagaacttatacaggctgggtatctagcccaattcgtaaagaggactaacattcactcggcaagagcgagacatggaggacaccaagaggatcaacacagaaatcaagatgttgatagaagaagggatagagtagaagatcgagggagacaaaggctctaccagcaaaaacgtgagctctag

SEQ ID NO: 88558 - DNA, 522 bp, Glycine max
  Peptide Sequence Number=SeqID_180243
atgatcattgatcaatctctgttcttttcattgactaaattacccagtcaaggtgcaccttttgagggcaccattgttgatgactggaaatttgattattctagtcatgatgctcgtcgtatgatcgactgggctcacctggttaggtaccgaatgcataaggcattacgggccaatgcacctcttccttatcctcaattggtcaccttatttctccatcattttcaaattcctcttgatgatgaaccttttgttcaagtcaagcgatcctttgctattggtgctggtgctgtaacttcatttggttaccgtaaagatcgtgatggtcaatggctgaagaaggacgcactacctcaacaagacgagcgtactccttctcctcctcaacgatatgattcctcagcccttatgaatgaagttctttcagagttacggggcctccgcacatatgttggtgaacgattcgattccttggatggtcactttgaaggcatggatacccacatcacccagtttgattag

SEQ ID NO: 88559 - DNA, 231 bp, Glycine max
  Peptide Sequence Number=SeqID_180244
atgtcacaaaactttatggattattacgcaatcatcccctctttgacttctggaattttacggaactttacggattgcacaataatgcttcctttcgactcccaacatgtcgcagaacttcacggattgcctaacgatgggtgtcatgttcctcgaagcggtcatgcgaaggtcgcatcccaccaaacagatggtcctcggacgaaattagggtatgacaaccagcaatga

SEQ ID NO: 88560 - DNA, 669 bp, Glycine max
  Peptide Sequence Number=SeqID_180245
atgctccaaccatgtgggatcgacataggcttaaaggagcattcaaaccaagtgtatttacccccaaggcctagactccaaagagtccgtcaaggcctctccctcctaactcagcggttccctaagattcctcaaggttttcctctagttgttctgctagtgtttccaagcgttggagagaaggagaatggattaaagcctcaatgtcactgtctccgtgtgaggggaatttctatctctacagatattattttgcaaattccaatagtaggtttgggtgtatgtgggaaaaagagggttttgggagatgaagaagggagaacgaatttgagagaaagaaaaagtgtaaaaacatatcgtaaatatgtaagcagtgcctttttaaatggttatctagagaaagagatctacatgacccaaccaccaggatgtgaattttctaacaatcagttagtgtgcagcctgcaaaaagccatttatggacttgatcaggcacctagggcttgcctacttctactcaatctctcctctctccttggccatcatgcagattgggcctctctgatcaagacaatagaaggtccacacctggctcgtgttaatttggtggaccaaggaaatatgatctcttggtggaccaaatacgaactcacttgcttgagaggataa

SEQ ID NO: 88561 - DNA, 207 bp, Glycine max
  Peptide Sequence Number=SeqID_180246
atgaagttgccaaccaaaggagggaagccaaatagcaagggtgatagaggactatctgaggatgaagagtttggcttaggtatgacttctacaagtggagttgctactccaccatctccaaaaagcacaaggctcaaggtggagatgattaaacttggtgatcaaatgagaagaatgagttatgaagataaaggatggagagaatga

SEQ ID NO: 88562 - DNA, 294 bp, Glycine max
  Peptide Sequence Number=SeqID_180247
atgtggtatgacaccaagggagccatcccttccaactctgcaatgtacctacttaccagcaaagggattccattcagctacccattatcttctgccactgcgtccaacaccttcatagattgcaataagctgacagggccaagtacgaagcaacttggaaaatcaaacttaaaaagaaagccaagcacagagctgatgcagaagctggatgcacaactgttgtttgggttaacaaagaaaattgatgccaaatttgttatcaaaagtgtgatgcaatggcaaattagtccttga

SEQ ID NO: 88563 - DNA, 243 bp, Glycine max
  Peptide Sequence Number=SeqID_180248
atggcctctggtctctactctttctcctgcaaagccgaggagtggtctagggtgtggttggactatattaggctaaacttcaagcctttggaatgtcttcaaatactgtatgtccgtgaagctgccttggtcaatgaggaccttagacaccatgaagttggcaattacgatggagacaaccatggggttgtcttggttgatagggttgatgtagaagcaaagactttgcctttaatgttttga

SEQ ID NO: 88564 - DNA, 1398 bp, Glycine max
  Peptide Sequence Number=SeqID_180249
atggaccttaaactagttgtcccacatcggggtggatgtgaccaaggtggactccaagatctcgcacatcagattgagaatgagccagtagcttgccaagtgtattttgtgaatcctagatggtacataatccccccaagctctgagccgacttgtagcaaaagaggttgtctggtgtcgaggagtggtaacctcgataagtgcaagagttgtaggtttgtgaggtttgctaagctccccaacctagacaagtgttgtccaggctgcttctgtaaagatgtctggggtggacatgcttttggttttgcaggcaaaatcagacgtattaggcgagtacagtgcatgcgtgttgctcttgcatgtgtgtcactcgtgaagtgggcacgtactggacacatgcaacccctggtggacccaaaggccatctccatcggtgattcctcctcagagaagactcatcatggagcttctaatagtgagtcctcttccttggagaggttgacaatcttgcactatgttggtggaggcacctttcgcctccatagaagggtgcaacctcttacttcttctctagatggggaatccattctagtcaccatcgtctcacctatcgttgcttgccataagtgggtgagggacaatgttttgaagtatcaggactgtttcttcaagatcttggttactaatgtcatggttgatggattgccactgatgttcaactgggatgaggagccctgcttcccgttctactggcagcctgaccctaccaggttcaagttgtttgacgaggatctattgacccttgtggagagggtcgacaaggctatcttggagcaattgcctacctcgttggatgcacgggccattttgtctcttctcttgataggcgatcccctcgttgccttggatggtaaaatgccttaccttgtcctcttttgtgtccaaggtaggactgtgccaccgtctattgtcattcctcctattggagaaaggggtcaacccactgttggggttggccctactgataaagttgttgaggtcttccccaatatgccttcctctattttggctaagaggaagtgtgatgacggtgttggggtgtcgcccctcgagtttgcaaggtcttccttcggctccattagttgtccaggctattgctctgctgttgctacaactattgttgttgctgcttctactcctccacctcctcctgctatgtctatccaggagatttatggttctcttgctattgaagttagtgcaccgactactttggccagtcctgtcggggttcctccatccaccatcgttgtacccttgctgagtgtcggtgtggcaaccacaagtgctctcgtgatgctgcctcctccttcttcagctccatcaattcccccttag

SEQ ID NO: 88565 - DNA, 777 bp, Glycine max
  Peptide Sequence Number=SeqID_180250
cttgggaggattgatggggacccggtgttgagagaaacgaggatatgggctacgtgggagtacgtgagctcagatggaggtgggcaacaggggatggtgggtttatgcgcgctttgtggatgtggaaaacttgttgtgcaccatcgcccgaccgccacctatggtacttggagatatgtcgcgggggtcaggagaccttggggacgtcaggtggggcgagctcctggcagtcaacagataaaaggaacaaagaccacaaagcaaggaggcttgtggtggctggccagctgtgaactcttattgatatgtgggttatggcctctggtaatcgattaccaagggcttgaaaacgaggcctctggtaaccgattaccagcctgtgtaatcgattacacagagggatgggtcattggtaatcgattaccagcctctggtaatcgattaccaaggctgtgtaatcgattaccagagatgaaaagccttaagatactccttttaattgcatgtagtggttatgagacgcattgtgttgcgacatatcgtctagtggagccagtccaagtgatcgaggtaacgtcatccgaggaagaccctgaggaggatctggaggagctacctcctgagcctgctgtagatgcccttgactttctagagggtgatgaggatccacttcttgaggtggattctcccgaggaagtcatgtcggcatctgaggcagactctacggaggatagtggcccgggggagatggcgaccagtggaggctcttcatcatag

SEQ ID NO: 88566 - DNA, 438 bp, Glycine max
  Peptide Sequence Number=SeqID_180251
atggtggacgaagtggagaacggggtagtcaacactgtactcattgcaattattgcaaccactatgggcaagttgaagtcgaatgtctcaccaagatcgacgtatcagacaatgatgggagtaggacatgagtctagaggattataccaactatcaagattagcgtttcattatttttggcccttgtatttacggctccatagtgtaaggagggttataaataaagaccttgtgtcgcaacctatccttcggcgggagggtgacgcgggattcacgggtgtgtcttccaagggaggaaggcgcgcggagccgccaccaacgtttattcgaggaaaacgtagaacgtgtggtctacgaactttaatcgtgaaaggttcgggagttgtttttacgcacagggaaggtattagcaccccacgcgtccgtcacaagggatga

SEQ ID NO: 88567 - DNA, 606 bp, Glycine max
  Peptide Sequence Number=SeqID_180252
atgggtgaagactcttggtcattggtccgaacccatttgcttatagaacttggcaaattctcaaaagactatatcaagctctttggtggcacaaacatatttgaggaattaaggatgtcactacatgttgatgggttaaccaaggtcactatggataagtggatggatataatcgacataggatatgtgattgcatcaagacttaagttatctgctttgggtttatttgttatgttaacataccctgatcaaatattcagatgttgtcctcctctagcaaaggttaacacaaaaggtgcaccgaagaaatcgatgaacagaaacccaaggtcaacaaagcgtgatccatcttactgggagtatgtagatggttttcattctcagcaaaatagcaattcgttagtgaagcatagtgcatcatcttctgagcagcccaatccaagaaggatcatgcctatgttggatcaatttcagccatttatccatgacatcattgataacattgttgatgtccaagctgatggaaactgtgggtattggtcggtttccagtttattagtatgggtgaagactcttggtcgttggtctgcacctatctgcttatag

SEQ ID NO: 88568 - DNA, 381 bp, Glycine max
  Peptide Sequence Number=SeqID_180253
atgaagaagatcctaggcctacaagctccaatggagcttacatcatatgtttcctacatgatgcctatgaggaaggaccaagcccatggaattttgggggctgcaccttcaaaatgcaaggaagataagggtcacattgcctctcaatgccccacaaagaaaaccatgatcatgaagggtcaagacatttatagtagtcaagaggagactacttcttgcccttcctctagtggaagtgaagatgaagtaaggggtgaagagtctagtgaggaagtctacccccatgaagaaggtgacttcttaatggttagaaggctccttggaggtcaatcttgtgatctatctcaatcccaaagagagaacatctttcatacaagatga

SEQ ID NO: 88569 - DNA, 431 bp, Glycine max
  Peptide Sequence Number=SeqID_180254
gggtagaagaaaatgcctcgagccaaagttcgagtaccaggcgctacagcgctgaagtaatccatgccatactcccaggaaaagctcgaacgccttcaacaaatgggtacctgtacccgaaaccgacacagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagtgagataccactctggaagagctag

SEQ ID NO: 88570 - DNA, 318 bp, Glycine max
  Peptide Sequence Number=SeqID_180255
atgtcacgaaaccttacggattacggaatcgtcccctctttggcttccggaatgttacggaactttacggattgcgcattaacacttcctttcaactcccgaatgtcgcggaacttcacggattgcctaacgatgagtgtcaagtacctcgaagtgtcaagcgaaggtcgcatcccaccaaacagatggtccccggacgaaattagggttataggagtagttgtggctgatactcatgaaaatgcaaagattgcagcaagaagagttcatgttgagtatgaagagctcccagccatcctttcaatacgggatgcctag

SEQ ID NO: 88571 - DNA, 1071 bp, Glycine max
  Peptide Sequence Number=SeqID_180256
gacatcatagaagcaggcgtggcagtaatcctgctggcgcctttgtttgccgtgttggccattggtgtgaagctgagttctccgaagccggtgctgttccgccagaagcgccatggactgggcggaaaggaattatggatgctcaagttccgctccatgcgcgtacatgcagagggcgccgggcagatcacccaggcgacgcgcggtgatccgcgagtgacccggttcggtgcgttcctgcgtcgcagcagcctggatgagctgccacagttcttcaatgtgctgggcgggaacatgtcggtggtggggccacggccgcacgcgatccagcacaacgaccactatgaacgggtgatcgaacgctacatgcaccgtcactacgtcaagcctggaattactggctgggcgcagtccgacgctggatgtacggatcattttgatgacggccttcaaagtgctgggccagaaatcggcatactaggcgaggctgctgccggcatgtggcggcacaatattctggttgtgtgtgtcggcaacatctgccgtagtccgtcggcggaagtgatgctgcgtgaggctgtgagcggcaggggcatcacggtgtcctcggccgggctgggggccctggtcaatcatggtgtggatgccaccgcgcaggcgctgttgaccgagcatggcctggatggcagcagccatcgtgcgcggcagatcgaccgcggcatcctggcagcttcggatctggtgctggtgatggagcgcaagcatgtccatcgcatcatcgaaatcgcgccggaggcgtcgggcaagaccttcctgctgggaaagtggcagtccgatcgcgagattcccgatccctatcgccagcagcgtgctgcattcgagcacgtctacacgctgatggatgagggggtgaagagctggacgaatggccgggagccgtcaggctcccggcttttgtcattccccgacgttacgcagattgtcgtagaagaagcgctcgtcgcgatcaccagtcatgccgtacaggccgtacttgcggccgagcatggcgccaccatcgcggatcagcgg

SEQ ID NO: 88572 - DNA, 576 bp, Glycine max
  Peptide Sequence Number=SeqID_180257
atggatcatgcacaacaccaaaactccgatctccccctaccgaagtgtcagttgggatcaagcccacatgacacccagtggacccggagaagtccaacagggctctggggtttccagctctggttatgggcctctgtcaatcctaccgggtgcccatcccccccccaacaagggatcgcgcccgcaagacacccagtggacccggagaagtccaacagggtcctagggtttccagctctgattacgggcctttgtcagttctatggagtgcccgtcgcccccaataaggtcatcagggcccctattaatcgggatttcatcaagaagtattgtgccccccaggcaggcacagggcgagacaccacagcagcctggggatggccagcagcgggcaatagacgcaccgctgccacctctagagcccctcagctcatctacaaaggctggagtgttgcctacgacccatggtcaaccagcaggcgaccaagtccaaagccaaaggtaagcaaaagtactaggtccatgaccaacaagtcatcacgcgtccagcttaagacgttaaagaagcgctactag

SEQ ID NO: 88573 - DNA, 564 bp, Glycine max
  Peptide Sequence Number=SeqID_180258
atgggagaaggaaacattagaaatcagtacaaggcacaaataaagaatgttctatatgttgatggactaaagcataacctcttgatcattagtcaactctatgacaagggcttcaaaattgaattcaacaagcattgttttcttattgatgaagctatatccggtgaggttgtccatattggaaaaaggataggtcatatctatatgttaaaaattgaacatgcatcatttcatgagcttagttgtttgggctacacagataaacatgcatcatctcaatcatctagtcagaaaagacttagtatggatgatcctaaggaatctcacttaacagctgtcaaaaggatcattgagtaccttaagggcacaaccaaggaagagcacaaatgggatatgccacctattaggaagctcgcttgtatcttggaattgcaagaagcaggcttgtgtagcacttttgatgtagctccatgtggagcttgtaggccttggatcttctccatcaatggagtcccttacttcttgaagatcaatggcagcggaatggagaaggaagagagatga

SEQ ID NO: 88574 - DNA, 457 bp, Glycine max
  Peptide Sequence Number=SeqID_180259
caacattctgcccagcgaccacaacgccaatctccccctgcaaaagtatcagttggtctgtgtcgtcccgacatggggatcgcacccacaagacacccagtggacccggaaaagtccaacagggccctggggtttccagctctggttacgggcctctatcagtcctatagggtgcccgtacccccccggcaaggttatgtcatcatagggatcgcgcctgcaagacacccagtggacccgaagaggtccaacagggtcttggagttgtcaagctctaattacgagtctctatcagttctacggaggcgaaacaccacagcagcattgggatggccggtagcgggcaatagacacaccgccaccacctctagagttaacctcagctcatccgcaaaaaggttagagcgttgcctacgacacatggccgaccagcaggcgaccaaatccaaagccaaag

SEQ ID NO: 88575 - DNA, 318 bp, Glycine max
  Peptide Sequence Number=SeqID_180260
atgaacccatttttcaaggtcaaaaggtctttctctattggtgttggtgcgattacctcctttggttaccgaaaggatgttgatggtcagtgggttcgcaaacaggacttgtcattgcctattcccgacgaacgtaccccatctcctccaccacaaaggactgattccacttctcttctgactgaagtactcacagagctccgcgaccttcgagcttttgtggatgagcgcttcgatgccatggacacccggattactaggcttgaagatgatatgagcttcatcaggcgttgcttcaatccccctgtcaactcttag

SEQ ID NO: 88576 - DNA, 471 bp, Glycine max
  Peptide Sequence Number=SeqID_180261
atggataatcattcatggtgttatccagcttgcattcaatgtcataggaaaattgacatccaaacaggaccattcacatgcggatgtggcaaggataatgatcagcctgttctgagcatgtacattgctaggtatagagttgaagtaatggatggtgatcttgatttgaatgtttcccctcaagcacttgataggctgttaggttatgtgcttgcttttaaggtcaggattcaatcaaaattcaagaatgtcgttgttcttagatactcaaatgaactagatttgatcaatgttgtgctcgagatgttggctgatatcgatcatgatccagttgcaggattccctttaacgcccaaaaagcggataccatctgatgaagttgatgatgagttaggaagctcacaaatttccttagcccaactatcgtctaacaaattaacaaggcattctgataaatgtgtatttagctga

SEQ ID NO: 88577 - DNA, 905 bp, Glycine max
  Peptide Sequence Number=SeqID_180262
ggtttgtatacctcgtcaaccgtggtatcagcaaacaagttcgtatgctggaggacgagttaggtatccagatatttgcccgcagcggtaagcacctgacgcaggtgacgcctgcagggcaggaaatcatccgtattgcgcgggaagtcctctccaaagtcgatgcgattaagtctgtggccggggaacacacctggccggataaaggctcgctgtatatcgccacgacgcatacccaggctcgctatgcgcttccgggtgtgattaagggctttatcgagcgttatccacgcgtctcgctgcatatgcatcagggctcgccaacgcaaattgcggaggcggtatcgaaaggtaatgcggactttgctatcgcaacggaggcgctgcacctgtatgacgatctggtaatgcttccatgctaccactggaaccgttccattgtggtcacccctgatcacccgctggcgggtaaagggtcggtgacgatcgaagagctggcgcaatatcctttagtgacctacacgtttggcttcaccgggcgctcagagctcgatacggcgtttaaccgggctggattaacgccgcgtattgtctttaccgccaccgatgccgacgtgattaagacctatgtccggctggggctgggggtaggcgtcatcgccagcatggcggtcgatccggtgtcagaccctgacctggtacgccttgatgcgcacgatattttcagccatagcaccacaaaaattgggttccgtcgcagcaccttcctgcgtagctatatgtatgattttattcagcgctttgccccgcatttaacgcgtgatgtggtggataccgccgttgcattacgctctaatgaagatattgaagagatgtttaaagatatcaaactcccggcaaaataa

SEQ ID NO: 88578 - DNA, 111 bp, Glycine max
  Peptide Sequence Number=SeqID_180263
atggatgctcgaatcagcatcaacattggctccactgttcttcatgaaggaataattgttgatatcatatcccttctaagtagggacattgagatttggcccaacagctaa

SEQ ID NO: 88579 - DNA, 351 bp, Glycine max
  Peptide Sequence Number=SeqID_180264
atgtcagttctagaattgtacgtagaaaaggatattgctggtggttctatgtttcatgctgcaaattctgttacgtcatgtggacataatgtatctcatcatgagtcgaaactgccaagaaatataagtaatttacatgatgatgaagatgatgatgataattatcttgcgtctaactcatacgttgaagagtctttcgatgaagatgatattgttgatggaatatctgatacagatgatgaagtcaccgacatcgttgaaccagtttcaattattcacccaactgaaggtgtaccaggaattcaaaatccattttggaatgatgctttgcattataataatatcaattga

SEQ ID NO: 88580 - DNA, 1137 bp, Glycine max
  Peptide Sequence Number=SeqID_180265
atgtcccatactaatggattcgggtccacaacgatgggttcaaatgtacgagatcttgtagcacttaccaacgaggccctatcgattagtattatacaaaaaaaatccatcatagacactaatataattagatctgttcttcatagacaaacttgggatttccgatctcaggtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactggtttatcaagaatacgcaagaaaagcattttgaattgttgattcattgccagagatggcttagaatcaatagttcattatctaatggatttttccgttctaatactctatctgagagttatcaatatttatcaaatctgttcctatctaacgaagcgctattggatcaaatgacaaagacattgttgagaaaaagatggcttttcccagatgagatggttgttgctatctgctccaataacgaatcattggtttaa

SEQ ID NO: 88581 - DNA, 333 bp, Glycine max
  Peptide Sequence Number=SeqID_180266
atgtatagttcatgcctgaggttcacactccacaagtcttcagaccataatagttttgtagaagcaaagcttcatgatgatgacaaaggtgatgacaaaaagctcaaagatcaatcaaagaacaacccaagtaatcaagttagaatcaagaacaattcaagagttcaagatagaatcaagagaagaattcaagactcaagaggaaagttaagagtcaagaatcaagattcaaggttcaagatctcaagaatcaagatcaagattcaagactcaagagaaggcttaatcaagataagtatgaaaagtttttctcaaaaattgagtagcacatga

SEQ ID NO: 88582 - DNA, 138 bp, Glycine max
  Peptide Sequence Number=SeqID_180267
atgaatccattgtcttgcgagatgtggaaagagttgcagactaaggtggctgaattacttaaggccaaacctcaaaagagggaactacaccaaggaagaggaggaaactattatcaagctgcacagacatctgggtaa

SEQ ID NO: 88583 - DNA, 234 bp, Glycine max
  Peptide Sequence Number=SeqID_180268
atgggagaaggaaaaattggaaatcagcacaagaatgaaataaaaaatatgttgtatgttgatggacttaagcacaatcttttgagcataagtcaactatgtgacaaaggcttcaaaattgaattcaataagaattgttgtctcatttgtgaaaccaaaaatgatgagttttggcatcgtagggctggacatataaacatgcatcgtctcaatcatctagtcaaaaaggactaa

SEQ ID NO: 88584 - DNA, 201 bp, Glycine max
  Peptide Sequence Number=SeqID_180269
cagccagcaaaccttcctacaccagtgcttgatcttccaacagacccgtctacaccattacttgatcttccagaggacccttccacaccagtcctgggactgactaccactcctctagccactcctgtgctacatttggcagatgaggagggcactcaggatcaggagacccagcaggatgaccagtcacaggagttttag

SEQ ID NO: 88585 - DNA, 168 bp, Glycine max
  Peptide Sequence Number=SeqID_180270
atgatgactctgtgcaaacctagaagaagacatcaaagagcaataattgtcattgtgctttctgtgggcaatctggacacttctaaaaggattgcccaaagcgtaagtcttggttcaaaaagaaaagtgagcttaatgctcatggattccttacaatccaaaccataa

SEQ ID NO: 88586 - DNA, 243 bp, Glycine max
  Peptide Sequence Number=SeqID_180271
atgaccgagcctctcgatgagtcgatctctttctttctcataaaggtggacccttgggtactagtacctatcacctttagaggaccttatgttctcgccatcagaggactgcacatcctcgtctgcagagggttgcacaccctcgcatttagagggctacacgtcctcattttcagtgtgctccatatccacaccttaagagaatataagggatcgcgcccacaagacgcccagtggacttga

SEQ ID NO: 88587 - DNA, 639 bp, Glycine max
  Peptide Sequence Number=SeqID_180272
atggagaggagtatgattgatgctaccagtggtggaactcttggtgatatgactcctgttgaggctaggaatttgactgagaagatggcttccaactcccaacaattcagtgcaagaaatgatgttattgtccttagaggagtccatgaggtggccatagattcatcttcatctgctgaaaataaaaagcttgagggaaaacttgatgccttggtcaacctggtaactcagcttgccatgaatcagaaatctgcatctgcacctattgcaagagtctgtggtctatgttcttctgcagatcaccatacagatctatgtccttctttgcagcaatctggagtcaataagcaacctgaagcttatgctgcaaatatttataatagacctcctcaacagcaaaaccaacaacaacagaataattatgatctttcaagcaacagatacaatccaggttggaggaatcatccaaatctgagatgggcaagtcctccacaacaacaacagcttgtccctcccttccagaatgttgctggtccaagcaagccacatgcaaatgactatccagaatatgcaatttcagcaagagacaagagcctctattcagagtctaacaaatcagatggggccgatggctactca

SEQ ID NO: 88588 - DNA, 180 bp, Glycine max
  Peptide Sequence Number=SeqID_180273
atggctttttatggaatcgcgggtctctttagtagtttttattttgggtcgattattttttgggatataggtggtggttttgatatcttcaataaaaaagggaaaaagatgaggcgttatttgatttcgaaatccgattattatattcctaacccgaagtgctccttggtgtattcataa

SEQ ID NO: 88589 - DNA, 96 bp, Glycine max
  Peptide Sequence Number=SeqID_180274
atggaaaatgtaatgatgagactaagacgcccgaagaaacatcatttcctagttaaccacgcattagaggaaaacgcaaggatcatgcatgagtaa

SEQ ID NO: 88590 - DNA, 129 bp, Glycine max
  Peptide Sequence Number=SeqID_180275
atggacgaagatcaatggatgtatgactatacgatgtcacaagaagttcatatggattatgataatgaagaagaatgtggtgtgaatgaaccacatgttgattgttcgaatgcttttaatacctgtcag

SEQ ID NO: 88591 - DNA, 1485 bp, Glycine max
  Peptide Sequence Number=SeqID_180276
atggatttcattacatctgaagatcatgggtgtgcacctttctctagagatagtcagagaaagagacagcgagagagacagagagagagacaaagagagaaacagggagagagacagggagagagacagagagagagaggacgcgaaagagtgccaaggagtgagagagagatagggagagacagaactcgaaggaaggagacatggagcgaaaacagaaggacacgaagtggttcctcatggagacgaaggagcatggaccgaacgacaaatccttatggcagggcacgaaccaacgtccctggacgggtccctccctatgctgatgaagataactggactacggtggttactagaagatcagcgaaggccaggaagaagcaactgctaatgggaagacaatcaaagaacttggaatcagggggccactctaaatactacaaccttaactggaggaacaatcctgatatcacttccttctacttcactcattttcctgatgaagctaacgaagagctgctatggggctattttaaaaagtggggcgatgttcgtgaagtatatattgctaaaaggctcaataaggaaggtaggagatatggattcgtgcggttcaagggagtgtcggacgtaaaagggctggaggtgagactggataatatcttcatcaacgattgcaaattgttcgttaacctacctaggttcgagaggctggcactgaagacagacttgcagaagaagagtttcattgggaggaagcctcttgacagacccaacaaacactgtggggtaattactggacctccgacgagatcatacgcggatgtaacggctagtggggcttatacaggaggcacaaagagagaggaagcaacaataacaactattctcatcaatccagaagaagggagggggtattggtgcaatgaagcttgggttggaaggttaaagaaggtgatagaggtggggaccttagaggatcgtatagcttgggagttagggtacaacactcgaatcaacttcctcggagatgacatggttctctttcctgggatgcctgatcaaaaggcccagcatatcattcgagcggaaacggaaattggaaactccctcttctattctctgaagaagtggacgtcggattgcaggcccaaaaacagggtagtttggcttcaggtgtggggattccccattcagctcgatgatgacacagaagaccgatacggactataccgagctaggttactggtgcggacacctcttccgctgtcgataaggacaaaggttcgcgtttgtgtgggggacttagagtatcgggtatggatagtggaagagacagggcttgatggcgggttgacccgaaaaggaaactcgccgtcggaaggatggtcggaggagatatcatcggatgacgtcgctgacggtatcatagacgacggcgacactatgtcttccttttcgccggagtcgccctatcggaaatag

SEQ ID NO: 88592 - DNA, 198 bp, Glycine max
  Peptide Sequence Number=SeqID_180277
atgcaccataagcatgcaagggtccaggcagtgttatcaatggcagaacatgacagaaggctaaaattccaccatataaacacgtcattgcacctcatggtgccaccatggcaggcctcccttcacaaattgcctgtggtggttggcaaaaaatccgccatgccattccaccatggtggtgccatggctgctatttaa

SEQ ID NO: 88593 - DNA, 642 bp, Glycine max
  Peptide Sequence Number=SeqID_180278
atggatgaacgagcagacattgcatctggccctgtgtggatggagtacatagcctttctaaagtcattgccggctataaatgctcaagaagaatcacaccggatgactacaatgaggaaagtctatcagaaggctattgttactcccactcatcacattgaacaactttggaaggactatgaaaattttgaaaattctgttagccgtcagttgttgttctttgttggtattagattagaatattttaaaggcatgcaatttgacgataagagtcagttgacaattacaactgtaactgctcatagcttcatttcgatcctcgtttcttctttcatggcttccgcttccatccctcctccccctcctccgccagtgaacggtggaactccgcttggttctgtggaagaaatgcagtggatggcatggaagagacttttatcttttgaaaaaggaaatccacagagaatagatactgcatcctccaacaaacgaattatatttacttatgagcagtgtctgatgcatatgtaccattatcctgatatatggtatgactatgctacatggcatgccaaaggtggtttgatagattctgcaatcaaagtatttcaaagggctctgaaggctctccctggtttgtag

SEQ ID NO: 88594 - DNA, 492 bp, Glycine max
  Peptide Sequence Number=SeqID_180279
atgatttcaatcacgaaacacaatcaaaatcacacatttcttccaataacaaccaaccaaagcactcaacaagaacactcactgcagttggaaacaatagcagaagctgctcgtatatgggtgtggcctccgcgacgggcaaatgctgagcaacacagaaacaacacgaatgagcaaaagatattattgggggcactttatagcttgactaacgagactgacggattcctacgaccacaacgccgctgcaaacaaccacgagcgaggtttcctacaacggtgctctcattatcgcggcgttggggggcttctgggcgcggcaaggtgttatgggaagatgcagacagcagagagctcatgacggagcaacggcctcaggagacgacgccggagattgtgcgagggcggagaacacaaacatcagaagcagtgatgctcgtcatatcatcaccacggaaaaggggaatgaggaagatcggcgaaagaaaataa

SEQ ID NO: 88595 - DNA, 429 bp, Glycine max
  Peptide Sequence Number=SeqID_180280
atggtacgcacactcactccttgctcctgtgttgttgatgacaaacccagtggaggtgacaagtataatgttgaaaccgcggaaatcttggcaaacgaggctcagcatttgcccgtcgcggaggccacacccatatacgagcagcttctgctattgtttccaactgcagtgagtgttcttgttgagtgctttggttggttgttattggaagaaatgcaatatgtggaggcacatatggctgcaaataatgatgatgctacaaaacagatttttagtcggtgcttgttgaattgtcttcagattcctctatggtatattgtttgcattatcttgtttatggcattggctggggaagtttctgggaagagaatgggctacaagctcactgcttgtcgtgtagctgtatttctgttcgatcaaccaaaatga

SEQ ID NO: 88596 - DNA, 57 bp, Glycine max
  Peptide Sequence Number=SeqID_180281
atggagctttgggttaacgaagtaaatgctagagtaacagaggttttgatgaggtga

SEQ ID NO: 88597 - DNA, 450 bp, Glycine max
  Peptide Sequence Number=SeqID_180282
atggacaaaaaattctccaaatcatccaagaaggttgacaacaacaacaactacacatgttttgaatatgcaaaatccataaatcatttgtcaacaagtgaagaaattgaggtaaattctgattttgaagaacttttagaagcatttaatgagatgcatgaggaagctcaaaagcttgctgtgttaaacaaaaagctaaagagtgaactgaatttgcatgtcaataaattggcttcaacacaagatgagtttaacaaattgaagcaagaaaatgaaaagcttgtttcaaaatgtaaagccatagcttgtgatgatacctctacttcctttaacatggatgattacaagtttttgcaaacaaagtttgaaagtttcaaaaaggatcaccatgttgaatgtatgaaattgcacactgagctttcctaccttaaagatttgttggaaaattaa

SEQ ID NO: 88598 - DNA, 134 bp, Glycine max
  Peptide Sequence Number=SeqID_180283
atgccacttcaaggagaagatgactcaagaagaagctcaccaccaaaggaagccatggataagagcttagaggtaggagaagaggaatggagggagaacgagagaggcagcccaaaatttgtgcctcaaaagag

SEQ ID NO: 88599 - DNA, 297 bp, Glycine max
  Peptide Sequence Number=SeqID_180284
atggcttcaagaaaaaggaaaagcactacatccaggccccaacctaactatgatacaaggaggttcaccttagaagaagcctggaacagatacgccgacaacaccctcgaccgaaacatccttccagagaggaacatgaagctctatatcatggagtttgatgagtttagaagggagttagagaggcgcaacctgcacaagcatctcaccaacttagctgatggaagtattgatgtcacggtggtcaaggagttctacgcgaacctctatgaccctgaagataactcaccaaagcag

SEQ ID NO: 88600 - DNA, 345 bp, Glycine max
  Peptide Sequence Number=SeqID_180285
atgtttccgtgggcgatttcgcgaaggttttccaccgttcttcatcgttcttcgtttgttcttcgtcgttcttcggtcttcaaccggctgtcgtcccttgtgacggacgcgtggggtgctaataccttccccgtgcgtaaatacaactcccgaacctttcacttaaagttcgtagaccacgtctttttctggtttttccaacgttttccgcaaataaatgttggtggcgactccgcgcattttcctttcttggaagacgcatccgtgagtctcgcgtcgccctcccgccgaagggtaggttgcgacagttggcgactccaatggggactattgttagagagttag

SEQ ID NO: 88601 - DNA, 495 bp, Glycine max
  Peptide Sequence Number=SeqID_180286
atgggggatttcatccgcagactctccttctctgaaaacaccgagactttttcaagtctcacaagttatccagaactacgtaggtctgagttcctcattggaggatacgtaggagcaagagcctcgcttttgtcgaccacaccgctttctgttaccatgacccaagagctggtagcccgcggagacaccttacggttatccgcacccttttgtcatccagaggcggcgggcccgatgacatgcggagacaaaatttggtcattccgcacccctttgccattcagacacagtcgtgtccgatggcacgcagagacaaaatgtggtcattctgcacccttgtgtcatccagaggcggcgggcccgatgacatgcggagacaaaatttggtcataccgcacccttttgccattcagacacagttgtgtccgatggcacgcagagacaaatgatggtcatgctgcacccttagtaaatcgcggacgacaagcccgttga

SEQ ID NO: 88602 - DNA, 528 bp, Glycine max
  Peptide Sequence Number=SeqID_180287
atgatatctatgagcgctgatgcccggcaggtcattggacagctgtggctcaccgggaagtacgcctggggagtagctgcactagtccatatgtacaaccacctcaacgatgcttctatcagcaccagccgacagcttggcggttacatcatgttgcttgttggatatacgagcactttccctcaatcacggagtccactgctgatccggactacgacgaggattcaccgcatgcctggagcacctggaccgactccggattctggattccggatgtctgttggatcccatatggggagcaccgatcgggtcatgcggcaatttggatacacccagaccattcctgctccgcctgtcgattcatgggtgtcgtatgatgatatacacgacgggtggatgcactattcagatcatatggttgtagcagtcgtccctgaggtcccagagacaaatatccctcacgtgccgaagccaggagcaccatcgacatctgcaaggcccgttgtggatgagcctagacatgcaatg

SEQ ID NO: 88603 - DNA, 627 bp, Glycine max
  Peptide Sequence Number=SeqID_180288
gagtggtcatgttggtgcgcatggtccgcactcttctctttgcagcggcacgggtgaaatcttgccccagtatgcatagtagctgtgtgatagcctccctctctggttgtgctcgcacagttggccctcctccaatatcagggggtggcccaggaaccgtgtggatatggagcccactgaaagtgaggacgcgtagtcctctaaaggcgagggcgtgtagccctctgaagttcaggacgtgtcgcctttcgaaggcgagggagtgtagtcctatgatggcaaggacgtgcaatcctctaaaggtgagggcatgtagccctacaaaggtgaaggcacatgaccctttgacggcgaggacgtgtagtcctctgaagttgaaggtacatgaccctttgaaggcgaggacgtgtagtcctctgaaggtgaaggcgaggacttatagtcctctggaggtgagggcgtgcagccctctggtggtgaggacgtgtagtcctctcaaggtgagggcgtgtagccctctcaaggcgaggacatgtagtcctccggaggtaagggcgtgcagccctctgatggtgaggacgtgtagtcctctcaaggcgaggacgtgtagtcctctcaacggtgagg

SEQ ID NO: 88604 - DNA, 798 bp, Glycine max
  Peptide Sequence Number=SeqID_180289
atgatatttgggctttttgtttgcggactgttgtccggggtaaccacctggctgtttggcttcggcggcggctttgttaccgtgccgctgctttacctgttgctgagccatcagggcgcagtaggcggtcaggcgatgcaaatagcggtagcgacgtcggcgctggtgatgctgtgcacgtcgctgttggcaagcggccgccacctgcgcgccggaacggttcactggcgctccctgctgccgatacttggcggcatcgccatcggcggtattgccggcgcggcgctggcgctgaaggtcaacggcgagtggatccgctggctgttcattttgtacctggcggtgaccattgtggattgctacgctcgccccggctttatggcgccgtcgacggcttgcgcaccgtcgagtgcagggcgcgagactatccttggcggcgggattggcctgattgccgccttccttggcgttggcggcagcgtgatgaccgtgccgctgatgcgccggcgtggcgcgacgatggcgcaggccgcggcaatggccaacctgctgacgctgccgctggcggcgaccgccagcctgacgtggctgctgatggcgccgatggcggcgctgccctccggtttcatcggtaatatctggtggctggcggccgggctgctggtggccgggagctggttgggattgcggggcgcatcgcgctggttggcaaaactccccgatcgctggcacgtgcggatctacccgctactattgctactggtgttgctggcgatgggctttggcggggtgggctga

SEQ ID NO: 88605 - DNA, 695 bp, Glycine max
  Peptide Sequence Number=SeqID_180290
atgggatcaagtcaaatgccttcacttaaaaggagattctatcaagtcaaggtcaagagcctagggaccaccagtctaaaggagttatggcagttaatgggtcagctccagcggcaagctattcacaaagcttacggtaaaatctgggacttagccatggtagaagtctccacagcggccattgcctcccttgcccagtattatgatcagccgttgaggtgcttcacctttggggacttccagctatcacctatggtagaagaatttgaaaagatcctaggatgccctctagggggaagcaaaccatacctcttctcagggttctatccctcattagctagaatttccaagatagtccaaatctcggcacaggaattagaccacaggaagcaagtcgaaaatggggtggttggaataccaagaaaatatttggaggcaaaagcaagaatcttggcaggtaaaggtgagtgggccccgttcatagatattctcgcactgttgatcttcggaggagtcctctttccaaatgtggatgggttggtggacctagcagcgatcgacgcttttcttgcctatcataaccacaaggaaagcccggttgtcgctatgctagccgacttatatgacaccttcgaccgaagatgtgaaaagagcaatacaaggattgtttgctgtactccagctctttatgtatg

SEQ ID NO: 88606 - DNA, 78 bp, Glycine max
  Peptide Sequence Number=SeqID_180291
atgaaggaaaaggtaaggaaggaggtgctcaagcttctagaggttgggcttatctacctcatctctgacagtgcttgg

SEQ ID NO: 88607 - DNA, 162 bp, Glycine max
  Peptide Sequence Number=SeqID_180292
atgaccataatttgtctctgtgtgccaccggacatgatcgcctctggatggcgaaaagaatttgtctctgcgcgtttctcacccaacttgcgaaatctgaatcacaaagggcgcagaatctgtctctgcgcgtttatcacccgcctcgctgctcctgaatga

SEQ ID NO: 88608 - DNA, 534 bp, Glycine max
  Peptide Sequence Number=SeqID_180293
atggcctctaggatacgcaagagtatcggttcaagacccacagctcaatatgatacaaggagatttcactccttagatgcatggaaccggtacacgaataatgtattggggagaaacatcttgccagagaggaaggtgaaaatctaccacactaagtttgatgattttaagactgagttggagaggtgtaatctccataaacgccttaccaatttggttgatgggagcatagatgtggctttggtgaaagagttctatgcaaacctatacagctttgagggcccttcacctaagcaagccaaggtcagaggccatctagtaaagatcaacactaacagcctcaacacattcctagagacacctgtggtgttggcaaagggtgagactttgcccacatactctatatacaacaggcagccttcagatcctagggagattgaggctgccctatgcataccaggccgagggttcatcttgaacgttgcggcccatcctgggaggatcatgaggaaggacttgacgactttagcccag

SEQ ID NO: 88609 - DNA, 807 bp, Glycine max
  Peptide Sequence Number=SeqID_180294
atggccccgaggaagcttgcctcaaagaggtccaggaaggacaaggcggctgaaggaactagttccgctccggagtacgacagtcaccgctttaggagcactgtacaccagcagcgcttcgaggccatcaagggatggtcgtttctctgggagcgacgcgtccagctcagggacgacgagtatactgatttccaggaggaaatagggcgccggcggtgggcatcactggttactcccatggccaagttcgatccagaaatagtccttgagttttatgccaatgcttggccaacagaggagggcgtgcgtgacatgagatcctgggtaaggggtcagtggatcccgtttgatgccgacgctatcggccagctcctgggatatccgttggtgttggaagagggccaggaatgtgagtatggccagaggaggaaccggtctgatgggttcgatgaggaggccatcgcccagctgctatgtataccggggcaggattttgcccggactgctgcagggaggcgagtgcgaatcatgcgcaccaacatgaccaccctgacccagatatggatgacgttgctcctcagcaacatcctgcccagcgatcataattccgaccttcccctgccgaagtgtatggcgcctaccaggcaccctttggatccagataagtccaacagggccctgggatttcccgcactgatcacaggactctgccagtcattcggagttcccgttgcacctaccaaggtgattcggccgcctatcacccgggcttttattgagaagtactgtacccagagacaggcttag

SEQ ID NO: 88610 - DNA, 747 bp, Glycine max
  Peptide Sequence Number=SeqID_180295
atgacccaagagctggtaacctgcggagacaccttacggttatccgcacctcgtcattcagtgaccccaagtgtgattgatgagcagaggccaatgtggtcatctacgccctttccggagatgtcagcatcttccggtggagactttttcaagtctcacaagatacgtaggagcaagagccttgcttttgtcggccaccccacaagatctgtcatactgaccctgaggtcaagtgacatgcggagacaaaatttggtcattccgcacccctttgccattcagacacagtcgtgtccgatggcacgcaaagacaaaatttggtcattctgcaccctttgtcatccagaggcggcgggcccgatggcacgcggagacaaaatttggtcaatccgcacccctttgccattcagacacagtcgtgtccgatggcacgcagagacaaaatttggtcattctgcaccctttgtcatccaaaggcggcgggcccgatggcacgcggagacaaaatttggtcattccgcaccctttgccattcagacacagtcgtgtccgatggcacgcagagacaaaatttggtcattctgcaccctttgtcatccagaggcggcgggcccgatgacacgcggagacaaaatttggtcattccgcacccctttgccattcagacacagtcgtgtccgatggcacgcagagacaaaatttggtcattctgcaccctttgtcatccagaggcggcaggcccgatga

SEQ ID NO: 88611 - DNA, 838 bp, Glycine max
  Peptide Sequence Number=SeqID_180296
atgacgaattgtgtctgcatgtgctccagccgacagccgccgttgccgggcttccgcgacagcccgcgcgtgcgtttatccacaacgttgagcctttcaaccgcgaatggtacgccggttcggccgggtatttatcgcccgatcaaagcgagttctgtgtggcgttgcgctcggcgcgcgtccaggatgacgccctgcggctctacgccggggcgggcatcgtcagcggatctgacccggagcaggagtggcaggagatcgaaaacaaagccgctggcttgcgctctctgctccttagggattaatactgattcgcgcaatcccgattcatatcaaaattccaattttttctattatttatactgtgtcgcattcttgataccggacaatctcatgtcagtaagttcttttaaccgacgctgggcggcggtgatccttgaagccctgacgcgccatggcgtcaggcacgtgtgtattgcaccgggttctcgctcaacgccgctgacgctggcggccgccgaaaatcgggcgttgattcatcacacccattttgatgagcgtggccttgggcatctggcgcttgggctggcaaaggtcagcaaagaacctgtggcggtgattgtcacctccggtaccgccgtggcgaacctctacccggccctgattgaagccgggctaaccggtgaaaaactgatcctgctgacggccgaccgtcctcctgagcttatcgactgcggagcgaatcaggccattcgtcagccgggactcttttcttcgcatccttcgcagacggtttcgctgccgcgtcctacccacgatattccggcaagctggcttg

SEQ ID NO: 88612 - DNA, 183 bp, Glycine max
  Peptide Sequence Number=SeqID_180297
atgttgaacgaaggaagcgtaggaaaactattttacaagaacgaaaaagacaatgttcagctactaatgtgtatctcacaatgtagtccaaccattaaccataataataaccctgttacaagcttccaatctacaccaccatcgcacgggactttatctatagatgattttgaacgatgctaa

SEQ ID NO: 88613 - DNA, 273 bp, Glycine max
  Peptide Sequence Number=SeqID_180298
atggcagagccatcgaagaagagaaagggatcatcctctaccgccgctgctgctgcccatcgccgccacggaccatctgaaacatccacaacacctattcatccatctttatcatctccaagatcatccacattattttctttcgatgatcagcgtctacggtacctctctcaattttcttctaggatcatcttagaccctaagtacctagatgtagagttctttaatgatgaaacgtttgattgctaccaagtgtttcaaaattctggcctt

SEQ ID NO: 88614 - DNA, 675 bp, Glycine max
  Peptide Sequence Number=SeqID_180299
atggatatgaatttggggtacctcatctgccaccagatctctcttactgcacaacatgatacatccagacttggattccctgccttgatcacaactttatgcaaggccagaggagtccaatcagaatctagatccttggagaacttgagccctgccattaacttagcatacatcaataagaactattggaatcttgatgatccaacagtggcatttagagggccaaggaaggccaaggataagagatcagaggtccccactactttagtaccaccagagacaataactccttcttcttccacagctccagtgcctcccattcaggctccagctattcctctagcatctacacagataccacttctagattctttatctacaggaccatcagactttgtatttacaccacagatgctgcactccatgctccagagcttacacagggggcagtccattatcatacaaagccttcaggcccaaccttctccttctggagggggtggggcctccgtagcccaagagcctgaaccagaggagccagcagcagcagcagaggagacttccagagaccagatcccagagccatccccagtacccatacctgatgatgtcataccatttgcactagcatctgagctagagcagcctatccctcaggattcacaagctactcag

SEQ ID NO: 88615 - DNA, 399 bp, Glycine max
  Peptide Sequence Number=SeqID_180300
atgcgagcacatccagagagggaggctatcatgcatctactatgcataccggggcaagatttcccccgtgccgctgcaaaaagacgtgtgcggatcatctgcaccaacatgaccacccttacgtggatgacgttgctatttagcaagattctacccagcgaccacaatgccaatctccccctgcagatgtatcagttgggatcgtgcccacaagacaccaagtggacccaaagaagtccaacagggccctggggtttccagctctggttatgggcctctgtcagtcctacagggtgcccgttcccccaacgaggaatcgcacccacaaagacacccagtggacccggagaagtccaacagggccctggggtttccagctctggttacaagcctctgtag

SEQ ID NO: 88616 - DNA, 516 bp, Glycine max
  Peptide Sequence Number=SeqID_180301
atgttattggtgcagtcgaaccctagcttggccgtgaaagagcgggttgccgccgtccgccgccgcgccgccgccatctccggcggttttctccggcgagatcagggtttagatcgccttgagaagtgcgacccaaccctgcaactctcgccgccttccaccgtcgcacgcgcctccacgcgccgcttcttcttctcgcgacttccgacgcgtgcaactcacgcgccgcgtgccggcgtcggaagctgccactttcggtcttggcagcttcatcgtcacttccagggtctgtttcaggcttcacctcccgcttccggcaagccgtttggtcagctcttgagtgtcttcctctcttgtgtgttagggtttgttgtttggctcttaaatggcctcttctggacctattttttcgttttccgggacttcaactatcaccactgcaaagctgaactggaaaaactatccttcgtggtctgcttccgtggagttgtggttccttggtcaaggacaccatga

SEQ ID NO: 88617 - DNA, 432 bp, Glycine max
  Peptide Sequence Number=SeqID_180302
atgaaggctgacatggaggccatgaaagagcaaatgaccacaatgatggaagccatgatgagtatgagaaaaatgatggaggtcaacacagttacagtcattgccgcaagtactgccactgaggtggacccgactcacccatctggcctcaatcaagtaaatcgtccagtcttgaatatggtaggtcagggaggcagagcattgggaagtatggatggccctcattttgtgcaagtccaaagcaagcattccttcccaccatatatggcttgtctcccaactatgcaccaccgaaagttgcacacgctcccaatgagaatgtcgataactctactcccatactcattgagagtcaataaccccaatctggtcatgcacgagtctctcaacccatgggggagacacatgaagtatcccgagaacccactctag

SEQ ID NO: 88618 - DNA, 291 bp, Glycine max
  Peptide Sequence Number=SeqID_180303
atggtaggttacatgccttcaagttttgtagatctagtgtttgttggcaagagaattgaagcaggtttgaggaaaggaacatttagttatgttgcttctgtaaatcctggtaatgaaggacccgagaggagtggcgagaggaagaaggagggagaatctcatgttgtggttgtagttcccgcgtggccaaacttttcattagccccttataatcccatgtaccaatatcctccccaacaatatcactactcagccaatatcagtcctacccattacccaccaccctactaa

SEQ ID NO: 88619 - DNA, 876 bp, Glycine max
  Peptide Sequence Number=SeqID_180304
atgagatcctgggtgaggggtcagtggatcccgttcgatgcggatgctattagccagttcctaggatatcctttagtactggaagagggccaggagtgcgagtatggccagaggaggaaccggtccgatggttttgacgaggaggccatcgcccagttgctgtgtataccggggcaggattttgcccggactgttgcagggaggcgagtgcgaattatgcgcaccaacatgaccaccctgacccagatatggatgatgttgctgctcagcaacatcctgcccagcgatcataatttcgacctccctctgccgaagtgtcagctggtgtacgccatcctgacaaggatgagtattcacgtggctcagttgatcgctgatgccatttatctatttgcaggtatggcgccgaccaggcaccctatggacccagataagtccaaccgggccctgggatttcccgcactgatcacaggactctgccagtcgttcggagtccccgtgagacaggctcagggtgatgctccacaggccgcgggcgcgccaccaccacctcatcaggctggcccggctgggtcatttgacatggagcagtatttacggcatttggtttgccagcaggcggccaaccaccaggcacatgtacagacccatgattgtctgtaccagctgagcctcagcatgcagagccagggcttcgcttctttttcatgccctactccagaccagttcagggcagaggtcgcatggcccggggattggcccgaggcccaagcaggagaggcacccccagaagctcccggcgatggagaggaggcccacgaggacgaggagatggccgatttgcttgacttcttgggagggagtggagctacgtga

SEQ ID NO: 88620 - DNA, 1133 bp, Glycine max
  misc_feature (1074)..(1074): n is a, c, g, or t
  Peptide Sequence Number=SeqID_180305
gatcccacaggaaggcaaggaaggagttctcttctcgtgtggggactaccctaatgttccattgatagggactaggggttgtattaattataatcccgcactcgccataagacagctagggtatcccatgaggggagtgccaaccgaagaaagtctctcgcctttccttgtgagggatctagacaaggagcttagaggcatccgaaatggcgtcatcgatagttatgatggatggttaagagttcacacgcgagggttagattggctctccaaattgaaagttatcaatgaagagaacttcgaagctccggaggaagatgaagaagtccaagctctcaaattagagctagggaaggcgagactcgccaaggagaagttcaaatcagccgctacacacatccggaaaaagtgcaccgagttacaagaggaaaacgtggccactgcaagagcccttgaacaagaaactaaaagggcccgcaaggaggaatatggccgagagaaattccgaggagcattgtggggtagcaacagtgagctcaagctccgaagagaggaaagagaccggtcacgggtgcatggcatgatcttaaaagaagagttagctgtgtgcgcaagatccaagaggagtttggctcaacacttggaagccacggagcaaagcatgctagctattatagggcaatacaaggaagagttgaaccagtctgtggcccatgaacaaaagctagtggaggattttgcacaagtgtacgccgaaaaagaagcaagagggagggtgattgatgcattgcatcaagaagcgactatgtggatggataggttcgccttgaccttgaatggaagtcaagacctcccgcgtctattagctaaagcaaaagccatggccgaagaacagatgaaggccgatctatcaaccttaaaagatcaaatggcttccatctcggaggtcatgttaaaactccagaaaactatagaggataaagccacgacaaccggctccagtacagttagggaagcggagccggtgctgcagcctgccttaaatccgggccgagacagaaacacggcagtgtntggtcgaaggtatagcccgcaagcttatccttatggcttgcctccggacttcactcccc

SEQ ID NO: 88621 - DNA, 243 bp, Glycine max
  Peptide Sequence Number=SeqID_180306
atgtacaaagataattggacccaaccttgggccatgggctcagaaatctaccctaaggttcatgagaaccctagggccttcttcagcagctctagctcaatcttcttggagcctcttgctcatggttctagtgattggtcccttcctagggaggattgcatcacaatagaattaggaccacatatacccactatagtagatgtaagcacaagcactacaacccaaaaacctagagatcagtga

SEQ ID NO: 88622 - DNA, 465 bp, Glycine max
  Peptide Sequence Number=SeqID_180307
atggccgtaataattcccgggaagatctaccaacatcctttcccaaagtggtatgaccctgacgcaacttgcgcgtaccatgggaaaaccctgggccactccactgaaaaatgcctggcccttaaatacaaggccgcgcagtctaagcctttaaaggacgtggcgacccctaggaggtttatctatgaggccctacaaaaggggggtgtaattccccacggtgcgcatgaagaggattcttatttgttgcatcctggcgagctacattacatggaaacatgttcagcaatggaggacttgttgcaacagatgatagatcaaggccgattggaagtcggcgatgaggggagggaagagcagcatatatgtatgcagtccatagatgaaagaagttttgggaggcctaaacctttggtgatatatttcaccaaggacgcagctccacaaaagccccgatatccctcg

SEQ ID NO: 88623 - DNA, 213 bp, Glycine max
  Peptide Sequence Number=SeqID_180308
atggtgtatggaggtggtggtgccaatagcgatagcggtgccgatgataatgttggtggtggtagagcaatctggcccacttgggccctccagaaggctgttgcttctggaggaagcaaccctgctcgcctgggcgagctgggcggcaagcttctcccctattttgctataaatagggggagaagtgaagaagaaaacggttcagccccttag

SEQ ID NO: 88624 - DNA, 669 bp, Glycine max
  Peptide Sequence Number=SeqID_180309
atggaaacatgccccgcggtggaagagttacttcaacggctcatggactgggggcagctcgaagtgtccaagggagatagggaagaaccacagatttgcatgcagtcggaagaaaagaaggttcccccaacccccaatgccctagtaatatgtttcactaggaatgtgaccggctccaggcccatgtaccccccggcaccgcccaagccgacgccgttttcctatcaaagcaataaggtcgttccgtggaagtatacccctcccgcttttagagaaagagttgcaaccgaagttgactccttgtcagccaaggtgaccaacatcaccggccttagtggcgtaacccgcagtggccgggtgttcgctcccctttactcagcggaattgccctccaaggggaaagcacccatgatccaagagcccgcagacgtggccaccccctcaaaagaagtggatcccccggtggtaaaaggaactgaaaagaaagaaggtcttcaaggaaagacggtgactttggaagaggctcatgagttccttcgtctcatccaacaaagcgagtttaaagatctctttcgaactgctcataaactccgagcctcatcatgtactattggtaaaggtcctcaacgaagcccacgtagcacacgacatctcagtcgagggttttga

SEQ ID NO: 88625 - DNA, 330 bp, Glycine max
  Peptide Sequence Number=SeqID_180310
atgtatataaacaaggttttcaagactttgaacttgggagacaaaattcgaaaatatagtaagagttctggaaaaagtcgtacattttttccacaaactgaatgtgccatggaaacttctccgcttcttcttcttccctttgaatttgaaagcatgccaccacctccaattagtagaagcgcaggcgcaactttgattgtggctaattggagtatggttgcggagttaccgcaacagatgctggaggtatcaactttcgtcacacccgtcgctcatgataactcgtcagttttgttagcgacgccaacaaatcggaggacttatcattag

SEQ ID NO: 88626 - DNA, 642 bp, Glycine max
  Peptide Sequence Number=SeqID_180311
atgacattgaccatcccagagcttttcttgaggccttatcaggttagatgggatgccaccgtgttcagggtctttaatccagatttccccttctacataaagcgcgaagacctctccgaaatcgcacacggtggtcaatgtctcagcatatcagtgttacacttgtggattctgcatctcactgaaacatgtatgcgagtggggaattctgatatctatggattcctcgagccacagtccattcagaggtctgggcaatcgcagtttgagtctaaaagttacataaagagttggatgcagagttcacaacgcaatgtctatcttggagcctacctaaatgggttccactgcagcggacaccggcagatggtggtcatcctgcccaaggaacacctagttgtctggttttgttcattgcataacaggccagacaactaccttaaggggattattaatagcctaaatcaaaggcttctgctaggtggattgtcgtcaagacaaaaaggaagtactgagtgcggctactatgtgatgcacaggatgtccaccatcattttaggaacttttaggaataattgggaagcgtattttaacgatcctagaccattggagccagagagattaaaggcattgcggatctag

SEQ ID NO: 88627 - DNA, 667 bp, Glycine max
  Peptide Sequence Number=SeqID_180312
atgagcgataaaaaaggaagcacttcaaaccatggcttgaatttgaacatacccccaccaagggttgccaatcagatacctgattcaccaactcgattaccaatagcgccaccaacatcgccaacaagctcatgtgtgtccagcgaactaagcctagatgacaacagcagcagcagcagcaacaacaacaacaaccgcggctgcactcggagccctgaagacatttccatggtgctagtagggtgttctcgctgccttatgtatatgatggtcaatgagggtgaacccaatggtggtgtcaatattgatgacaattgtggttttggggaggatggtagtcgttgcataggtggtgattgtggtagtagtgtcagtgcatatggttatggtggtggcggtagcggtgccgatggtggtggtggcaatagcgatagcggtgccgatgataatggtttcgcatgttcgttgctacctccattatcgccggagaagggaaacattaacgctggattattcttgtttgcctatgaagaagacagtaatgagctggccatgaaggtggaggtattcgaggtggcgcgttcgacggtggtggcgtggggaggaggtgaagaaggcaaatacgtggcagtgactaggcttgatgacgtgacactctgtctgccat

SEQ ID NO: 88628 - DNA, 267 bp, Glycine max
  Peptide Sequence Number=SeqID_180313
atgactaggggcaatccaggtgatttacagccctttgatcctgaaatagatagaacctttcatagattagttaggcatagtgtgcatcctgatcattctgtgcattttgagcattgtgagcattttgagcattttgagtattctgttgctggtgattctgaatattctgattttgagcattcaactactaattcttatactgagaacatggctcaacctccaccttatgagaggactgatgtgtcatcattttctcatatttcttaa

SEQ ID NO: 88629 - DNA, 510 bp, Glycine max
  Peptide Sequence Number=SeqID_180314
atgttgcccatagctcctgttgtggtagccaacatcttcatgggctgtagagatctcttgactctcagaattttacatggtgaaacattctcattcttcaacaacctctcttcagaatgtgatgaggagtcccaaatggttaaatgtcaagtagccataattgggatgatcaaatatgagtttgttttctccaatttcatcaattgcatgtatgcaattcctgttagctttaggagaagagatgatatccattccatagcgcctggtatcccagctatgcggagagaattctgcttcttggcagtagaggatacatctacttgggttgttgtaaatgagaacaaaagagggtacatctcttgtggatcagttcaagtggagggtacatccacttggttgttcaaagagaacaagggagggtacatcccttgtggatctttgcttgtaaaggcttttacaaggttgaaaagaaatcttaaggaccgcaggtcacttagggactggatgtag

SEQ ID NO: 88630 - DNA, 798 bp, Glycine max
  Peptide Sequence Number=SeqID_180315
atgaagttttttaatcttctgaaaagcagacatgtcagatcctcctcctcttcttcatcaagggcctggccatcctgccaccaacccaaaaccctctcttttagagtcaccaccaccaaaattaacaatgaggaagacaataacaacaacaacaacgtcgtcaacgacgttgttttgaaagacattaactcagcgttagtgtcacaaactccagaatcgtttttcaccgagtctccggactcggcaagcttctcaacaacttccgagttgtctcgtggcatggaccccatagaggcggtgattcgcggcctgcgttcggatcgacttttcttcgatccggacgaggcaagctgcatattagaggccaaaccgacgacgacgagcctagagcctttcaaaaacagcgtcgttttgacgatggattcagaggaccctcacgtggatttccgcaaatccatggaggagatggtggagactctcggcgtcgaagactgggagagtctcgaggaccttctgtgctggtacttgcaggcaaacaccaagagcaatcacgagtatatcattggagcattcgttgatttgttgttcgatctggctgttccaaattcaccttgttcacaagacgatgacgaaaatcttcattctcactctcattctcgtccttcttctcctttatcgttttataactcttcttcttctccctcatcctcttgcagcactccctattgtataaaaggtgaagtggaagaggaagagattacacctgaagatgaagctgcttcatcttctaacaactga

SEQ ID NO: 88631 - DNA, 936 bp, Glycine max
  Peptide Sequence Number=SeqID_180316
atggaagttaaaattaaaactgcaagtgagaatgattttcagactcttccaccaaccatgcattttgaaatacaaaagatcagtaacttaatgctctgtgtaagaatgcttcaggcacaatggcattgttcattttctgtacaatgtggttgcgtcttcttcattattcttgattccctttctgcgccattggctgctttcattgacattgaggatgtctccgccactcttgccgtcaagattatggttagaactagagatctaggtcgtaccttaggcagagttataggaagagtcctgggagagaggataatcgtcattcagatgatgttccccatcgacaaaggcccacaacatccgcacgtaggtaacaggaagttgccgctgttgttgaggatgctcctcacgtggatgacgcagctgaagaggtattccaacatgctggagaagctgttgatgatgccgagggaacatcttgacttgaagatatcctccgatggaaggaaggttcagaaatttaggaggcttactactaaaattgaagggctagtcgctaccacaggattaagtcctttgatcgaatgttcattggacactggcgatcggggacttatatcggcttttgtcaagaggtggcataaggagatggccagtttccatcttccagtaggagaggtcaccatcaccctcgatgatgtggcctctttgcttcatcttcccatcataggcgcattccacagcttcgagattcttcatgttgacgaagtggtgttgatgttagttgagttacttgaattctctggagatgaagctagagctaagacagttgcactccttttgttaataagagtgcaacacatgtgcatgtggtgttcttggacgccttctgagacctcagttagagtggaagctacgcatgggaagctgccgccctag

SEQ ID NO: 88632 - DNA, 1221 bp, Glycine max
  Peptide Sequence Number=SeqID_180317
gatgtgcgcatcaaggcacaggccatccagaagcagaatactgccccccacgttttgtctcgtgggggttatgattatttggagcagaagctcctggctgagaagaccaagaagaagctgcatgaaactgcacagtcaggaagcgttgatggcgtcatcgaccctccatccccggtcagacgccacgtgaagtggaagatggcccgcaccaagaagacaagggagatgacgactgaggccgcaaaggaaatcactgagaagattgccacacagggatcgttcgtcccccatggacgtcaggatgttttggccgctgctattggacgtccagagcaccctggacgtgtctgtgctgctggagccggtatcagggaccagctagaggagtccatcacagagaaagtgacgaggcaggtcatggcatccttcagccagctacagtcacagatgcaatctcagggacctcctaagcctctggttggtcctggtccctccggtcctcgggtgagcacaaaggggaattgtgttgatccctcaggaaacgatcctgagacgggtgactctgacaggtgcggcttctacatagaagcagatcctgcccgcctggttgccgtggggagagtttatgagggatccactcttgttcataacactcctttgttacctggccaagtaaaggtgagtgtggacgaggttaaagatgcagatgctccagttcctgtacccactgatgaggtttccttagtggggcaggcacttcacaccttccttgcttggccgacacatctggtcaagtctttatcacaccaggtagctgtgtctctgccaaaaccacctccgaagcccgatccggaggtcgatgatccgctttatctgatgacattgaccatcccagaacttttcttgaggccttatcaggttatatgggatgccaccgtgttcggggtcgttaatccagatttccccctgtacataaagcacgaagacctctccgaaatcgcacacggtggtcaatgtctcagcatatcagtgttacagttgtggattctacactggcagatggtggtcatcctgcccaaggtacacttagttgtctggttttgctcattgcataacaggccagacaactaccttaaagggattattaatagtgctatcaagggtcttgatgatgctccacagcctaaatcaaaggctcctgctaggtggattgtcgtcaag

SEQ ID NO: 88633 - DNA, 66 bp, Glycine max
  Peptide Sequence Number=SeqID_180318
atggccctaaagttaatgcccactaccactatgattatggtgggagaatacttgtcaacaatgtaa

SEQ ID NO: 88634 - DNA, 549 bp, Glycine max
  Peptide Sequence Number=SeqID_180319
atggcgcctaccaggcaccctctggatccagataagtccaacagggccctgggatttcccgcattgatcacaggactctgccagtcgttcggcgtccccgtcacacctaacaaggtgattcggccgcccatcacccgagcttttattgagaagtactgcacgcagagacaggtccagggtgatgcaccacaggccgcggacgcgccgccacctcatcaggctggtccagccggatcatttgatacggagcagtatttgcggcatttggttcgccagcaggcgaccaaccaccgagcacatgtacatactcattattgtctttatcagatgagtctcagcctgcagagccagggctttacttcttttccgtgccctactccggaccagttcagggcagaggtcgcatggcctggagattggcctgaggtccaggcaggagaggtaccagcaggggcaccagcagaggctcccgacgaggcagatgaggcctgcgaggatgaagagatgaccgatttacttgatttcttaggagggagtggtgccacatga

SEQ ID NO: 88635 - DNA, 264 bp, Glycine max
  Peptide Sequence Number=SeqID_180320
atggcattggagatgttgttgttgttgtgcagtttggcttgtgacagcaacatggctttgtttgggaagaggatcttgtgcagtttgggagtaactgcacaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagtagcgcaggctga

SEQ ID NO: 88636 - DNA, 432 bp, Glycine max
  Peptide Sequence Number=SeqID_180321
atggcagcgcagttgatccatgatcacgtcgtgatggagtgcctagagggtgtttgggagaccctcaaaggcaatgagaggtgccgattccgtggcacagttcgactcactgcttcttcgctagtacatctggagcaacccgcacgcacacttcagcaacctgtggagtggatactacctatgcctactccatatcgactagttgagcctgttcaattgatagaggtgtcatcctctgaagaggatcttgaagaggacccagaggagttacctcctgaacctgctatggatgcccctgacttaccagaggatggtgaggacccgctccctgatgttgattctccagaggatattatgtcagcatctgaggcagactctacagaggagagtggccctggagggacagccaatagtgacgactcttcatcatag

SEQ ID NO: 88637 - DNA, 259 bp, Glycine max
  Peptide Sequence Number=SeqID_180322
aagtagctctagttcttccaagtccctccgctcagagctcagagccttccttatctatgctgtagagctggcatcagggccagctcctgatcatccagagtttacaggatgtggtccagcagcggaggatgttgcagtaccagagccatctcctcagcctgagcctaagccatctacaccagtgtttgacctgcctctttctcaggatccatcatctacaccagcactggacctgaatgagcatgcacaggatcattga

SEQ ID NO: 88638 - DNA, 372 bp, Glycine max
  Peptide Sequence Number=SeqID_180323
atgtatattgttgtggtaaaacaggggcaggatcaccttgggctaccttctggagtagagacaaaacatgaacggcagaaaccaatcaaggtacttaaggacgaacgcgggcggggatggggtcacgaccgaccgatcgttgcccttctctgtgcgaaacaagcagagaatgtcgctgcaaggcagccccccctagggccatcctttttcgcatttttgattccgttttgcgcttttgttcatcaccaacaagcctataatgcatttttgaacaatgggacatgccacattgtccccgttctcttgctattgacgcctaaacgcgcgcccaccaagtgttcggtgaaatgcctcaatggcattagcgcgtga

SEQ ID NO: 88639 - DNA, 162 bp, Glycine max
  Peptide Sequence Number=SeqID_180324
ttgagcttagctcatcagtgggctaagcgcgcatccatcgctaagtgtagcttcagcgcgcttagcgtgatagaagaatctggaagggcatcaatatcaaggctgcatgctaagcgcgagatcagtgcgctaagcgcaacaattttcttcagccaggcttag

SEQ ID NO: 88640 - DNA, 288 bp, Glycine max
  misc_feature (42)..(42): n is a, c, g, or t
  Peptide Sequence Number=SeqID_180325
gtcgactctagaggatcccctcttcgcgtaattacccatggnaaatgttacggaaacattacggaatcgcctcgggttggattttcttcacggaaacaattttcctcagcaaatttaagagaatacgaagtgccaagaaggcagaaccctttcctcttcactcctccccctatttatagcaaaataggggaggagcttgccacccagctcgcccaggcgagcaaggttgcttcctccagaagcaaccgccttctggaggaagaatctggaaggcccaagtgggcctga

SEQ ID NO: 88641 - DNA, 243 bp, Glycine max
  Peptide Sequence Number=SeqID_180326
atggggcctaattttaattgggagattgatgtctccccttatatcccgatggctaccatcgaaagcccgcactaccttggagctcggcctcatgtgcgacgcgttaaaaggcaacttatccaatgtagttttgggtatgacgttgagggaagagctgctgtcgatgagcactttggccactatgtggtccaagcatttgacggacacgtgcaaggctttgttgtgtcccctgccttcgactag

SEQ ID NO: 88642 - DNA, 246 bp, Glycine max
  Peptide Sequence Number=SeqID_180327
atggaacaacctccaccccgtgagaggactctaagggaaatggttgcacctgatttcacctacgaaagcttgtgcatccaataccctgatgaggatgtcccatatgttcttaaaactggactgatccatttgcttccaaagtttcatggccttgcagtcatggaagccccaaatttttcttatacttggtggagtgggccactcaggaatgacctttattctcttagggttcatgggaacccttga

SEQ ID NO: 88643 - DNA, 171 bp, Glycine max
  Peptide Sequence Number=SeqID_180328
atgaaggttcactattatcaagcaagtcggagacccagcatgaccacagattcacctccgctccttatgctcccatggacccagtccccaatggagtcgccaactgtcgcaacctacccttcggtgggagggcaacacggggctcacgggtcgccaccaacatttatttga

SEQ ID NO: 88644 - DNA, 321 bp, Glycine max
  Peptide Sequence Number=SeqID_180329
atgatgataacaaaagacgatgacaaaggtgatgacaaaaagctcaaagatcaatcaaagaacaactcaagtgaatcaaagatcaatcaagaagaattcaagactcaagaagaaagtctagagacaaggatcaagattcaagggtacatcctttgtggtacaagtagagggtacatctacttgggtttgactgagaacaagagagggtacatctcttgtggattagttatagtggagggtacatccactaggttcaaagagaacaagggagggtacatcccttgtggatctttgcttgtaaaaggatttttacaaggttga

SEQ ID NO: 88645 - DNA, 153 bp, Glycine max
  Peptide Sequence Number=SeqID_180330
atggcaatgacaaaccttgagattaaaagagccataaccctgatgcaatcctactctccaagggcattggatagaagactccaagaagattgggccagagatgcaagagaaggccctagggttctcatgagccttaggggctccataatgtag

SEQ ID NO: 88646 - DNA, 333 bp, Glycine max
  Peptide Sequence Number=SeqID_180331
atggaggccatgaaagagcaaatggccgcaatgatggaggccatgatgagcgtgaagaagataatggaagccaatgcggttgcaattgccgctaccagtgttgttgctaaggtgaacctgatgtccccatccgacatcaaccaaatgaatcatccaacctcagatatggtagacaaagatttgggaagtacgggcgacccccatgatgtgcaaattcaaaacgagcatgccttcccaccatatggcttgcctcccaactatacaccacccaatgtggcgtacactcccagtgagaatgtcaataactccactcctatactcgttgaaagctga

SEQ ID NO: 88647 - DNA, 195 bp, Glycine max
  Peptide Sequence Number=SeqID_180332
atggatcgattattcacaatgatattggggtttacttccaaacttcaactccggtgcccattcgagtaccaaacagctgtgattttgcaagctaaaaaatcagaatacacaataccctccagctatccgacaaacaatttttggatgaaatttactaccggaagccattcacccatacagtgttggtctaattga

SEQ ID NO: 88648 - DNA, 715 bp, Glycine max
  misc_feature (26)..(26): n is a, c, g, or t
  Peptide Sequence Number=SeqID_180333
cgccacgcttcccgaagggagaaagncggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacagcggataacaatttcacacaggaaacagctatgaccatgattacgaattcgagctcggtaccccacgcgcacgcactcctgccacaggcgctggccgcttttgccctcgtgcatcttggcgttgacgtccagcgcggcgaacagcgggtagaacgggctggtagaggcgtgcagcatgaaggcgttgttgaagcgcttgtggttgcagtagcggctctgccccttgatgtgcttgtcttttttgtggatctgcgaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 88649 - DNA, 111 bp, Glycine max
  Peptide Sequence Number=SeqID_180334
atgaagaatattccagattcaggagttatctttacgtttgaggaaggtcgacaaaagcggggcccttgctcctacgtaccctccatcgaagaggaaatcatacctatgtag

SEQ ID NO: 88650 - DNA, 306 bp, Glycine max
  Peptide Sequence Number=SeqID_180335
atgacagcaattaaagaaagttctacaattcaggaaaacaaaaagaatatactggaccagtgcccggtaatgtacgttatggaaaaaatcggaggtttctggaaaccgattatattatttcagttgtctacaggagagaaacgttacagtgagttaaaaagggcaatcccggaagtcacagaaaaaatgctcatccagcatttaaaacaattggaagccgatggtttgatcatcagaactgcaaagcctgtggtgcctcctcatgtgacctatgaacttagtgaagcagggaataagcttgctcct

SEQ ID NO: 88651 - DNA, 886 bp, Glycine max
  Peptide Sequence Number=SeqID_180336
ggtggacccttgggtacacgccctcgccttcagaggacgacacgtcctcaccttcagaggactgcatgtccttactttcagaggactgcacatcctcaccttcagaggactacacgtcctcaccttcagagggctgctcgccctcgccttcagaggactagacatcctcgccgtcagaggactagatgtcctcgccttcagaggactatacgtcctcgccttctgagggctatgcactttcgccttcagtgggctccacatccgcaccttaagagaatttatggtcctccaaccttaatgcttaaccaagacttgcgctcccgggcgaccaactatgcgagcacaaccagaggaagagactatcgcgtagctactgtgcataccgggggaagatttcacccgtgccactgcaaagagacgagtgcggatcatgcgcaccaacatgaacactcttacatagatgacgttgctactttgcaacattctgcccagcaaccgcaatgccgatctccccctgcgaaagtatcggttggtctgtgccatcccgacataggggtcgcgcctacaagacacccagtggagcccaatagggccctggggtttccagctcgggttacgggcctctatcagtcctatagggtgctcgtcccccccagcaagggtcttggagttgccagctttgattacaggcctctgtcagttctacgaagtgcctgtcgccccagcaaggtcatcaggccccctactaatcgagctttcatcaagaagtactgcacccccaggcaggcgcagggcgaaacaccacagcagcctggggatggccgacagcgggcaacagacacaccgccaccacctctagagttcatctcagctcatctacaaaaag

SEQ ID NO: 88652 - DNA, 563 bp, Glycine max
  Peptide Sequence Number=SeqID_180337
agaaaggaggggcaaattgggaccaactcttagcaagcaaagaaggagcatctgtcaactggttccctcgatggaaggaaggaagaactggagttcttatttcatgcggaggatttccaaatgttcccttgatggggacgaggggtgcatcagctacaatccccgtccgcaaggcatggggggtggtacaaaagaaggacaaggaactcaggggcagtaacaatgggcccatcggtggctatcataagtggttaaaagcccacgtgcaaggtttggattggctcccgagtttgagaaccgctaaaagaaaggaagttgagacaccggaggaagacgaaaaggtgcaggctcttaggacagaactcaagcaagctcaaatagtcaaagaaaggtttaaatcagtggctcttaggatccgaaaggagaatgctgaactgagggatgtaaatgtagctaccaccaaggccttggaacaagagacaaagagggctcgtagggaaaagcatagccggaacaagttccgaggggctctgtggggtagcaacaacgagcttaaactctga

SEQ ID NO: 88653 - DNA, 132 bp, Glycine max
  Peptide Sequence Number=SeqID_180338
atgggtgtttttgcgcaattcgtgagtgtcgcaacctacccttcggtgggagggcgacgcgtgactcgcgggatgcgtgttccacgaaaggaatacgcgcggagtcgccaccaacgtttatttgaggaaaac

SEQ ID NO: 88654 - DNA, 298 bp, Glycine max
  Peptide Sequence Number=SeqID_180339
atgacccatcgaggtctaaaaaagaagcatgaccggatgacgccgatcgaacatttcccaatcgcggtttctgatgaggacatgaccaagagcaagggcaaggatccacttgaaggacttggaggatctatgacaagggctagagcaaggaaagtcaaggaagctcttcaacaagtgttgtcaatactatttgaatacaagcccaagtttcaaggagaaaagtccaagggcccaattggcaacctaggcatcagccttttgggagaccaaatggtggctgacttgttggctgttgggg

SEQ ID NO: 88655 - DNA, 378 bp, Glycine max
  Peptide Sequence Number=SeqID_180340
atgaccataatttttctctgcgtgcctccggactcgattgtctctggatgggataaaggtgtgcagatgaccataatttgtctccgcatgtcatcgggcatgccgcctgaacatgacaaaaggtgcagaatgaccataatttgtgtatgcgtgccaccggactcgatcgtgtctggatggcgaaaaggtgtgcggattaccataatttgtctccgcatgtcatcgggctcgccgcctctggatgacaaaaggtgcagaatgactataatttttctctgcgtgccgcctttggatgacaacacatgcgtaatgaccataatttggctctgcgtgccaccggactcgatcgtctcaggatggcgaaaggtgcacggatga

SEQ ID NO: 88656 - DNA, 323 bp, Glycine max
  Peptide Sequence Number=SeqID_180341
agtcattcggggttcccgtcacacctagtaaggtgatccgaccgccgatcacccgggccttcattaagaagtattgcacgcccaggcatgtgcagggtgatgcaccacaggccgcagacgcaccgccaccacctcatcaggctgatcccaccgggtcattaggcatggagcggtgcagatacacgagtgtctctaccagctcagcctcagtcagtagggccaggatttcgttccttttgcgtgccctactccagatcaatttaggactgaggtcgcatggcccggagattggccctaggcctaggcaggggaggcgcctatag

SEQ ID NO: 88657 - DNA, 357 bp, Glycine max
  Peptide Sequence Number=SeqID_180342
atgttggataaacaagtagttgtgtctccagcaaaacctacagatgggccggatgctcaggttaagtgggatgctaccatgttcggggtgtttaatgaacacttctcattgtacataaagcacgaagatctgtctaaaattgcacatggtggtcaatgtctcaacatatctgttatacagttgtggattctgcatctgactgagacaagacttgatgatactccacaacctaaatcgaaggctgctgctgggtggattgttgttaagtgtaatagacaaaaaggaagcaccgagtgtggctattacgtcatgcacttgatgtccactataatcctaagaagtttcaggaataactag

SEQ ID NO: 88658 - DNA, 270 bp, Glycine max
  Peptide Sequence Number=SeqID_180343
atggctagcgggcagggcaagtaccgcaggtggccatggctatacttgtggatgataaagacttccgctagagggagaggctaccatatggaagagactcacacttgggggggagatgtgttgggttacaagtgtgagggagaagggagacacaaaagaattcaagcggttagtcctttgttcttttggaaaagggagaagagagacacaaaaagaattcaggcggttagtccttggcgaattctttttggcaaagggagaagggaatga

SEQ ID NO: 88659 - DNA, 234 bp, Glycine max
  Peptide Sequence Number=SeqID_180344
atgtataatagtataataacctatattggtctccactgcagtgcacattggcaaatgctcatcattttgcctaagaaaaatgttgtcatctggttttgttcattgcataataggctagacaactacctcaaaggcataattaacagtgctttgaaaggacttgacgatactcaacaaagtaaatccaagcctgctgctgctaggtggattgtgttagtcaatgaatacaactaa

SEQ ID NO: 88660 - DNA, 288 bp, Glycine max
  Peptide Sequence Number=SeqID_180345
atggatttaatgatgaaatctgttcattttcagcgcaaaggagaatcaggcagagcatcagcatcaaagttgcgcgctaagcacgagatcagtgcgctaagcgcagcaggtgccttcagccaggctcagcgatacacaccttttgagacttggcacagaattttcagaggcacttgtgtacagcattccattgtgcctattttgggaaaagagcccttgaagcagcaaagaggaacaactagtgcgttgaagcctaggttttgtcatttgagagagattattgagtag

SEQ ID NO: 88661 - DNA, 336 bp, Glycine max
  Peptide Sequence Number=SeqID_180346
atgtcgatctccccctgtagaagtatcagttggtctgtgctgtcacgacattgggatcgcgccccctacaaggagccccttggacccggagaagtccaacagggacctagggttcctggctctaatcatcaggcccccattaaccgggctttcatcgagaagtaccacgcccccaggaagcgagcaatagacgcaccaccaccacctccagagtccacctcagctcatctacaaaggctagagcgttgcctacaacccgtggctggccagcaggcgaccaagtccaaagccaatggtagcaaaatgcctcacaaaaatatatatgtgcttaggtag

SEQ ID NO: 88662 - DNA, 378 bp, Glycine max
  Peptide Sequence Number=SeqID_180347
atggcgcctcctctcacctcttttcctttgtcttccgctacatctccatatggtggaaaatcaccattaaaggaccccattgaagctcaaagatccagcctccatagaagccccacaagcaagcttctatcaggtcagggtgtgtgtgtgtttgtcatgagggtgtctgtgtgtggacaaagcatcaatgctagacgatgccatcaactatctgaagaccctaaagcttcagctacagataatgtcaatgggaaatgggttatggtcacttatgatgctaccagctgcaaccacggcgcatcacatgaatccttagctaggaatgggattcaggccaccacaactacctattccaccatcactttctgctatcactga

SEQ ID NO: 88663 - DNA, 288 bp, Glycine max
  Peptide Sequence Number=SeqID_180348
atggatctccttcaagacaaaaacactcatcatcccgttgtggttttctcgagtttaagaatcaagaatcttctcaatttcaatgtgttggttctattctcgaagcacgggaaagagttggaacaagaatatagtagaaacgggggtatgaacaatgtgattgaagaagagacaaggaagaggccaaggctgaattggggtgaaggacttgctaagttagagaaaaagaaaactgagggtgatggtgtaagtgttgctattgtttctactccaacttctgctgcatga

SEQ ID NO: 88664 - DNA, 549 bp, Glycine max
  Peptide Sequence Number=SeqID_180349
atggggaaatttatgcaaaacaatgtcaatatttgttcgataaccatcaagctctaccctaaatttatcaagatccgcgtcggccatcgccgcctccttgaaaccacacgggcctttgagggagtcacttcacttcctaaaaagcccccagtggcactgatgaatccacacacttctgcgatagtctcctctacaaccgcctcacctctgtgtgacgtcgtgtgggacaaggtcatcagtgcccaaggccaccacatccccccttacgtcgtcggggttggtgcttccctttgtgctatttatgcttacactgtttttgccgagtggaatgcggactcctgcccaaaacctgttcaatggaatgctcatgaagggaaggtctgttgttgtggaagccattgcacttctcaagggaagcatgtgcttggcatgatgttctaccttatcatagctagtcctaataatgaatgcctcaagttattcatattctatcaacctttagatgcatttctccgttggtcaagattcactcaaagatcacattcatag

SEQ ID NO: 88665 - DNA, 582 bp, Glycine max
  Peptide Sequence Number=SeqID_180350
atggcacgcttattatttgataacattgagaacaaggatgttgtttcttggagcagtatgattaggagctatgataagagtgggttgcttcatgaagcattggaccttttgagagatacgcatgttatgagagtcaagcctagtgaaattagaatgataagcatcacacatgtcttggcagaacttgctgatttgaaattggggaaagccatgctttcttatgtaatgaaaaatgggaagtgtggaaaattaggagttccactatgtacttctttgattgatatgtatgttaaatgtgaaaatttagcttatgcgagaagggtttttgatggcttgtctaaggctagtatcatttgttggactgctatgattgcaacctatatgcattgcaataatttgaatgaagatggacattctaataaccataaatctaatgctaagaaccacaactccaccaacatgcctagtgatttgacaagtgcaagggatcatggactggacaacaaaaaacaagaagttgttgttgctgtagggaatggttctgatgatttctatgatggacttgggtgttgtcatgtttag

SEQ ID NO: 88666 - DNA, 1491 bp, Glycine max
  Peptide Sequence Number=SeqID_180351
atgttttcaatgttcaattctagtaatgagctggttgaagatccgttggccgttgagacagaaggacctatgattaaccattggacattagaggagagaaagattttcttcgagaaattttcagcctttgaaaaagatttccaaaaaattacatctttccttgaccacaagacaactgttgactgtgttgaattctacaacaaagatcataagaccaattgtttagagaaagataagaagaaaaagaagaagaagatgggttgtaaaagtcaaaatttgaaaacatccaaaactaccgtgaagggattgggctacaaggctgcatgccaacaacctgtgacacctaacattactcgtcaggatattgatgatggagattgtgagtggacaaatatggagaaggcagcctttcttcaggctgtatcgtctttcgatgaggattttagaatgattgcacgacatgtaggagcaaagtccaaagatcagtgcaagaaatttttcatcaagggtcagaaatcccataggttggatctcatgcgccatatacttgaaaatattggatctctactgaatgaaataaatcttggcatgagtactgacactaacgatgcacacattgtggaggcagattcagtcactgacaatgataagttaggcacaaaaacaattgatgaccaaccttcatttgtcgtgaactcgagccgtgataaatccaaacctatggaagccaggaatctttcaactaactttaaggaattagtcattggcaatgataagtcaggaaccaaaacaaatgatgagcagtcttcatttgacatgaactcaagccatgataaatccaaatctgtggaagccaagaatcggtcagctgacttaaatgaatcgaaggaaattaatagagaatttgatcatcaagataaaaccatcatttctaataaatataacgatgagtctaaactggtggacactgatggttgtggggttgtcttgtacaattatgataagtcgagttcagtcaaggacaagaaagctacaactatgtcaaatatcatggaagtcagaaaagataatgtgggagatgcagttacagaattggtgtcatctgcttccaagataattgaaccatatccctctcattttgttgttgaggatagactatctgtgatgttgatgtcatttcctacatggcttgatgataaagatggtaaacatggaggtgatatcgatgatgatgtggtggaattgaaaaaccaaagccatgattcaaacaccaaagcaaatacttgcttatcatctgtgctagtttctttctcaacattgacttttggtgttgaaaatcagctcaaactgttcttgaaaaagtccaattatttaggaccgtccatggaggatcctatcccaactgcaaattcaatgttgcaaaataccattggtgtgctaggcatgttgttcaacaagaggaatcaattacacaagatggcctgtctttga

SEQ ID NO: 88667 - DNA, 195 bp, Glycine max
  Peptide Sequence Number=SeqID_180352
atgaggtcctttaatggtgattttccaccatggagatgcagcggaagacaaaggagaagaggtgagaggaggcgccatccactagggaataagccatggaagaatgagcttcaccaccaagtagcttccttgataagctttcttgagaaaacttccttgagaagcttctttgaaaaaacttccttgagaagctag

SEQ ID NO: 88668 - DNA, 285 bp, Glycine max
  Peptide Sequence Number=SeqID_180353
atgcagtgtaaagaatgtgaaatagataacagttatttacattttacacagttcgacaattgcggtcgtgcgaggcgaggctcacgggtgcgctttccaaaggaggaaaggtgcgcggagtcgccaccaacgtttatttgtggaaaacgtcggaaaaaccgaaggaaaccggtcaaaatgaaaattctaagttcgggagttgtatttacgtttgaggaaggtcgacaaaagcggggctcttactcctacgtaccctccatcgaagaggaaatcagacctacgtag

SEQ ID NO: 88669 - DNA, 416 bp, Glycine max
  Peptide Sequence Number=SeqID_180354
aggcggcgggcccgatgacatgcagagaccaattatggtcatccgcacgcttttgctatctgtaagactcaatgaggatagtaagtcgagtggtgggcagagacaaattatggtcattccccacaccttttcgccatccagaggcgatcgtgtctggtggaacgcagagacaaattatggtcattttgcgccttgtgtcaaccaagaggaacgaattcgacagtatgaggatgatgtgccggggcaacggtcataccctaatttcgtccggggaccatccgttgttgggatgcgaccctcgtttgaccacttcgagggggtgcaaatagcaaccaggcccacttgggccttccaggaagttctccagaaggcggtggcttctggaggaagcaacctagctcgcctgggcgagctgg

SEQ ID NO: 88670 - DNA, 309 bp, Glycine max
  Peptide Sequence Number=SeqID_180355
atggaaaaatctgaaaagaaaaatcataatgaaaagaaactgaagaaagcatacatcacatgggatgaaaatgatttggaatcctctgaagattctgaaaatgaagagataaatctctatcttatggctaaaagttacgaaagtgatgaagagggtataaatctgaaaaacaacaaaagtttcataaaaacttttccacttccacacaaaaatgtaattctaattctatcacttgtttctactgtggaagaagaggacatggcatatcaacttgctacttcaagaaaaattatagtaaccttaaaatga

SEQ ID NO: 88671 - DNA, 297 bp, Glycine max
  Peptide Sequence Number=SeqID_180356
atgggatcgagtcaagcgccttcgcttaaaaagaggttctatcaagtcaaggttaagagcctaggaaccaccagtctaaaagaattggggcagttgatgggtcagctccagcgacaagcgtttcgcaaagaagtgaggcatccttgcccgctagaaagccaccgttcatgcacagagaaaagtggggcaaattgggaccgactcttagcaagcaaagaacgagcatctgtcaactggttccctcgttggaaagaaggaagaaccgaggttcttgtttcatgcggaggatttccgaat

SEQ ID NO: 88672 - DNA, 297 bp, Glycine max
  Peptide Sequence Number=SeqID_180357
atggagaagccccggggcattccattgagtactgattttcaagtttattcctcagttacagcgctaaataaatggataaatttgacatctttgtccctcatcctctctgtcgcaacctaccctacggcgggagggcgatgcgagactcgcgggatgcgtgttccacgaaaggaatacgtgcggagtcgccaccaacgtttatttgaggaaaacgtcggaaaaactggaaaagatgcgatctacgaacttttaagtgaaaggctcgggagttgtatttacgcgcggggaaggtattag

SEQ ID NO: 88673 - DNA, 150 bp, Glycine max
  Peptide Sequence Number=SeqID_180358
atgagaaatgctctcgggagcggaagcttcgcgcatacgccagacatcttctcaaagatcccaacgaaacaactggaggaagctgctaaatctggaaatactaacaccgtcattgatcctccatctcccatcagacgacacgtgaagtga

SEQ ID NO: 88674 - DNA, 727 bp, Glycine max
  Peptide Sequence Number=SeqID_180359
gggatgatacctctagaaaccatcaagagagatatgaccaccttgggaattatcactaaaagccttttagttcctccaagctcttatccatggcctcctatggtggagtccattgatgaagaagatcctaggcctacaagctccaatggagcttgcatcaacatgtccttgccttcagaggacaacacatcctcgccttcagaggactacatgtcctcgtctttagaaggctacatgcccttgccttcagagtactacacagggctacatgcccttgcctttagagggctacacgtcctcgcctttgaggaggactacatgtccacgccatcagagggctacatgtccttcagaggactacacgtcctcgccttaagaggactacaccccctcgccttccgagggctacacgccctcgcctttagaggactactcgtcctcaccttcagaggactaccagtcctcaccttcagaggactacacgccttctccttcagaggactacatgtgctcgccttcaaaggactacatgtgctcgccttcaaaggactacacgtctttgccttcaaaaggctacacgccctcgccttcaaaggaggtctggacgccctcgccttcagaggtctaaacaccctcgccttcagaggactacacgtccttgccttcacagggctgcacgtcctcactttcagagggctccacatttgcgcctttagaggacttaaag

SEQ ID NO: 88675 - DNA, 411 bp, Glycine max
  Peptide Sequence Number=SeqID_180360
atgggggagacacaggaaataccctaccacaatctagcagacttcaagccttgcctcggatatgccactgaagggaaagcagttggtggtatacccctgcaaaacactttggagggccctcagtatcacccacaagcacacctcttgcattccacaacaagtaagaacccttatgctatggcagaattgggaaagttggatcatctagaggaaatgctcagggccattgaaggaggcgaagattacacctttgctaacttagaagagttgttcctagtacccaatatcatcacccctcccaagttcaaggtgccggactttgacaagtacaaggaggctacttgccccaagaaccatctaaagattattgtcagaagatgggggcatacgcaaaagatgaggaactgctga

SEQ ID NO: 88676 - DNA, 466 bp, Glycine max
  Peptide Sequence Number=SeqID_180361
atgaacattgtacaactttccatcctcgcctctcctttagaggactacacgccctcgccttgggtactagttaccctcaccttcagaggactacacgtcctcaccttcagagggctacacgccctcgccatcagaggattgcacgtcctcaccttcgtagggctacacgccctcacctttagagggctacacgtcctcaccaatagagggctgcacgccctcaccttcagaggactacacgtcttcgccttgagaggactacacgtcctcaccatcagagggctgcacgccctcacctctagaggactacacgtcctcgccttaagagggctacacgccctcgccgtggtactagttaccctcaccttcaaaggactacacgtcctcaccatcagagggctgcacgccctcacctctagaggactacacgtcctcgccttgagagggctacacgccctcgccttgg

SEQ ID NO: 88677 - DNA, 87 bp, Glycine max
  Peptide Sequence Number=SeqID_180362
atgactgcaggtgatccaccccagcagaagacaagtcaaggaaatgagaaaaagaaagaagatgagaatattactcaaggtagctga

SEQ ID NO: 88678 - DNA, 366 bp, Glycine max
  Peptide Sequence Number=SeqID_180363
atgacttcccgacttatgggatgttctcaggttggacaactgctggcagacttggttgtcccatataaagagtataggaggaacccacaagaagagcgagccattagagttgtttttgagacaaaaggttcacacattttgaaaagtgcaatgaacaagatcagaaatggtcaagataaaggaaagtggataacagccaatgttcgagcagccttggatgaacattggggttctagaaatttcctaaacaagagctccactgccaagacgaatcaatttgttgatagaggagcctcatcatactgtggtggttccatatctactgcggctcactttgaaaagctgataatttcactttatatgtga

SEQ ID NO: 88679 - DNA, 276 bp, Glycine max
  Peptide Sequence Number=SeqID_180364
ttgcagggccgcgaacacgtcgcgcacgtgcggcaggatctgctcgcccgcatgggtcagttcgagctgcggcgcattgcggtcgatcagcagcacgcccagggtcgactccagcgcgcgcagggcgtggctggtggccgagggcgtcatgccgatcttggcgccggcactggcgatgccgtcggcgctggccagggacaacagcagttccagctggcgcagggtggggacgtcgggcccgaggggcgaaatcatattgaatccaaattcaattga

SEQ ID NO: 88680 - DNA, 363 bp, Glycine max
  Peptide Sequence Number=SeqID_180365
atggcatccttcagccagatgcagtcccagatgcaatctcagggacttgcactgcctcccgagcctttggttggtccctctaatcctcgagtaagcacaaaggggagttgtgttgatccctcaataaatgatcctgagatgggtgactcagataggtgcggcttgtacatcgaagtagatcctgcccgcctggttgccctagggagagtttatgagggatccactgttgttcataacactcctttgttgcctggccaagtaaaggtgagtgtggaggaggttacagatgtagattctccagttcctgtacccactgatgaggtttccttagtagggcaagcacttcacaccttccttgcttga

SEQ ID NO: 88681 - DNA, 454 bp, Glycine max
  Peptide Sequence Number=SeqID_180366
tcagggtgttccttttgagcacactctagttgatgactggaagcatgtctattctagtcatgatgcccataaaatggtctgcaatgaccatgctgacatgactgacagattgcttgctggtcaaattgaccaggccaatcttgttaggtaccgaatgcataaggtattacgggccaatgcacctcttccgtatcctcatcttgttactttgtttcttcagcatttcaatgttcatttagaggatgagccttttattaaggttaaaagatcttttgctattggtgttggtgctgttacttctttcgaataccggaaggatatggatggccaatgggtgcgtaagcaagacctgccacctcccattcctgatgaacgcacaccttctccaccaccgcaacgtgatacttcctcttccttattaaatgacgtcctcactgagctacgggatctttga

SEQ ID NO: 88682 - DNA, 918 bp, Glycine max
  Peptide Sequence Number=SeqID_180367
atggaacaattgtattttgatgggatgacaatttgtgcccatgttggatttcctgatctattcttgacattaacatgtaatctagcatggccagaaatacaacgacaagttgcaaagtcaaatcttatagctcatgattgccctaatgttgtgtcacgggtattcaaaatgaaactaaaccagttgatgcatgatcttaagagtggacatgtatttggtcccattcttgcattggcaaaaagaggattgcctcatgctcatatcttaatctttttgcatccttcaaataagtatccaaatccagaagacattgacaacataatttctgttgaaataccaagcaaggacagggatccagaattgtatcaaattgtctccaaccacatgatgcatggtccatgtggactagctaataaaagggcaccatgtatggccaatggcaagtgtttcaggtttttcccaaaaaagtttcagccagccacaattgttgaccaagatggttttcctgtttatagaagaagagacaccagacggattgtgcaaaaacagggtgttcatctcgataatcgatttgttgtcccatatagtccacatttgttactcaaatatagaacacacctaaatgtggaatggtgcaatcaaagtacctcaataaaatatttgtttaagtacatcaataaaggatctgatcggattacaacagctattgtcaatgaccaaaaccaggatggcacacaaaatcaggttcatgatgaaattaaacattatcttgactgtcggtatgtgtcggctcctgaagcatgttggaagatttttgcattcccaatgcatgggcgtgcaccggcagttgaacgtctttatttccacctagaaaatcaacagcctgtttattggaaagatagtcaagaaattggcaca

SEQ ID NO: 88683 - DNA, 344 bp, Glycine max
  Peptide Sequence Number=SeqID_180368
atgacgttgctacttagcaacattctgcccagcgaccgcaataccgatctccccctgcggaagtatcagttggtctggatcgcacccacaaagacacctagtggactgaagaagtccaacagggccctgggggatcctgcccgcaagacacctagtggacccgaagaaggccaacaaggtcttggagttgccagctctaaatacgggtctctgtcagttatagggagtgtctgtcgcccccagcaaggtcatcaggccccccctactaatcgagctttcatcaagaagtactgcgtctccaggcaggcgcatggcgaaacaccacatcagcattgggatggccg

SEQ ID NO: 88684 - DNA, 303 bp, Glycine max
  Peptide Sequence Number=SeqID_180369
atggacatcaagttgatgcttgcccctaagtcaatgaaagccttccttactgactcattccctatggtgcaagggattgtcacgctcccggggtctttaaatttcttgggtagtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggctcgggagttgtatttacgcgcggggaaggtattag

SEQ ID NO: 88685 - DNA, 207 bp, Glycine max
  Peptide Sequence Number=SeqID_180370
atggttaccatggacaaatggatgaatattacggatataagatatgtcattgcttcacgatacgacgtgattgttatttctctttcacgacaacaaagcatgacattttttcctcttagaagtcagccaccaccagattcttctgtgcatcgcgtaatatgcattgatcatgtgtatggaaattattttgtacaggttttgttatga

SEQ ID NO: 88686 - DNA, 270 bp, Glycine max
  Peptide Sequence Number=SeqID_180371
atggcctccatcattgtggccattttctctttcaaggcctccgtgtcggccttcatttgctcttgcacctcctatacttcacccattactctagctctagcacagattttcaacatggtccatgacatctttgtcaaggtgaaactggaagtaacagggacatcgacagtcctaaatgtgtttggtagtagacgaagcagcgatgtaactcgatccatcttttgccccaattttgcaagatggttacttccatacttcaacttgacttga

SEQ ID NO: 88687 - DNA, 775 bp, Glycine max
  Peptide Sequence Number=SeqID_180372
gactacacgtcctcgccttcagaggactacacatcctcacatacagaggactacacatcctcgccttcagagggctgcacgccctagctttcagagggctacacgccctcatcttcagagggttgctcgcctcaccttcagagggctacatgccctcgcctttagagggctgcacgccctcgcctttagaagactacatgtcctcgccttcagagggctacatgtccccaccttcagagggcaacacgccctcgccttcagaggactacacgtcctcgtcttcagaggcctacacgtcctcaccttgagagggctacacgccctctccttcagagaactacaagtccacacctacaaagggctacatgccctcgccttcataggactacacgtcctcgccggcagagggctacacgtcctcgccttcagagggatgcacaccctcgccttcataggtctacacgtcctccccttcagagaacaacacgtcctcgccttcagagggctacatgtccccaccttcagagggcaacacgccctcgccttcagaggactacacgtccccgtcttaagaggactacacgtcctcaccttgagagggctacacgccctatccttcagaggactacacgtcctcaccttcagaggactgcacgtcctcgccttcaaaggactacacgtcctcacctacaaagggctgcatgcccacgtcttcagaggacaacacgccctcgcctttagaggactacacgtcctcaccttcagagggctacac

SEQ ID NO: 88688 - DNA, 519 bp, Glycine max
  Peptide Sequence Number=SeqID_180373
atggcaaaaactagaggtaaaagtgtcaaccgtactgaacgcgtgggacctaccgcgtttgcatgtagacgagttcgagaagctgatgttgctgatgaccatgaggagcatgacgagcaccagcaaatggagcaacaagatgagtcgcaaccaactgatgattttgtggttgatggtgggtctgaggacacatcagtcctcacttcctatgctgatcatgtagcccgaagtttgtccttgggtctaacccctctctccctcaacctttgttgcctcaaacctcgagctctccctcaaacccctctctccctcaaacctcgctgtccctcaaacctcgaggtctccctcaaacctcgctgtccctcaaacccctctctccctcaaaccttgaggtctccctcaaacctcgcggtccctcgccaacgtccattccgtgcactggagctcgcgcctgtcgtgacctgtttgccatctcgaggaagtgtatctactgtgcgccttaggtcatcgtatcggtaa

SEQ ID NO: 88689 - DNA, 492 bp, Glycine max
  Peptide Sequence Number=SeqID_180374
atggaaacctgccccgcggtggaagagttacttcaacgactcatggactggggacaactcgaagtgtccgaaggagatagggaagaatcgcaaatttgcatgcagtcggaagaaaggaaggttcccccaacccccaaagccctagtaatatgtttcactaggaatgtgaccagctccaggtccaagtaccccccaacagcacccaagccaacgccgttttcctatcaaagcaataaggccgttccatggaagtatacccctcccgcttttggagaaagagctgcaaccgaggttgactccttgtcagccaaggtgaccaacattaccggccttagtggcgtaacccgcagtggccgggtgttcgctcccccttactcggtggaattgccctctaaggggaaagcacccatgatccaagagcccgcagacgtggccaccccctcaaaagaagtggatcccccggtggtaaaacacttacctagttgtttctag

SEQ ID NO: 88690 - DNA, 567 bp, Glycine max
  Peptide Sequence Number=SeqID_180375
atgatgcaatcctaccccccaagggtattggatagaagactccaagaagattgggccaaagatgcaggaggaggccctagggttctcatgagccttagggtttgtagggcaccctacaaattaaaggcaccctaccctataaagcaacaacttaaaaggaagcctactttaaaatcttatggctctcactcttatccaaagaaagaccaaggtcaaggcattttaggggttgcaccttctaagcccaaagatgttaagagggacgaggaagaaatactagaaaaacaaaaagaaaaaaggataataaggccttgtcttcaaaggccaaggggaaggaaaaagaggaaaaggatttctccaagaagattgttaagaaggaaaatcattttgcaacaaaaggtgatatcaaaagagcactccttcttaaacaatccttctaccttctcctatcaagggaaacctcccttagcacagccatatctcttgagcttgaggtattataaggtaccaaatccctatgataggtggtatgatgaatgtgttgagtggtgtgaccctcttttgtaa

SEQ ID NO: 88691 - DNA, 456 bp, Glycine max
  Peptide Sequence Number=SeqID_180376
atggagatgacaaagagcttagaacataaaaatctgagtagtgatctggatgaaagaatatgtcatgcaggattattagaagagggttggaaagtttttgaatcaatcaaagttcttgatgtagaccactatgcatgtatgattgacatgctaggtcgagttggtaaattagaagaagctgtgaaattgattcagagcatgtcaatggagccccatactggaatctatggacctctgttaaatgctaccaacatccataaacgagttgaacttggggaacttgctgcagctaaactgttcaaggttgaaccacataatttcggcaattacatgttgctttctaacatttatgctttggctggcaggcgaaaagatgttggcaaagttagggataaaatgagaaaacagggagtgaaaaaaacaattgccatgagctgggtaaagcataactcataa

SEQ ID NO: 88692 - DNA, 165 bp, Glycine max
  Peptide Sequence Number=SeqID_180377
atggtgaatggagatgcagtggaagataaaggagaagagaagaaggagctttgccaccaagaatgtgccttggataagaagctcggagatgatgcttcaatggaggaaaagaaagagagaggggggagcacgaaattgaaggaggaaaagggggagaaaagttga

SEQ ID NO: 88693 - DNA, 597 bp, Glycine max
  Peptide Sequence Number=SeqID_180378
atggtgtctcgtttcgtgatgcacaatggtaagtctacttgtccattagaagatttttgcatggtgcctgataagagcaagattaattgggaggagttgctggctagcatgacaggatcgacaattcgctggttcccaaggtgggaggaggtgcctaatggttatgtcaactataaccctatgttggggatcaggcagttaggatacccgatccgaggaccgccttcaaacggagctatccaaccgttcattgttcaaggaatgaatgaagaacatctcgggctacaccaacaaattaggaaggtgtgggactcaccaaataggagagtgttcgtggccgcacaacaacttagcctcgtactattaaggactttagaatcaaaccagtttccactgttgaatgaccgtaacaaagcatgcatctatgtgatcaaggatctcacaatcactcacaaactcatctcaagttctcagaatggcttccgcttcgagctctcatctctgcagatcttaacacaacaaaatctctcagaactctttggaacctggacctttctctctctagaacttcctaaacaagcaaaagcttcaagctaa

SEQ ID NO: 88694 - DNA, 210 bp, Glycine max
  Peptide Sequence Number=SeqID_180379
atgggcccaaaatctaccctaaggctcataagaaccatagggcattctcctgcatctttggcccaatcttcttggagtctccttgggaggattgcatcaattccactgccattgatcttcaagaagcaaaggactccattgataaagaagatccaaggcctacaagctttacatggagctacatcacctatgaatgtaccctttctatga

SEQ ID NO: 88695 - DNA, 324 bp, Glycine max
  Peptide Sequence Number=SeqID_180380
atgtcgtaccggatgtcacgacatcacgcttcagaacatgcagattatatgtgtccgtatgaacagattaaacaaacacaagagatcaactctacacacataggtccaacacttgatgttagggtaccatcaaggtggctcacaaaagactcaagtcccaaaaactcacaaactaactcttcaatcccggacttggtacagaactcgtgcagcctccatgattatatagccgtgtacgattctgggctgcaactccttgatgctggaggagatctatcttcttctgaaaaatctgcagttaaagaactaaaagataacttttga

SEQ ID NO: 88696 - DNA, 348 bp, Glycine max
  Peptide Sequence Number=SeqID_180381
atggtcatcattgtcaatgcggaagcttgtggttacgtgagcatgaactactatcaatatatagatgttgtttatacaaacgagcacatcttaaaagcttactccgcacaatggtggcctcttgggaatgaagcggctattcctccttctgatgatgaatggacacttatccctgacccagctacaatttgtgcgaaaggtcggccaaaatcaacaaggataagaaatgagatggattgggtcgaaccatctgagcaccgatctaaatgtagtagatgtggagccgaagggcataacaggcgtcgctgtccaatgcaatctgagcgtgggagttgttcaactcgttga

SEQ ID NO: 88697 - DNA, 636 bp, Glycine max
  Peptide Sequence Number=SeqID_180382
atgtcctcgccttctgaggactggacgtcctcaccttcaaagggctacacgctctcatcttcagaggactacacgacctcgccttcagaggactacacgtcatcgccatcagaggacttcacaggactacacgtcctcaccttaagaggaccacacgtcctcgccatcaggggaccacacgtcctcgccatcagaggcttgcacgccctcgccttcagaggactacacgtcctcgccttcagaggaatggacgttctcatcttcagagggctacacgccctcacctttagcggaccacacgtcctccccttcagaggactggacgtcctgaccttaagagggctacacgccctcatttttagaggactacacctcctcccctatagaggactacacgtcctcgccttcagaggaatggacgttctcatctttagaggactacataggactacacgtcctcaccttcagaaacctacacgccctcgccttcagaggactacacgtcctccccttcagaggactacacgtcctcgccttcacaggaatggacgtcctgaccttaagagggctacacgccctcaacttcagaggactatacgtcctccctttcagaaggctacacgtcatcgcctttag

SEQ ID NO: 88698 - DNA, 180 bp, Glycine max
  Peptide Sequence Number=SeqID_180383
atggccgccgtgatccgccattacttgccattgaacccctacaccaagaggaacactttaatcagagcggaatcctcaaaatcctcctcaaagattcgatggagaaaatccctcaatcctccatttcatagtttctctgagggtgtttttgcacttcctttgaaaaaccctagagaataa

SEQ ID NO: 88699 - DNA, 168 bp, Glycine max
  Peptide Sequence Number=SeqID_180384
atgataagggtttttaaatcaatttcagattcatcgtctgattctgaggttatgtcagcccatgttttctttggaagtttggtcgatgacccttctgtttttggcttctgggtagatgacccagcctgggttggtgacccagatgatgatgcacaaaacaattgctaa

SEQ ID NO: 88700 - DNA, 342 bp, Glycine max
  Peptide Sequence Number=SeqID_180385
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccgaacaaagtactgctggtgaagggactgactgcaaacttgatcagcatcagtcagctgtgtga

SEQ ID NO: 88701 - DNA, 321 bp, Glycine max
  Peptide Sequence Number=SeqID_180386
atgactctcggcaacggatatctcggctcttgcatcgatgaagaacgtagcgaaatgcgatacttgtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggaaagatgaaaaggactttgaaaagagagtcaaagagtgcttga

SEQ ID NO: 88702 - DNA, 627 bp, Glycine max
  misc_feature (601)..(601): n is a, c, g, or t
  Peptide Sequence Number=SeqID_180387
atggagttggcatgggacggggcgaaatttgggttacctaatgcctcaaatggtgacaaatgtttaaacatatttgtactgaagctgtggatgatgtttatgaatgattggagtacaagcattggtttttctccagtgtacggtttccttgagccccagtctatacgctgcataaaggacacgcgtgaagaatgtcaaaagtacatagaaacgtgggtcaaggagtcacatcgagaaatctacttaggaccttacttcaatcaggcacattggcaacttcttgtgttgtgtccacgagagaacattatagtatggttatgttctatacgaagaaagcctgatgttcacattaagtttgcagtgaacaaaaaatatgcagtaatctccaaggcaaggacaatgcacctccacctccaccttaatggattgaggctaagccatgtacaacaaggaggatatgagtgtggatattatgtgatgcattggatgtggtgcatcgttagtgccggtttgaaaaatgaactccacaattatttttcagatggaacagcattagacactgacaccatgacgacaatacacaagaaatgggcagcctatnttctagaagttggaaaatggatgtaa

SEQ ID NO: 88703 - DNA, 189 bp, Glycine max
  Peptide Sequence Number=SeqID_180388
atggtgtttttcctaagctacacgaaagcaaaggctaaaaacgctcaagtgagaaatgctctcggaaacggaagcttcgcgcacactccagacatcttctcaaagatcccaacgctgaagaccaaatttctcaaagatccaacggttaacgaaggctgggtagtgtttttaccgagacagctcatgtag

SEQ ID NO: 88704 - DNA, 785 bp, Glycine max
  Peptide Sequence Number=SeqID_180389
cgaggaagcggaagagcgcccaatacgcaaaccgcctctccccgcgcgttggccgattcattaatgcagctggcacgacaggtttcccgactggaaagcgggcagcagaaactcatgtcaatgaaccatctaaggaaacagtgaaacgagagtcagaagctgagaaaccttcagaggaaactcatatcagtgaaccagttaaggaaacagagaaactagagtcagagactgagaaaccttcagtggaaactcatatcagtgaagcagctaaggaaactgtgaaactagaatcaaaagctgagaaaccttcagaggaaactcatatcaatgaaccagacaagaaaacagtgatagttgagtcagaagctaagaaaccttctgaggaaactcatatcaatgaaccagttaaggaaacagtgatagtagaagctgagaaaccttctgaggaaactcatatcaatgaaccagctaaggaaataatgatagtagagtcagaagctgagaacccttcaaaggaaactcttgtcaatgaaccagctaaggaaacagtgaaactagagtcagatgctgagaagccttcagaggaaaacaatcaaagcaggggatcctctagagtcgacctgcaggcatgcaagcttggcactggccgtcgcccgcaccgatcgcccttcccaacagttgcgcagcctgaatggcgaatggcgcctgatgcggtattttctccttacgcatctgtgcggtatttcacaccgcatatggtgcactctcagtacaatctgctctga

SEQ ID NO: 88705 - DNA, 309 bp, Glycine max
  Peptide Sequence Number=SeqID_180390
cttgggaggattgatggggacccggtgttgagagaaacgaggatatgggctacgtgggagtacgtgagctcagttggagggtggaacttcctgcttttattcgttgaccacagagtggtacctggagatatgtcgcgggggtcaggagaccttggggacgtcaggcgagctcctggcagtcaacagataaaaggaacaaagaccacaaagcaaggaggcttgtggcttaaaaatgaaggcaggaggctaagatggtctctggtaatcgattaccaagagggtgtaatcgattaccaggctaaaaacaag

SEQ ID NO: 88706 - DNA, 279 bp, Glycine max
  Peptide Sequence Number=SeqID_180391
atggatatctctgaagatactgacatccctgtaatattgggaaggccattcatgttgaccacaagttgcatagttgatatggggaagaggaagctggagctaggttttgaagatcagaaaattgattttgatttgtttgttgaagacaagccttctccagaacataatgtttgcttacaggtaatggaaggaggtcaagaggttctgaaactggccaaggttgagctaagccaacttcaattcgatctgaattcggctaagcttcagcctgatcgctaa

SEQ ID NO: 88707 - DNA, 342 bp, Glycine max
  Peptide Sequence Number=SeqID_180392
atgactcaagagctggtagcccgcggagacaccttacggttatccgcacctcgtcattcagtgaccccaaaggcggcgggcccgatgatacgcggagataccttacggttatccgcacccttttgtcatccagaggcggcgggcccgatgacaagcagagaccaagtttggtcattctgcacccttgtatcgtccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 88708 - DNA, 552 bp, Glycine max
  Peptide Sequence Number=SeqID_180393
atgcccgggttccggtttaaccggttggcctggctggtccagtctgagttttataacacttcacacaagatccctttggtcttgaatcacagacagtacactgcccacttaccttgtactgaaattcaacattttattaaaagaacgaagacagcacatttgaactctattcatgttacattaggtctttacgcctttatcttattctgcaatgactctttggatcatgccaatgaattatcaaactccctgaaagaaagtgccaatattaacactgtttgggcatcgcttattgttgaagaatgcacaagacttggtttgatgtatttgtgtattgctcctggatctagaccttcccctgttgctgttgctgttgcaagtcacaaattaatcacatgtatttcatgcttcgatgagcgttcacttgcatttcaagctgttggatatggaagaggatctcacattccagcagtagccattacatcatcaggcactgcagtttccaaccttcttcctgctgtatgtttcattaatattgcttgttttacatag

SEQ ID NO: 88709 - DNA, 165 bp, Glycine max
  Peptide Sequence Number=SeqID_180394
atgccttttagaggcttgaaaagtggaagaaaacgaactgcgttttatggaaaacgcgatgaactcgctaagcgttctctgaagaactcgctaagcgagttcatcctcttgctgaactacctgtggctaagcgaggctaaattgctaagcccagatggcttctag

SEQ ID NO: 88710 - DNA, 370 bp, Glycine max
  Peptide Sequence Number=SeqID_180395
atggtattagctgagggggagaccttacccgcttactccagatactatgggttgcttacagactatagagagatagaggctgccttatgcatatctggccgagggttcatcttgaactcagagggccatcctgggaagattctcaggaagattctaactacactagctcaggtgtggagtgtcctctcatacttcaacttggcccccacatcacaaccttatgacttgacagtggatagagttaggctgatatttggcctagtctctcgcttggatataaacataagagcactgatctctggccagatgacctctatagcccagtctaacacttctagacttgggttccctgctctaatcaccacattat

SEQ ID NO: 88711 - DNA, 813 bp, Glycine max
  Peptide Sequence Number=SeqID_180396
atggctaagtttgaccctgaggtagtcctagagttttacgctaatgcttggcccacagaggagggagtgcgggacatgtgttcatgggtgaggggtcaatggattccttttgacgcagatgccctcatccaattcctgggtgacctgctagtgttggaggaaggccaggagtgcgagttcagtcagaggaggaacaaggccgacgggttcgacaaggaggccattgcccagctattgtgcacaccggggcaagatttcgcccggactgctaccgggagacgagtgcggatcatgcgcaccagcatgaccaccttgaccaagatgtggatgacattgcagctcagcaatgtcttgcctagtgatcataactccgatctccctctgtcgaagtgtcagctggtgtatgccatcctgacacggatgagcattcacgtggctcagctgattgctgacgccatctatttgtttgcaggtatgccacccaccaggcaccctctagacccggataagtctaacagggccctggggtttccagcattgatcacacgcctctgccaatcattcaggattcccgtcacccctagtaaggacacagatgcaccaccgccacctcatcaggtcgatcccgctgggtcactaggcatggagcgttatctacagcacttggtttgccagcaagcggccaaccaccggggacagagcagtttagggctaaggtcgcgtggtccgaagattggcccgaggcccaggcaggggaggcgcctacaagatccccgggcgatgcagaggaggcccgcatggatgaggagatga

SEQ ID NO: 88712 - DNA, 930 bp, Glycine max
  Peptide Sequence Number=SeqID_180397
gcagaaatatctggtgaacaccgccggtatggacgccaagctggccagcggcatcatgaccgccgcgctgttcgtcttcatgctgctgcagccggcggcaggcgcgttctcggacaaaatcggccgtcgcagctcgatgctgatcttctcggcattggccaccctgttgacggtgccgatcctgttcgccctgaaaggggtgagcaacccctttatggcgttcggcctgatcgtactggcactgttcgttgtcagcttttacacctcgatcagcgggctgcttaaagccgagatgttcccgccggaggtgcgtgcgttaggggtaggcttgtcttatgcggtagcgaatgccctgttcggcggttcggcggaatatgtcgcgctgtcgcttaaatcgttcggcgtggaaaatgccttcttctggtatgtttccggcatgtgcctgctggcgttgctggatacggctaatcaaccgatcgatgcggatacgccgcagacggcgaatcagtttgcgcaccttgatcgggtactgctgaatgctttgcagctcctgataatggccgaccacggtggtgtgagtgcggatgcactccagttctgtttgccgctgctcgcgcatttcctgcttgggatcgtggatcagaatggcgttttccagatccaaccgccaggcgcgcgggttgagattattgccggtaatcagctgccactcttcgtcaacccacatgcctttcagatgatagctgttatcgccatccttccacagacgcacgatcagctgcccggtgtcgatatagcgctgcaagcggctcagaaaacggcgcaggttgatctcgtacaggtagggcagcgcgccgatgattttgaacggctggtcttccggaatatagaagtcgttggcggtcttgtcgccgacgatgatctccacct

SEQ ID NO: 88713 - DNA, 360 bp, Glycine max
  Peptide Sequence Number=SeqID_180398
atggttaatgaggagtgtaaggaggtaagtgtctcctccaagaggttaactaagaaggaaagacattttgaaataaagacaaatattaaagaaatctcccctcttagacaacctccacattttctcctttgtaaaaagacacttgttagcattgccacacctattaggcttgagtttattcctcaagtaaaggagttgttggatgagggtttggttcgcaagagcttaaatacttgtgctttgttggtgcccaaaatagggcttcctatggaccctaagagaataaaggtcattcctgagtggcctactccaccaagtgttgaggaaagattcatgagtttcaagaacctctggatttga

SEQ ID NO: 88714 - DNA, 618 bp, Glycine max
  Peptide Sequence Number=SeqID_180399
ggtacatccactaggttgttcaaagagaacaagggagggtacatcccttgtggatctttgcttgtaaacgaattttacaaggttgaaaagaaatctcaaggaccgcagagaggttcaaagaacctaggagaattagcgagtggtgactatctaacatttagtgcactcatttggcgtggttgggagcttggggatcattgtatgatgtatccatatgtggtgatcactcccaactaccatccacatgattatgtaagaccatcaagacctggaggattgatggcagaggatgtccacctagtgccaatagatagaatagatgcagtgcccgttactgtagaccatacattgacctgctatatcctatgggaattcacattacgggcagagcttcgatattatgtagattctcacttatttttcgaggtagaagagccacgccatgatttggagttcctattgactccaattgagtatgatgggcgaggcaacgttcgtcaatacaacgtggagcaagtgcacccaatggaggagattgaggtgtaccagatatttcttaatgagttggagttgacgtctaaggaggagagtgacaattcttctgaagacatgtcttag

SEQ ID NO: 88715 - DNA, 96 bp, Glycine max
  Peptide Sequence Number=SeqID_180400
atgaaggctaatatggatttagcaatggtctggctgcttgtttctcccaaaaatgacatagtaataagattgactttggtttatgaagttgtatga

SEQ ID NO: 88716 - DNA, 375 bp, Glycine max
  Peptide Sequence Number=SeqID_180401
atggctccacctaaagaaattgtgatcatcatttaccacaattgtcacattacagatgacccagttcatggtttgggtcaaacacgttatatttcagcacaactactcgacaatgacgatctcaaaggcgcgatggaaataattctccagaatccacaattgaattctaccgaattctatgttgttactaaccttattcctcaaccacaaccatcgtctccacaatcctcatgtccagaactacaactaccacctccacaacaattaccgtacaacaacatagaccttaataatccagtatcttcatacaacaaccttgaaacacaagatccatttgacaattatacttcatacacaactattatccgaaaatga

SEQ ID NO: 88717 - DNA, 126 bp, Glycine max
  Peptide Sequence Number=SeqID_180402
atgtgggatcggcacaggcttaaaggagcactcaaaccgggtgtatttacccccaaggcctacactccgaagagtccgttagggcctctccctcctgattcaggtttatcacaacatggggagtaa

SEQ ID NO: 88718 - DNA, 144 bp, Glycine max
  Peptide Sequence Number=SeqID_180403
atggctggaatgttagtcacaacatgggttcctccctccttcttattctctccattttccccaggctcctcattcatcaaagtaggatggatcaaattttcctcttctcagactcacttcgatcctttcgccagtgaaaactaa

SEQ ID NO: 88719 - DNA, 907 bp, Glycine max
  Peptide Sequence Number=SeqID_180404
cactatacagagcaagctacgaaagtttcgtgttcttggcactcacaacaactacccccaagattcagaagttgaagagaagagtttgattatcaaattgaagttcaaatccgttttgggtggctattatttcagcaagggattttccacctccaccagcgttcaaaagggtggtggtggttctgaggaaggtttgaaatcattgaacctctgttctgcaattaatcaggctcttcacattgccttggactctgatccacgttcttatgtttttggagaggatgtaagctttggtggggtcttccgttgcacaactggattagcagaccaatttggtaaaaagagggttttcaatactccactctgtgagcagggtatcgtcggttttggcattggtctcgcagctatgattgtcaatgaagctgctaaatttagataccgaagtgggaaccaatttaattgtggcggtttaacagttagagccccttatggagctgtgggccatggtgggcattaccactctcagtctcctgaggctttcttctgtcatgttcctggtatcaaatggctttatcgtttggctgttgaagaagtaccagaggatgactacatgctgcctttatctgaggccgaggtaattcggcaaggaagtgatgtaacacttgttggatggggagctcaattagctataatggaacaagcttgtcttgatgctgaaaaagagggaatttcttgtgaattgattgatctgaagacactaattccttgggataaggaaacagtagagtcctcagttaacaagacaggaagattgcttgttttggtgctgaaatttcagcttctattgttgagcgttgcttctcaagggtatgctcagcctcttattgctatttccaccacattgtga

SEQ ID NO: 88720 - DNA, 168 bp, Glycine max
  Peptide Sequence Number=SeqID_180405
atgcagacttatgctattatttcaaatgcgtcaagctcaaccaatcagactatgtcctgttttgataggtatggattcaagactgctaacatggaaggttctataacactttcacaggcacaacattcaatgaaaaataatattttccacactcatttgagaatgtag

SEQ ID NO: 88721 - DNA, 225 bp, Glycine max
  Peptide Sequence Number=SeqID_180406
atgtatggggtagagggtgtcacacgaatcgccaattcctctagtgacaggcgtttgattgatatgggtggttgtttcgatggtgtgggtaaaagggaaggtgatgggctgaagttcgaagctcgtggcagcaatggatcaaaaggaacggggaaccgagccaaagcttccgccagaattaacgtgagccctctcagtgaatctccgaagccaaaccggagatga

SEQ ID NO: 88722 - DNA, 525 bp, Glycine max
  misc_feature (472)..(472): n is a, c, g, or t
  Peptide Sequence Number=SeqID_180407
atgggatcgagtcaggcgccttggcttaaaaagaggttctatgaagtcaagatcaagagcctaggagtcgccagtctgaaagagttaggacagttgatgggtcagctccagcaacaagcctttcgcaaagcctatggtaagatctgggacctaaccatggcgaaagtcttcacggaggccattgcctccctcgcccaatattatgaccagcctctgaggtgcttcacctttggggacttccagttaacacccacggtggaagagtttgaagagatcctgggatgccctctgggaggaaggaaaccaatttctaaaatagtcaagatctcgacacaggaagtggaccgcggaaagcaagtcgaaaatggggtggttggagtaccaaggaaatgtttggaagcaaaggcgaggaccttggcaagtcaagacgaatgggccccgttcatggacatcctgacactcttgatcttcnggggtggtcctctttccaaatgtggaagggttggtggaccaggcaacgattga

SEQ ID NO: 88723 - DNA, 1164 bp, Glycine max
  Peptide Sequence Number=SeqID_180408
atggcgacgcgcatcgtcgacctcgatcgcggcaagctggtgtcatggccgggcgattacgatcagttcctgctgggcaaagaggaagcgctgcgcgttgaagagttgcaaaacgccgaattcgaccgcaagctggcgcaggaagaagtgtggattcgccagggcatcaaagcgcgtcgcacccgtaacgaaggccgcgtgcgcgcgctgaaagcgctgcgtcgtgaacgctccgaacgacgtgacgtgatgggcaaagccaatatgcaggtcggtgaagcggcgcgttccggcaaaatcgtctttgagctggaaaacgtggattacggcgttgacggcaaaacgctggtgaaggatttctccacccaggtgcagcgcggcgacaaaatcgccctgattggcccgaacggctgcggtaaaaccacgctgctgcgcctgatgctcggccagttgaaggcggatgccggtcgcgtgcactgcggcaccaaactggaaatcgcctacttcgatcagcaccgcgcggagctcgatccggataagaccgtgatggataacctggcggaaggcaaacaggaagtgatggtcaacggcaagccgcgtcacgtgctcggctatctgcaggacttcctgttccacccgaaacgcgccatgacgccggtgcgtgcgctttccggcggcgagcgtaaccgcctgctgctggcgcgtctgttcctcaagcccagtaacctgttgattcttgacgaaccgaccaacgaccttgacgtcgaaacgctcgagctgctggaagagctggttgatggctatcagggcaccgtgctgctggtgagccacgatcgtcagtttgtggataacaccgtgaccgaatgctggatctttgaaggcaacggcgagatcggtaccttcgtcggtggctaccatgatgcgcagcagcagcgcgccgcttacaagcagaccaaagctgcaccggtcaaaagcacagcggctaaaccggcagaaaaagccgacgcccccaaacgcagcgcaggcaagctaagctataacctgacgcgtgaactggaacagctgccgcaaaagctggagcagctggaaacgcgtatcggtgagctgcaggcgcagatgagtcatccggacttcttcagccagccgcacgacaaaacgcagccg

SEQ ID NO: 88724 - DNA, 846 bp, Glycine max
  Peptide Sequence Number=SeqID_180409
atggagggaagcatagatgtggctctcgtgaaggaattttatgctaatctttatgtcctgggggataagcctccaaagcaagttagggttaaagggcatttaagtaagtttgatgcggattccctcaacacttttctagagactccggttgttctagacccaggggagactcttcttacttactccaggttctgcagactgagaccagaccctcaggagatggttgcccgactttgtatccctggtaggggatttgttctgaatgctgagggcttgccatggaagctgctgaggaagggcctcactactctggcgcagacttggagcgttctgtcttattttaaccttgcctctacatcacacacttctgatctgaacttggatagggtaaggttggtatatggattagagatgaagatggacatgaatgttggagccctcatctctggacagatcacacttatggctcaatccaactcctcaaggctcgaatttcctgccctcatcactaccttatgcatggctcgaggagtcatctcagattccttgacttttgagtccctcaacccaaccattaacttggcttacataaagaagaactgctggaacttggacgaccccacgatcagctttccagggacccgcactagaggatctgagggtccatcttctgctgctccacagacatctatagcaccagctcctattccttcagcacaagttcccgctacttccaatccctccgctcaaagcacagacctcatgatggtgatgctacagagcattcaccagggtcaatacctggtgatgcagagtttacatagtttggctcagcatcagctgtag

SEQ ID NO: 88725 - DNA, 951 bp, Glycine max
  Peptide Sequence Number=SeqID_180410
atgaatattcgccgggctcgccccaccgactaccccgccattttgcagctgcagggggaaaacgtgccggaagcgctcgacgagcgccaaaaacggcagggatttatcgtatcgcgcatgaatgaggcgcagctggcggcgatcaaccgcggcatcggcatactagtggctgaacaggaaaaccaactggcaggctttgtttgcctgatgcccgccgacgtgcaaccgcgcccgccggtggtggacgcgatgctggcgacgctcgccacgcaatccttcgccggacgcgcgctgaatgaactgcgggtgtttctctacggcccggtctgcctcgccgccgcctggcgcggcaaaggcgtgctgaagcgcctttacgctgcggtcaaagcgcataccagccatgactacgacgtgggcgcgctgtttatcgacgacgacaatccgcattcgttggccgctcacgtgcaagggctgggcatgacggcgctggcgcctttccattgcgggcagaaaggctatcagctggtgcataaaggtgtccaccaccatcgacagcggcacgtctatcaccgtgacgtagcgccagggcgtatcgcgcagatcccactgcacgccgggatagtactggtggccatgccccgcgccgggcacggtgcggctgataatgctgccgcagccggtcagggccatcacgccggccgccacgcaggccagccgaaggtaggaagagagattcacgacattgactctgagcaagggggttgtttcgcgagtgaacaacgcatcggccgcagtctaccacagttccctttctccgccggcaccgacgcaccgattaacgccggcccgttgggtgcgccagcgggttgtgcggcaactgctgatagtgctcacgccaggcggcgccttccggcaacagccagacgcgctggtgcaaacgagccagcgtga

SEQ ID NO: 88726 - DNA, 288 bp, Glycine max
  Peptide Sequence Number=SeqID_180411
atgtaccctctcttgttctcaatcacaacaacccaagtagatgtaccctctacttgtaccacaaaggatgtaccctccaatgtgttaagacaaagttctcaggcgggaaaagggagacacaaaagaattcaggcggttagtcctttgttcttttggaaaagggagaagagagacacaaaaagaattcaggtgaacaaagtttggaaaccagaaaactcagaaagcttttggcaaaggaagaagaagaagaagttcaagaagatgttcaaagagattcaaaggttgtaa

SEQ ID NO: 88727 - DNA, 877 bp, Glycine max
  Peptide Sequence Number=SeqID_180412
atgggtctgctggataataaacgcatgaaaagcgatacccagtgggtcattgatgccatgcgggtgaaaacgcccggccatcatacccaaattggatcgctctccggcggtaaccagcaaaaagtcattattggtcgctggttattgacgcagccggaaatattgatgcttgatgaaccgacgcgtggtattgacgtcggcgctaaattcgagatttatcagctgatctcggagctggcgaaaaaagaaaagggcatcattattatctcttctgaaatgccagagctgctgggcattaccgaccgtattttggtaatgagtaatggtcaggatccgacctttttaagcctgatgaacctgagtaacattctgactcagtcatcggtccgtattattatcgccctcggcgtagccggtctgatcgtgacccagggcaccgacctgtcggcggggcgccaggtgggtctggcggcggtggtggcagcaacgctgctgcagtcgatggataacgccaacaaggtgttcccgcatctggaaaccgtgccgattccgctggtgattttgaccgtgtgcatcatcggtggcgtgattggtctggttaacggcgtgatcatcgcttacctgaaggtgacgccgtttatcaccacgctgggcaccatgatcatcgtttacggcatcaactcgctgtactacgacttcgtgggcgcttcaccgattgccggttttgacgctggcttctcaaagtttgcccagggcttcctgcgcttcggcgacttcaagctgtcgtttatcaccttctacgcgattatcgctatcgtgttcgtctggatcctgtggaataaaacccgcttcggcaaaaacatttttgctattggcg

SEQ ID NO: 88728 - DNA, 204 bp, Glycine max
  Peptide Sequence Number=SeqID_180413
atggcacgaagtgtgtttgctctatgcccttatttgggaacctataggtccccagtggagtcgccaactgtcgcagcatgcccttttgcgggcgagcaaggcgaggttctcgggtgcgctttccaaaggaggaaagaagcgtggagtcgccaccaatgtttatttgtgaaaaacgtcggaaaaaccgaaggaaaccggtcataa

SEQ ID NO: 88729 - DNA, 428 bp, Glycine max
  Peptide Sequence Number=SeqID_180414
ctgatgctgagcagcgcctcaacactgctgatgacccatctgctgcagcgctacagtcaggtacagtggcagctgccgcaggtgcgcggcggactggcaccggtggtattgcgccgcgtgctggcgctgatcgatacgcagctggatcagccgttaacgctggcccaactggcggcagaggcggcgctcagcgaataccattttgcacgtatgttccgcagcagcaccggcgaagcgccgcaccagtatgtgatgcgccgccgtatggaagccgcgcagcaactgctgcaattcagcgcgctgtcgctcaccgagattgccctgcgctgcggtttccactcctccagccatttcagcaaccgcttccgtcagctgcacggcatggcaccctcggcatggcgtcagcgctgacgggacagttggaatga

SEQ ID NO: 88730 - DNA, 306 bp, Glycine max
  Peptide Sequence Number=SeqID_180415
atggagagaagtatgattgatgctgccagtggtggagcccttggagacatgacccctgctgaagccaggaatttaattgagaagatggcttccaactcccagcaatttagtgccagaaatgatgctattgtcattaaaggagtgcatgaagtagccacgaattcatcttcatcaactgaaactaggaagcttgaagctggccttgaatcaaaaatctgtacctgtcgcaagagtctgtggtttatgctcctctgccgaccaccatacagacctttgcccttctatgcagcaacctggagcaattga

SEQ ID NO: 88731 - DNA, 408 bp, Glycine max
  Peptide Sequence Number=SeqID_180416
atgggtgaagtagaggaggtgcaagagcagatggaggccgacatggaggccatgaaagagcaaatgaccacaatgatggaggccatgatgagcatgaagaagataatggaagccaatgcggttgcagttgccgctaccagcgctgttgctaaggtgaacccgacgtccccattcggcatcaacctaatgaatcatccaacctcagatatggtaggcaaagatttgggaagtacgggcggcccccatgatgtgcaaattcaaaacgagcacgccttcccgccatatggcttgcctctcaactatacgccacccaatgtggcgtacactcccaatgagaatgtcaataattccactcctatacccattgagagccaacaaccccaaactgatcatgcacatgtcttttaa

SEQ ID NO: 88732 - DNA, 379 bp, Glycine max
  Peptide Sequence Number=SeqID_180417
atggcgcaaaagcagatatggtccggtattcccttgttccctgtattggttatgttcttcatttctcgtctagcagaaactaatcgagctccgtttgatctcccagaagcggaagctgaatcagttgcaggctataatgtagaatatgcgcgggatgcgatccttaatagtccactgttggcggaagccaatgtcccggggtcccggggactcattctgactgaaacaaggggtgcttgctggggcagggcactcttcattcttcattcgaaactaatgaatgtcgggtcgggggtttctgccttgttatcaaaaagggagttgggtaaagcaaactccactcattggacgagcacggggcttagtcaagtagaaccgg

SEQ ID NO: 88733 - DNA, 156 bp, Glycine max
  Peptide Sequence Number=SeqID_180418
atgggtcaaggaatcacaaaggcagttgtatttaggagcttacttgcatcaatgtggtgcatcgtgactgccgatttgaaggatgactggcacaagtggttttctgatggatcaccgttagacgtggaggccatcacaacagttcgacagatatag

SEQ ID NO: 88734 - DNA, 916 bp, Glycine max
  Peptide Sequence Number=SeqID_180419
atgggacctctccaaatgcaagccttccgcatggcgtacggaaagattttagatttaaccatagcgaagatattcgcggaagctgttgtattcctcacccaatactatgaccagcctttgagatgcttcacggattcggcaagagagttggatcatgtaaagcaaactcgaaacggcgtagtgggcctaccatggaagtacttggaaggaaaggcaagggatatggcgaatcatgaggagtgggtcccatttgtggacgtattagcgttgctaatctttggggttgtcctctttccaaacatggacggtttggtggacctagccacgattgatgctttccttgcatatcaccatagcaaagagagcccggtggaaggaaaggagggagttctcttctcatgtggggactacccaaacatcccgttgataggaacgaggggttgcattaactacaatggtgcacttgctataagacaaatagggtaccccatgaggggagcaccgaaggaagaaagcctctctcctttccttgtgagatatttcggcgcgcaaagtttcaagattatacaaagagtccataaggcgtgggaaaacccgttaaggaaagataaagaacttaggggcattcgtaatggcatcattggtggttatcatgaatggctgaaaattatcaatgaagagaacttcgaagctccggaagaggatgaagaagtccgagctctaaaaaccgaactaggaaaagtgagacttgccaaagaaaaattcaagttggtcgctacagacatccagaaagagtgtgccgggttacgagaagaaaatgcagctaccgcaagagcccttgaacaagaaaccaagagggctcacaaggaagagcatggccgtgacaaatttcgtggagctttgtggggcagcaaca

SEQ ID NO: 88735 - DNA, 557 bp, Glycine max
  Peptide Sequence Number=SeqID_180420
gtcgactcggatccccagccccgtaacttcgggagaagggaccatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgtcgccataaagcg

SEQ ID NO: 88736 - DNA, 234 bp, Glycine max
  Peptide Sequence Number=SeqID_180421
atgcaagtgctggaagcacccatcaaagccaccacagaaaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagatgcagcagaagagacagaatcagatgatgattctgaagccaccccatga

SEQ ID NO: 88737 - DNA, 234 bp, Glycine max
  Peptide Sequence Number=SeqID_180422
atggagtcaggtgacatgcggaggtaccgtatggtgacccgcacctttcgtcaaccaggggcaaaagagcctgttgacgcggaaagactaacatcgtcttctgcactttttggccatccagggacagcgagtcgggtggcaggtggagataccttatggtttttactctcatcgtctggagacattcaagcccgacgacacacgagattcttctctgctgggcggggacgataa

SEQ ID NO: 88738 - DNA, 565 bp, Glycine max
  Peptide Sequence Number=SeqID_180423
tcaaggtgcaccttttgagggcaccattgttgatgactggaaattcgactattctaatcatgatgctcgccgcatggtttgtaatgaccaggatgaaatgaccggtagattgctggccggatcattagcctttgattgtcgcatcatgcactatattatcatcgactgggctcacttggttcggtaccgaatgcataaggcattatgggccaatgcacctcttccatatcctcaattggtcaccctttttctccgtcattttcaaattcctcttgatgatgaaccttttgttcaagtcaagcgatcctttgctataggtgctggtgcagtcacttcatttggttaccgtaaggatcgtaatggtcaatggctgaagaaagatgcgctacctccacaagacgagcgtactccctctcctcctcctcaacgagatgattccttcacccttctgactgaagttctttcaaagttacgaggcctctgcacctatgttggtgaacgattcgattctttggatggttgctttgaaggcatggatacccgcatcacccaacttgaagaggat

SEQ ID NO: 88739 - DNA, 717 bp, Glycine max
  Peptide Sequence Number=SeqID_180424
atgaatgcgaggacgtgtagtcctctaaaggtgagtgcgtgtagccctacgaaggcgaggacgtgtagtcctttaaaggtgagggcatgcagccatcttatggctaggacgtgtagtcctctgaaggtgagggcatgcagccatctgatggcgaggacgtgtagtcctctgaaggcgagggcgtggagccctctaaagacgaggacgtgtagtccactaaaggtgagggcgtgcagccctatgacggcgaggacgtgtagtcctctgaaggttagggcatgtagccctctgaaggagagggcatgtagtcctcagaaggtatgggcgtgcagccctctgatggcgaggacgtgtagtcctttgaaggagaatacgtgtagtcctctgaaggagaggacgtgtagtcctctaaaggtgagggcatgcagccctctgatggcgaggacgtgcagtcctctgaaggcgagggcgtgtagccctctaaaggcgaggacgtgtagtcctctaaaggtgatggcgtgcagccctctgatggcgaggacgtgtagccctctaaaggtgaggtcatgtagccctttgaaggagaggacgtgtagtccacagaaggcgaggacgtctggttctctgaaagtgaggacgtataatcctctgaaggcgagggcgtacagccctctgaaggtgtggacgtgcagtcttctgaaaggtgaggacgtgtaa

SEQ ID NO: 88740 - DNA, 321 bp, Glycine max
  Peptide Sequence Number=SeqID_180425
atgtctgtgatgccgcgacgatgtcgcacatggccgatcccaattcctagctgccctatcagggtttcttcttctatgattccccctttcatccacttcgtcagcctcggcagcccctttcatccaggtacattccacggaccaccaagtggggcatttggggtcggtagttcattattttgggtgaatgaaggagtcccccctgaaggaggagaggatccaaatatgcttgtcatattgtaccctggatggaaatcatgtgggtatgaatacatcggcgccatctacgatggttcttgggtgaataccggtggtgtgtaa

SEQ ID NO: 88741 - DNA, 729 bp, Glycine max
  Peptide Sequence Number=SeqID_180426
atgggttgtagcagcccgcacgtatctgcagggggattcgcctggggagcggctgcattagtccacatgtacgaccatctgaatgatgcgtcgcaggcctttacacggcagctgggcggttatattacacttctccagtgctggatatacgagcactttcctacagtgcatacattcgtcgttcatgatgcttatgatgaggggagcccacgggcctgtaggtggcttacgggtaaggctcatatgatggggatcaagggagccccgtatcggagacgtttggatgccctgagtgtgactgtcgtgtgctggatgccctatggtgagcactggggagtcagggcctttgacttgatatcgtcgtacaccggccaactcagatggggtcagattgtggtgtacgttcgatctgagcgggttcttcgacagtttggctaccttcagacggtccctccgccgccagtttgtgattctttgacgggtgatgatatagatgaccggtggctgcatttttcagaccatttggtgccttcaggggagctctgtgtagttcctggacaggtggcgccagactacatggagtggttttttcagatatcgcacccattcgtcacgcagactgaggagactgctgcgcggagacatccgcctccccctcatcatgaggagttcgtcgagccacccatccccgaggtttcagtcgcgaccaatctccctacgcattcagtg

SEQ ID NO: 88742 - DNA, 228 bp, Glycine max
  Peptide Sequence Number=SeqID_180427
atggctggacaagctccaacagtgttcataccaaaagagatttgtccatacaaaccaacaaaaagaaatcaagttgaagttgtgatagacaaacccaaagctgaatggacccaagatgagaaaacaaaacttcttttaaactctagagcaaagttcttcttgaaatgtgctttgagcatatctaagtttgataaaatagaagaatgtggaactactcaagaaatctag

SEQ ID NO: 88743 - DNA, 701 bp, Glycine max
  Peptide Sequence Number=SeqID_180428
atggcatcttcgtcgtcatgttcatcaaatattaaaattaagtctggcccgatcgatggtggtgtattatggatgcaagctaagcatgtttcaaaacatgtttggaatgggaaagaagactggaaattactcatcagacgagctgtccccacgtatcaaggggaagaagaaataccagaggaaattattcctctacttcggcaatgtgatttttattggataatgaagatgggctacctaaaaattagtgtgtcattaattactaccttgattgaaagatggaggcccgaaacacatacgtttcacatgagatgcagagagtgtacgattactcttcaagatgtctgtattattagcacgtatgcatggggacctgccgtgcttgtttttttatatagagagatgagcagcgccaccgattacaaaattaaatcaatcggaggtatgtgcatcttaatccaaatgtgggcatgggaacgatgcacgactttggcaccaaagaggactcctccctttctgtgggagccttacacagcaactgctatgtcagcgttacctccaatttgtttggttggtagtgtagcgtggtgcgcggtggtgccactcatttgtttccatgctgttgagtggcaccaacccgatatagtgttgcaacaatttggaatgcaacaacctattctcgagtgtccatcgcaaccact

SEQ ID NO: 88744 - DNA, 225 bp, Glycine max
  Peptide Sequence Number=SeqID_180429
atggcaacacctaacgccccattagctccgcaatggaatgtacccaaagcaatacctgatatgggtgacttattaggtgttgatttgcgtcaggagttttctgttgaggctgagcaagtagaagcgaggaggcatcgcggcagaagaaatcctgatcatcaagcgcgaagatgggatcgaccatgtggcacatcctcacgtcaccacggacatcataatgaatga

SEQ ID NO: 88745 - DNA, 414 bp, Glycine max
  Peptide Sequence Number=SeqID_180430
atgggacacatcggaagaaacatgggacccattaatttggcagcggaacaagagaccttcttcagtatatggctttgtcacgttggcaaaggtgcggtgatttggcggcaccgtcgcatcgtgcttcatagggagagggaagaggaaggggaggcgcaggcaaacaaggaaggggaaaggggaagagaaaagagaggaaggggagaggggaagaggaacagtcatgtagagagaggaaggggaaaaagaggaaggggagaggggaagaggaatggtcacatggagagaggaagaagaaagagaggaagcggagaggggaagaggaatggtcagcaagagaggggaagaggaaaacaagagaaaaaagggagaggggaagccaacgatctcgacacagattggggaaaaaggtaa

SEQ ID NO: 88746 - DNA, 1881 bp, Glycine max
  Peptide Sequence Number=SeqID_180431
atggccactcctatgagcactgctcgctatctgaataaagatgaaactgatcagtcaatagatattaagaaatatagagacgggagattattcgacgtttcgataaagaatgcggaaaatacccgaataggagggcaaaagggtcattctaaggctttttctgacccctggctcgcccaggctagcctccggggcacctggcccccgaaatggcttaggggtgaagtaaccagctcgcctgggcaagcaaggttacttcaggttgaagcagtagctcacctgggcgagctacagaccaaccaaaagaagaagaaagaagggaaaaatgaggctgaggcactacccaattgtgaccgtaatcaactttcacatcgttcttcattcggtgttcttcgtccgtcatccgagcctagaactagccagcttgcaaaagctagggcagcggatggatcaagttcaacgtcaagccttccgcaaagcatagggaaaatctgggatttggccatgatagaagtacctgtcgaagccattgcatccctcgctcagtactacgaccagtcatgcagatgctttacatttggggactttcagttggtaccaaccatagaagagtttgaagggatcttgggatgcccgctgggaggaaggaagtcgtatctattttctggattctacccctccatggaaagagtggcaaaagtggtcaagatctcgacacaagagttagaccgactaaagcaaaataggaatggagtggtagggataccaaggcaacacttggaggaaagggccgaagctttggcaaatcaaggacaatggacttcattcattgatatattagtgctgttggtgtttaggatcatactctttccaaatatggacagactagtggatatagcagcgattgacacttttcttgcttatcaccacagcaaggaaagcccggtcgttgcttttttacccgatgcctatgacacattcaacttgagatgcgaaaaaagcagtgcgggaattgtcatcgcatgtgtgtcgaaaagggaaggacaaattgggaggaactcttggcaggaaggaggggccgaggttttgtgcttgtgtggagaattcccaaatgtccccttgatgggaacgaggggttgtattaattataatcccatactggctataagacaactaggttaccttatgagagggcacaatcgaaagagatcatcgtgctttttgttgcacggggttgcaatgaaggcaatgcaaaaatacttcagagaatttgcaaggacacaagggataacttggctttcgaagctaaagatttcaagtggggaagaagttgaagtcctcgaagagagcgaagaagtgcaagccttgaaagcagagcttgaaaggacgagagtggtcaaggaaaaactcatgacaacagtcactagggtcagaaaagagtgtgatgagctaagggacgtcaacatgactacaaccgaagccaacaacaaactcaagcttcgaagggccgaaaggaacgagtcaagggtggaaagcatggttttaaaggataaattgaaggcttgtcaaaggtcaaaaagaagtttgaccaaacagttaagtagaacaaaagaaaatatgttgacaatcatcgaccagtataaagagaaggtaaacctagctgctagtcatgggcagaggctagaggatgagcatgtgaaggcgatgaaatggatggatagattcgctctcactctaaatgggagtcaagagctttcaaggctgttagccagagccaaggcaatgtcggatgtatacccgattcccgatgaagttcatgggctttgtgattattgtcaccacatgatcgagttgatgtcccatataattaggaaccgctga

SEQ ID NO: 88747 - DNA, 818 bp, Glycine max
  Peptide Sequence Number=SeqID_180432
atgcatcacgttccttttgaggctactcctcaattcgacatcaaccatgtcatttcctaccacacctacttgggatttgagcggccagacaatccactacgattatggcagcaattctttgggcatgattctaatgggagggtctctagatctaccttctatcaggctacgtatgtcaaattctacggagatgtgggagattttaccgatgatgttctaccaaggtgtttgcggggaagaaatatcggagggagagatgtctccacagaggccattgcatccctcgcccagtattatgaccagccattgaggtgcttcacatttggggacttccaactatcacccatggtggaagaatttgaagagatcctaggatgccctcaagggggaaggaaaccatacctcttctcaagaaaatgtttggaggcaaaagcaagaatcttggcaggtagaggcgaatgggccccattcatagacatcctcgcacttttgatcttcggaggagtcctctttccaaatgtggatgggttggtggacttagcagcgatcgatgcttttctcgcctatcatgaccgcaaggaaagcctggttgtcgctatactagccgatctatatgacaccttcgaccgaagatgtgagaagagcagtacaaggattgtttgttgtactttggccctctatgtatggttggtttcacacctttttcgccaagaggtgaggcatgcttgcccgctagaaagccaccgttcatacacagagaaaaaaggtgcaaattgggaccgactcttagaaggcaaagaaggagcgtctgtcaactg

SEQ ID NO: 88748 - DNA, 357 bp, Glycine max
  Peptide Sequence Number=SeqID_180433
atggcttgtccaatcatctcactcacatcagatttggtaacaaaatctggagtggtggagtggacaatgatggtagcaggatctctagaagttgcttcatttgaggtgtttgacagcttgggcgcaggatgtcacgacccgcctcattgctacgatatcaccattctaaatcacgattatccagagctgggcatgggacgacgatccatcgatcatgggcctagcctctactcgcgtccgtccctaagtaccggaaaagcaggaaatgacattgcacacacaaactgtggccacgttaccgtttacctcaatttgtctctatctttggatttggcccgacatttgaccatcgcctaa

SEQ ID NO: 88749 - DNA, 3069 bp, Glycine max
  Peptide Sequence Number=SeqID_180434
atggaagcttgtactgggctttttgctggtaccccaaacagcaatgagcttgtggtcattcaaggacacgatgagcctaagcctgtgaagaacttagatggtcagctctgtgagatatgtggtgattctgtgggacttacggtggatggagacttatttgtagcttgtgaagagtgtggtttccctgtgtgcaggccatgttatgagtatgaaagaagggaagggactcaagtttgtcctcagtgtcatacaagatacaagcgtatcaaaggaagcccaagagttttgggagatgaggatgaagatgatgtggatgatattgaacatgaattcaagcatgaagagatgctacaagggaacatgacccacggagatagtgaagggaattctaaatcgaaaccagtaggtttagcaaaggtgaatggggagttgcccgtatcttctcacagtgttggagaacctggtgcaaagttggatgacaaggagaaagtagatgagtggatgttgcaccaaggcaatctatggcctgaaactgatgcctcagttgatcccgaaaaggccatgaaagagccactgtcaaggaaagtaccaataccatccggcagactcagtccttacagaatgatggttgtcgctaggctcctccttctattactgttctttcagtacagaatcttccacccagtacctgatgcaattggactatggttcatatctgtgacatgtgaaatctggctcgcattatcctggatgattgatcagcttcccaaatggttccccattgatcgtgagacatatcttgatcgtctttcaatcaggtttgaaccagagaacaagcccaatatgctttctccaatagatatcattgtcactactgtggatccaatcaaggaacctcctctagttacagccaacactgttctttcaatcttggccctggattaccctgctgacaaaatctcatgctatgtttctgatgatggagcttccatgctcacctttgaagctcttcaagaaactgctgagttttccagaaagtgggtacctttctgcaaaacattttctgtagaacctagagcaccagaaaagtacttctctgagaagatagattttctaaaagataagcttcaatccacttatgtgaaagaacgccggactatgaagagagaatatgaggaatttaaggtgaggataaatgcacttgtggctaaatccatgagagttcccccagaagggtggactatgaaagatgagacaccatggccaggaaacaactccaaagaccatcctagtatgatacaagtccttcttcctcacaatgtaggtaatgaacttccttgtcttgtctacacatctcgtgagaaaaggcctgcattccaacaccacaacaaagctggcgcaatcaatgccatgcttcgtgtatcagcagtgttaagcaatgctccttttgtgctaaacttggattgcaatcattatgtaaataacagcaaagtcgtgcgagaggccatgtgtttcttcatggacatacaacttgggaatggcattgcctttgtacagtttccactgaggtttgacagcctcgataggaatgatcgttatgctaacaaaaacactgttttatttgatattaacttgaggtgcctagatggaattcagggacctgcttatattggttcagcatgtatcttcagaaggaaagccttaaccggctttgattctccaaagacttcaaaacgcccaagcatggtgcaagtacactcaaaacaggacgagaatggagaggaagcaagcataacaggtgaggacaaggagctattgaagtcagagatgaatgatgaaaataaatttgggaagtccatacttttcatgaattctgcattagcagaagaaggtggtgttgatccttcttccagtcaggaagcactgcttaaagaagctattcatgtcatgagttccagatatgaagacagaactctctggggatatgaggtgggtttaagctatggatccatagcagcagatactctgacaagtttgaagatgcattgtggtggttggaggtctgtatattgcatgccaaagagagatccattcaggggtacagctccaatcaacctcactgatagactgaaccaggtgctaagatgggcagtgggatcgcttcagatcctattcagcagccattgcccacttctatatggaggaagactcaagggactccaaaggattgcctatattaacagcactgtctaccccttcagctcaatacccctcctcatttattgtatcattcctgccatctgcttgctcactgataaattcatcacaccatcggtaggcacttttgcaagtctcatcttcattgcgttgttcatctcaatctttgcctcggcgattcttgaattgagatggagtggagttagccttgaggaatggtggagaagccagcaattctgggtcattggaagtgtgtcggcgaacctctttgcccttttgcaaggcattatgagagccctgccacttggtagagtcaacacaaacttcagcattgtatcaaaggcaccggatgatgtagagtttcgtgaactctatgccattagatggactgcacttctaatacctccaaccaccatcataataatcaatctcattggtattgtggctggcttcacggacgccataaacagtggtgaacattcttggggagctttgctagggaaactcttcttttctttatgggtcgttatccatttgtaccctttccttaaaggtctaatgggtaggcagaacagaacaccaactcttattgtcatatggtctgtgctcttggcttctatcttttccttggtttggtcatctgttcctccgaacacaaagttcaagatcatcataggatccaaacacaaacaacacacagggagtgagttatcacaggatctagttagggtcacgctgttttacgagaatgctccaaccatgtgggatcggcacaggcttaaaggagcactcaaatctggtgacccccaaggcctacactctgaagagtccgtcagggcctctctctcctga

SEQ ID NO: 88750 - DNA, 447 bp, Glycine max
  Peptide Sequence Number=SeqID_180435
atgtttgaagatgaagcgctgaacattaagatcttaaattttctcacaagaacttgggaaccaaagattacaacaatcaaggaatccaagaatctagctacaatgatgatgggagctctctttgacagctctagcagtgaggaagatgctgaaaactttaacttaatggtaagaaaatttggaaaatttctcaagaaatcaaaggacataaaattctccaaatcctcaaagaaggttgacaacaacaacaacaacttcagctacacatgttttgaatgtggtaagcaaggccacattaaatttgagtgtcctatctaccttagaaaacatggtggtaaaaagaaagggaagaaggaaagaaaacaaaagaaagcctacatagcatgggaagaaagtgcatcaataacttccaactcttcaagtgatgaagaaattgctaatgtgtga

SEQ ID NO: 88751 - DNA, 294 bp, Glycine max
  Peptide Sequence Number=SeqID_180436
atgaaagtggagaagagttggcacattgatagtggttgctccaaacacatggcaggagatgcatcaaagattattcatatttctcccaatgatagtgaatatgtgatctatggagacaacaaacaaaggtttcaggttttgatgacaccgaaaagaatttgcttgataattattctcatcatcaaaaagggggagaatgtgaagaatgcgggttttgatgatgctgagaagaattcacttgataaggattgtcatcatcaaaaagggggagattgtgaatgtatgaatacatga

SEQ ID NO: 88752 - DNA, 96 bp, Glycine max
  Peptide Sequence Number=SeqID_180437
ccttgggattcatgcaaggctattctgttatgctattcattattcagagcttttgttttagggttttacgttttctgctttgatgctattgttcac

SEQ ID NO: 88753 - DNA, 249 bp, Glycine max
  Peptide Sequence Number=SeqID_180438
atgactaaagcacgtcaaaagggggtacggaaattaaatgaaatgaaaataaaagtacgcgaaacaagtggggaccaccaaggggaaaagaggcagaagcttgccacccagctcgaccaggcgagctcggttgcttcctctagaaggcaccgccttctggaggaacttcctggaaaggcccaagtggacctggttgctatttgcacccccccatatttactaaatacagcccttgcctttttttgctga

SEQ ID NO: 88754 - DNA, 276 bp, Glycine max
  Peptide Sequence Number=SeqID_180439
atggagaaggacatttacaaggtggagaagattcctctcttcttcaaaagattttggacaggttcgatggtcttcaaacctttgttggtgaaagtgaagcttaagctcaaaaacaaagtgatgcaagctccattggagcttgtaggcctaggatcttcttcatcaatggattcctttgctttttggaagatgaatggcagcggaatggagaaggaagagagagaggagacgccacttcaaggagaagatgagtctagaagaagctcaccaccatag

SEQ ID NO: 88755 - DNA, 387 bp, Glycine max
  Peptide Sequence Number=SeqID_180440
tactgcacccagagacaggctcagggggatgctccacaggccgcgggcgcgctaccaccacctcatcaggctggcccagctgggtcagttgatacggagcggtatttacggcatttggttcgccagcaggcggccaaccaccgggcacatgtacagacccatgattgtctgtaccagatgagcctcagcatgcagagccagggcttcgtttctttttcatgccctactccagaccagtttagggcagaggtcgcatggcccggggattggccagaggcccaagcaggagaggcgcccccggaagttcccggcgatggagaggaggcccacgaggatgaggagatgaccgatttgtttgacttcttgggagggagtggagctacatga

SEQ ID NO: 88756 - DNA, 483 bp, Glycine max
  Peptide Sequence Number=SeqID_180441
atgtgggcctttcataaaggtttacaaattgattgggcacaccttgttagatatcgcatgcataaggcattgcgattgaatgcccctttgccttatcctcatcttattacccttttccttcaacacttcaacatcccttttgattttgaaccctatgttccaatcaagagatcattccttataggcgcttcagtcatagcatcctttggttatattaaggagcatgatggctcttgggtaaagaagggtgctagaaatgttggtgaagaaggacatgagggagaagattcatctcatctttcgaagattttggaaaggtttgatggtcttcaaacctttgttgatgagaggtttgatactttggatttgcaagtggatatgcgcttcaatgaaatagagtcaagaatgacaaaggttgaagaagatttatcttacattcggtcaagcttcgatcttccaccactgccgccaccatcatcttag

SEQ ID NO: 88757 - DNA, 546 bp, Glycine max
  Peptide Sequence Number=SeqID_180442
atgacttccaagattattttgatgatgccaaagaatcaagagttaagcaagtttcaaagaatcaggagtcaaaaagcttcaggaatcaagtttcaaagattcaagattcaaagaacaatcaagtttcaaagaatcaagattcaagaatcaagagaagactcaatcaagataaggtacatcctttgtggcacaagtagaaggtacatctacttgggttgttgtactgagaacaagagacgatacatctcttatggatcagttcaagtggagggtacatcccttgtggatctttggcttgtaaaggattttacaaggttgaaagaaatctcaagaaccgttggttgctgggggactagatgtaggcacggattgtggccgaaccaaagagaaactcactctatacaccttatttttcagatggagacgtggttatgtgcaatcgatcatcagaggcggaatgggaaggcttcagaaaatgataagaatgagaaaatgagaaccttggaggatactgatgcaatcctacctcgcaagggcattaggtag

SEQ ID NO: 88758 - DNA, 153 bp, Glycine max
  Peptide Sequence Number=SeqID_180443
ataacggatgctgaaaagaaaaatcatagtgagaagaaactaaagaaagcatacatcacatgggatgaaaatgatttggaatcctctgatgattctgaaaatgaagagataaatctttgccttatggcaaaaagttacgaaagtgatgaagag

SEQ ID NO: 88759 - DNA, 495 bp, Glycine max
  Peptide Sequence Number=SeqID_180444
ggccctaggatttcccgcactgatcacaggactctgccagttgttcggagtccccgtggcacctaccaaggtgattcggccgccatcacccgggcttttattgagaagtactgcacccagagacaggctcagggggatgctccacaggccgcgggcgtgccaccaccacctcttcaagctggcccgactgggtcatttgatacggagcggtatttacggcatttggttcgccagcaggcggccaaccaccgggcacatgtacagacccatgattgtctgtaccagatgagcctcagcatgcagagccagggcttcgcttctttttcatgccctactccagaccagttcagggtagaggtcgcatggcccgaggattggcccgaggcccaagcaggagaggcgcccccaaaagctcccgacgatggagaggaggcccacgaggacgaggagatggccgatttgcttgacttcttgggagggagtggagctacatga

SEQ ID NO: 88760 - DNA, 64 bp, Glycine max
  Peptide Sequence Number=SeqID_180445
atggatccttcactccctaacaagggaagtccaccaatagagggcatacctttgaaagctaagg

SEQ ID NO: 88761 - DNA, 417 bp, Glycine max
  Peptide Sequence Number=SeqID_180446
atgtatggattcctcgagccacagtccattcagagatctggacaatcgcaatttgaatcggaaagttacatcaagagttggatgcagagttcaaaacacgatgtttaccttggagcctacctgaatggacactggcaaatggttgtcattttgcctaaggaaaacctagttgtctggtttggttctttacataataggctagacaactaccttaagggaataattaacagacaaaaaggaagcactaagtgcggctattatgtcatgcactggatgtccacgataatctcaggaactttcaggaataattgggaaacggcctattttaatgatgttagaccattggaagcagggagattcaaggcgtttcgcatccagtgggcacagtatcatctaaaagttagaaatcaaacatag

SEQ ID NO: 88762 - DNA, 216 bp, Glycine max
  Peptide Sequence Number=SeqID_180447
atgtggtggaagtcgaaaagaggtgtttttgcgcaatccataagtttccgtgacttcttcgaaaggcccacttgggccttccagaagcttcctccagaaggctgttgcttctgtaggaagcatcctggctcgcctgggcgagctgggcggcaagcatctccctattttgctataaataggggaggaagtgaagaagaaaagggttcagccccttaa

SEQ ID NO: 88763 - DNA, 608 bp, Glycine max
  Peptide Sequence Number=SeqID_180448
ggaaagctgcaatatctttgtttcatcaattccctgatgaatctttgagcgaagctttggagagaccacaaaccaagaaactgttagatgcttctacagggggaaaaataaagctgaagaccctggaagaagcaactgagctaattgagaatatgtcagtcaatgatcatgccattctgcgagacagaacccatcaacccacaaagaagagcttgttagagctatcatcacatgacactttgttggcacagaacaagttacaggttgtaccatctatggtgaggttcatgaaacaggccaatgtatttccatcgaagaaaacgctcaagaaattcattttatggggaatcaacaacgacaagggtatactcaaggaggattttcaggctttcagtagagtccctataatcaacaaggacagtggaggacacaccctggagaccttgaatcagtttatgcaggtaacaatgtcaaatcataaaatcactgagttagcactgaagaaccttgaggtccaggtggaacaactggccaagcaaatagttgacaagtcatccaacagttttgtggcaaatacagaacaaaatcccaaggaggaatgcaaagat

SEQ ID NO: 88764 - DNA, 348 bp, Glycine max
  Peptide Sequence Number=SeqID_180449
atggagatatgtcacgggggtcaggagacattggggacgtcaggcttaaaatgggactggaagattgtgaaggcctctggtaatcgattaccagcctgtgtaatcgattacacagaggaacaggccactggtaatcgattaccagggagcttgggagaccctcgaaggcaatacgaggtgctgatttcggggcacgattcgattcacggcgacttcattggtgtatccagaggaacccgcgagtacgcttcagcgcactttggagtggatattacccacgcctacaccataccgtctagtggagccagtccaagtgatcgaggtgacgtcatccgaggaagaccctga

SEQ ID NO: 88765 - DNA, 712 bp, Glycine max
  Peptide Sequence Number=SeqID_180450
gtcctccgccgcatcccaatggatgatcaaacagcacctctcattcgtttagttcctagtaaaacatgtttaagctatgacctcaagagtgctaccgattggtggcctcttgtgtttctgtttgaaaggcttgcgctattgtttgacaggtcatttgcttcaagtgttgtgaatacaacattagggacgaatgtatttgaggtacccttcgttaagagggctctgtctcaagtgtcctttgtgaccggtcaaccgttaggctattatggttattggcctttgttcgcgttcacccatcatgttttggtgtggtgggctgcggaacaggttagacctgggatcctgttcgacaggtatgctatattaggtgatgatgttctcatcaccgatccacttgtggcggaacagtaccggctaggcttacaacggcttggtgttaagatatccacacacaagtctttgatatcctcaactggtgctgtagagcttgacggagttcagtctgtctggagggaatcatttcttctcaatgccatgatactttctgttttgtcgagccctgctttggtctctggtctcgacttctccgctatgatcttcccagtagttcatataggagctatagccgtatcattcctattcgttgttatgatgttccatattcaaatagcggagattcacgaagaagtattgcgctatttaccagtgagtg

SEQ ID NO: 88766 - DNA, 366 bp, Glycine max
  Peptide Sequence Number=SeqID_180451
atggatgtagaattcacggagatatgtctacctaggagcctacttgaatgggtaatgcacattggcaaatggtcgctatgtcctaaggacaatgctgccatatggttttgttccttgcacaataggcccgacaactgcttgaaaggaattattaatagtgctttgaagggattcaacgatagtcaaggaagtaaatccaaggttattactagatggattctagttaaatgtaataagcaaaaagtaagcattgagtacaggtactacgtagtgcattggatgtcaacgatagtcctaggaggtttcgaggataattggaaaatgtattttgctgatccaagagcattggaactagagacaatgaag

SEQ ID NO: 88767 - DNA, 51 bp, Glycine max
  Peptide Sequence Number=SeqID_180452
atgcagcatttcaaagtcatagatgatgggaggaagagcattaacatgcag

SEQ ID NO: 88768 - DNA, 423 bp, Glycine max
  Peptide Sequence Number=SeqID_180453
gacctgatttgggaggatattcaggcagaatttgatatcctagaggcttctgacagtaggacgaaaaggaagttactacagaccgtgggggagagatggaggcagtttaaatcaaacctcacgaggaaatgggcccttgcagccgatcaggacggtgtcgaggacactgtctgtgacaaatacggcatcagcaaggaaaagtgggcccagctttgccagactcgcagagacccttcttgggaggatgtgcacttcaaggcacagaccatccagaagcagaatactgccccccacgttttgtctcgtgggggttatgattatttggagcagaagctcctggctgagaagacaaagaagaagctgcacagtcaggaagcattgatggtgtcatcgaccctccatccccgttcagacgccacgtga

SEQ ID NO: 88769 - DNA, 432 bp, Glycine max
  Peptide Sequence Number=SeqID_180454
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcggtattcggtggactattgctataaggaagatgaagataatgaattgatatattcaagggaggtgaagcctcttgtgtctgcagcttttgatggtcataacagcactgttattgcacatggtgctaggggtagtggaaagacgcacgcaattcagggtaccgagctcgaattcgtaatcatggtcatagctgtttcctgtgtgaaattgttatccgctcacaattccacacaacatacgagccggaagcataaagtgtaa

SEQ ID NO: 88770 - DNA, 462 bp, Glycine max
  Peptide Sequence Number=SeqID_180455
atggcaccgccttgtcactcttgtaggggaaaggggcacgcttctcaactgggacaggctggaaaccttggggcttttgtgtggcaacatctctggagaagtggatcaccaatggcttgggtttgctcgggctctcatcaaccgattgcatgcacacatctccttccccctttcttatgccataaacttcaattaggcctttgtccatcatcccctatagtagctcctccgttgtcgggcatgtttccacgtcatgtgatgccctcggatgcatcaaacaagaatctcccttgtccccgttgtcataccctaatttcgtccggggaccatccgttgttgggatgcgaccctcgtttgaccacttcgaggtacttggcacccatccttaggcaattcgtgaagttctgtgacatgccggaagtcaaaagaaggcattgtagcacaatccgtgaagttccatga

SEQ ID NO: 88771 - DNA, 831 bp, Glycine max
  Peptide Sequence Number=SeqID_180456
atgaaagggctgcacgtcctgaccttcagaggaatacacgtcctagccatcagagggctgcacgcctacacctttagaggactacacgtcctcgccatcagagggttgcacgccctcaccttcagaggtctacacttccttgccattagagggctacacgccctaacctttaaaggactacacttcctacccatcaaagggctgcaggccctcaccttcagaggactacatgtccttgccatcagaaggttgcacgccctcacctttagaagacaacacttcctcgcaatcagagggctgcacgccctcacctttagaggactacacgtccttgccatcagaggactgcacgacctaaccatcagaggactacacgtcctcgccattagagggtcgcatgccctcaccttcagaggactacacgtcctcaccatcagagagctacacgtcttcaccatcagatggctgcacgtccacgccaccagagggctgcacaccctcaacttcagaggattagaaatcctcgcctttagagaaccacacgtcatcgccatcagagggctgcacgccctcacctttagaggacaacacaggactataagtcctcaccatcagagggctgcatgtcctcaccatcagagggcggcacgccctcaccttcagaggactacacgtcctcaccttcagagagctgcacgtcttcaccatcagagggctacacgtcctgtccatcagagggctgcacgtcctcaccttcagagggctgcatgtcttcaccatcagagggctacacaccctcaccttaagaggactacacgtcctagccattag

SEQ ID NO: 88772 - DNA, 267 bp, Glycine max
  Peptide Sequence Number=SeqID_180457
atgcaacctaaagtactaattcttgatccctccattatcatcacagcatattcagaaaaccaaaaccccaacaatacatccctggtgaaaaagaggctaatttttgaatttcaaaatgtagcagttgggctaagcgcatatccaccgctaagcgcagcttcaacgctcttagcgcaaaggagaatcaggctaagctcgagactggcgctaagcccaatttcacttactcgcgctaagcgcagcgtcgcgatttcagagcctatttaa

SEQ ID NO: 88773 - DNA, 564 bp, Glycine max
  Peptide Sequence Number=SeqID_180458
atggatcaagtccgacgtcaagccttccgtaaggcatatgggaaaattttggatttggccatgatagaagtgtttgttgaagccatcacatccctcgcacaatattatgaccggtcactaagatgcttcatgtttggggactttcagttggtaccaaccatagaagagtttgaagcaatcttgggatgcctgctaggagggaggaagccgtatctgttttccagattatacccctccatggcaatagtggcaaaagtggtcaagatcttggcacaagagttagaccgggtgaaacaaaatagaaatggggtggttgggataccaaggaagaacttggaggaaaaggcaaaagatttggcagatcaaagagaatggacttcattcgttgatgttttagcactgttggtatttaggatcgtgatctttccgaatgtagacgggctagtggatttagcgatggtcgacgcttttcttgcttatcactacaacaaggaaagcctagtcattgttgttttggcttatgcctatgacactttcgacctaagatgcgaggggatcctctag

SEQ ID NO: 88774 - DNA, 391 bp, Glycine max
  Peptide Sequence Number=SeqID_180459
taaggttaagcgcgccctgtgcgctaagcctgagtgttattcggttgaggctgagctaagcgcgccatgctgcgctaagctccaactcttttcgatgacatctaagaataggaaagctccttctacaactacccaggccagatttgatagatccaggttcacatccctagaggcttgggagagatatgctgacattgtggtgcctcgaaagctactaccagagaggaatgttgtaatttattacacaaagtttgacgagttcaaggaggaactcaagagaagacattgggataagaagctgactgatttttctgataatagcatagacatcgctattgtgaaggagttttatgccaacctctatgaccctgaggataaatcacctaaacag

SEQ ID NO: 88775 - DNA, 957 bp, Glycine max
  Peptide Sequence Number=SeqID_180460
atggccctgagaaagctccccacgaagaggtccaggaaagacaccactggagagggttccagtgcgaccccacacgccgatgtggacctcgatagacacaggttccgaagtgtggaacaccagcagcggtttgagaccatcagaggctggcatcgggctccgctcgtatcacccatggctaagttcgatcctgaaatagtcatggagttttatgctaatgcctggcctacggaagaaggggtccgagacatgcggaaggctagcaatgcgagtatagccggaggaggagtcaggcctcaagctttgatgaggaggctattagccaattgttgtgcatgtcggggtaggactttgcccggaccgcaacagggagaaagcaaaattctccctagcgaccataactcggacctcaccctactaaagtgtcagctggtctacaccatactgacacatgtgagtgtacatgtggctcagctgatctctgatgctatttaccagtttgcagggattgtgcgtaccagacacccggtggacccggagaagtccaacagggccttgagatttcatgctctgattataggcctctgtcagttctatggagtgtcggtcacccccagcaagcttatccgccctcctattaatagggctttcattgagaagtactgcatgcccaggcaggcacagggccaggcaccacagcagcccgaggatggccagcagcaggcagctgcagacgcaccaccaccatctccaaagtccacctctactcacctgcggagtacaccctacatcagtagggccaggatcccagcccttacacatgacctactcctgagcagttcgaagtcgcagtggcatggcctggagattggcccgatttttagacaaggccagggcctgcagggacctccgaagatggagacggacctcaggaagacaatgacttggccaatgtga

SEQ ID NO: 88776 - DNA, 636 bp, Glycine max
  Peptide Sequence Number=SeqID_180461
atgttacaaaacctcacggattgcgtaacaatgcttccttttgatttccggcatgttacggaaactcacggattgtgtaacactatagccaaggtgatagggtgttggcatgaaggcaatacctatcaagagggatgggagaagaattatgattcctatgttacaagggtgctttaccgggagaatgctcaaaaggatggttccaaaacaaccttgcctgacctccacaagtttatactttttcacttgatggagaacctcccttttggccttccacacaccatctatagcaacatactgaggaacctaaagggcttaggtgttctggacgacatctattatgccgctctcatcaacaagattttgggggatcaaggagtgtaccatgtcttcaacaagatgaacgaagactctaagcacatcctaatagctaagggctcagttgttgctaaacaacaaaagtttagcaaggctaacctgaaagctatgaaggtgtcttttatcccctctacaattctaagacatatccagacgagggcgaccaaggccaaccccaagattggtgacaaggaatgggcagtttcctttattgggaacaagaaggatccagcctcatcaacatcatcagatcattaa

SEQ ID NO: 88777 - DNA, 285 bp, Glycine max
  Peptide Sequence Number=SeqID_180462
atgactaaagcacgtcaaaagggggtacgaaaagtaaatgaaatgaaaacaaaagtacgcgaaacaagtggggaccaccaaagggaaaagagggagaatcttgccacccagaaggaggtgccttccggcatgttacgaaacttcacggatcgtgcaacaatgctttcttttgacttctggcacgttatggaacttcacgtattgtgcaacaatgggtgccaagtacctcaaagcggtcaagcaaaggatgcatgccatcaaacaatggtccccaaacgaaattag

SEQ ID NO: 88778 - DNA, 147 bp, Glycine max
  Peptide Sequence Number=SeqID_180463
atggaattggctacacgaagctggtgggaggagacgaggtcatcatacacgaagtcgacaatggaggagacaaggtcgagattttgtgcttacttgacctatctgccttgtgcaaggcttataggacactacagaactctaaactga

SEQ ID NO: 88779 - DNA, 339 bp, Glycine max
  Peptide Sequence Number=SeqID_180464
atggaaatctatgagagtgatcgactaggaaaaagtgtaagttgtcatcataaaaaagggggagattgtagaaccaagcttcatgatgaatcaagattgattcaaagaagttttgatgataacaaaggtgatgccaaaaagctcaaatatcaagaacaacttcatgataacaaagatgatgatctcaagaatcaaagaatgagttcaagatgttcaagattgaatcaagaacatttcaaggttcaagaggaaattcgatttcaagattcaagaatcaagattcaaggttcaagcttccaagaatcaagatcaagattcaagactcaagagaagaattaa

SEQ ID NO: 88780 - DNA, 63 bp, Glycine max
  Peptide Sequence Number=SeqID_180465
atggtgattttccaccatggagatgcagcggaagataaaggagaagaggttagaggagcctag

SEQ ID NO: 88781 - DNA, 462 bp, Glycine max
  Peptide Sequence Number=SeqID_180466
atgcagctactatgcataccggggcaagatttcacctgtgccgctgcaaagagacaacaacattctgcccagcaaccgcaataccgatctccccctgcggaagtatcagttggtctgtgtcgtttcgacatagggatcgtgcccacaaggcacccagtggactcggaggagcccaacgggaccctggggtttccagctctggttacgggcctcgatcagtcctaccggatgcctgtccccccagcgaggtcatgccattgtgacatagggatcgcgcccgcaagacacccagtggactcggagaagtccaacagggtcttagggtttccagctctgattacgggcctgtgtcagttctacggagtgcccgtcgccccagcaaggtcattaggccccctactaatcaagctttcatcaagaggtactgcgcccccaggcaggcgcaggcgaaacaccacatag

SEQ ID NO: 88782 - DNA, 251 bp, Glycine max
  Peptide Sequence Number=SeqID_180467
atgagtgatggattttgcggtactcatttgcagatcatggttaggacaagaggattaggttgtgccttaggtcaggtcactggcagaggtctgggcagaggagatcgtgatgattccgatgatgctccgcagcgtcgacggcctactgcatccgcacggaggcagcaagtcactgtgactgcggatcacgtcgatgagccagtcatccctgcgccagatgttcagatgacccgatggaggcaccagctgct

SEQ ID NO: 88783 - DNA, 577 bp, Glycine max
  Peptide Sequence Number=SeqID_180468
gtcgactctagaggatcccctcaccatcagaggactacacgccgtcacctttagagggctacacgccctcgccttcagaggactacacgtcctcaccttcagagggctacataccccgccttcagaggactacacgtcgtcggcttcagaggactacacgtcctcgccttcagaggactacacaggactacatgtcctcaccttcagaggactacacgtccacaccttcagagggatgcatgccctcggcttcagaggactaaacgtcctcgacttcagagggcttcacaccctcgccctcagaggactacatgtcctcccctacagaggactagacatcctcgtcattagagggctacacgtcctcactttcagtggactacacgtccccaccttcaaaggactacacgtcctccactttagaggactacatgtcctccccttcagaggactacacatcctcgtcttcagaggactacacgtcctcgccttcagtgggctacacatactcaccttaagaggactacacgtcctcgccatcagagggctacacgtcctcaccttgagaggactatag

SEQ ID NO: 88784 - DNA, 498 bp, Glycine max
  Peptide Sequence Number=SeqID_180469
atggtcatccacaccccttttgctatccagagacaagcaagtcagatggcatgcagagaccatcatggtcatctgcaccctatttgctatccaaagacaatcaagtatgatggcatgcggagaccatcatggtcatccacaccctttttgctatccagagacaatcaagttcgatggcacgtagaggaaaattatggtcatccgcacccctttttctatctagagacaaccaagtctgatggcacgcggagacaaattatggtcatcctcaccccttttactatctggagacaagcaagtccgatggcatacggagaccatcatggtcatcctcaccctgtttgctatctagagacaattaagtccgatggcacatggagacaaattatggtcatctgcacccattttgctatccagagacaagcaagtctgatggcacacggagacaaatcatggtcatccgcacaccttttgctatccatagacaagcaagtttga

SEQ ID NO: 88785 - DNA, 129 bp, Glycine max
  Peptide Sequence Number=SeqID_180470
atgtctcaattggtcgatatcggttatatgatgttagctctcggatctggatccattattcattcaatggaagctcttgtcggatattctccagctaaaagtcaaatatggttcttatgggcggtttaa

SEQ ID NO: 88786 - DNA, 459 bp, Glycine max
  Peptide Sequence Number=SeqID_180471
atggttaggacccgaggattaggtcatgccttagggcatgatactgacagaggcaggcaacgagtacctgtgattgctgcggacgatgagccagtggtccttgcggcagaggctaccggagcttcgattgaggctgacgtatatgcggataagccaatggcaagaggtgatatacatgacactggggcagacactcctgcagacacaggcacacaggctgctgaggatgagcctgagggattttcgggtggtccgagggacccatccgtgctgaccgagtatgcggatcacgttgcagacagtgtatggatgggagaggagcgtcctgagttgaagctatcctctcgcgggaggaaggtgcatagtttaggcaggcttgtccctgcctttgaggggctagttgttgggacaggactaagtcctctgatagcatgttcggtagacattggcgatcagtga

SEQ ID NO: 88787 - DNA, 183 bp, Glycine max
  Peptide Sequence Number=SeqID_180472
atggttttcggggcttcgcggcttcgtaatacttccgtaaatttcgaaaaccttggaaaaatcaagtcgaagtacttccgtaacgcttccgtaagcgattctgtggaaattcttcatcgttcttcgtcgttcttcaccgttcttcatccgttcttcgttcgttcttcattcttcaacgggtaa

SEQ ID NO: 88788 - DNA, 210 bp, Glycine max
  Peptide Sequence Number=SeqID_180473
atgcagaattcaaaacgggatgtctacctaggagtctacctaaatggtgcatactggaaaatagtcatcattttgcctaaggaaaatctcgttgtctggttttgttccttgcataataggtcaaacaactaccttaaaggaataattaacagtgcattgaaaggacttgacaatactccacaacctaaatccaaggctggtgctaggtga

SEQ ID NO: 88789 - DNA, 246 bp, Glycine max
  Peptide Sequence Number=SeqID_180474
atgacaaagttgagcgaccgtgttataagacacaaaattattctctggcatttcatcgaacaccttcaaggccaaattgaccaacccaaactccatatactccgtgcgattgtgaagagagtgcagaacatgtggaggaagtgggagagtataacaacccaagtagatataccctctacttctaccacaaaggatgtactctccaacgtgttaagacaaagaattcttaggcggttagtcccttga

SEQ ID NO: 88790 - DNA, 273 bp, Glycine max
  Peptide Sequence Number=SeqID_180475
atggctgaccgtgcctccgccaccactcgcctccacatctccgccgcacctccctttccgatctccaaaggtcccttctcttgcctctatttttcgattctcctaaaccctagcgtcgttccgccactttcgctattcttattaggttacgccagccacttcatttctctgtttgagcttaaggttttgcttcgtctccgagtggtctcgattttgagttcggaggtggcattgatgaattgctctgcattccgcttatttcttgctctttga

SEQ ID NO: 88791 - DNA, 753 bp, Glycine max
  Peptide Sequence Number=SeqID_180476
atgtccagaacacgaggtttaggtcgtgccataggtagagttgtaggcagagatagagctgctgacgaggatactggcgatgttcccgagaggcgtaggcctactgcctcagcccgtaggctacgcgttcatcagatgactacggagggacgtgatatggctgaggacgtcgctgacatgactgatgatgtccctgagcaaccggaggcacctgagatgcgtgcggacgcacagggtgctgatagtggtgaggggtcagatggtgatgatgctgcagagggattccctggtggtccacgtgacccgtcagtgctcacatcatttgccgagcatgttgcacatgccgtgtggagtggacaggaacgtcctgatttgaagttagtgtcacatgggaggaaggtgacactgattgggaggccagtgcctgagattgaaggcctggtggctgccacaggattaagttcattgatagattgttcagttattactggcgatcctggacttatatccgcatttgtggagaggtggcacagtgagactagcaccttccaccttcctgtaggagagctgacgatcacattggatgatgtgtcgtccattctacatttgcccatcactggcgccttgcacagtttccacgctctttctacggagaaggccagattcttgctcacggagttgctggaagtgtctgcggaggaggccagagccgagacagcactcacacgtggagcatatgtacgattaggatgg

SEQ ID NO: 88792 - DNA, 210 bp, Glycine max
  Peptide Sequence Number=SeqID_180477
atgggtgaagcggaggaggccataaaagagcaaaaggccacaatgatgaaggccatgatgagcatgaagaagatgatggaagccaatgcggttatagttgtcgctattagcgctgtcgctaaaggtgaacccgatgctcccatctggcctcaagcaaatgaatcatccaacctcaaatatggtaggcaaagatttgggaagtacggatga

SEQ ID NO: 88793 - DNA, 309 bp, Glycine max
  Peptide Sequence Number=SeqID_180478
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtgtaaaacgacggccagtgccaagcttgcatgcctgcag

SEQ ID NO: 88794 - DNA, 69 bp, Glycine max
  Peptide Sequence Number=SeqID_180479
atggagaatttcttttttgcagtccgacgtggtaaaacgccggccagtaccaagcttgcaggcccgcag

SEQ ID NO: 88795 - DNA, 780 bp, Glycine max
  Peptide Sequence Number=SeqID_180480
atggatatgaatcttggatctttcatttctagtcagattacactcatggcccagcacgactccttgaggctcgactttcttgccctaatcactgctttatgtaaaacccaaggagtccactctgattccttgacccatgagagattaagtcctgccattaatttggcatatattaagaaaaactactggaacctagatgacctctcagttactttcagagggccgcacaaggccaaggggaagaggtctgaggctccctcatcttttgaggccccttccactttagcaccaaaaacaccaactccttcttcttccataactccattacctctcactcatattccagttattcctcctgcacccacacagataccacttccagctcctttatctataggtccattagattttatttttacaccaatgatgctgcactccatgctccaaagcatccacagggggcagtccattatcatgcagagccttcaaagcttgggcttgtcctccattatgagcatggaggagtttgatgctcgggtggcctggccaggagaccagccctcttcttctggagggggtggagcatctgcagccctggaacctatgattgaggagccactaataccagtagcagcagcagcagcaaaggaggagactactcctgaggagacccaaccatctacaccagttacggagccagagcagcctatccaggattcatcaatagctctagcactggatttgaatgaagaccagccacaggaggagcaggacgtttaa

SEQ ID NO: 88796 - DNA, 381 bp, Glycine max
  Peptide Sequence Number=SeqID_180481
atgtactttatccgcccgctgggttacgggtgggtattttaccagagatatactctcggggagggtgcagggcggacgatttcaaaacagattacccattcattcgatagagaagatcaccaagatttcgtgattcgctgccgaatattccaattcagtgggctcctagaatatgcgacccttgggcgctttctattttattgtattgaaaggcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggctttttcgaataa

SEQ ID NO: 88797 - DNA, 162 bp, Glycine max
  Peptide Sequence Number=SeqID_180482
atgtcgcgctatgcacattcatccctgctgatgaacatggcatctaagaagaggaaagctccttctacacctacccaagccagatttgatagatccagattcacatccctagaggcttgggagagatacactgacattgtggtgctcgaaagctactactag

SEQ ID NO: 88798 - DNA, 348 bp, Glycine max
  Peptide Sequence Number=SeqID_180483
atggtcattattgtcaatgcggaagcttgtggttacgtgagcatgaactactaccaatatatagatgttgtttacacaaatgaacacatcttaaaagcttactccgcacaatggtggcctcttgggaatgaagcggctattcctccttctaatgacgcatggacacttatccctgacccaactacaattcgtgcgaaaggtcggccaaaatcaacaaggataaggaatgagatggattgggtcgaaccatctgagcaccgacaaaaatgtagtagatgtggagccgaagggcataacagacgtcgctgtccaatgcaatctgagcatgggagttgttcaaatcattga

SEQ ID NO: 88799 - DNA, 270 bp, Glycine max
  Peptide Sequence Number=SeqID_180484
atggtgtataaaaactcacacagcattcgttattcgctctcccttgaggagattctgctgtcctcttcttcgggggaaaggatgaggattctcttcattggccaagggtgtcggtttcgggttaaacttccatattatttccacgaggcacgcgtaacaatgatgatttggaaacaacgtgcaaaattagtcatgcatacagctaggtgggtactcaagcatccagtttatggcattgtgatactaaggcttgggatttatgcaagttga

SEQ ID NO: 88800 - DNA, 1128 bp, Glycine max
  Peptide Sequence Number=SeqID_180485
atggctacttcacttcagaaatctcgaagtgcaaccaagaaattgcttgaagatttcacaaagaaacgaagactagaatcgccaaaagaacaaccaacttggagcacaagagctgcagaagaagctgaggctgtggcagcaataccatgttcaggacatggaagagcctacttagatggtcttattcttaaagatatgaataagtctcgttgtgaatgcaattcatgctatgctggatctgactgctcccagtttttatctgattgtcctgccaacgctgatggtggtgatccatattttatggagccattttggatgcaacatgcagcaagtagtgccattctagtatcaggatggcatagaatgagttattcttatagcgatggatcagtcatctcacaactattggttgagtacataaaaaaagttcatggcatcgttgggaatgcaatcaccgaaggaaagtacatcgtatttggaagtggctcaactcaacttctcaatgctgctgtttatgccttgtctcccgacccatcaatgtctccagcaaaagtggtagccacagcaccatattacccgtttgtgacttcaccaaacaatccagatggaaagttgaacaagggaattctcaaaggctctgatgtgaaaaccatttatgatcgagcctattattggccacatttcactgctattccttcaccagctgatgacgatctcatgctgttttcaatttccaaactcacaggccatgctgggagtagatttggcgccatgggagtttcccgtgacgttcagctgagagttttaaagcttttggacgtggctactgagggagatggaaaagaaatatttcaatttacatattcaacaatgagagatcgttggataagggtcagagatccttcaccagcgtacgcttggttgaagtgtgagagacaacaagacatgaattgctatgaaaccctaaaagctgctggcatcattggccgtaaaggaagtaactttagtgcagatgaacgttacgtgcgtctcagtcttattaagagccaagatgattttgagatactaacaaataagctcagaagtcttgttgcaaaggaatgggaatccaacccagcttccatttaa

SEQ ID NO: 88801 - DNA, 558 bp, Glycine max
  Peptide Sequence Number=SeqID_180486
atggatgttatgcccttccttggggaatttcatgctaatgaaattttcccaaggggaaacaatgcctcgtttatagccttgattcctaagcgacaaagtgcattcatagagggcagacacttcttccagagtgttgttactgctaatgaggctattgatgaagcaaggagatctgtattattagttactggactctgggattacatttattccttgagcacaactgtgtctgccttttcagtggcttctgacataacagctgaaggattcactgttttgtcatttttggatgaggtgtctatgatctataagaatgtgggtttgagcctaactcaaccccaaaagctagttcaaaaggttaggacagatttgttgcctttaatatggctctattctaggcaagtaattatgagtcttaggtgtcttgtgtccctactgttagtggaaggccaccctctgttagagccacctgaaactggtcactgcctactagtgcctagagccttgctggcaagaaaaactccatgcctctccacgctcatagagatcctagtgtga

SEQ ID NO: 88802 - DNA, 442 bp, Glycine max
  Peptide Sequence Number=SeqID_180487
gatcccccttgagcacaagaggttgcatgatttggtgtttgtcaaatacaaccaacaattgaagcaaagatataatgcaagagatgaaattgatccaatttctcttaatgatattgatgtgtgcaatgaatggctcgtggaagagatggatcaagatgatgataatgatgctggaaatgatttggtatttgaagatgatgatgctctaaattggacaactgtgtatcaggcttcgggggttggagagtgtaggatgaagcaaaaagcagtccaagaaaatgatgaggatctagattttgaggagaatattgatcttgaatctgaagaagaagaaatcatggtcaattttgaggcgtctaatggggaagagggagagggagatgctccattaccatatgataacaacgaagatgattatgttgggattggagaagatgattag

SEQ ID NO: 88803 - DNA, 525 bp, Glycine max
  Peptide Sequence Number=SeqID_180488
atggtagaatggaggagctgccaggggcgtttggaagcagcgccagtttggctctccggttgggccaaacagtcttttccacagcttcccttctcttcatgtgtttggatgttgatttctacggctacactgctttctgagagtggtgtactgtggggaggagagaagcatgagtgtagggaatgtattaggatatttcaggaaatcaggaaactgtatctacttggtaactgtcatgggtttggtaattccctggagcataacactgttggttgtagatgcatactctgtctttataaaatgtttacccctccaacgaagacttgtactgatcgtctttctgggagacatgctgcagcatgttcaacagccagtgtcacagatctcctgcttgatgccgatcgatcctattgcccaccaaagttatgtggtagatatcaattgtctgctgctatggccttcttgtcttggtttctttcatcagcatcctctctgtttaacttctggcttttcccttctttgtaa

SEQ ID NO: 88804 - DNA, 165 bp, Glycine max
  Peptide Sequence Number=SeqID_180489
atgtctcatgtgagagtcatcacgaacggagagaggcagaaaagaaaggccaaaggaagtgaaatcttatttctctcctctttcaaggaaatcaaagtacaccggaaagaagttcctatggagaaagatacaagtcttcctgatggagaaagacacacatcatga

SEQ ID NO: 88805 - DNA, 6090 bp, Glycine max
  Peptide Sequence Number=SeqID_180490
atgtcctcctcctccattagctatggatggaaatatgatgtgttcctcagcttcagaggttctgatactcgccatggttttactggtcatctctacaaagctctcttagacagaggaatctacacctttattgacaatgaggagcttcaaagaggagaagagatcacaccatcacttgtcaaggcaattgaagactctaggattgccatccttgttttctctaagaactatgcttcttccacgttttgcttagatgaacttgtacacatccttgcctgtgttaaagaaaagggtacaatggttttaccggttttttatgaggttgatccctctgatgtacgacaccaaagaggtagctacgaagaagcactgaataaacataaggagaagttcaatgacgacgaagagaaattgcagaaatggaggattgctctgcgtcaagcagctaacttgtctgggatctatgaagcacggacacttcagccctttgccgtgtccggtgtccgacacgcgtccgtgtcagtgtccgacaccgacacgacacccgtagggatccatggaattggcggggtaggaaaaacaacgattgctcgagaagtttataatttgattgctgatcaatttgaatggttgtgttttcttgataatgtgagagaaaactcaattaaacatggattggtgcatctccaaaagacacttctttctaaaacaattggagagagtagtattaagttaggaagtgttcacgaaggaattccaataataaagcataggttcctcctaaagaaggttcttttggttgttgatgatgttgacgatctagatcagttgcaggcaattgttggagggaccgattggtttggttctgccagcagagtcatcattaccactcgagacaaacatttactaacatgccatggggttacaagcacatatgaggttgatgggttaaataaggaagaggctcttaaattgcttagtgggactgctttcaaaattgacaaagttgatccatgctatatgagaattttaaaccgtgtggtaacttatgcttctggccttccactggctttgatggtaataggttccaacttgtttggaaaaagcatagaagaatgggaatcttccatagatcagtatgagagaattcctaataaaaagattcaagacgtactcaaagtaagttttgattctttagaagaagatgagcaacaaatttttcttgatattgcttgttgcttcaaaggatatgctttgacatatgttaaagaaatactttctactcatcacaatttctgtccggaatatgctattggagtgttgattgacaaatctctcataaaggtcgatgcagatcgtgtgatattgcatgacttgatagaggacatgggtaaagaaattgtccgacaggaatcaccaagagagccaggaaaacgcagtaggttatggtttcctgatgatatagttgaagttttggaagaaaataagggaattagcagaattcaaatgataactctggattacctcaaatatgaagcagcagtagaatgggatggagtggcattcaaggagatgaataacctcaaaacacttattattagaagtggttgtcttcatgaaggtcccatacatcttccgaatagtttaagagtattagaatggaaggtatacccttcaccatctttaccaattgatttcaatcccaagaaacttgtcatactgaagtttccttatagttgcttaatgtctcttgatgtgctcaagtcgaagaagctttcatattgtcatagtcttgagagttttccagaagtattagggaagatggaaaatgtaacttctcttgatatttatggcactgttataaaagaactgccattttcaattcagaatctcacacggcttcgaagacttgaactggtgagatgtgagaatcttgaacaaattagaggggttccacctaatttagaaacattctctgtaaaagattgctcatccttgaaagatttagatctcacacttcttccttcatggacaaaggaacgtcatcttttaaaggagcttcgtttacatggaaacaagaatcttcaaaatattaaagggattcaactgagcatagaagtactgagtgtagaatactgcacatccttgaaagatttagatctcacacttcttccttcatggacaaaggaacgtcatcttttaaaggagcttcatttacatggaaacaagaatcttcaaaaaattaaagggattccactgagtatagaagtactgagtgtagaatactgcacatccttgaaagatgtagatgttactcttcctcctgcatgcacccaagaatgttgcattttgagtacacttttctttgatgcttgtgggatgaatcttcatgaaatacacgggattccgtcgatcattagaacttgttctgccagaggctgtcaatactcgacatctgtgcccacaggcatgttactgaataagttcctaaatcatatggcagaaagagcagaaccatcctcgtcttccttcgcagacaaatggaatttttatgatgtcttcctcagttttagaggcaaagacactcgtcaaaatttcactggccatctctacaattctctattcaaaaatggaattcttactttcatagatgataaagggcttaggaggggggaagaaattacaccagctcttctcaatgccattaagaattcaaggattgccatcattgttttctcagaggactatgcatcctcaacttattgcttggatgaacttgtcacgatccttgagagcttcaaggaagaagagggtcgatcaatttatccaatattttattatgtggatccatcacaagttcggcatcaaacagggacttattcagatgcattggcaaaacacgaagaaaggttccaatatgacattgacaaagtgcaacaatggaggcaggctttatatcaagcagctaatctatcaggctggcatttccatggatctcaaccagagtataagtttatactaaagattgttaaagagatctctgaaaagattgattgtgttcctttacacgttgctgataaaccaattgggctagagtatgcagtgctagcagtgaaatctctctttggactcgaatctgatgtcagcatgataggaatatatggtattggtggtataggtaaaaccacaattgctcgtgccgtgtataacatgagttttagtaaatttgaaggcatctgtttcctccctgacattagagaaaaggcaattaataagcatggccttgttgaactccaagaaatgctactttctgaaacactcaaggagaaagatatcaaagtgggacatgtcaacaaaggaattcaaataataaaacagaggcttcaacaaaagaaggttcttttaattctagatgatgttgacaaattagagcagttaaaggtccttgcaggacaatatgattggtttggttctggaagtataatcattatcaccacaagagacaaacacttgctggctactcatgaggtggtaaaattatatgaggttaaaccattaaatgatgaaaaatctcttgaattgtttgattggcatgcctttaaaaataataaaactgatccaagttatgtgactatttcaaaccgtgcagtttcttatgcatgtggccttcccttggctttggaagttataggttctgacttatttggaaaaagtttgaatgaatgtaattctgcattggataaatatgaaagaattcctcatgaaaaaatccatgaaatatttaaagtaagctatgatggtttggaagaaaacgagaaggggattttccttgacattgcttgtttcttgaatacttttaaagtgagctatgtcacacaaatgctacacgctcatggttttcatccagaagatggtttgagagtgttggttgacaaatctctcgtaaagattgatgcttctggttttgtgagaatgcatgatctaattagagatacaggcatagaaattgtaaggcaagaatcaacagttgagcctggcagacgtagtaggttatggtttaaagaggacattgttcatgttttggaagaaaatacgggaactgataaaatagaattcataaagcttgaagggtacaacaacatacaagtgcaatggaatggaaaagccttccagaagatgaagaacctgagaattttgataattgaaaatacaaccttttctacaggccctgagcatctaccgaatagtttgagatttctagactggagctgctatccttcaccatctttaccatctgatttcaatccaaaacgagttgagatactcaaaatgcctgaaagttgccttaaaatcttccaacctcacaaggcatgttgcaaggtcttaacccatctgccgagcctaagagaagtaccactcgtaacctttttgtgtctcgattactgcagtaatttagttaaaattgattgttcaattgggtttcttgataagctcctcaccctgagtgctaaaggatgctccaagctgaaaattctagcacactgcatcatgttgacttctctcgaaattttggatcttggggattgcttgtgtcttgagggcttcccagaagtattggttaagatggagaaaataagagaaatatgtttagacaacacagccataggcacattgccattttcaattggaaatcttgttggacttgaactcttgtccctggagcaatgcaaaaggctgattcagctaccaggtagtatctttacactgccgaaagttgaagtgatatttggttttaggcattggagatatctattctttgaagagaaccaagatgggaaagagttgagtttagaagtgtttccaaaggccattcttgtttgccatcttgatcccaggcattatcatcatcttgacctgtattatctgtacatgagtcctaataatgtcatccaagtatgcagtcctaatctgtatatgctctgtgatttcgatttgttgttccaaaagcttgcattgggtgtcgagaaggactggtttcgcagatgcaggaaatggtcaatgaatttctcgtttcgaaaaaagtttcctaagattgcgcacgaatggaatgaagctgagattttattcgagttgaaatgtcctgcaccaagttctgtagaagcaatgtgggcccacaacatttccatggaaattatagactggactctaattggtgtctacaatcaaggaaacattaaggatgatattaaattcaaaatgccgatgtcaacttttttactccctaacagagaacctccttcattacctgatcaaccagaggtttatcgaaagattgttaaagaggtctctgaaaagattgattgcattcctttacacgttgctgataatgcaattggactagagtattcagtgcaagaagtgaaatctctccttggacttgagtctgatgaggtgaacatgatacgaatttatggtatcagtggtataggtaaaaccacaattgcctgtgttgtgtataacttgatttttagccattttgaaggagtgtggtttctccccgacattagagaaaagacaattaataagcatggcctcgtccaactccaagaaatgctaccctctgaaatactcaaggagaaatatatcaaagacaatcattgtcaccacaagagagacaaacacttgctagctactcatggagtgataaacttatacgagcatgcctttaaaaataataaagttgatccatgttatgtgaatatttcaaaccgtgaagctcttgatgtgcatggccttccattggctttggaagcaataggttctcacggaattttccttgacatttctaatatcttcaaaactaaagaagtgggctatgtcacacggatgctacatgctcatgattttcatgcagaagatggtttgagagtgttggttgacagatctctcataaagattgatgcttcagggggtctgttcttccatggatgccgccagaagaactggcgacataggtgttccgccattgcagatggcgagaagtacgctgagctggagggtgccgccactggcacaggcgagacatgctga

SEQ ID NO: 88806 - DNA, 2619 bp, Glycine max
  Peptide Sequence Number=SeqID_180491
atgaagattcttttgtttcttgatgatgtcgatgatctagatcagttgcgggcaattgctggagggacagactggtttggttctggtagcaggatcatcattaccacccgagacaggcatttactaacttgccatggggttaaaaataaatatgaggtacatgggttaaataaagaagaagctcttaaattgcttacctggagtgcttttaaaattgataaagtggatccatgttacgtcaacattttaaaccgtgtagtaacttatacttctggccttccattggctttggaagtaataggttccaacttgtctggaaaaaggaaagaagtatgggaatctgccctagatcagtatgaaagaattccagataaaaagattcaagacatacttaaagtaagttttgattctttacaagaagatgagcataaaatttttcttgatattgcttgttgcttcaaaggatatgattttacatatgttaaagaagtactttctatccatcatggtttttgccctaaatatgctataggagtgttgattgacaaatctctcctatgtcgacggtccagttacttgacaatgcatgacttgatagaggacatgggtaaagaaattgtaagacaggaatctccaggagagccaggcaaacgcagtaggttatggttgcatgaagatatagttcaagtcttagaagaaaatgagggaactagtagaattcaaatgataattctggattgcctcaaatatgaagtagtacaatgggatggaatggcctccaaggagatgaataacctcaaaacactcattgttaaaggtggttgcttttccaatggtcccaaacatcttccaaatagtttaagagtactagactggtggggatatccttcacgatcttttccaagtgattttcaaccgaagaaacttgtcagattacagttaccttatagtcacttaatgtgtctcaatttgttgtcttcgaacaagatgttcgtgaatatgagtgttttgaattttaatgactctccatatataacagagatacctaacttatgttgtgtcccaaatttacaaaaattatcatgtcgctattgtgataatttgattaaaatacacaaatcggttggattcctggataaacttgaagtcttagatgctgataaatgcagcaaacttagcagatttccacctctcttgaaattgacctctcttaaagaactcgggctttcatgttgtcctagtcttgagatatttccaaaaatattaggaaagatggaaaatgtaacttccctttatatttcatacacgcccataaaagaactgccattttccattcaaaatctcactcgacttcaaagacttgaactagtggcttgtggaattgttcagcttccaagtagcatctatgcgatgcaggaacttcgccatttgattgtgaaggcatgcaaggggttgcttttacccaaagaggataaaggtgaggtacaaacgaactcattggtctttaaaaacaccattgttcttgatctttcaaagtgcaatatatcagacaaaagccttcaaagaggtctccatttgtttgccaatatgagagaattatacctatcatataatgatttcacaattcttcctgcaagcattaaagaatgtcacgttttgacaaaaatttatttgaaaggttgtgagaatcttcaggaaattagaggggttccacctaacttagaaggattctctgtaatagagtgctcattgttgaaagatttagacctcacacttcttcctacagagaacaaaaaacggttctttttgaggatgctttatgtaactggatgcaagaatcttaaaaaaattgaagggattccacagaggatagaagtgctcagagtaacattttgctcatccttgaaaattgtagaatttactcttcatcctgcaggcacccaaggttttcaccttcggagggaaattgttctggataactgtgagaatcttcaagaaataaaagggattccatttggcattcaatatttttcggcaagggattgtcattcattgtcttccgagtgcagaagcatgttactgagtcaggaattgcatgagactagggaatgtggagtgttttatttggcaggaacaaggattccagaatggtttcatcattgtatcaatggatcgtcaatttctttctggtttcgtaacaatttcccttcaatatctctgggtgttgttgctggacccaagagttatttaaatgtgcattccagatttaggatcaatatcaataacaatataacatttaatttaggaataaggaatcatttggttcaagtacgtcatcatcgggtggagctagcctcgatacctatagttttttggggaaataaatggaatcgtgtggaatgtactgtatacccacttcaagagttcatcaaacaaattggaatccatgttttggaacaaggaaacaacatggaggacatccaatttaccaatccgctgtcgtcctcaggggaaatgaacaaaaagaggaaaaagaggggaaccaggcgtcctgctcctccccaagtactggagggcccattgtccagattgatttttaaagtaaactcagttttatga

SEQ ID NO: 88807 - DNA, 111 bp, Glycine max
  Peptide Sequence Number=SeqID_180492
atggctacaactagtgatgtaaaaaatgaagggaaaggcaaaggagacagcagttatagcctagcctgtgttgctatctcgacggttcagattcgcgagtatgcaagctga

SEQ ID NO: 88808 - DNA, 3450 bp, Glycine max
  Peptide Sequence Number=SeqID_180493
atgtcctcctcttcctttagctatggatggaaatatgatgtgttcctcagcttcagaggctctgatactcgccatggttttactggtcatctctacaaagctctgtgtgatagaggaatccacaccttcattgatgatgaagagcttcaaagaggagaagagatcacaccattacttgtcaaggcaattgaagggtccaggattgccatccctgtgttctctaagaactatgcttcttccactttttgcttagatgaacttgtccacatccttgcctgtgttaaggaaaagggtacactggttttaccagttttttatgaggttgatccctctgatgtacgacatcaaagaggtagctacaaagatgcactgaatagccataaggagaggttcaatgatgaccaagagaaattgcagaaatggaggaattctctgagtcaagcagctaacttggctggttatcatttcaaacatgggattgaaaatgaatatgaatatgactttattggcaacattgttaaagaggtctcccaaaaaattaatcgcactgttttgcatgttgcggattacaccgttggactggagtttcgaatgaaagaagtaaactcgcttttgaatttcaaatctggtggagtacacatggtagggatccacggagttggcggagtaggcaaaacaacacttgctcgagcaatttacaatttgattgctgatcaatttgaagtattgtgttttcttgataatgtgagagaaaactcaattaaaaatggattggtgcatctccaagagacacttctttctaaaacaattggagagaagggtattaagttaggaagtatcaacgaagcaattccaataataaagcataggctccaccgaaagaaggttcttttggttctggatgatgttgacaaaccagatcagttgcatgcaattgctggagggatggattggtttggttctggtagcagagtcatcattaccactcgaaacagacatttactaacatgccatggggttgaaagcatatacgaggttcatgggttaaatcataaagaagctcttgaattgcttagttggagtgcttttaaaactggcaaagttgatccatgctatgtgaacattttaaaccgtgcagtaacttatgcttctggccttccattggctttgaaagtaattggctccaacttgattggaaaaaggatagaagaatgggaatctgccttagatcagtatcaaagaattcctaataaagatattcaagacatacttaaagtaagttttgattctttagaggaatatgaacagaatatttttcttgatattgcctgttgcttcaaaggatatcgtttgtcagaagttaaagaaatactttttagtcatcacggtttctgcccacaatatggtataggagtgttgatcgacaaatctctcataaagattgattgctttggtaacgtgacattgcatgacttgattgaagacatgggtaaagaaattgtccgaagggaatcaccagaagagcctgaaaatcgcagtaggttatggtgtcctgaagatatagttcaagtcttagaagaaaataagggtactagtagaattcaaatgatagctctggattatctcaattatgaagaagtagaatgggatggaatggccttcaaggagatgaataacctcaaaacacttatcattagaggtggttgctttaccacaggtcccaaacatcttccaaatagtttaagagtattagaatggcggcgatatccttcaccatctctaccatttgattttaatccgaagaaacttgtctcactacagttacctgatagttgcttaacgtctctcaattggctcaactcaaagaataggttcttgaatatgagagttttgaattttaatcagtgtcattatataacagagatacctgacgtatgtggtgccccaaatttacaagaattatcatttgaatattgtgagaatttaattaaaattcatgtatcggttggattcctggataaacttaaaatcttggatgctgatggctgcagcaagcttacaagttttccaccaatgaaattgacctctcttgaagaacttaaactttcattttgtgctaatcttgagtgttttccagaaatattagggaagatggaaaatgtcacttcccttgatattaaagacactcccataaaagaactgccatcttcaattcaacatctcagtcgacttcaaagaattaaactgaagaatggtggagttattcagttaccaagtaccttttttgcaatgaaagaacttcgttatttgcttgttaaccaatgtgaggggttgctactacctgtagagaacgaagggaaagaacagatgagctcaatggtggttgaaaataccattggttatcttgatctttcacattgccacatatcagacaaattccttcaaagtggtctccctttgttttccaatgtgaaagaactatacctaaatgggaatgatttcacaattcttcctgcctgcattcaagaatttcagtttctgacagaactttatttggaagcttgtgagaatcttcatgaaattggatggattccaccgaatttagaaatattcgctgtaatagattgcacatccttgaaagaattagacctcacacttcttcccacatggaacaaagaatgttgccttttaaggaagcttcttttatgtggatgccggaatcttgaaaaacttaaagggattccactgaacatagaagaattgattgtagaatcctgcaattccttgaaagatctagatcttactcttcctccttcatgcacccgacaatgtcgtattttgagtaaacttatattggatagttgtatggattttgaagaaataaaagggattccatccgacattggagtattttctgcaagagaatgctcatccttgacttctgagtgtagaagcatgttacttaacgaggaattacatgaagccgatgggttcaaagagtttattttgccaggaactagaattcccgagtggttcgagtgtaccaatgaatcatcaatttgtttctggtttcgtgacaagttccctgcgatatctgtctgtgtagtttctgaaccaatggattcagatgtaacgttcagctttatcatcaatggtgtggaacatttaccaaagggtgctatctctttggacctatgcgttgatcatctgtggattattgatcacatagaggaactattcaatgactgtgttctttcggaaaatgaatggaatcatgtggtgtgtactacatcatgggtaccccaaccaatcaaacaaattggaatccatgtaatcaaacaaggaagcaacttggaggatatccaatttaccaatccactattgtccaaagaagacccagattttcgcatacaacatgatgattcaaggaaacgaaaaagacaagagtga

SEQ ID NO: 88809 - DNA, 711 bp, Glycine max
  Peptide Sequence Number=SeqID_180494
atggttcctaatacaatgacatacagttctcttgttgatggattgtgcaaatcagggagaaagtcttatgctttggatcttattgatgagatacaccgcagacgtcaaccagctgatggtggaagacttaagaatgcacaggagtttttccaacatcttttggttaaaggctattgtatagatgtctggacatatactgtcatgatcagtgggctttgtaaagagggcatgcttgatgaagctttggccatgaagatgagaatgataaggccttgtagtaagaataatcctaggattgtgcgttctgtgcctaccataaccgcaaatttaccgaatccacattcttactcccatgattctaaccttcgtaaagccataatctcactccttcacaagaaccgcaagaacccaaaacacgttcaatcaatacactgccacgccgtaaaaactagaacttcacaagacccttttgtagccttcgagcttcttcgcgtatattgcaaggtgaactacattggtcatgccatcaagctcttccgctgcatccagaacccaaatgtgtacctttacacttccctcattgatgggtttgtgtcatttggctcttacccgccactgaggttagaggagttaaactatttgacacagttcgaaggttatttaccaactgaggtggctttacatgatattgatgatgaacagaaggaatag

SEQ ID NO: 88810 - DNA, 2967 bp, Glycine max
  Peptide Sequence Number=SeqID_180495
atggctgcattctcctgggaccagttatttgaggttttttcttgtttacctgccaaagccattcataggttcaaatgcacaagcaaaacactggccaagcttcttgaagaaacctgttttgcatcaaagcaagctcagaactcaatgaagaaggatgatacatgtttcttccttcaacaagagacccctcattacaatgaaaaagttgaagttgagttgcatccattacccggaaaccaattgtcttctggcgtgtcccatgatgttctgagattcttgtctaactcaacaagagtcttggcttccactaaagggttgattctttgtaatcacgccacgagccacacaccaattgaactcttcatttgtaacccatcaacaaaaacttggttacccattcccaccccgaaggaagttcaaaaaagatatgatgctgctgatcccacaatgctgttgctagaatcttcctacgatggctgtgatgatgattacatggtatttcaccttgaacttgaaagcacaacagattggtcctcaaattatgcctgcaagattttcaagcctaaggaaggttcgtggaaaacaatggaaacaagtttctttgtaggtggcaggaacatgaagtttaacatgcctgtgtgttgtaacagggcaatccacttcatttctgattgtggtccttatctgactaaaaggagctgcttttttaacccctatgtcatgtcttacaatctagagagtggcacctcaacaatgctaagggtgccaaaagatgctagaaggggctcccatgattcaagttgtgacatgagaattttcatttggggaaaggcttacacagctcaatgctccatatgtttggtgaggctaagaaaatctgtcttcactgtttggatcttgacagattatgaaccaagcagatggttgagaattctcaaggtaagaacaaaaggaatgggcttgagggaggaaaatcctaaaataaccggattcgcggttatgaatggtgatctcctagtttttgcaactgaaacaagggtctatagctatggtttaacagaggaaaactatatgagggttgaggaaatctgccaacacagattccaatctaatgtctgctttacttcatacttagatacccttcggttctgtgggcgtggtgctgaaatgtgtgatctgaatcccgatgaacaacgtgcttttggttgggagtaccttactaaagaagcacaagctgcagggaagaacgggaatcgcgcccatgaaatgattatttccacagtgcctataacaaccgcaaatttaccaaatccacgttctaactcccatgattctaaccttcgtaaagccataatctcactccttcacaagaaccgcaagaacccaaaacacgttcaatcaatacacggccacgccataaaaactagaacttcacaagacccttttgtagccttcgagcttcttcgcgtatattgcaaggtgaactacattgatcatgccatcaagctcttccgctgcacccagaacccaaatgtgtacctttacacttccctcattgatgggtttgtgtcatttggctcttacactgatgccaaatggttcggaagcacgttttggctgataactatgcagtcacagcggtccattgggttgaagttggttgagttgtatgggaagtgtggtgtattggaggatgcgaggaagatgtttgatggaatgcctgaacgaaatgtggtggcatgtaccgttatgattggttcgtgtattgattgtgggatggttgaggaggcgattgaagtgttcaatgagatgggaactcggaatacagtgtgttggacaatggtgattgatgggttggtgaggaatggggagttcaacaggggtttttgggagctttggctcggtcgatggattcatgcatacatgcgcaagtgtggtgttgaggttaaccggtttgttgccggtgcgttgatcaatatgtattcaaggtgtggtgacattgatgaggcacaatcattgtttgatggggtgagagtgaaagatgtgtctacttataattccatgattgggggattggctttgcatgggaagagcattgaagcagttgagttgtttagtgaaatgcttaaggagagggttaggccaaatggtataacatttgttggggttttgaatgcttgcagccatggagggttggtggatctgggtggtgaaatatttgaatcaatggaaatgattcatgggattgaaccagaggtagaacactatggctgcatggttgacattcttggtagggtaggtaggcttgaagaggcctttgacttcattgggaggatgggagtggaagctgatgataaaatgctttgcccattattaagtgcttgtaaaatccataagaacatagggataggagaaaaggttgcaaaacttttgagtgaacattataggatagattctggttccttcatcatgctgtcaaatttctatgcttctttggaaagatggagctatgctgcagaagttagagaaaagatggagaagggaggaatcataaaggaaccaggttgtagttctattgaagtcaacaatgcaattcatgagtttctttcaggagacctcagataccctgagaggaaaagaacctacaaaaggttagaggagttaaactatttgacaaagttcgaaggttatttaccagcaactaaggtggctttacatgatattgatgatgaacaaaaggaattggctttggctgtgcatagtgagaggcttgcaatatgctacggactagtctcaactgaagcttacacaacacttagagttgggaaaaatgtaaggatatgcgatgattgccacgcaatgaacaagctcatagcaaagattactaggcgaaaagttgtggttagagatcgcaatagattccaccattttaaaaatggagaatgttcttgtaaggattactggtga

SEQ ID NO: 88811 - DNA, 270 bp, Glycine max
  misc_feature (14)..(14): n is a, c, g, or t
  Peptide Sequence Number=SeqID_180496
atgggaataggtgntggagaagttcctaaagaaaatactcctacacatgggttcagggagccaatccagttcaacatcttcattgatgacttgcgaccccattccaagcagctccttgatgcctccgtcgatgggaagattaaactgaggacttcagaagaagccatggagcttatagagaatatggcaaccaatgatcacgccatgaagctgatagagaatagggataaagtgactttgttttttctttgcatacatctatatgcttaa

SEQ ID NO: 88812 - DNA, 1506 bp, Glycine max
  Peptide Sequence Number=SeqID_180497
atggaggagccacaaccaggacccaacccgttacgcaaaatgattttggtgtcatcaatggcggccggtatccaattcgggtgggccttacagctctcccttctcaccccatatgttcaaaccctaggcgtcccgcacgcttgggcctcatttatttggctatgtggcccgatatctgggctgctggtgcagcccattgtgggctacagcagcgaccgatgccaatcccgtttcggtcgtcgccgtccctttatcctagccgggtctttggccgtcgccattgccgtgttcctaattggttacgcggccgatataggacacgcggcaggcgacaacctgacccaaaagactcggccacgtgcagtggcgatcttcgtgatcgggttttggatcctcgacgtggctaacaacatgctccagggtccatgccgtgcctttctgggcgacctcgctgccggggatgagaaaaagacaaaggcagccaacgccttcttctctttcttcatggccgtcggcaacatcctgggctatgctgcgggatcctacgacggcctccaccgcctcttccccttcacggaaaccgaggcatgcaacgtcttctgcgcaaacctcaagagttgcttcttcttcgctatcgtcctcctggtggtcctcaccaccttggtgctgattaccgtgaaagaaactccctacacgccaaaggcagagaaggaaaccaaagatgcagagaagacacacttctcgtgcttctgcggagaactttgtcttgcattcaaggggctgaagaggccaatgtggatgttgatgttggtgaccgccgtgaactggatcgcgtggttcccttactttttgttcgacaccgattggatgggtcgtgaggtgtatggtggtgacgtggggcagaaggcgtacgattcgggagttcatgcaggttctctagggctaatgttaaacgcgatggtgttggctgtgatgtcattggcaattgaaccgttggggcgtgtggttgggggaatcaagtggttgtggggaatcgttaacatcttgttggctatatgcttgggaatgaccgttctcatcacaaagatcgctgagcatgaacgtcttctcaaccctgctttggttggtaacccttccctcggtatcaaagttggttccatggttttcttctctgtccttggaatccctcttgcgattactttcagtgtcccatttgctctagcatctatatactccagcacttccggagcaggccaaggtctatctttgggtgtccttaatattgcaattgtcgttccacagatgatagtatcaaccataagtggaccttgggatgccttgttcggcggtggaaacttgcctgcattcgtgttgggtgcggtggccgccgtcgtgagtgcaatattagcagttcttctgctgccaactccaaagaaagctgatgagggctttacatgtttcactttcaaccttgctttgatatgggaaaaagaacttagtctttag

SEQ ID NO: 88813 - DNA, 507 bp, Glycine max
  Peptide Sequence Number=SeqID_180498
atggctccttttaatcttggtttttccaaagtagatttgacccaacttgccgacataggggaaatcgatgccaagattgggaaagtagattcatggaatatgggtgaatggctatgggaactacaatggaggagatcttggttccaatgggaacaaagtgtagtgcaacaaatgttggataccattggggaatttcagccgaaacaaaataagttggatgattgggcatggaatctaaatgtggagaagaaatacgtggtgagggagctggtgtatgagatattgattacggaagaaaccatgaaggatgaggaattttttaaacaaatgaagaaattaccaataccttcaaaggagctgaaatctgctatggaggagcacatggaccttatggcagatcttgttcagaagctctcttcagatcttcgcgctggctttcgccccgcttacgataactttatcggttttttccatgccattgactggaaggtagccctcccattttag

SEQ ID NO: 88814 - DNA, 900 bp, Glycine max
  Peptide Sequence Number=SeqID_180499
atggatacagaggagttcagtttccctagaatcagtgatacttgtgcacacaacattgattcacctcctctatggaacctgtcaccagcagcatctcctaatccctactaccaagggaacaaaagaggagaaaatgagtgttttggagcaaaactagtagcagctgaggttcacaggaagagtttttcatgtgtagaaaatagcaggaaaagatttggactagaggaggatgaagacagaatggacatgttgtgggaggatttcaatgaggagttgtattcaacaacaaccacagtgtctgctacctcttcttcaagggaattaagatatgctccagcattaactgttgcaaagaccaataatagttcactatttcccactaagaacaacaagcctagcatggtggtgattgtgagggtcatgaggaagcttttctccatcaacaattctcaaggtcattcaatagtgattttcagtcatggagttgcagcggaagataaaggagaagaggagaagtttcaccaccaagagagtgtcttggataagaagcttagagagaaagcttcaatggaggaagagaatgagagagaacaggggaagcttcctcgaatagttaatgcaggtcctctagatgtggatagtgttggagtcgtcattggagaagtcaaggcaaaagaggtagatctaggtggagtggatttcagatttggagaaagaaacatcaccaccgttggcaaggcaaactccacctttgccgcgagatacgacgttggcgaggcaaaggtgaacggagtcgtaagtcgcaacgacgcctctaacaaggagaagaagttttcgtcactatcgatggagaagaagaagaagttgttgattataaaaaaaggaaagatcggacagtga

SEQ ID NO: 88815 - DNA, 776 bp, Glycine max
  Peptide Sequence Number=SeqID_180500
atgggagagggatgttgtacgcagccttacccttgcatatgcaaagaggctgtttccggattcgaacccatgaccaacaagtcaccaaggcacaactttactgctgcaccagggctcgccctcaatggagtaccagaggacttggatttttcacaatacaccccctcacgcccaacacttcttgggcttggtgtgtggataacaatggaagctttggatcttgtttgcatgggatgtgtgttagctggtatagagcttggtgctgaaggagactcagaggaggatgtattaatggttgtggactctaaacgggtcgtatccgccgctgtccgcgtagccgtcgcaccgtcgcgccgtcgtccgccgtcgtccgccgccgaccgtcttcattctggccaccatttcaaccggcgactacagggttttgtgcgcctcgaagagcgcaacccaacccaactaatcgcctggccagaagctcctccacgcgccgcctccgtgctcaccaaacaccggcgcttgaccaccacgcgccgccttccccttgccggaatcgcacgcgtttgctgccggccgtctagtcggactctccggagtccatatcagccattagtttttggtttcggcacttcattgcgtgatctttgctttcattttccgaaactcccaccatcacagcagcaaagctcaactggaaaaattacttatcctggtctgcttcagtggaactgtgatttcttgggcaagggcatcatgaccatcttgaaaaagatgctgag

SEQ ID NO: 88816 - DNA, 1002 bp, Glycine max
  Peptide Sequence Number=SeqID_180501
atgatcggaaacttcatcgacgacattgactgcggcaacttcttcgaccacatcgacgacctcctcgaattccccgacgacgccgccgccgctgacacctccgccgccgctcctgtccctccaccggcgaacttctggtccgccgagtccgactcgctccccgccaccgacacggtgttttccgacaactccgtgacggacctctcggcggagctctctgttccgtatgaagacattatgcaattggaatggctgtccaattttgttgaggactctttctctggtgggagcatgaccatgaagaaagaggagccacaatgcaccaccaccaaggaggacatagctcctgcccagttccagacagcaagcccagtatcagtccttgaaagcagcagtttctgctctggggagaaggctggcacggagattaacatctccgtgccatgtggacgcgcgcgcagcaagcgcccgcgtcctgcaaccttcaaccccaatccagtgatgcagctcatctcccctgcatcctccactggtgagaacacgcagcacaacgctgccaacacctccaaggcatcatcggattccgagaatttcgctgagtcggtgatcaaggctcctaagcaggcctctggggagcacaagaagaaaaagaagatcaaagtgacgttcccatcaggtcaagagcggaatgcaccatcacaggcaattaggaaatgcttgcactgtgagataaccaagacaccacagtggagggcagggccaatggggccgaaaacactctgcaatgcttgtggcgtgcgctacaagtcaggccggcttttccccgaatatcgccctgcagcgagtccaacgttttgtgcggccatgcactccaactcccataagaaggtccttgaaatgaggaacaagacaggcaccaaatctggctttgcaactgtttctgctgcctcaccagaactcattccaaacactaacagcagccttacccttgaatatatgtga

SEQ ID NO: 88817 - DNA, 102 bp, Glycine max
  Peptide Sequence Number=SeqID_180502
atggtgagaatagagagggaagaacgatttgagagatccatgatgagggatgcgacagagatgagaatggagagaaaaagccaattaagaggaggcatataa

SEQ ID NO: 88818 - DNA, 549 bp, Glycine max
  Peptide Sequence Number=SeqID_180503
atggaagctgcaaagggaaccgtcaaaggtgtggctatcatcatcggagacaacaacattagaggctctcttcagtttcttcagcaccccaatgggaccacccatgtgacagggagagtgacagggttgtcccaaggctttcatgggttccatattcatgcttttggtgacaccaccaatggctgcaactccactgttttaacctcctctaccccaggtcctcacttcaatccgttcaagaaggatcatggggctccttcagatgataagcgccatgctggtgatttgggcaacattgctgcaggccctgatggagttgctgagatttctattagagatagacagattcctctaactggagttcactccataattggaagggccgttgttgtgcatgctgatcctgatgatcttggaagggtattgaaaaatcataaagaggctccactgtatatctgcattttaggtgggcatgaactcagcaagactactgggaatgctggtgcaagagtagcatgtggtatcatcgggctccagtcatctgtttag

SEQ ID NO: 88819 - DNA, 1659 bp, Glycine max
  Peptide Sequence Number=SeqID_180504
atggagaaggtaagcccatgccacaccaacactcctctcccacttcctaatcgcccttccaattttcttcaattcaagcaccaaactttcttcttcaagttcccgaacccgaacccgaacccgaacccgaacccgaacccgaacctcgttcgattgcgcaggctcaattgctcagtatcagacggcaccgttccgtcttcggttggtgccacggactcttcttctcttgcggtgaagaagaaagcagcagaggtgtcttctgagctcaaagggacctccatatttctggttggtttgaagagctcttttaaaactagtttggggaagctgctggcggatgcattgcggtattattatttcgacagtgataatttggtggaagaagctgtaggtggtgcactggctgcaaaatcattcagagagagtgatgaaaaaggcttctatgagtgtgagactgaagtactgaagcaattatcatccatgggtcgactagtggtttgtgccggaaatggcgctgttacaagctcaactaatctggcacttctgagacatgggatttcgttgtggattgatgtgcctctagattttgtagccagagatgtaattgaagaccagagtcaatttgctccatctgaactatctatttcaggatcatacccagaggatgaactaggtgctctatacgatagatacagagttggatatgccacagccgatgctattatttcagttcaaaaagtagcatctcggttgggttgtgataacttagatgaaattacaagagaagacatggctttggaggaatcatttgaaattccacgtggccaaggtcacggaggtggtggtgacattgagttaggagaatatgcaaggaattcaggagacctgggcttggatagtttcttcaagaaggttcaagagcttgataaacaatatgctaagctggataagcttttgaaaaagctccaggatgcccatgaggaatccaaagctgtgaccaaagctccttccatgaaggctataaagcagagaatggagaaagatgttgatgaagttaagaaaactgcacattacttaaagaccaaaattgaagaactggacaaagagaatttggcaaacaggcagaagcctgggtgtggaaaaggatcaggtgttgaccggtcaagaacagcgacaaccatttctttaaaaaagaaactgaaagataaaatggctgaatttcagaccctgagagaggccatccatcaagagtatcgcgaggtggttgagagacgcgtttttacagttacgggcacaagagctgatgaggagacaattgacagattaattgaaactggagatagtgaacaaattttccagaaggctattcaggaacaaggacgaggccagataatggacaccttggctgaaatacaagagcgacatgaagcagttagagatgttgagagaaaacttcttgatttacaacagatatttctggatattgcggtgttagtcgacgctcaaggagacatgcttgacaacatagaaacacaggttggttgggtggttaagaaagaaggaaaggcggaaaaggttgcgggtttcaagtgcagtggatcacgtgcagcaaggcaacaatgccctccagaaggcaaagaaactacaaaggaactctag

SEQ ID NO: 88820 - DNA, 354 bp, Glycine max
  Peptide Sequence Number=SeqID_180505
atgtggagtgggattgcgaggcagtcgctgaagaaggttgtcgatggtggtggccaaggtgtcgatggaagcggcgaggttgtgttggctgaggagggtggtcttgcagctgtggagagcagccatggaggttccgtacgacgagtagtgtgggtgatggtaggtagtcatgggagctttgtatgcttggttgctgaacttcgagggtcaacacctccaaaagaagaagaagaagagaagaagaagaaagttaaggggaggaactttgctatttcattcattcatatccccagcaagtgccattacacagatatatatatagctatgaaggggacaaggcccgacaagcactaa

SEQ ID NO: 88821 - DNA, 1134 bp, Glycine max
  Peptide Sequence Number=SeqID_180506
atgcaggttgaatgtaccatccccaaagatgatggcagcttggccacttttgttggattcaggattcaacatgataatgctagaggccccatgaaaggagggatcagataccatcctgaggttgaaccagatgaagtgaatgctttggcacaactaatgacatggaagacagctgtagcaaatataccatatggtggtgccaaaggaggaatagggtgtgaccctgcagatttaactgtgtcagagttagaaagactcactagagtttttacccagaaaattcatgatctgattggagttcagacagatgtgcctgcacctgatatgggaacaggaccacagactatggcatggattctagatgagtattccaaatttcatggccactctcctgcagtagtgactgggaaacctgtagaactcggtggatctctaggcagagatgcagctactggacgaggagtcctctttgcaacggaggctttgcttaaggagcatgggatgagtgtatccggacagcggtttatcatacagggatttggaaatgtggggtcttgggctgcccaattgatcagtgagaaaggtggaaaagttgttgcagtgagtgacataactggggccataaagaataccaatggccttgacataccaagcttgctcaaacattctagagaacacaggggagtcaaaggattccatggtggtgatgcaattgaccccaactcaatattggttgaagactgtgatgttcttgtcccagcagctcttggtggagtcatcaatagggaaaacgcaaatgagattaaggccaaatttattgttgaagcagccaatcacccaactgacccggaggctgatgagattctgaaaaagaaaggggttgtgatcctcccagatatatttgcaaattcaggaggagtcacagttagctactttgagtgggtgcagaacattcaagggttcatgtgggatgaggagaaggtgaacaacgagctaaagacatacatgactaaagggttcaaagatgtgaaggagatgtgcaaaacccataattgtgatcttcgtatgggagcattcacccttgcagttaaccgtgtggcaagggccactgtacttaggggttgggaagcttga

SEQ ID NO: 88822 - DNA, 510 bp, Glycine max
  Peptide Sequence Number=SeqID_180507
atggatgcaggacctttgagtttttccccaatcatcgagacacgatcacgttacccttttcagcaacaatttcaaaaaaagagttccaaaggaaattgtgaacaccatcagttggataggttcataccaccaaatcggtcagcaatggattttgattatgctcactacttatgtttactgagaggaacaaagcttgcagaattatttaacatgaaccggctccgaattcttgctttcaagaacaaaccatctaagccagttgacttattgcatcctcagatctccactcttatccgccaaaataaaccagccaagccacgaagagttattcctcagactttggatgctccagaacttgtggatgactattatctcaatttatggggaagcaacaattgttcttgcattgcacttggaagcataatgtatttttgggatgcaaaaaatcattctacttcggaacttgttacaattgatgatgaagatgaccctgtcacattcgttagttag

SEQ ID NO: 88823 - DNA, 894 bp, Glycine max
  Peptide Sequence Number=SeqID_180508
atgtttgccgaaatatatcagtttcttcaagtgagtgtcagcaagagcttcccacccttgatgaccttttctgtcatcagaacacgtgtttatatgctgccttgtgtgtggattgttccaactaaatttggcaccaaaaaatgtgagcaggaagtggattttggcatggaatggttatcagtgtttgtggaagactgtttctctagtaggccaagttgcctcttgccaccctctggtggtggtgttcaaaccacaagcactagcaccaagccttcttcaggcacaataatgccaagaccccaacaaagtcatcactgtcctttgcagaattttgctgtgccagggaaagcaaggagcaagagaaagagactttcagcccctagaacaacaaaacacaccctaagcacatggtcacaacatttcagctcacagaatgatggggtgagttctgaccctcctctcttgaaacaagcatattggttggctgatagtgaactcatagtccccaagaagaaggatgttgagcaagaagagggggttgttgtggtggtgaagaaggagaaattgggggattattatgatgatgatgagggtgatgaagttaacaacaataataccaacaataataataatgataatgtgcagcacccaattccaagaaggtgcacacattgtctagctcagaggaccccacagtggagggcaggaccattgggtccaaagacactatgcaatgcatgtggggtgaggtacaagtctggaaggttgttgccagagtataggccagccaagagccctacttttgtaagctatttgcattccaattcacacaagaaagtcatggagatgagaatgggtgttggtgttgctgttctttctacagacaagaagtag

SEQ ID NO: 88824 - DNA, 1317 bp, Glycine max
  Peptide Sequence Number=SeqID_180509
atggaaggacaatcaagagatacaatgaatgaacaacaatgtttggagacaaaattaaccaacatgcttcaaaatgtgaaacctccagaaatgtatggattcgatatgcaatgcatttatagagtaccaccagacattcgtgaaactaatcccaaagcctacacacctcgaattgtttcaattggccattttcacaaagcatgttacgctggaaatgaagacagcatttttgagtcaatggaagagcttaaagtgaactatctcaaggcatttctaaatcgaacccaagtacctgtgggaacctttgttgtcacacttcatgcgttggaagacaaaatccgaagttgttatgcagtgcgtattaaatataacagcgatgatttcttaaagatgattctaattgatgcttgcttcataattgagctttttttgagactctatagatacaactattggcggggaaaggaccctgtgttgctaaaagactggatgcgaatgcaaattaggagcgacttgatactactagaaaatcagcttcctttctttgttcttgaacaactgtacaacctcgctggtatgaatcaggaatttccctcctttcttcagatttctttcaactgtttgaagcatgagagatatggaacaacatcgtgtccaacagagtccccaaagcacttcaccgatcttatgagaactagtataatatcgtcatcaaagtttgttcttagagaagaagaagaatgcaaaggaataaaacatgtatacagtgcaagccaactacgggaggcaggtcttaaattcaaggtcagtctaaatgaaaatgaatgcttacttgacttgacctattctagtgagggtgttttgacaatgccaatcttgaatataactgagaattcagaaatgttcttcaggaatatattggcatttgaggaatgtcacctttcagatgatacaaacatcattactcaatacctagtgattctagattttgttatcaacactgaaaaagatgtgaatgtactagttgataacaaaattattgtcaattggatgggtgatgctaataaagtggctacaatggttaacaatctggactcaaatcttgcaatgccagacttcaattcacactactactctctctgcaatagcttaaatgaattctatgaaaatcctcgcaacaagtacaaggctaggttcagactcttcataaacgagtacttcgacgctccttggacaatagcatctacagttgctgcagttgtgcttcttttgctcacagtgattcagactatatgttcaataatctcactgttttaa

SEQ ID NO: 88825 - DNA, 1086 bp, Glycine max
  Peptide Sequence Number=SeqID_180510
atggctagtgctataaaagctgccattggagatttggtgttgacttttctgtgggtcttcttctcttccatgttgggattggtcaccaacgccataacaacagcgcttgatcttcatcacgtgtcttacaacggttttgattacccttctgctgtgatcatcacttcgctcatctttatcctcgttaccatcttcacgttcgttggcaatgccttgggtggcgccagcttcaaccccaccggcaatgcttcctcatacgctgtcgggctcggctccgacaccctcttctctatggctctacggttccctgctcaggtttttgtggactgtggtcatttgcgaccacgttggccgcatttgtctgttgctgtgcggtttctagccatgacactgcaagaaaaggatattgtggataaaggaggtgaatgcggtaacaattgtggtcgcattgccaaagacctcaaaaaccttgacattactactgaaattgcatggactgcactgggttcagtgggtggtgttctggctgttatggaggttatgccaccaaaatacaggcacttgattggagggccttctttgaaggttagcttgcataccggagctattgcagagggggtgctgacgtttgtaatcacctttgttgttctacttatcatgatcaggggtcctcgtagtgaggccgtgaagactttgttgatggcaatctcaactgtggttttgatcactgctggttctgcttacacgggaccagcaatgaatcctgcctttagtgcttatgcacagaatccacaacagaccgctgaatctttgatttccctattggacaaagcagagagtgttgttcctcgggagtttcggccaaagacaccagttggagttggggttcgggatttgcttaagcaaagaagcactctaaaatctgagcttgatgcagtaacagtgctggatggaacacaagaaggtgcttttcaatgggtgactattccttatctactgggaaaattgggaaaagatttttcagagactgttggggtagttgatcttggaggtggatctgttcagatggcatatgccatctcatag

SEQ ID NO: 88826 - DNA, 441 bp, Glycine max
  Peptide Sequence Number=SeqID_180511
atgttgagactgttggatgcacactgtcaccttcaggacccgagaatcttaagcaaggcaccccatctcatcaaaaccgcgcaagacaccggcgtcgcgtacttcgccgttaacggagtttccgaacaagactggcactccgttaagcagttggccgaaacatacccttccgtcattccttgcttcggtctccatccttggtttgttaaggaacggagtcccaattggtttcaaacgttgaaggaatattttgattccacaccctctgctgcagttggagagattggtgtggacaaaggatcacacggaaagaagattgatttttctgagcagaaaatgtataaaatgcaatgtgatccgcataggcagatttgcatatttgcagtaacttccaggaaagctgagtgtatgtgcccttttccttttcttccccatgactaa

SEQ ID NO: 88827 - DNA, 1850 bp, Glycine max
  Peptide Sequence Number=SeqID_180512
gagagtgacagacagagatagaaggaaggagagatggagcgaaacagacacggcgaagacgagtgtgaagcaggatcgaaaggacactagcccaaacagaagaactccaaatggttcctcttcaaggagatggaggagtatggatcgaagggaaaaaccatatggagggcaacgagtcaacattttcggaagggataatgattacgctgacgaagataactggactaaggtggtaagcaaaagatcaatgaaggttatgcagaaatcctctttagcgggaagacaatcacaaaatctggagataggggacagcactaaacattattgcctcaactggaggaacaatgccgacattacttccttttatttcacccattttcccgacgaagctaacgaagagttgctatggaggcacttcaaaaagtggggtgacgtacgagaagtatacattgctaaaaggctcaacaaggatggcaggagatacgggttcgtgcggttcaagggagtctcggatgcaaaaggactggaggtgagattggacaacatcttcatcaacgactgtaaactattcgtcaaccttcctaggtttgagagaccagctcggaatgcagagttgcagaaaaagagccctattgggaggaagtacactaacgaagccagtaagccctgcggggtaactaccggtcctcatcggagatcatacgtggatgtgatgactaaggggggttgcaaaggagacaaaaggacaaacgaggcactaacaccaactattctgatcaacccagatgaagaggactgcatcgcttgggagttaggatataatatccactctaagttcctcggagatgacatggttcttctctctgggatgtccgacgacaaagttcaactcctcattcaatcggagatggaaagtggaaactctctcttttactcactggagaagtggacgccgaaatgcagacccaataacagggttgtttggctccaggtttggggatttccgatagaggtgtgggaaatgaaaaatctcaggagagctgtagctgctatcggggatgtcatcgagccagacgacgacacagaggaccgccgtagactggaccgggctcgattattggtgcggacaccgcttccgccgttgataaggacggaggtcatcgttcgtgtggggaagcttgagtatcgggtttggattgtggaagagtcagggttcgaaggtgggtcgaaccggaaaggaagctcgccgtccgatggttggtcggaggtgataacgtcggacgacggaggggacgtcggcgatgttcttgacgatactgacaccaatttctccttctcgccggagctgtgcaaccggaaactgtcttcgtccggtacccaacgggcagaagaagggactgacgggtgctgttatgaccttagacctctgggtaatacccaggtagacgttacacccaaagaaaagtcaaaaggcatcgaagaaggtatgctgggctcttgctttggtaagctcgacctaggggacagcttcgcaggaacagaaaaggaagctgctaacactaaagaggtaacctgctataacaccctacaggatgatcgaaggcagaggaatcacatagagggatattattcgaatggtggagcaaaagtagctgttgaccagacctttatcggggaagaagagggacacgtcacgcaatctctctctccttcaatatcggggcagatccaacaaggacttgggccaggctgcattacgggcccaatttcgactcaaggagggtgtaataaggaagacatcctccctgtagagcttttgggggtgcaagttgtgcagattcaaaaagagg

SEQ ID NO: 88828 - DNA, 528 bp, Glycine max
  Peptide Sequence Number=SeqID_180513
atgccaaacttacgtagatattctcttgaagagctgaatcgcaggatatttcactgtctccatgaagcaagcattgtcgatggaagttccgatgttgtcgaagatttgctcgcagagcttcttctcgcttgcgaagagaattctaacgcagaccttggcggcttttatccagtgtctgattttgttctcaaactgctcccactcgaggcgttgaacgtctccgatgctgagctttttgatgtggagcttgtggaagctcgcgtccatggaggattttcacacgctgtcgtatacctggatgcactcgcggaggtagccgaaggagagcatgcgctcggcaatgcaacggaggtcatagatggcgttggaggggatcagattgatctcacgaatgttgctggtggaacggtaactactgttgttaacagagttgacggagcatctgccaagacatgggatgcattaccgagggaagaaccagaagttgatgaagttgttgtttgggcaagaagctcttcagtgagagaa

SEQ ID NO: 88829 - DNA, 912 bp, Glycine max
  Peptide Sequence Number=SeqID_180514
atgcatgtgacatccttcaagtgtggtggttttgcaattggcatctctactagccacaccacctttgatggcctcagcttcaaaaccttcctagacaacattgcttcaatagctgctaagaagcccttggctgtcacgccctgccatgacaggcacctcctagccgctcgatccccaccacgtgtcaccttcccacatcctgagatgctcaagctaagtgaccagctcccaacatgccccgagtccaacatctttgaggcctccaccgaacaacttgatttcaaggtcttcaaactaacatcaaacgacatcacaaaattgaaggaagaggctaggaattcttcaattagtggtggcctaagtactaaatgtgtcactggctttaacgttatcactgcctacatatggagatgcaaggcactttcgtgctacaatgatgagaaccctaataggtcatcaactatactatatgctgtagatatacgttcaagattgaaccctccattgcctaaatcatacgcgggtaacgcagtgttaactgcttatgccacggcaaagtgtaaggagctagaagaatggccttttatgaagctagttgaaatggtgcgtgagggagcaactaggatgacaaatgagtatgcaagatctatcatagattggggagagataaacaatgggtttcccaatggggaggttttggtgtcttcatggtggagattagggtttgaggaagtggagtatccgtgggggaagccaaagtattgttgcccagtggtgtatcataagaaggatattattttgttgtttcctccggttggtggaggtgaaggggtgagtattattgtggctcttcctcctaaggaaatggaaaaattccatgggctcttcaacaagttcttgacttcacattga

SEQ ID NO: 88830 - DNA, 1233 bp, Glycine max
  Peptide Sequence Number=SeqID_180515
atggtatttgttgtatcggtcttgagggttcaatttcctggcaagcatagcagatctgggttcttcaaggagtattgctgtcctgacacttggtgtgtagaagaagggctatcttcctttctaccttgccacatcatttcattcatgggggagtggattgttggagctttcatcaacctctttggtagtattgcaataaactttgggaccaatcttctcaaattagggcataatgagagagaaagacatttacttggaagtgatggggtaaatggaaagatgaatctgaagcctattatatacttccaaagttggagaattggcattgtatttttctttcttggaaattgccttaatttcatttcctttgggtatgctgctcagtcacttcttgcagcactaggatctgttcagtttgtatctaacattgccttcgcttactttgtcttgaacaaaatggtgacagtaaaggtactggttgcaacagctttcattgttcttgggaatgtttttctagtcgcttttggcaatcaccaatcacctgtttatacgccagagcagttgacagagaaatataccaatattgcattccttctataccttctagctttgatctctattgttgccttgcatcactccatctacaagcggggagaacttctgtttgcagtatcaggacatgacctcagaccctattggagcatgctactgcccttttcatatgctgtagtttcgggggctgtaggttcatgctcagtcttgtttgctaaatcgctttctaacctattacgactggctatgtccaatggttatcagttgcacagctggttcacatattccatgcttcttttatttcttagtactgctggattttggatgaccaggttgaatgaaggactgtcattgtttgatgcaattcttattgttcccatgtttcagataacatggactttcttctcaatctgtacaggatttatctattttcaagaatatcagcataaacaagcaaagaggacatttcagtttaagttcagcaacttcaaatcagaaacactgaaaaatagatgccagggagccagatacagaagagaattagagaacagagaacccagcagtcagcaaaagacagatgtaaaagagaaccacccagcaaactcagcaaacataagtgcagaagagaagaggaacaatgaaggagaagaagatagcatgcagcagtggtttcagctttag

SEQ ID NO: 88831 - DNA, 456 bp, Glycine max
  Peptide Sequence Number=SeqID_180516
atggctactccatcaaggtccaatagtggatctgcgagaaacccagttccgagttggcgactcagcaccgatggacgagtggggttatgcgtcctctccgccgcggccggtggcgatcgagggcggcgagggagacacggcgctggcgaagtcgcgcgtgctgacgcgggaggaggtgctccggcggcggctgcggcgaacgaggcagctggggcggtgctaccgggcccactactgggccctgatggaggagatgaggaagatcacaatgacaacagcgacaacaacaacaaccaaaacggcgtcgtttctggtggtggtgacgacatcgtgcagtgtcgttataacggatgcaagacgaaggccatggctttgacgaattactgtcacactcatatattgagcgattccaagcagaagctttaccagggatgcaaagccgttgccaaaaagtga

SEQ ID NO: 88832 - DNA, 240 bp, Glycine max
  Peptide Sequence Number=SeqID_180517
atgacgttcaacaccataatgaggatggtgtcggggaagaggtaccatggtgaggattgtgatgtggagttagcaaggcaatttagagagatcattaacgagttggtgactttaggaggggccaataacaccctggggatttcttggctttgcttaggttgtttgatttttatgactatgttacttgcggaaactgatacatcagctgtaactttagaatgggaatgtctaatttattaa

SEQ ID NO: 88833 - DNA, 339 bp, Glycine max
  Peptide Sequence Number=SeqID_180518
atggagaaggcaagacacgtggcggatttcactattagtaatgagaacctcaagcgtgatgatgcggcggagattgcgccagtggtcgccgtagggcgaaaacgccatgctggtgttgtcattgccgatgtactttcctgcaagaaagcgaggccggttcgcccagacgatgtcgtgaagcattcttgcactccggcgaaagacgaaacgacgaggacgatacgagaaccgaaccagagggagaagacttggccatactttttgggacatgccatgcaaggtttggtggaggggttgtttgagttggtggaggtttcagattatggtggagattcttga

SEQ ID NO: 88834 - DNA, 1411 bp, Glycine max
  Peptide Sequence Number=SeqID_180519
tcaaaacaccaacccaccaattaatccttccttcaagcattatctcacaatgtcttcaaacctcaccattgaacaaaggctcgaacagctgcaaaaggcaaaggaaagagcacaaccccaaccacccaaaggggccaaaatccaacgggtagcacatcatctccgagaccgaaagcatttcaccaagcattacgagccgaaactgatgtcattgggtcccatccatcacggtgctgaaaaactgcagctgggagagcagtgtaagcaaaggtgggcagcaacgtacatcgaaagcactggaaaaaccccacaaactctacacaaaagggttgtggacgattttgaaaaccagaagaagttgtttgacgatgaccttttattagcatcgacccaacaggagaagagaaatcttttgggtcctattcgtcacaaatgcaccttgctcgaaactcaagcgccatggaaagtcatgtctacaaaattccacagtaaaaagtctccgtcactcatcgaacaaacaaatgacattaacgtatcagaagcaaggcttcacaaccatggaagaaaagattcagtggatgctgttcgtggacgcgtgtgccctgctgcaaattctggaacatgcaaatcttcacgcaccggagaaaatgaaaatcaaggtcgatcaactggttctggtgatgggggacgtgctcttgttagagaaccagcttcctttctctttgctgaaactgttgtggaaaaacgacgagagcgagttgatgaaaacaatgaaaaagtttcttcgcgctctatcatcctctatgatcctaacaagagaaaacagactcaaaataatgataatcaaaatcaagacactaacaaggggaatgaggctcaaaatgatccaaacataaacatggccaacatgggaaatccgactccaaatgaaaaccctgagttaaaagaagcagggattgtattgaagtcaagcaagacacgtaggccaagagatgtatcattctcctatggttggatccgttcggagttaaagcttcctgagattgttgtagatgacacaacagctgctactgtgctaaacctaatagcatatgagatgtgtcctgattttgagaacgactatgggatttgctcttatgtgtccttcttggactcactcatagaccacccagatgacgtgaaggcattgagatcagaacagattttgctcaattcattagggagtgatgaggaagtggccaacctcttcaataccataagcactgacttggttcctgatatggtgaaatatgctgatgttagaaatgaaattgagaagcattacagtgataagagtaggacttggctggctctagggtatcatacctatttcagcaacccttgggctatcattgcattccatgctgcagtt

SEQ ID NO: 88835 - DNA, 1492 bp, Glycine max
  Peptide Sequence Number=SeqID_180520
cttactccctaatcaacaagcagctgatgaggagatgtcatgctacaaaaatggtctctcaccagaggctgcggaatcatcttcattgaagaggtttttggagaatcatagaagtttaaaaacagccctgctggttgtggtgttgctaggtgcttgcatggtcataggtgatgaacctatactttggccagtttttgttattgccacccttgcagctattgttggaagtcaagctgttattactgccactttctccatcatcaagcagtgccatgtacttggttgctttccacgagtcaaaatcgtacacacctcaaagcatatgtttggacaaatctacatcccagaaatcaactggatacttatgatcttgacccttgctgtaaccattggatttcgggacacaaccttaattggaaatgcttatggccttgcttgtatgacggttatgtttgtgactacatttctgatggcactagtcataatgtttgtctggcagaaaaacattctgattgccacaatattccttctgtttttttgggtgatagagggtttatatctatctgcagcattgataaaagtgtttcaaggaggatgggttcctcttgtcttatctttcatcttcatgcttgttatgcatgtatggcattatggcacttgtaccaagtacaactacgatctaagcaacaaagtttcattgaaatggttactggctttgggccctagccttggtgttgcccgtgtccccgggattggtctcatctacacagaacttgcaacaggaatacctgcaatattttcccactttgtaaccaacctccctgcatttcacatggtgttggtctttgtttgtgtgaaaacagttcctgttccacatgtattaaccaaagaacgtttcctaatcgggcgagtttgtccgagaccatatcgaatgtataggtgcactgtcagatatggatacaaggacattagaagggatgatagagactttgacaaccatatcatacgatgtatagccgagtttatccaaatagaggcgcaggaattacaactctcgatttctgaaacttcttcattcgatggagggacaactattataagtgttagaagcttcgaatcagtttcaagttggacagtgtctgagaatgaagatgttggtgtggacaacaacattgctagtggtagatctttctctcgacaaccatcgatttccacttatgacaaagaaaacccacattcaagaaggcgccacgttagtttcctggtacctgatgatcctgcattggatcatgaagttaagcaggagcttcttgatttagctcaagctatggaggctggggttgcatatataatggggcacacacatgtgaaggcaaggaaatcatcctcattattgaaaaggcttgtgatcaatgttgggtatgcatttcttcgaacgaattgcaggggtccagctacggctcttaacattcctcacatcagtctcattgaa

SEQ ID NO: 88836 - DNA, 288 bp, Glycine max
  Peptide Sequence Number=SeqID_180521
atggctttggttcagagtttatggcctttgcatctaagttctaggctgagaaagccttctctgagccttgttggtgaagtgttccacgtgaccgatgaagctggcaagaagctcacagacgaaaccctcatgctccacatccaacaggatgtcaagtgccagggttgcttcaacatccactctcagacagtagtagtatgtggtaactgccagactgtgttgtgccaaccgactggtggacgagcgaggttaaccgaagggtgctcttttaggaaaaagggagattga

SEQ ID NO: 88837 - DNA, 4341 bp, Glycine max
  Peptide Sequence Number=SeqID_180522
atggctgctgatcagaggagaaaacgagtaaatggtgcaaacattgctggttatggttctagagagcaacacaggatcaaaagaaagaatttgggattagttcaaaatgatttgaacatgagacctcacatctctgttgagtgggatgataatcacaaaaaggttgttgctaagcgggaacaaattggcatcagttggagacaaatgaagccatttatcaattcggtttctaatgatcacaaaatcttggcagatgtgttttcagtgcctcaagaaatttttgacttggataatttaagtgaagttctttcgtttgagtgcctaggtgactggacagtcatgggtttgaatccggaaatgacctttttgcatatgcaagggggtgcttcgctttgtttaggtggtcttcatccagatatgattgttgatcaggaacagcatcttaagactgagaggagagaataccactcacacatacataattatcacaacgatatgataggatttctatctaagttgaagaagagctggcaaagctgtaaagatccagaaaaggagattgcgcaaaagatatggaggtcaaaacatgtagagaaaagaatgccctcaaaagtgattgaatctagagtctatgatcatgatgggaatgttacagggacatctgattcatgctcctgggatgcagaggagaaagcatgtagtagcgacaaccaaatttcctcactgagaaaagacaataaacttcaaagaagggtgcttgaaaagggcatttttaaaggtaaatcccaaaatttgatggattctttggacaacatgcctaatgtggcagaaaagccgaagacaggagacaaactgcctaagcgtagcattcattctagtgatagtgataaatacatgtcatgtatcaagattagtaggcagcagcatgagcttgttaagaatatgaagcagtctggtaaaagcatccaatctaggtcccttaaccgggttttgggtaaccttgaaaaaattcatgtgcaaccatacaatatatttgtcaaagaagaacagaagaagttgcaggagcattggttgctattagtaaacaaagacctccctgtggcttatgtaaattggacagagagacagatacagagacatgccgtgagaaattctttggtggcagagatgaaggataaatcaattcctctcatagagggagtgaacacagggagtgaacttaaggatcaggttgatgtgaactcagggagtgaacttaaggatcatgatgatgtgaactcggggagtgaacttcaggatcatgatgaggaggtgaactcagggagtgaacttcaggatcaggatgaggacaatattagctcaggggacaagctgaaggatcagaatgaggataacatgagttcagaaggtgagcttcaggatcagaatgatgataatctgagctcagggagcgaacttcaggatcagggtgaggataatgtcaactcgggtgatgagcttcaggatcaggtgaaggatggaggtctgagtgatcagtctgatttgaaagatgatgatgattctatttctaggtcccccgagaaccagtcccagcacaattctgatgttagtggtgataatgagttcaaccaaatgagtgtggattcagaaaagaatattcttttatcaaaatcaacaaataatacttcgtcgggtagtggtgatcatgaattcaaccaaatgagtgtggattcagaaaagaatcttttatcaaaatcaaataatacttcatcgaataaagatgagtattcagtgcatatgaacactcaggatgtttctattgatgaaggagcacctttcacttccagtggtgatgtctggcaaggagttgaaatgccacattcatactatgattctgctgtgacccacgagtacgcagccagtgggttatcactggctaatcctcaagtcagtcaagagcagccaactcgtatgattgatcttgaagctgatttgcgtcgagaagagacaggcaaagagttgttaagtaggcaattagataatggaaccttcagttcataccaaagccaggatcgaagtgtcttacttcaatcactcttcaaaggagagggattgttaccttatcatcatgatcagaaagaagctgagttagatttccaaacttcaaacaatgttatgatggggggtggccaattttccagtcatttcaaggagccattgcaaacgtcgctgacattggaccaggggcgaaggagagctactgaggtttacatgccagaaaacatgtcagagaatatttattcggatgaaggaaggtatttaatccccagacaagatccattgatccccaggcaagatccattgatccccacgcaagatccattgatccccaggcaagatcctttgatccccaggcaagatccattggtccccaggcaagatcctttggctgcagtaaatatgactgattgggctgctaataatgctcgcatagcagggccttcccaatctcacttaaatactggagattttattggtcatcattggtttcctgctgatcatcaagttcgtggtggtggctggaatggatctgatggtggtggtctttcaaatcaaagtcttggccctggagcaagctctgatcagagtttatttagtattctgtcagagtgtgaccaattgcattcaggtagcctttatgattcagttagaaatactgaccagtttcttgcacccagaacttatggattagtagatgcaggtacaccaagggtgaacacggttgcaccaccggcttctcgtccattagattacttcactggacgtgaagcacctagtggcctggtgcctgatgatatggcatggatgagcttgccacgtcagaattcttcaatacatgaccaaatgggaaagccatacttaaggtcatggaaccggaagcatcttatgcctagtttgcgaagcatgaatcttattccattatgtgttgccaagaaacactttgtttggtctttcacagatcctttagaacaaatgggcaacgagaagaagaaggaagtgattcggatagagcgtgaatcggttattccagttttgaagcctcagctcatcatggcattggccaaccttattaaacatagtgctgaccgagttgaatttttgaagctctgcaagagaatagagtataccattcgagcttggtaccttctacagtttgaggacatgatgcaactctattctctctttgatcctgtgtccggggctcagaagttggaacagcagaagttacctcgtgaagaaattgatgttcttgagcaaaatttcttgacttacctatttgaggtcatgaaaaaaagcaacttcaagattgcaactcaagaagagattgatattgcactttctggacagtatattctaaatcttccaattacagtaaatgaatctaagcttgacaaggttcttttgaaaaactattttgaagcacatcctcacgataaccttccagattcttatgataagaaaactttaacccatggtgcttgtaggttggaaaagtttttatccagaagggcaaaaaggcgtcgtaggaaggatcccaagaatgatgatgaaattaacttggagttggaagattttcaggatgatctcaatgttccatctagaaatccaactgctcattcgtctgataaatgcatgctgttttatctcaccaaaactgctgatctcatgcataccacaatccaagaacctacatttgataggattattgttgtgtacaggccagctagctccaattcaaaaaaagaaagaggaatttttgtgaagcatttcaagaacattccaatggctgatatggaaatagttcttccagaaaagaaaaatcctggattgactccaaaggattgggtcaagtttcttgcatctgcaatggttgggctggttgctgtagctagttctcttcatgtggattcagctgatttgagggtcattggtgccgttctctctacagtacttggatatttggccaagacatacttcacgtcaatgtatgacaaacaactggacagtggaaagggtacacttctccatttatgtgatgatgtcattcaacaggaagaactcgatcaatggtgcgaggagctaatcagagaagagtttggagagagctgtaattttgacgtggatgatgcagttaagaaattagagaagttcggaattgtcaccaaggatatcattggccggtatcaatgcgttgggctgaaaagggctaacgagataataggcaccaccactgaagaacttgtccttaaggcaagacaggggggaagcaccactccttga

SEQ ID NO: 88838 - DNA, 1335 bp, Glycine max
  Peptide Sequence Number=SeqID_180523
atgcttccaacgagagctctcactcacactctcggcgttccctggacggagcccgaaaacgacgccgttacaggggacgccgctctcttagcgtcgttcaagtcaatgctggaccgtgactggtacatggaccaacctcactgtgattttctccaaaacgacgctgcgtttttggagcaccctttgggttcgtcttcttcttcttcttcttcttctctgcctcagcagcaacacttcgtggtgccgccaaaaccgtgctacttcaacgtgaacgggaatggtcctttggaatgtggcttcgagttggggtctcagagcagtttcctcgccccgtttcccgtgaacgcgctcgagctcagtctggaccccgagttcccggcgagcaaacccggtggtgggttgattcgccgggaagagaagcagcggcctctcgacgcacttgctccatccactctgtatcagaagcggacggagcggtggcgagaggccgggaaggcggaggaattggcgatgccgccaccgccgccaccgcagttggcgatggagaagaggaggaagaggggtgaggagggggaggatgagggagggttgaattatgagtctggtgaggatatgaagttggaggagaatggtgttgatgcaaataacaatgataatgataatgatgatgatgatgatgatggtgatggtgataatgggaatgggaatggtggtggtggtggtggagaccagaaggggaagaagaagaagaggaagaagatgccggcgaagaatctcatggcggagaggaggcggaggaagaagctcaatgataagttgtacatgttaaggtctgttgtgcctaatattagcaagatggatagggcctcaatactaggggatgccattgactacttaagggagttacaagtgcgaattactgatcttaatcatgaactagagtcaggcccgcctggctcatcccttccacctgctgcaagctttcaccctgtgacacccactctgcctacccttccctgccgggtgaaggaagaaatatgtcctatctctctgccaagtcctaaaaaccaatcagcaaaggtggaggttacggtaagggaagggggagctgtcaatatccatatgttttgtgcccacagaccaggtcttttactttctaccatgagggcaatggatagccttggattggatgttcagcaggccgtaatcagttgtttcaatggtttttctttagatgtgtttagagctgagcaatgccgagaaggccaggatgtccttccagagcaaattaaagaagtattgttggacacagcaggtttccatggaatgatgtga

SEQ ID NO: 88839 - DNA, 1839 bp, Glycine max
  Peptide Sequence Number=SeqID_180524
atggctatgagaccatcctcatcttcatttagttacagattcacctatgacatgttccttagcttccgaggggaagatactcgttgtggtttcagtggcaatctctacaatgcccttcaggacaggggaattcacaccttcgtcgactacaaggagctccaaagagggcatgaaatcacatcagcacttgagaagggaattgaaattcttcggatgtgcgacaccacagaggtagtttttggagaggcattggctaatcatgaaaagaagttcaatgcaaataagatgggtttcaaacataacatggagaagacagaggcatggaagatggctctgcatcaagtggctaacttgtctggctaccatttcaatgggatagttgacttgatttcaagcaagattaatcatgctcatttacatgttgcggactacccagttagactagagtctcaagtgctaaatgttatgtcacttttggatgttggatctgatgatgttgcccacatggtggggatccatggacttggtggagtggatgatgtcaacaaacgagaacagttacaagcgattgttggaagacctgattggttgggtcctggcagtagagtcaccatcacgactcaggacaaacagttgctagcatgtcacggtgttaaaagaacttatgaggtggaattgttgaacgatgaagatgctcttcgcaataacttatgcttagggccttccattggctttagaagtaataggttccaacttatttggaggaagtatggaacaataggagtttgctttaaatcgatgagcaaagagttttttctcgacattgcctgctgcttcaaagaatatgaattgggagaggttgaagatatacttcatgcacatcatggccaatgcatgaaacatcacattggagtgttggttgaaaaatctctcataaagattggtttgggtggtaaggtaacactacataacttgattgaggacatgggaaaagaaattgtccaaaaagaatcaccaaaagagcctggaaaacgtagcagattatggttccctgaagatatagttcaaggaactcgtcatattgaaatcatgtttatggattttcccttatgtgaagaagtagaggtagaatgggatggggatgccttcaagaggatgaaaaatctcaaaacacttattattagaaatggtctgttttccgaaggtcccaaacatcttcctaatactttagagtattggaatggtggagatatccttcacagtagcactgaggaagggtggctattgcctaaaaagggtgcagaaaaagttagctcaactgtgtcttcaaacattcaaaagcttgctctccaatactgcaagttgtcagatgagtttttttggatagttctcccatggtttgttaatgtgaaggaattagatatacgtgggaataattttacagttattcctgaatgcatcaaagaatgcttctttttaactagtctttatttgcatcactgcaagcttcttcaagaaattagagggattcctccaaacttgaaatatttctctgcaaagaattgcctatccttgacttcctcatgtagaagcaagttactgaatctggaactgcatgaggctggaaacaccaactttcatttgccaggagaaaagattccagagtggtttgagtaccaggccgggccgggggtccatcaatttctttctggatcagtcgagtattcgccacccgaagatgaagatgagtattccctgcttgaagacgaagatgagtatcccttgatagaagatgaagatgaagacgaagatgagtattccctgctagaaggaagatga

SEQ ID NO: 88840 - DNA, 174 bp, Glycine max
  Peptide Sequence Number=SeqID_180525
atggaaagtgttgaagggatgtgttatgttgtatttgttgggttgggttgggttggaggaaccaatgaaaaggggaccgtacaatgtgatggaatggaaggaagaaagaaagagggaaaggtccacctggcggctaaaccagggttccctccctcggtctttttttttaaataa

SEQ ID NO: 88841 - DNA, 534 bp, Glycine max
  Peptide Sequence Number=SeqID_180526
atggagaataaccttatcgagaattctggtagacttgcgactctacaacacaatgcagatgctaacaacaaagaagtcaccacattggatatgcctaatttcatccccattttcttgcaactagtagaagagaaaatagtgaagtacgaaacaaatgaggctcagtctcatcaagaggaagatcaagaggaaaacaaggtcaagggaaaaacgaacttgatcatcaacgacataagtgcgattcagcaagaggaaacggttacaaaatggagcaaaatagctaaagaaatgattgtagaagatgtagtaggagccactagagcgcgagatccccacgaggaaggaatgcacctccgtgtggctccccggagagcagagtcgagacaacattacggcgagcctcttcggcaacctctcgcgtgggatcgtgtacgagaccctgagggatgtgattctgaacatggagagccttttccccgccaaccatggggaaatcaagcacgagatgatttcggtcaagtgccgcctccgtga

SEQ ID NO: 88842 - DNA, 1017 bp, Glycine max
  Peptide Sequence Number=SeqID_180527
atggaagcaacctatcatatggtaaggtttcaaggaacagtagattctgtggcggcacagtttttcttaaagaatatgcactctcagatgaggactgctgctctcaatttgtttggtgacccacaagttctaggtttacggccgaatgtttttggggagctcatgagggttctcatatccccttcagaagatgttgaggcagctgtcaattgggttattggtggtggggagaatcctgacatctcattgcatatgcgaatgcttatgcataggtctggaagagctgtgcaggcagtgttgcattgcctgaacaaagccatgcgcagtcaacatctaatgtcatcaagaccaaaggtggttgtggtgtcagatacacctgctgttgttaaaagtatcatgtatatgtctaacctaagtgaatttgtagaggttcttcattttgattatgacaaatacagaggaagtatgtttaaaggtttgcacatcacagattctagaaggagggattggggtacagcgcctagatgggttgcttttgtggatttttttcttgcttctcgcgcaaaatatgccaccatttctggagctcaccggcgtgtcgggactacatatgctcaattagtcgctgcactgtctgcagcttacaatctgggtatttctgctattcactctgcttattctagggacatgtctggttcaaggtttatattccttagcagtttccagagtaatttgttgactgatggcctaaagaatcagcgtggttggggccatgtgtggaacagatatgctggtccattgagttgtcgcaagcagggcaatcaatgtgccttcacaccagttctcccttctgcttggtgggacggtctttggcagtctccaattcctagggatattaatcgtctggcttcctatggcatcaaattatctgctcttggcactgttgataaagattcccttaaaaatcactgtaagaaaaagaaaaatgttgtacgaaccattacattcaaattatag

SEQ ID NO: 88843 - DNA, 435 bp, Glycine max
  Peptide Sequence Number=SeqID_180528
atgtatattgcagatcctgagaggttcaggcttgcaaaggacacaacatttggacaaaggcacttgaatacgtggagtcagtcatcaatttccttatggatagttagcttcttcagacaattctctggatctgttaagaaagttgactatttcgcattgcgacatggatttatcacggcacatctggctccgggaagtgatgcaagatttgatttccagaagtacattaaaagatcacttgacgaggattttaaagttgtagttggcataagcccgatcatatggttcttcgcggtgctcttcttgctggctaatactcatggcaatcttattagtgggtgccaagctacaaatgatcataacaaagatgggactgaggattcaggacagaggggaagtactcaagggtgcaccagtggtggagccaggagatga

SEQ ID NO: 88844 - DNA, 369 bp, Glycine max
  Peptide Sequence Number=SeqID_180529
atgtctgatgacaagctcgagatgaagcagttgagcagaaagggaggaaggagaccaatgattcgattggccaaagcctcaaactcctcgaagaatggggtgatcttgaagatccatccaagtggatctgaaccatcaaaccgaggcacttcgagctttatacgatacagggttgatgatgggagcaaaaaagtggggttggtcgatgaggaagaaggtgagggttggttggttttgagggaggacattttctgtatgaggtggtcgagcttagcggacatggtgatttggttggcggcaaaggttggaagttacatggaagttactaaaacttccatcaacggttggaagttacatggaagttactaa

SEQ ID NO: 88845 - DNA, 711 bp, Glycine max
  Peptide Sequence Number=SeqID_180530
atgccgtcgtcgaattccggcgagagccgccgagcgagcaagccgcatcgatcggtggcggcgccgccggtcgagccagagaacctcccctgcccgcggtgcgactccgccaacaccaagttctgctactacaacaactacaactactcccagccgcgccacttctgcaagtcctgccgccgctactggacccacggcggcaccctccgcgacatccccgtcggcggaggcagccgcaagaacgccaagcgctcccgcacccaccacgccgccgccgccacatcgtcgtcctcctccacctcctccgccacgacgtcagcgcacgaacaccacaacgcgcacacgttaaccgcattggctcccgttaccgccgccacgcacttcggacatgacggcgacgtcaaacagactaacggtaacgcttgcgggagctacacttcgttgctgaacaacacccagggctccgggtttttcgccctcggtgggtttgggcttgggcttggacacgggtttgacgacatgggctttggcattgggaggtcgggctgggcattccccggaatggtggacaatggcaacattggcggcgccattgcgtcttctggagtcaacacgtggcagttagagagtggcgaaggtgggttcgttggcggagattgcttctcttggcctgggcttgcgatttcaacaccgggaaatggtctcaaatga

SEQ ID NO: 88846 - DNA, 717 bp, Glycine max
  Peptide Sequence Number=SeqID_180531
atgccgtcaccgttcgtgccgttagtctccgtctgcacagtcgtcgtcatgttctactacgtcgttattatgattaaaaccaaaggaagagtcttagggagagaagtaagtcacgatgctgatgaagttcccaagcagcaaagacccacaacatttgcacgtagacaatgggaagctgcacctattgataagaatgttgagcatgtggatcgtgcagttgacgaggttcatgaacagcctaaagtaccagttactaatgctgagggttttctaggtaaaccctacgacacatcagttttgatggactatgttcatcatatgatagtgatagtttggaatagagaggaacatcttgagttgaagttgtcctcccatgaaaggaaggtagagaaatttggcagacctgctctagaaattgaaggcttagtggctgccataggattaagtcctctaattgctttttcgttggacactgatgatcggagacttatttttgcatttgcagagaggtggaaactagtattttcaatcttctgctcgagcatatctcttgcatctggaagctacgcatggggagctgttacactagtccatatgtatgaaaatttgaatgatgcgtcaaagagcagtgttaggcaacttacaggatatatcacactattacagtgttggatctacaagcattttctttctgttacttcttctattgttgcttga

SEQ ID NO: 88847 - DNA, 344 bp, Glycine max
  Peptide Sequence Number=SeqID_180532
atggctaaaggcatgggagtcaattatgaaaaggaggagataaggatgatatccagaatcaaaatattagaaggaagagacaaaaacaatgcagataagttcaataaggagattggtactaaaagaacagtttgctgggcagaaagtccagcaataaatacagcaggaggagttttgtctatatggagtgaagaatcatttgcaatgcagaggaatcaaagagatcaaggcagtggggtgatgagggaattcactgcgtggttgaaggagcttgaagtggaagatgtgccatgtgttggacgtgatttcacacggtataggccaaatggagtggcgaaaaacag

SEQ ID NO: 88848 - DNA, 96 bp, Glycine max
  Peptide Sequence Number=SeqID_180533
atggggtatcggtggcgcaaatttgaaggattgaaatctgaatcaaggcggcgggtgaacaatgaagctggcttgctcctttttcaacttatatag

SEQ ID NO: 88849 - DNA, 1071 bp, Glycine max
  Peptide Sequence Number=SeqID_180534
atgttgtgcattgctccgttgttgggcttgactgtgagaaggaaagtttggctttgttcgattgttcgttttgggtgcgagaaatcaaagttatacttttgtacccatgtttggattgttaactttggtttccggtggttgaggtggctttgtgattataaagttatggcacgtgttcctgataaaattaagttgatagatggatcgagggaagctcttaagctttctgtaaggatcactgatctttggttcattgggatccctgaaaagtttgaacaagccgaaatggtggttgttgattctgatggagatgaaatccatgttgtttgcaaacaagatcagctaaagtcttggaaggctgatttgaaggaaaatttgacttatgtgatgcataattttaaagttatgaagaatgatgttattggcgtggttgatgaagtggtattccgatatgtgtcatcgaaaaatacgaaggtactatcctgcacactctgggaaaattactgcttacagtttttgtcttatttgaatgaggttgaagatgaaagacccatcattattcttttgacacatgccaggatcaaggaagcccagggatcatatctgccatcagtcagtaattctttcaaggcgtctaaactcatgatcaacgagcttgtgctggaaattcaagaattgagagagaggcttttagatttagggatggagaaaattgtttgtgttactgtcgccaaaattacaactattcatggtgctattcggcttgcggtcaatgtcacaaaaaaaactgacatagaaactgtgtcattcatatgtccatgtggcaaagacaacgatcaacctgtactaaggtatagagttgaagtgatggttaatcacaagggtgaacaaaccaaatttttgctctgggaccgtgaatatgcagagttaattggtcaatcagcggatgaagtcaacaggctcaaaatagaagatgacgatgttgatttaaatgcctctcctcaagcactagataggctattgggttgtttccttgcattcaaagtgaaggtgcaaccaaggttcaggaat

SEQ ID NO: 88850 - DNA, 189 bp, Glycine max
  Peptide Sequence Number=SeqID_180535
atggtgaaaccttctgaagctgaaaagaaccttgttcaatctaatgcttttggtggagcagccggtgtaactggcccctatggagctgtggaccgaaaattgtatgtggggaatcttcacttcaacatgactaagagtcagctgtgggagagttttggcatgtttcttggtctttgctacatttattag

SEQ ID NO: 88851 - DNA, 753 bp, Glycine max
  Peptide Sequence Number=SeqID_180536
atgagagatttgggaagcaatatccccttcaaagttagaatcacacaagttgacatgcttgttagagagaaacttgttgagctttatgaatctgagaaacaatggtcaaaagcatctcaaatgcttagtgcaacatctagtaaaggggttgatactaatgctcatcatgctgagggtttttacaaacacacttggctggagatgaaatttgggtggaaaataatattgggtagcataattggattcctaggatcaacatttaggactgtggaaggtgttggtgagggtggcatatttgtgcccgtgcttactctagttgtgatttttatctttcttacggatcaacttgatccggaactttccctgttgcaagcgatgccgacgaactcagcacggaggattcttacctcgacaatgccgacgcgcggaggcagcaacaccaccgtcaacttggttgggatacccacggcggcacggtcgatgatgacgaagaagacgaagatgaagaacgaatgcgctgcggtgatgacgaccgtgctcaagctttttcgagaggaagaagacgaacgaaggttaggaagaagaagaacgcgggagggaggggaccaaaagctcaaaagaagcaaaaatggagaggaagaagcagaagcaggaatgtgggattggaagggagaaaggagaatgaacaattttttttttaaattaattaagccagaggccgacttcggttacacatttttcgcccaacgataa

SEQ ID NO: 88852 - DNA, 1203 bp, Glycine max
  Peptide Sequence Number=SeqID_180537
atgccttcaaattctaacccttcaaccacatcatcaagagtagtagcagaaactacaagagaattttctataattacaaaaagcaccaatcaaggtcagagaagtggtgttagttctcgtaatgatagtttagagagcactagtggtgcacatattaagccacatacaggaggtgatgtgaggtgggatgcaattaacatggtttctagaggtaatggtcttaatcttagtcatttcaagcttctacagcgtgttggttatggagatattggtagtgtgtaccttgtggaacttaaaggaagtaaggcattctttgccatgaaagtaatggataaagcatcacttgcaaagattttgttagctttagaatacttgcacatgctaggcattgtgtatagagacttaaaaccagagaatgttctagttcgagatgaaggtcacataatgttatcagattttgacttatcccttcgttgctctgttaatcctacacttgtgaagtcatcatctgcacatgaaagtaataatggtccatctgggagcattttggatgatgagcaagtaatacatggttgcatacaaccttcaagtttctttccacgcattttaccttcaaaaaagaatagaaagttaaagtctgattttggcctcatggttggaggatgcctgccagaactaatggcagagcctacaaatgtgaggtcaatgtcctttgtaggaacacatgagtatcttgcaccagagattattcgtggcgaaggacatggtagtgcagtggattggtggacatttggaatattcttgtatgaacttttgcatgggataacaccctttaaaggtgaaggaaataaagccacactctttaatgttgtaggtcagcccttaaggttcccaaaaaaacctcatgttagtaatgttgcaagagaccttataaaaggattgttggtgaaagagccccagaaacgatttgcttataagagaggtgccacagaaataaaacaacaccctttttttaacggagtaaattgggctctagttagaagtgctacacctcctattataccaaagcctttagatttttctaagtatgctaacaaatcaaatattcccccaatagacaagaagattgcagatattgttgcaagcgataaaagtaggcatacacaacctaattcttcttatgaagattttgagtatttttag

SEQ ID NO: 88853 - DNA, 201 bp, Glycine max
  Peptide Sequence Number=SeqID_180538
atgcccaacattgtgaatttaatgtgtttcaacttcaatttcaacgaggcttgtgcgcttagcgagaatcatgcgctaagggaggcactcagcccgcttagcgagctgggagaatctatgaagcatatgcgcgctcagcgtgtcatcagcttgctcattaggctaagttcgacgagacatccgagaatgaggtttaattag

SEQ ID NO: 88854 - DNA, 1014 bp, Glycine max
  Peptide Sequence Number=SeqID_180539
atggccccgaggaagcttgcctcaaagagatctaggaaggataaagcgaccaaaggaactagttccgctcccgagtatgatagtcaccgctttaggagcgttgaacaccagcagcgcttcgaggccatcaagggatggtcatttctccaggagcgacgcgtccagctcagggacgacgagtatacttatttccaggaggagatagttcgccggcggtgggcatcactggttacccccatggccaagtttgatccagacatagtccttgaattttatgccaatgcttggccaacagaggagggcgtgcatgatatgagatcctgggtgaggggtcagtggatcccgttcgatgcagatgctatcggccagctcctgggatatcctttagtgttggaagagggccaggagtgcgagtatggccagaggaggaaccggtccgatgggttcgatgaggaggccatcacccagttgctatgtataccagggcaagattttgcccggactgctgccgggagacgggtgtggatcatgcgcaccaacatgaccaccctgactcagatatggatgactttgctgctcaccaacatcctgcccagcgatcataatttcgacctccccctgccgaagtgtcagctggcccagggggatgctccgcaagccgcagacgtgccgccacctcatcaggccggtccagccggatcgtttgatacggagcagtatttgcggcatttggttcgccagcaggcggccaaccaccgggcacatgtacaaacccatgattgtctttatcagatgagccttagcctacagagccagggctttacttcttttccgtgccctactccggaccagttcagggcagaggtcgcgtggcctggagattggcctgaggtccgggcaggagaggcacctgcagaggcactagcagaggctccagacgaggcagatgaggcccgcgaggacgaggagatggccgatttatttgatttcttaggagggagcggagccacatga

SEQ ID NO: 88855 - DNA, 666 bp, Glycine max
  Peptide Sequence Number=SeqID_180540
atgccgatcgacatcctgcgcgtacgcgatgacgatatccctggcctggtgatggatggcgtggtcgacctcggtatcgttggcgaaaacgtgctggaagaggagctgctgacgcgccgcgcgcagggcgaagacccgcgctactttacgctgcgccgcctcgatttcggcggttgccgcctgtcactggcaatgccagtcgatgccgagtacaccggtccgcaatgcctgaataatgcccgtatcgccacctcttacccgcacctgctgaaaaaatacctcgataaacaaggcatcgcgtttaaatcctgcctgctgaacggttccgttgaagtggctccacgcgccggtctggccgatgccatttgcgacctggtgtctaccggcgccacgctggaagccaacggcctgcgtgaagttgaagtgatctaccgctctaaagcggtgctgattcagcgcgacggcgaactgccagcggcgaaacagcagctggtggacacgctgatgacgcgcatccagggcgtgattaaagcgcgtgaatccaaatacatcatgctgcacgcgccgagcgagcggctggaagaagttatcgccctgctgccgggtgccgagcgccctaccgtgctgccgctggccggtgaagtgagccgcgtggcgatgcacatg

SEQ ID NO: 88856 - DNA, 159 bp, Glycine max
  Peptide Sequence Number=SeqID_180541
atggtgattttcaaccatggagttgcagtagaagataaaggagaagagcctagcacatgggaagcttccttgagaagcaaggaaggtagcttccttgagaagctagaggaagaaagcttccctgagaagctagtggggttactcacactcctccaatag

SEQ ID NO: 88857 - DNA, 387 bp, Glycine max
  Peptide Sequence Number=SeqID_180542
aatgttgctggtgcaagcaagccatatgttcgtcctccaatacatcaacaacaacaacaaagacaacaaccaactgaggcccctcctcaaccttccttagaagagttagtgaggcaaatgaccatccagaatatgcaatttcagcaagagacaagagcttccattcagaaatctgaaaatgtgagtgccatcaccttaaagtctggcaagcaatttgaagtgcctccaccagtagcagcacctacacctgaacctgtcaagcttcattctacacttgaaaaagaggatgagatagttgtacaaaagagaaagcttcctgatcatgagggagttaacaaaaattttcatgcaggtggaccttcttctagtaattctgacttacaatag

SEQ ID NO: 88858 - DNA, 129 bp, Glycine max
  Peptide Sequence Number=SeqID_180543
atggcacaacctccaccccgtgagaggactctaagggaaatggctgcacctgatttcacctacgaaagcttgtgcatccaataccctgatgaggatgtcccatatgtgaagacccgcacaaacatttga

SEQ ID NO: 88859 - DNA, 485 bp, Glycine max
  Peptide Sequence Number=SeqID_180544
atggttatccgcacctttggtcatcttgagacggctagtccgacgacatgcgggggtaacgtatggttatccgcacctttcgtcaaccgagggcagacatgcccgttgacgcgcagagacgaacgtcgtcatctgcaccctttgtcaaccaggggcaagcaagcccacggcaagttcgatgacatgcggggctaccgtatggttatccgcaccttttgtcatccagagacggtgagtccgatgacatgcggggctactgtatggttatctgcacctttcttcatccaggggcaaacaagctcagacggcaagtccaatggcatgcgggggtaccctatggttatccacaccttttgttatctagagacgccaagtccgatgacatgcgggggcggcaattccgatgacatgcgagggtaccgcatggttatctgcacctttcgtcaaccaggggcaaacaagcccgttgatgcgcagggactaac

SEQ ID NO: 88860 - DNA, 565 bp, Glycine max
  Peptide Sequence Number=SeqID_180545
atgaactcgctaagtgcgcttactgcgctaagcgagttcatcttttgtggatgaacattcatcttcctgatgagatacctgtggctaaccccaggcttagcgggcagtcgctcgctaagccgattatcggaccatgtctcgctaagccgctgatggcctccaggaagcataagagcattggggcaaggccaattgctcagtgtgacactagatggttccattcacttgatgcttggaaccgttatatagataacgtcttaggaaggagaattttgccagagaggaaggtagagatataccacgcagagtttgatgacttcaagacagagttggagaggcgtaatcttcacaaacgcctcaccaacttggctgatgggactattgatgttgctctggtgaaagaattttatactaatctctacagctctgaggatccttcaccaaagcaagccaaagttagaggccatgtggtgaagatagacgttgacgacctcaacacatttttagagactcctgtagtcctagaggagggggagacattacccacctactctaggtactgcag

SEQ ID NO: 88861 - DNA, 934 bp, Glycine max
  Peptide Sequence Number=SeqID_180546
gggcaggatcatcttgagctaccttctggggtagagacagaacatgaacagcagaaaccaatcaaggaacggatgcaagtgaggatggggtcacgaccgactgatcgtcgcccctttctccacactaagcaagcggagaacgtcgctgcaaggcagccccccctagggtcatcctttttcgcattttttgattccgttttgcgcttttgttcatcaccaacaagaatggccccgaggaagcttgcctcaaagaggtccaggaaggacaaggcggccgaaggaactatttccgctccggagtacgacagtcaccgctttaggagcgctgtacaccagcagtgcttcgaggccatcaagggatggtcgtttctccgggagcgacgcgtccagctcagggacgacgagtatactaatttccaggaggaaatagggcgccggcggtgggcatcactggttactcccatggccaagttcgatccagaaatagtccttgagttttatgccaatgcttggccaacagaggagggcgtgcgtgacatgagatcctgggtaaggggtcagtggatcccgtttgatgccgacgctatcggccagctcctgggatatccgttggtgttggaagagggccaggaatgtgagtatggccagaggaggaaccggtctgatgggttcgatgaggaggccatcgcccagctgctatgtataccggggcaggattttgcccggactgctgcagggaggcgagtgcgaatcatgcgcaccaacatgaccaccctgacccagatatggatgacgttgctcctcagcaacatcctgcccaccgatcataattccgaccttcccatgccaaagtgtcagctggtgtacgccatcctgacacggatgagcatccatgcggctcagttgatcactgatgccatctatatttttgcag

SEQ ID NO: 88862 - DNA, 118 bp, Glycine max
  Peptide Sequence Number=SeqID_180547
acattattttacaattcccaacggtgagaatgctagaaattgggttgcgaacgtgttgctcaaatttcacgacgatccaacggtgaatgagtccaagatcattgtttttccgagacag

SEQ ID NO: 88863 - DNA, 574 bp, Glycine max
  Peptide Sequence Number=SeqID_180548
ggtgaaaagggaatattgaatgtagttaaagactccatggttgtcatgaggggaattatggagaatggcctctattctgtagatggtgaagttgtaattggctctgcagccactgcaaccagaagagttttatcaaaaactgagttatggcacatgaggagcttctatgtggggatagaatggaaagataaaagttctgtgaacattgtgtctatggcaaagcctgtagaggaaattcaatgttggacagtagagaacataaaggtacccttgattatgtttatgctgatctttggggtccaaccaagactccctctcattctggagcaaggatgtgaagacccaacgatttttgtatgggtgaagcagcaattgactgcagtatatctcaatgaaacaacccgaggggtccttgacagctctaaaggatattctgagggagtgaaagggtataagctgtggtgtttggaggctggttttaagaggtgtttagtgagtcgtgatgttgtcttcaatgaagctaagatggcttacaagaccaagcccaacatggttcagtccaacactgatcaga

SEQ ID NO: 88864 - DNA, 1290 bp, Glycine max
  Peptide Sequence Number=SeqID_180549
gcagcaatgaaggcgctggacgccgctgcgccaggctcggcaagagccccgaccgcctgttgctggaactgggcgcctggccgcacgccctggcgctgcacaagcgccgcttcctggcggtgaactttccccggggcctggcctttcccgagctggaactgccgccgatcgaccgcgaactgccgctgtcggacgccgagatctattcggtcgacgacgtcaccaccaccgagatcgacgacgccctctcggtttccaccctgcccgacggcaacctgcgcgtcggcatccacgtggccgcgcccggcctgacggtgacgcgcgacagcgaattcgacaagctggcgcgcgcgcgtctgtccacggtctacatgccgggcgacaagatcccgatgcagcccgacaacgtcatcaaggccttctcgctggacgcgggccgcgaggtgccggtgctgtcgctgtacgtggtggccaacccggagaccggcgaggtcatcgaatccgacacgcgcctggagcgcgtggtggtgcgcgagaacctgcgccacaacatgctggacgcccaggtcaccgaagacagcctgaacgacacttccactgagctgccctacggccactggctgcgcccgctgtggaaactggcgcaggccttgtcggcgcagcgcgagaacgtgcgcggcaagcccgagaacaattcgcgggtggagtacagcttctacctggacggcgaccccgacgatcccgacaccccggtgcgcctggtgccgcgccagcgcaacgcgccgctggaccggatggtggccgagtacatgatcctggccaataacctgtggggcggcctgctgaaccagcacggcgtgccgggcatctaccgctcgcaacaggccggccgtgtgcgcatgagcacccaggcgctgccgcacgaggccatcggcgtgccgcagtacgcctggagcacgtcgccgctgcgccgctacgtggacctggtgaaccagtggcagctgatcgccgccgtcgagcacggcgtctcggcgcgcctggtggctcccttcaaaccgcgcgacgcggatctgttcgcgatcatcggcgcgttcgacgcgcagtacgcggcctgggccgagttccagagcgcgatggagcgctactggtgcctgcgctggctcaagcagcacaacatcacccgcaccgtggcgcacgtgctgcgcgaagacctggtgcgcttcgccaactgcccgctcgtcacccggatcgggggggatgcccgagctggagcgcgggacggcggtggag

SEQ ID NO: 88865 - DNA, 1062 bp, Glycine max
  Peptide Sequence Number=SeqID_180550
tcaaggtcaagagcttagggaccaccagtctaaaagagttagggcagttgatgggtcagctccaatggcaagcttttcgcaaagcttacggtgcttcacctttggggacttccagctatcacctatggtagaagaatttgaagagatcctaggatgccctctagggggaaggaaaccatacctcttcgcagggttctatcccttattagctagaatttctaagatagtccaaatctcggcgcaggaattagactacagaaagcaagtcgaaaatggggtggttggaataccgagaaaatatttggaggcaaaagcaagaatcttggtagataaaggtgagtgggccccgttcatagatattctcgcactgttgatcttcggaggagtcctctttccgaatgtggatgggttggtggacctagcagcgatcgacgcttttcttgcctatcataaccacaaggaaagctcggttgtcgctatgctagccgacctatatgacacctttgaccgaagatgtaaggcatgcttgcccgctagaaagtcaccgttcatgcacagagaaaagaggtgcaaattgggaccaactcttagcaaaacagaaggagtgtctatcaactggttccctcgatggaaagaagggaaagtcggagttcttatttcgtgcggaggatttccgaatgttcccttgacggggacgaggggttgcatcagttacaatctcgttcttgctataagacaacttggctaccctatgagaggggcaccactagaggaagagctcgcgcctgtcatttcacgaggtttcaataagaccaacatggagacacttcagaaggtccgcaaggcatgggaggtagtgcgagagaaggacaaagaacttaggggcggtaacaacgggcccatcggtggctaccgtaagtggttgagagcccacgtgcaaggtttggattggctcccaagtttgagaaacgctaaaagggaggaagttgaggcaccggaggaagacgaagaggtgcaggcccttaggacaaaactcgagcaagcccaaacagtcaaagaaag

SEQ ID NO: 88866 - DNA, 183 bp, Glycine max
  Peptide Sequence Number=SeqID_180551
atgccaaaagatagggggacttgtcttgatttcagggattgtcatcatcaaaaagggggagattgtagacaaatgatcaagctgaatgttttgatgatgccaaagcttcacatgcgtctcaaagctttattcaagacaaagaaattaaatatattcaagatggatgatcaagacagtctctag

SEQ ID NO: 88867 - DNA, 661 bp, Glycine max
  Peptide Sequence Number=SeqID_180552
gattcgtttgagagcaggcacacagggatcgttcgtcccccatggacgtttggatgttctcgccgttgctattggacgtccagagcaccctggatgtgtccgtgctgctagagccggtgtcaccatcaagcaatactttggatcggctccacggacggaccagctagaagagtccatcacagagaaagtgatgaggcaagtcatggcatccttcagccagcttcagtcgcagatgcaatctcagggacttgcagtgcctcctgagcctcaggcggaatttgatatcccagaggcttctggcagtaggacgaaaaggaagacggtgtacagagagatgcatctagttcctgtgacaaatacgcatctagcaaggaaactagtggggcttccagcttccttgccagaccatcgcaagcctctttccgggagcacaggccatccagaagcagaatactgccccgccgacgttttgtctcgtgggggttatgattatttggagcagaagctcctggctgagaagaccaagaagaagatgcatgaagctgcacagtcaggaagcgttgatggcgtcatcaaccctccatccccggtcagacgccacgtgaagtggaagatggcccgcacaaagaagacaggggagatgacgactgaggccgcatag

SEQ ID NO: 88868 - DNA, 402 bp, Glycine max
  Peptide Sequence Number=SeqID_180553
gatgtgcgaaaaaaggcacaggccatccagaagcaaaacactgccccccacgtgttgtctcgtgggggttatgaatatttagaacaaaagctaatggctgagaagaccaaaaagaaactggaggaagctgcccagtttggaaccactgacggcgtcattgaccctccatctcccattagatgccacatgaagtggaagatggctagcaccaagaaaactgggcagatgacatctgaggcagcaaaggaaatccttgagaagatcgcatcacagggatcgttcgtccctcatggacgtcaggatgtcttgactgttgccattgggcgagcagagcaccccagctgtgtccgtgctgcaggagccggtgtcaccatcaaacaatattttggatcagctccatga

SEQ ID NO: 88869 - DNA, 639 bp, Glycine max
  Peptide Sequence Number=SeqID_180554
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaggtgtccatagaagccattgcatcacttacccaatactacgaccagcccttgagatgcttcacattcggggacttccaattagtaccaaccattgaagaatttgaggaaattctaggatgtcctctcgggggaaggaaaccatatctttcctccgggtgtctcccctctttaagcagaattgcaactgtggtcaaggattcagccagaggtttggaccgcataaaacagactcggaacggcatagcgggcctaccacagaagtacctagaagacaaagcgaggggcctagcagcaatcgacgctttccttgcctaccaccatagcaaggaaagtccggtggtagctgtcttggcagatctatttgacacatttgaccgaagatgcaagaagagtagcgcacggatcatctgttgcttacccgccctctgtgtttggtttcacacttgttccaacaagacacaagacatccatgtccgctcctga

SEQ ID NO: 88870 - DNA, 657 bp, Glycine max
  Peptide Sequence Number=SeqID_180555
atgcatctactatgcatactggggcaagatttcacccgtgccgctgcaaaaagacgagtgcggatcatgcgcaccaacatgaccactcttacatggatatggatgacgttgctatgccaatctccccctgcagatgtatcagttggtctgtgccgtcatgacatagggatcacgcccacaagacgcccagtggacccgaagaagtccaacagggccctggggtttccagctctggttacgggcctctgtcagtcctatagggtgctcgtccccccagcaaggaatcgcacccgtacaaagacacccagtggacccggagaagtccaacagggccctggggatttccaactctggattacgggcctctatagtctttacagaggtcttccccccggcaaggtcacgtcagcccctcaatcgagctttcatcaagaagtactgcgtcccaaggcaggcgcagggcgagacaccgcagtagcctggggatggccagcagcgggcaacagacacaccgccaccacctccaaagccactcagctcatccacaaaaagttagtgtgttgcctacgacccatggccgaccagcaaacgaccaagttcaaagccaaagataagcaaagtactaggtccgtgaccgacaagtcaacaagtgtctag

SEQ ID NO: 88871 - DNA, 1278 bp, Glycine max
  Peptide Sequence Number=SeqID_180556
atggcgccgaagcacgacaactgctgctcgcgctgcatcggcttcctaatagccataggcctcactgcgctcttcctctggctgagtctccgcgtggacgaacctaaatgctacctcgactacatttacgttcctgccctcaacaaaaccctaaattccagttcaaattccactcacaacaaaaacgccacaatagtcttcgctctcaagctcgccaatgagaacaaggacaagggcatccaatacgacgacgttctcctctccttcagagtcttcgagagcgtgaacaccacgcgccccctcggcaacgccaccgtggaaaggttctaccagggccacaagaagaaggccaccaagcgcggaaacttcaccgtcggaggtggcggcggaaacctcacggcggcgctggatgggaaagtgtggtaccgtgtggactatgctactgcggtgaagtacaagattattttctggtacacgaaacggcaccgtttgtggggaggggcaaatgtggaaattggtgaattgggaacgaaggtgaatcgtaaagccgttagacttggagggaagaaccccgtggtgatcgagtccggcgcatcgaagctcagtggacgctatcgtgcgcctcttcttctcccttttgcttatctcctggcttctggtaagtcagccaagaaacctgattctgaggaaattgatggggcaaagaagtttgaagaaatgtcaaatctatcatggttgtcaagtgtatctcaaaacaatatattactgcaacggaaagagcaatctcgtaaaaagaaacaaaaatgtgtgtttgacttcactcaagaaagccgttttcagaagttaattgaagtctgtgcaaggatactaggaccagaggctaccattgagttgtttggtaaagtgggacgagaacctggtgtgaaaggatacaatacattggtagaaatgtgcatagataaggccaggggaactgatgacgaagacattacaatagaagaactggggaaggtttttaaccttttcaaatcaacgagggaacaaggtttagagttacaagagcaaacatatcgcctgcttcttttgtatctgattgacatgcgtatggttgaggaatttaaatttttctgtgttgttatcaaagatgagaatcccagttcagttacaagactgggttactatgaaatgttgctgtggttaaaagataataatgaagaaaagattcaaggtatttgtgactatattgcagagaatgatgaagacacatctgatatatga

SEQ ID NO: 88872 - DNA, 507 bp, Glycine max
  Peptide Sequence Number=SeqID_180557
tattatgaagaactgaagcaatctggaatcgtagctaccaagcaaattttcatggcacttataaatgcttatgctgcttgcggacagttggagaaagcaaaaaaggtaatcttagatccattgataccaccgaagagcttgaatcaaatcaagggttttcttgtctcagtacttgcatcacatgggcaattgtctggggctctagttatttatgacaaaatcaaacaatctggacacaagctggaggcaaaagaaattacgagtctcattgtaagttctgctgtcgaattgtgtaatctgctcatggataagttccaaagtgatgagcaagttatggaatttctctttgataaggtattttctctgattgaagagtcaagtcatttgcacactttcctcgagttgctttcggaaatcaaggataagcttgggcttctgccttcacagaaacgtcatgattctctgctacgtgttactgccactgatttgcatgattctgatttctga

SEQ ID NO: 88873 - DNA, 783 bp, Glycine max
  Peptide Sequence Number=SeqID_180558
atggtttccccggaaaacagcaattggctgttcgattacccgttgatcgacgacgacgttattcccgtcggcgactcctccttcgccgtctccgcttccaccttctcctggcccccacctcccgccaatgtcagtgtcgaaattgatgcttcgcttggggattctgatggcctaaaaaatcctgctttgaagaaaaggactaaatctgattcaagtactgcttctagctccaaagcgtgtcgggagaagttgaggagggataggcttaatgacaagtttgttgaattgggctccatcttggagcccggaaggcctcccaaaacagacaaggcttccattctgattgatgctgcccgaatggtgacacagctgcgggatgaagccctgaagttgaaagactcaaatacgagtcttcaagagaagattaaagagttaaagtttatttctgtagctgtgaggaaaacatcttgtaaaccttttataacactaagtattgaattcctatctcctatgcaggctgagaagaatgaacttcgtgatgagaaacagaggcttaaggcagagaaagagaagttggaggtgcaggtaaaatcaatgaatgctcaacctgctttcttgccaccccctcctgcaatccctgctgcatttgctccacaaggccaagcccctggcaacaagttggtgcctttcatcagctatccgggagttgccatgtggcaatttatgcctccggccgccgtggatacctcacaggatcatgtactccgtccaccggttgcctaa

SEQ ID NO: 88874 - DNA, 336 bp, Glycine max
  Peptide Sequence Number=SeqID_180559
atgcaatcgacaaataaggaaggtcttaaaaggcctaaacccttggtaatacacttcaccagggacacggctccccaaaggccccgacacccttcggcagtgtcgagcgttagacctattccgtttccttacaagaacagtcacgcaattccctggaggtatgcccctccgggtggaaggaagcaagaagctactgacgtcggctcactatcggccaaagtaaccaacatcaccaggctgagcggcataacccgcggtggtcgcatgttcacaccccctggcttgccaacgcagcctgcaaacgctaaagggaaaacaaaggtgaccgaaggataa

SEQ ID NO: 88875 - DNA, 399 bp, Glycine max
  Peptide Sequence Number=SeqID_180560
atagctattgaagaacccgtaataagagataatgttagtgacttcagtgatgacgagcaacaacatgattttgatgaacatggtaaaccaaccaatcaaagtgagttatcttcatattttgaaatttttagtagccaactttctgaaaatcaagagtactcaaatccttatcaaaggacaacgagtgttagtacaaatgacctttatgaagggttgacatttgaatcaaaacaagccactgtgaatgccattaaacaattccattttatgcattcacttaattttgatgtggtcgagaacaagagtgacaagtacgttgtcatgtgtaatcaatatgataatggatgttattggagacgagagtatcgttcagcaaaatacgcaaaaggtgggagttga

SEQ ID NO: 88876 - DNA, 774 bp, Glycine max
  Peptide Sequence Number=SeqID_180561
ttgggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggccttcagggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 88877 - DNA, 264 bp, Glycine max
  Peptide Sequence Number=SeqID_180562
gtttatcaagtcaaggttaaaagtctagatgtcaccagcctcaaggaattgggacgattgatgggacctctccaaaggcaagcctttcgcaaagtgtacggaaagattctagatttgaccgcggcggaggaaaagagggaggtggttgtcgcccagctggtccaggcgagctgggtggcttccaccagaaggcaccgccttctgttggaacaccctggaaggtccaagtgggcctggtgctatttgcacacccttgtttactaa

SEQ ID NO: 88878 - DNA, 531 bp, Glycine max
  Peptide Sequence Number=SeqID_180563
atgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttaggaagtacgggcggcccccatgatgtgcaaattcaaaacgagcacgccttcccgtcatatggcttgcctctcaactatacgccacccaatatggcgtacactcccaataagaatacccatgaaattccccatcacaatctagccgacttcgagccttggctcggatataccactgaagggcaagcagttggtggtatacccctacaaaaccctttggagggccctcagtatcacccacaactgcacctcttgcattccacagcggttaaaaacccttatgactatggcaggaatgggaaagttggatcatctagaggaaaggctcagggccattga

SEQ ID NO: 88879 - DNA, 634 bp, Glycine max
  Peptide Sequence Number=SeqID_180564
atggggacaaatcaaaacggcaaaaggttttatcaagtcaaggttaaaagtctagatgtcactagcctcaaggaattgggacgattgatgggacctctccaaaggcaagccttccgcaaagtctacgggaagattctagatttgaccgcagcgaaggtatttacggaagctgtcgtatccctcgcccaatactatgaccagccgttgaggtgtttcacgtttggggacttccaaatggtaccgactattgaagagtttgaggaaatattaggatgccctcttggggggagaaaaccgtatcttttctccggctttcttccttccttgagcaagattgcagttgtggttggagattcagcaaaagagttggatcgcatgaagcaaactcggaacggcgtagtgggcctgcctcagaaatacttggaaggtaaggcaagggatatggcaagccaagagaagtggggcccatttgcggatatattagctttgttgatttttggagttgtcctctttctgaatgtggacggtttggtggacttagccgccattgatgccttcctcgcgtatcaccacagcaaggagagtccagtggtggctatcttggcagatttgtttaatacctttgaccggagtt

SEQ ID NO: 88880 - DNA, 239 bp, Glycine max
  Peptide Sequence Number=SeqID_180565
atgggggatgcaaatagcaaatttgaaattttgaattgggccttccagactgtttttcaaagatggattgcttctggaggaagcaacccagttcgcctaggcgagctgggcggcaacctcctccccctttttcctataaaaaggcaaaatggggttgttctaagggtccctgattcccctggctatgcatttcagctcaaatccatgaaggttttcatccgttcttcgttcttcaacag

SEQ ID NO: 88881 - DNA, 234 bp, Glycine max
  Peptide Sequence Number=SeqID_180566
atgagtgactggcgaaaaggctctcagtggtttgaaattaaccgagaactagctcttaggatagttgaagacaatacttactatcctaagctcaaaggctctcactattttcagacaatgttaacaattaatactcctcatcttttggcaaatagaagcctcacttatgtggactggtcaagctttatgcttattcatttggttcaacctataatttttggagcaactagataa

SEQ ID NO: 88882 - DNA, 147 bp, Glycine max
  Peptide Sequence Number=SeqID_180567
atgtggaccaccacgggggaggagcttgccacccagctcgcccaggcgagcaaggttgcttcctccagaagcaacagccttctggaggaagaatctggaaggcccaaaaataggagtagtgggggcaagatacgcgggttaggctaa

SEQ ID NO: 88883 - DNA, 702 bp, Glycine max
  Peptide Sequence Number=SeqID_180568
atggacctcatcaaggctgctggactgctgaaaactgtcaccaagttgggagattgttatgaatgtctagtcagggaattcattgtcaacattccctctgacataacaaacagaaagagtgatgagtatcagaaagtgtttgtcagaggaaaatgtattagattctcccctgctgtaatcaacaagtatctgggcagaccaactgaaggagtggtggatattgttgtttctgagcatcaaattgccaaggaaatcactgccaagcaagtccagcattggccaaagaaagggaagctttctgcagggaagctaagtgtgaagtatgcaatcctgcataggattgggactgcaaactgggtacccaccaatcatacttccactgttgccacagaagagagaatctcctctatccctgcattacaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcattgatgatggagaagcagctgaggaagaagaagatgcagcagaagatacagaatcagatgatgatgattctaatgccaccccatga

SEQ ID NO: 88884 - DNA, 219 bp, Glycine max
  Peptide Sequence Number=SeqID_180569
ataattggacccaaccttggcccatgggctcagaaatctatcctgaggctcatgagaaccctaaggccttcttcagcagctctagcccaatcctcttggagccttttgctcatggctctagtgactcgccaccaacgtttatttgtggaaaatatcggaaaaaccgaaggaatcggtcatgaagaatattccagattcgggagttgtatttacgtttga

SEQ ID NO: 88885 - DNA, 162 bp, Glycine max
  Peptide Sequence Number=SeqID_180570
atgcctatgcaaagacacatgcgggaatgtgcacagtatgacatatttaccgacatagcaaaaggaggtatcatcccctttgacgaacatattgtagcagtagggactactagcaacaataggttttcaaagagaaaagctctagatgagggttcactgtaa

SEQ ID NO: 88886 - DNA, 324 bp, Glycine max
  Peptide Sequence Number=SeqID_180571
atgacggagaaaaagattatcacaataatagtacacacattaccagtgttttactatgaaaaaactgtggggtatgcaccttcaagctttgcgaatttggtctttgccgacaaaaggatcgaagcgggtctgaaaagaggcaaatttgatcatcctactttgatgagtgagaaagctggggcaaatgaagaggatgagaatgagggagaaaccctagctatgattgccattcctacacgatcaaatttcccatcagcccaacaatgtcattactcagccaataacagtccctctcacccaatcatccacaaagaccatccctaa

SEQ ID NO: 88887 - DNA, 216 bp, Glycine max
  Peptide Sequence Number=SeqID_180572
atgatagaaccttctatgttaataaaaactcatcttgatactaaaaattttgtagataccaccaactgcttgccactgaagggcaagcagttggtggtataccccttgaaaacacttcggaaggccctcagtatcacccacaactacacctcttgcattccacaacaagtaaaaaccctcatgctatggcagaaatgggaaagttggaccatctag

SEQ ID NO: 88888 - DNA, 255 bp, Glycine max
  Peptide Sequence Number=SeqID_180573
atggggaccggtgctgagaggaacgagatgaggagtggtacctggagatatgttgcgggggtcaggagaccttggggatgtcaggtgggtgctattgcccaaaaccaagcttggctaatcccgacccaacccgggcatagtcagtcagtgagaacctgtgacgtacctaaacaggcgagctcctggcagtcaaccaataaaagaacaaagtccacgaagcaaggaagcttgtgtggcggctggccagctatgtaa

SEQ ID NO: 88889 - DNA, 138 bp, Glycine max
  Peptide Sequence Number=SeqID_180574
atggcacatcaggcattgagaggcaatgtgacctctcccaagacatttgaagcatttaatgttgccagtcctttcttggaaactagtcttaggggtgcagcccccaaaattccatgggcttggtccttccttggataa

SEQ ID NO: 88890 - DNA, 157 bp, Glycine max
  Peptide Sequence Number=SeqID_180575
gtcgactctagaggatccccttgcatggcccggagattggcccgaggcccaagcaggagaggcacccccagaagctcccggcgacggaggagaggcccacgaggatgaggagatggccgatttgcttgacttcttgggagggagtggagatacgtga

SEQ ID NO: 88891 - DNA, 480 bp, Glycine max
  Peptide Sequence Number=SeqID_180576
atggccccgaggaagcttgcctcaaagagatcaaggaaggacgtcgcggccgcagggactagtgtcgttcccgagtttgatagccatcatttcaggagcgctgagcaccagcaacgttttgaagccatcaagggatggtccttccaccgagagagacgcgtccagctcagggacgacgagtacacggatttccaggaggagatagctcgccggcgttggacgtcgctggtcactcccatggccaagttcgatctagatatagtcctcgagttttacgccaatgcttggcctacagaggagggtgtacgggacctctggtcatgggtgaggggccagtggattcctttccaatggggccaggagtgcgaatacggtcagaggaggaaccaggccgatggatttgatgaggaggccatcgctcagctgctatgcataccaggtcaggattttgcccggaccgctgctgggagacgggtgtga

SEQ ID NO: 88892 - DNA, 225 bp, Glycine max
  Peptide Sequence Number=SeqID_180577
atgtcagtgaaaaatctcgtcgggcgcctaggagtacatgacaagacaaaccacataataatatgtcaattagggtcacagtgttttgcgagaatgctccaaccatatgggatcaacataggcttaaaggaacactcaaaccgtgtgacccccaaggcctacactccgaagagtccgtcagggcctctccctcctgattcaggtccaacccagaaaacattttag

SEQ ID NO: 88893 - DNA, 327 bp, Glycine max
  Peptide Sequence Number=SeqID_180578
atgattaatgcaaactgtccgcaagaatcattgcattcagtctcaaacgggaatctaagtttatataacaagttcttgaaaagaatcagtgccaaaaacttgacaccaagagcagctgctattgagcaagggattgctatgagtatgtggaagtcgatccaagacagtaatcctgaagatcttgagaggttatacagtgaagttcatcttctaaagacattgaaacacaagaacatcatgaagttctatacttcctgggttgatactaccaacagacacattaactttgtcactgagatgtttacctctgggactctaagacaataa

SEQ ID NO: 88894 - DNA, 1143 bp, Glycine max
  Peptide Sequence Number=SeqID_180579
atgacttcttttcttcccgccacaacagagtcacttgatctggcagtggatgccaaagacccatccgagtccatctccattctttatcaggtacttgattatccttcttcttctccagatgctctgcgcatgaaagaacaggccatcacaaacctcactgagcatctcagggaacaaaatagggcagaggatctgcatagccttcttactcagttgaggcccttcttttccttgattcctaaggcaaaaacagcaaagatagtgaggggcataattgattctgttgcaaaaataccagggactactgatctacaaattacactctgcaaagaaatggtgcaatggacacgtgctgaaaagcatacctttctgaggcagcgagttgaggcaaggcttgcagcatttctaatggaaagtaaggagtattctgaagctttgactctccttagtagcctggtcaaagagctgcttatttatgttcctcctgctcaacaaggttccatagatctgcagagtgggattcttcacgcagaggagaaggattccaaaactgcatatagttatttctttgaagcttttgaatctttcaatgctcttgatgaccccaaggctgtatttagccagaaatacatgttgttgtgtaagatcatggtgagtcaagctgatgatgtggctggaattatatcttctaaagctggcctgcagtatcttgggcccgacttggatgccatgaaagctgttgcagacgctcattctaagcgatctctgaagttattcgaaattgctttgcgagatttcaaggctcagctggaggaagacccaattgtacacaggcacctgtcatccatgtatgatactctcatggagcagaacctttgcagattgattgaaccattcgcaagggttgagattgcacacattgctgaactaattgaacttcctgttgatcccgttgagcgaaagttgtctcagatgattttggacaagttgtttgctgggacattggatcaaggagctggatgcctcgtcatattcgatgattccaaaactgatgcaatataccctgcaaccttagaaaccatttccaatattgggaaagttgtggacagtctttttgttaggtccgccaagatagtggcatga

SEQ ID NO: 88895 - DNA, 288 bp, Glycine max
  Peptide Sequence Number=SeqID_180580
atgacgacagaggaagcggttgtcagagtggcaaaggttgctggaggtgccgtcggaggcaatgaaggtggtcggaagggacacagagcaaaagtgtctgaatcaagtttggggatagttgagaactggtttaactcagagtatgttgtgaaaataggaaaggatgagtgggatgttaagaagattggactggtgcacgaagaatatctgctaaatgaggaaggtcacaacgtaaacccattcggaccctcaaagcccacaagcccaagccacaaaacaaaaccctag

SEQ ID NO: 88896 - DNA, 348 bp, Glycine max
  Peptide Sequence Number=SeqID_180581
atgggaagaatagggaactggttcttcaaaaagacatcagacttcgactctttgagacatgtcactcaggatgttggtggtgctaaggaatcactgcagaaagtaacaggacaggaagacacccctagaagcatggtggaagatcttaggatggagctggagaaagtaaaaagaggacactctgaattgaaggaaaaagaatccaaaattgaatccattgttgagaatgtgcagaatgacactgcaaaattgaagatcaaagctgcagtggctaaacttctgttagaagatgcagaaacaaaggttaaagtagcggtggaagaagtggaaccacctaatgcagcatag

SEQ ID NO: 88897 - DNA, 777 bp, Glycine max
  Peptide Sequence Number=SeqID_180582
atggggagagttaacttagggttaaatgtgagaatggtagtgataatgtcaattaggacttgtaggaaagcttgggcagagcaaatgagaaaaaggaatgacaagtgtgaaagaaaagagtcatttctaggtaaaaattttaagtcgatccaacggttaacgaatcataacgaagagaatgttactgggctcggaggggttgatggagacccggtgctgagagggacgaggataagggctacgtgggagtgtgtgagctcagttgaaaggtgggcaactggggatgtggtagctggagatatgtcgcgagggtcaggagaccttggggacgttaggcttaaaaatggagacatgatgttaaaatggcctctgggagatagggcactggtaatcgattaccatttaggtgtaatcgattacacaatcgcgatggcagcgcagttgatccatgatcgcgtagtgatggagtccctagagggtgtttgggagaccctcgaaggcaatgagaggttccgattccgtggcacaattcgacttactgctacttcattaccagttcaagtgatagaggtgtcatcctctgaagaggatcctgaagaagacttagaggagttacctcctgaacctgttgtggatgcccttgacttacctggggatgatgaagacccactccctgatgttgattttccagaggatgttttgtcagcatctgaggcagactctatagaggagagtggccctggagggacagcgaatagtgacaactcttcatcatag

SEQ ID NO: 88898 - DNA, 336 bp, Glycine max
  Peptide Sequence Number=SeqID_180583
atggcgagggtcaacgacactagaggcgtagatggcaaagaaagtggtggtgatggatttggtgtagtaggtgaagggtgggcttggagcactagggttaggggcttgggtggtggcgtgatgacaagatggtggcacatggtctggggaatagggtcaaatctggttgaggatggcaatgggtcttgtttgaaggttgcgcgtgggggagatgacaacgttgataacctattatatcttgggagacttacgtatcacatggataagcccatgaagataatgaggtacaacttcaactgtcatgctaattatatctgggatcaaatgagttcgtaa

SEQ ID NO: 88899 - DNA, 615 bp, Glycine max
  Peptide Sequence Number=SeqID_180584
atggtaatggaaacatatataaataatcttccttatctccaagccatagtgaaggagacactgaggcttcaccctccatctccatttgtattgagagagtcaactgggaattgcactattgctggatatgacattccagcaaagactcaggttttcactattgtatgggttattggcttgaaaggtttcttagcaatgataatgagagtggaaaaatgggtcaagttggggtcaggggacaccattatcaactttttccttgggagtggaagaagagggtgtccaggagcttcactagcactaaaggttgctcacaccacccttgctgctatgattcaatgctttgaattgaaggctgaagaaaaaggagggtattgtggttgtgttgacatggaagagggaccttcatttattctttcaagtgttgaacccttgatttgtgtccgaaaatcaagactcatgtcattccctttgtatcatgctaaatactatttcttggtgtcactcaaattaagaccaagtatgaaacctagaagcaaagttagactccttgttgatgtagtaaacaaagttagactcttttggtcccttagattgaaaagtaattttttttag

SEQ ID NO: 88900 - DNA, 570 bp, Glycine max
  Peptide Sequence Number=SeqID_180585
aatgagtcgtttccagaagggggtatgccacctaacctgagaacagtttcgattgagaattgtgagaaactaatgagcggcctagcatggctatccatgggcatgcttactgatctcactgtttggggtcgatgtgatggcatcaagtcattccctaaggagggtttgctgcctccctcccttacgtttctgtatctatatggattctcaaatctggagatgttggactgcacggggcttctccatctcacatccctgcaagaattaaccataagggaatgtcctttgctggagaatatggtgggagaaaggcttcctaaagctcatatttatgcgtgtaaagctgatcttccagggcaaaaggaggaggaagcgatggcgcagtcagctgatggcaaagtgtttaagattgttccatgtcaccatctggagcatagcaccagcaactccctgagcatacgggccttaagccatgacttgactggttcagataggggtggctttgatcaaattgacaaggatgattccaacctacctctggatacagctcctattaagcatgtcacgcag

SEQ ID NO: 88901 - DNA, 507 bp, Glycine max
  Peptide Sequence Number=SeqID_180586
atgactcccgaagaactagaacagctgactcaacaaatcagggaccaactggaggagtcgatcacagaaaaaatgcaatctcagtttcagtcacagatgcaatcacagtgtcttgcactgccttcgaagcccgaggttggtccctcagttgctcgtgtcagcacaaaggagagttgtgttgatccctcagggaacgatccagacacgggtgactcagacaaatgcaggttgtacatcgaagaaaataatccccgcctggttgccctaggaagagtttatgagggatccataaccgttcacaacatccctttgttgcatgatcaagtgaaggtcggtgttgaggaggataaagatatagatgctcccgttcctgtatccactgataaggttatatgggatgttaccgtattcgtggtgtttaatgaagacttccagttgtacataaaacacgaagatctgtctgaaatagcacatagtggtcaatgtctcagcatctctgttatatag

SEQ ID NO: 88902 - DNA, 426 bp, Glycine max
  Peptide Sequence Number=SeqID_180587
atgtatgaaactgatgatgatatcacatttgaaggccctaaaaaagctattcaaataaagcgtggtaaatatattgcactgcaaatttgtaacgatgaagatgttgaaacaatgattcaaagttttgaacaacaacaagaaatgtctgtcatagaattatgtgttgaagttgatgttacgggtgcttttgcaattaatttgacaaattcattgttatcatgcgaaaataatatgtctcacaatgaatcgggtagtgcaacagttggaacaaattcagaagaagattttgatgatgatgattatttaatatctaattcatacgttgaggactcattagatgaggatgaggatattgatgaaatgtttgacacagatgatgaagctgcctgtttgatcgaaccacttatagttgtgcaatcgggataa

SEQ ID NO: 88903 - DNA, 210 bp, Glycine max
  Peptide Sequence Number=SeqID_180588
atgacaagaacaaaaacgttacaagaagaagaacaagaacgaaacaaagacacaaacaagaatgcaacaagacgcaaacaagaaaacaagatagaacctgtatcaagagccgaagctctgataccagatgatgtgatcctgactaggagcggatcgcttgatacaggctacggagatttggatgatgccacttccagtaaaggaagataa

SEQ ID NO: 88904 - DNA, 240 bp, Glycine max
  Peptide Sequence Number=SeqID_180589
atggtagaagtctccatagaagccattgcctccctcgcccagtattatgatcagccgttgaggtgcttcacctttggggacttccagctgtcacctatggtagaagaatttgaagagatccaaggatgccttctaggaggaaggaaaccatacctcttctcaaggttctatccctcattagctagaatttccaagatagtccaaatctcggctgatcgaggccgtacccgaatcaaataa

SEQ ID NO: 88905 - DNA, 429 bp, Glycine max
  Peptide Sequence Number=SeqID_180590
atggataatgaagagggcgtgcatgaacagatgaaggccgatctatcgaccttaaaagatcaaatggcttccatctcggaggacaaagccacggcaaccgcctccagtacggttagggaagcggagccggtgctgcaacccgctttaaatccgggccgagacagaaacacggccgtgttttgtcgaaggtatagtccgcaagcttatccttatggcttgcctccggacttcactccccgtgccactccggaagatttaagccaagcccctacttttgaggggcaactcccgccttatgacgactatcccgggcaggacgataaggaaggagatacccatctcgcccccctgctccacctcaaagatccgtccccacatgaactaccccaaccgaacatagtccgccatatcccggcctcacccacaccc

SEQ ID NO: 88906 - DNA, 201 bp, Glycine max
  Peptide Sequence Number=SeqID_180591
ggtcgacgtaactcttacctaggtagactggctatccaactgaatcgagagcccagctcccactacttcttcaggtggcagttagcagcaggaacaggaccagcaactagggttgttcacagagcagccgtctttccgtctcaagcggagaagacatcaaaagaatctttatctatggctctaccagggaatcctagttag

SEQ ID NO: 88907 - DNA, 465 bp, Glycine max
  Peptide Sequence Number=SeqID_180592
atgtcttgtgtgggagaaacaagcagccagaccattgctaactccagattagccttcatttttccaaatggatcaatcactcataaccaaactggtgtttattttcaaagtcccactccaacaccaatgcgaattcctaacgactattcttttgacacactcaagcgtagaatgcacaacacccttcaactaaccaacgatcaattagtggatgaaatctactaccgacaaccattcatagatgcagaattattatgtatcattattagaacactggatgttatactcaacctgcttcaatcaactatcactcctactcatcatgcaattatgtattacaatgggaagtggaacataccacgtcaaggtggatttttgggttactcctttactggaactaatccaataagatctggcattccttcgggatgtggcatggacaaactcaatgatttaatcaagtaa

SEQ ID NO: 88908 - DNA, 174 bp, Glycine max
  Peptide Sequence Number=SeqID_180593
atgccacgatggcatgaccttgctgggggggacgagcatcctgtaggactgacagaggcccgtaaccagagctggaaaccccagggccctgttggactcctccgagtccacttgcctcctcctctagttgcgctcgcacagttggccctcctccaggatcaggggatggcctag

SEQ ID NO: 88909 - DNA, 83 bp, Glycine max
  Peptide Sequence Number=SeqID_180594
atggtcggcgcgctttgcgacgagacgatggtttgcccttcctgggtgacgatgcccagcacctcgccgtcgatagggggcgg

SEQ ID NO: 88910 - DNA, 264 bp, Glycine max
  Peptide Sequence Number=SeqID_180595
atgactactggcaggatcaaccagcaagcgccagggcaagcgtcatccgagacaaccgattttaaggacaatgtgggggcactagaccacccacgttcactgcatgcaccgcatccgagagacatcaccacacgtgtgccacaggaagccgttatgatgacgactaacgtggttcacgtgtgggactttgaaatcctccagcgtccccaacaaagaggcctggatggaatgggtctgactagccacacgaataccgtttggtag

SEQ ID NO: 88911 - DNA, 458 bp, Glycine max
  Peptide Sequence Number=SeqID_180596
atcaacagagtttgagcatcctcctcatctatcagatggaaagattggggaatcaaagagagcaacaacttctccggatgaggaatcagaaagatcaacagctcctccaactggggaatcagggggatcagctacttctccagctggtgaatcatggggagcagcagtttctctagatgggaaatcggagatgataatcagaggtggagatgggggaaccacttcaagctcaggagaagaaggtggattcaccactggagattgtgggtcagctggctctggatcaacctatgtaggtgtgggctcaggaggggcagcctcgctgtcataccctaatttcgttcggggattattacttgatgacatgcaacctttggatagccgctttgagatacttggcgtcctttgttgcacaataaatgaagtcccgagacgtgtcagaaatcaaaaggaagcag

SEQ ID NO: 88912 - DNA, 205 bp, Glycine max
  Peptide Sequence Number=SeqID_180597
atgtcaatgaacaagatgtacttctatttatcgacaatatctttcgcttcgtccaacaggattgaagtatctgccttattgggtcgaatgccttctgctgcaatcccactcttcggtactgaaatggtttctttgaaaaagaaagaatcactgggacgtatcgcccaaataattggtccggtactagatgtagcttttcccccag

SEQ ID NO: 88913 - DNA, 597 bp, Glycine max
  Peptide Sequence Number=SeqID_180598
atggacattatagaagtgcccactttttaccaccaacaatgggcaccagaataccctgagtttgtcaactttagatatgatggaacaatataccaaatcaggctaaggcagcatcgggcaaaagtctactttgcggaagggctgaaagaattcagaaaagatttatcaatttatgaatctgtgatcattaaattcttggcatgcaacagcaaatccatgtttgatctttattttgttccctcactggaatgccagacttgcggaaggccagaagttatgtcaagacaatatatttggacacttgaaatcacacaatcaattcttggtgcaccaggaccactgagactccccaattgtgccatgacatatgtaaatgcctgcggtcaacacatgaccattcttaggagatttggaactccattacagtggaatgtggtggttgatggtggaattgggcgcatatatgttgtccaaccatggtatcaattccttgcagataatgatttatctcacggtgatgaagtctccttctattacaagaccattgataaaatatgggaaattgtcatctgccggagaaagaattgggagtattag

SEQ ID NO: 88914 - DNA, 471 bp, Glycine max
  Peptide Sequence Number=SeqID_180599
atgacgtctgagccaccaaaggaaattgcagacaagattgatgtactgactgcttccattgggcgaccagagcaccctggacgtgtccatgctgctagagccagtgtcacaatcaaacattactttggaccagcttcaaggggctcctacacctcttcgtccatggcttctaaagacctagagcagttggcacaaaagatcagagaccagttggaggagtcgatcacacaaaaatctcagatgcaatcacaaagactcgcattgcctcctgaggctgaggttggtccttctattgcttgtgccatcacaaaggaaatttgtatcgatccctcggggcaggacccagaaagggaaacttggacaaatgtgggttgtatgttgatgatagtcctccccaactggttgctcttggaagagtttatgaggggtcgacaactaaccacaatgttcctttgggcaatgatcaagtga

SEQ ID NO: 88915 - DNA, 635 bp, Glycine max
  Peptide Sequence Number=SeqID_180600
atggccaagttcgatccagacatagtcctcgaattttatgccaatgcttggcctacagaagagggcgtgcgagatatgaggtcctggggcctagagtgtgagtatggccagaggaggaaccggtctgatgggttcgatgaggaggccatcacccagttgctatgtataccggggcaagattttgcccggactgctgccgggagacgggttcagatcatgcgcacgaacatgaccaccctgactcagatctggatgactttgctgctcagcaacatcctgcccagcgatcataatttcgacctccccctgccgaagtgtcagctggtgtacgccatcctgacgcggatgagaattcatgtggctcagttgatcgctgatgccatctatatatttgcaggtatggcgcctaccaggcaccctctggacccggataagtccaacagggccttgggatttcccgccttgatcacaggactctgccagtcattcggcgtccccgtcgcacctagcaaggtgattcggccacccatcacccgagcttttattgagaagtattgcacgcagagacaggtccagggtgatgcaccacaggccgcggacgcgccgccacctcatcaggctggtccagccggatc

SEQ ID NO: 88916 - DNA, 216 bp, Glycine max
  Peptide Sequence Number=SeqID_180601
atgagcctaaaatctaccctaaggctcatgagaaccctagggccttctgtagaagaaagcttcgtgatgatgaaccaagcaattttgatgttgccaaaagcccaagtgattgatttcaagacttcaatcaagatcaagcatcaagaatccaatccaagattcaagattcaagagaagaaatcaagaagcaacaagtcaagacttcatataggataa

SEQ ID NO: 88917 - DNA, 184 bp, Glycine max
  Peptide Sequence Number=SeqID_180602
atggcccgcaccaagaaaacggggcaaatgacgtctgaggcagcaaaggaaattgttgacaatattgattcgttggaggaccaggcctcacagggttcctttgttgcccatggacgtcaggatgtactaactgctgccattgggcgaccagcacaccctggttgtgtgcgtgctgctggagccg

SEQ ID NO: 88918 - DNA, 350 bp, Glycine max
  Peptide Sequence Number=SeqID_180603
agtacctgtcacccccagcaagggcatcaggccccctagtatcgagctttcatcaagaagtactacggctccaggcaggcgcagggcgaaacaccacagcagcctggggatggccagcagcgggcaacagacgcaccgccatcacctctagagttcacctcagctcatccacaaaaaggacacacctagttgctcatgatcctaggaatttaaataaaacaagcacaagctcggaaggacatcccctttatccccgaaccgctggccaaaccctgacatatatcatgaccagccgttctacaagccttgagccaaaatcccaacttaccataaaccttgacccagggtga

SEQ ID NO: 88919 - DNA, 612 bp, Glycine max
  Peptide Sequence Number=SeqID_180604
atggtcacaccctttaaaacaaaagatatcaatgaagaaatcacttcaaaagacatcaaaagcctaatggaacaagctaactacaccaacaaataccttcaggtattaggagaatccattaacagagaaaaggtatctcctaaacacaaaacccatgaaggatctgcatcaaacgtccagatagaaaaacctttattcaaaccattcaaagttagtgaaaaggcaaaacaaaaaattataaaacttaggaagaacaaaacctttacagaagggataggtgataacaatagtgaactgttaaacaagattgatagtttacttaaagtcatccctgaaacacctcatgcttcagaggaatcatccaaaatgagaaccagaagtacctccaaactaatcaatgttattaatgatgacagtaaccaaaactcagaacaaacaactgaagaagattcagtatctggaaaggatattaatccaataaacaccaaacattggaaatcatcttccaaacattattgccaaagaccaactgccctgatcttttactggaagaaagaggcaaaaataattttaaaagctttagtgcaaacaacatctatgaatggaatatag

SEQ ID NO: 88920 - DNA, 129 bp, Glycine max
  Peptide Sequence Number=SeqID_180605
atgaccattaaagaaggcttgcaaaaagttatatggtttcctatgcaaagaacagaaccaaacaacaacatgttgcctaggacacaaaattacgagttgccaatgtgccctgcatgtcattcacattag

SEQ ID NO: 88921 - DNA, 102 bp, Glycine max
  Peptide Sequence Number=SeqID_180606
atggctggcggtagtgaatttcatccaaaaattgtctgttggcttgcaaaatcacagctgtttggtactcgaatgggcaccggagtggaagtttggaagtaa

SEQ ID NO: 88922 - DNA, 1110 bp, Glycine max
  Peptide Sequence Number=SeqID_180607
atgggtctgcaagatgccattaacaccagaattggagggcggggttctaaaggcgctagtggggtgcagcttcctaccagaagaattgctactttggctcagaatgatcacattcagaggactgttattgcttctatccaccagcttagtagtgaagtttttcaactcttaaataacctttgtcttttgtcttcgggtaaaacagtttactttggacctgcttctgctgcaaatgaggttttgcttcaatgtttgtgtagtttttcgcttcaaattaatggttttccttgtcctgttctcatgaatccatctgataatttaatgaaaactatgaacaagtttttcgatcaggacattgaggtgggtttactgggaatagaaaagtacccacagaagaagcaatccgcatccttttcaatcgaatggaagagagggcatgctggcttctttaatcaatgcttagttcttactgaaagatccttcgcgaacatgtaccgtgatctaggctattattggttacaatttgccatatttgttgcattggccatagctttggccactattttctgtgatttgggtacaagttacggctcagttcaggatccaggttctcttattgcatttataaatggattcttaactttcatgaccattggtggattcccttcctttgtggaagtcatgaaggtatttcaacgagaaaggcaaaatgggcattatgtggatagtcttatgatgatagttgcgagcgttgttcccaactttctaatgggcatcatgaccggtgctggaattcaaggaatcatgcttttactagatgggttctttaaattgccacgactaagatttgcttccaatgaagttggaggaggttacataagtggtgaagatattttaagaaatacatggcaagttgacacgagttactcaaagtgggttgatcttgcaatcttgatagggatgattgttgtgtatcgagttttgtttttggttatcatcaagattaaagagaagatgaagcccgttgttgtatcactatcgtgtatgtcagcgtcttccaagcgaacaatacaggtcatggaaaaccccaacgccactcctttacattga

SEQ ID NO: 88923 - DNA, 930 bp, Glycine max
  Peptide Sequence Number=SeqID_180608
atggagtgcaacaaagatgaggcagctagggccaaagaaatagtagaaatagcagttagggccaaaaagatgacatacgcacttgttgctatctttctcatgtctttggttgttcaagctggaaccttcgtcaacagagtgagaatcaacgaatttgggaggagtttgctggcggttcagagtttttctcattggccgattcgtgaatacaagacaatcacagggatgatggttgatacgggttctatgtcaagtgctggaccccttgttgatatgatgccagagaaagatgatgatggtcgatttgctagtggagggtggaaaagtgaagatggaagacttagctgtggttattcaagttttaggggaaagagagtgacaatggaagatttttatgatattaagacattgaagattggtggccaatcaatatgcttatttggaatatttgatggtcatggtggttctcgtgctgctgagtatttaaaggagcatctttttgataatctcttgaagcatccaaattttttgacagatgccaaattggctataagtgaaacatatcaacagactgatgctaattttctggattccgaaaaggacaccttcagggatgatggatctacagcttcaacagcaattttggttgatagccatctttatgtagctaatgttggagattctaggactataatatcaaaagctgcaattgctctctctgaggatcataagccaaatagaagtgatgagcggaagagaattgagaatgctggtggtgttgtcatgtgggcaggtacttggagggtaggaggggtgctagcaatgtctcgtgcctttggtaaccgcatgctgaagcagtttgtagtagcagaacctgagatccaggtgatccttgattactgtgtgcaatctgagtatatagtctattaa

SEQ ID NO: 88924 - DNA, 249 bp, Glycine max
  Peptide Sequence Number=SeqID_180609
atgtctcctccacctctaggacctcacaatcactcacaaacttatctcaagctctttaatgcgacttcctcttcaagctcaattctctgcggctcatccttctcccagattcttcctcgcgctcagccgaggagtgttgtgctcaacggatggctcgttaagccggaagattggcttagcgagagggtgaaaatcaacacttcacaaacttgcctaattaacctgaaattgagagaaaatgattattaa

SEQ ID NO: 88925 - DNA, 222 bp, Glycine max
  Peptide Sequence Number=SeqID_180610
atggaaatattctacatgctcagtcttctagctattgctgcttctttcttctattttgagtttgtgatgcaagctccattggagcttgtaggcctaggatcttcttcatcaatggattcctttgcttcttggaagataaatggcagcggaatgaagaaggaagagagagaggagacaccacttcaaggagaagatgagtctagaagaagctcaccaccatag

SEQ ID NO: 88926 - DNA, 630 bp, Glycine max
  Peptide Sequence Number=SeqID_180611
atgaaagataaaagggatgaggaggaaaaactagaaaaacaaaagaaaaagaaggatagtaaggccttgtcttcaaaggccaaagggaagggaaaggaggaaaacgattcctccaagaagattgttaagaaggaaaatcattttgcaacaaaaggtgatattaaaagggcactccttcttaaacaatctttctaccttctcctatcaagggaaaaatctcttagcaccgctatacctcttgagcttgaggttattcctcaagtaaaggagttgttggatgagggtttggttcgcaagagcttaaatccttgtactttgttggtgcctaaaataggtattattaggcaccaaatccctatgataggtggtatgatgaatatgttgagtagtgcaacactcttttctaaaatcactcatgcacccaacatcttcatgatttgtgtacatagggactcattaggtaggaataatcaacatgaaaataaagaaaaaggtatgttttattccattactttccttaaatttgtaaatagtgatcaagggcttcctatggaccctaagagaataaaggtcattcttgagtggcctactccaccaagtataagggaaatttggggcttcatatcttag

SEQ ID NO: 88927 - DNA, 1076 bp, Glycine max
  Peptide Sequence Number=SeqID_180612
ggccggtggctcggcaatacgcgaacggtgcaaggctggctttcgcacctgccggcccactaccatcaacgcgctcacaacctgttccaccgccacgggctttccgccctgctggtcggccgcttcctggccttcgtgcgcaccctgctgccgaccatcgccggcctgtccggcctgagcaacgcgcgcttccagttcttcaactggatgagcggcctgctgtgggtcttgatcctgacaacgctgggcttcgcgctgggcaaaaccccgctgatgttctgcctgatgatgttgccgctggtattgctggtggtcgggttgatcggctcgttgatcgtgctgtggcgcaagaaacgcgccagcggccagaacccggggaaaggggcgtgacagcaaagcgcccgcgctggcaatacgtcctgatgatcgcgctcgccctgctggcgttggcgacgctgttggtgccctgcatggtgcgcaccgagagcgagctgcgcattcgcgccagccagcaagggctgtcgctgcccgacggtttttacgtctaccagcgcctggatgagcgcggcatccgcatcaaaagcatcacgccggaaggcgatggcctggtcatccgtctggattcgccggagcagcagttgctggcgcgcgaagcgctgcaaaccatcctgccgcccggttaccacatcgcgttgagcgaatcccccgtgccgtcgcattggccggcgatgaacgccctcctctcgcgctgccgccttcggcagtcaggaaagcggggcggctgcgccgccaaagcgcaagacatccagcagcaaatcgactatgccacccagcacggcaacacccaccgcgtggacgggctgaaaaaagcgctgagcgaagtgcagactcactgcaccgaagccggcctgcaggccgaacgccagaaaaatatcgcggagaaacagcgcaaggtcgacgaacgccggcaggagctgaaagaagcgcagcaaaccggcaagctggacaaggtcgccaagaagcagcagaagctggcggaagcgcaggctgagctgaaacgcgctcaggcggaataa

SEQ ID NO: 88928 - DNA, 558 bp, Glycine max
  Peptide Sequence Number=SeqID_180613
atgacttgtgttgcaaatagttttatgaataattgtggtagaagcaaagttgatcagtcactgtatggtctgttggagcctcaatctatacacaatgctaaggacagacgtgaacaatgccaagaatacattcaaacatgggtcaaggaatcacaaaggcagttgtacttaggggcttacttgcatcaggcacattggcaactatttgttttgtgtccaagggaaaacaccgttgtttggttttgttctctgaggaagaagccagatattaacatcaaagccacaattaacagtgcaatgaagacaataaccagttctttccaaggcatgtctaatcaagctgcacctcggtgggttgaaccaaagtcatgtccaaactggagcgtacgagtgcggatattatgtcatgcattggatgtggtgcatagtgactggtggatgaaggatgactggaacaagtggttttctgatggatcaccgttagacgtggaggccatcaccacacttcgccaaaaatgggcaacattctttttaagtattaggaaaagcggatgctaa

SEQ ID NO: 88929 - DNA, 414 bp, Glycine max
  Peptide Sequence Number=SeqID_180614
atggaccctaagagaataaaggtcattcctaagtggcctactccaccaacaccactcattgagttggtgaggaactatattctctcatgggaagatgaccacgaaaggggtgttgaggaaagaatccatgagtttcaagaacctatggatttgagtagtttccttttatcagtttctgggccaccccctgatattagagggggaccaactgtgcaagcacaaccagagagggaggctatcacgcaactactatgcataccggggcaagatttcacccgtgccgctgcaaagaaacgagtgcggatcatgcgcaccaacatgaccactattacacagatatggatgacgttgctacttagcaacattctgcccagcgaccgtaatgctgatttccacctgcggaactatcagttg

SEQ ID NO: 88930 - DNA, 129 bp, Glycine max
  Peptide Sequence Number=SeqID_180615
cgtctcgatatagtacgtgatgcaatccttcctaggaaaggaccagtcactagagccatgagcaagaggctccaagaggattgggctagagctgctgaagaaggccctagggttctcatgaacctcagg

SEQ ID NO: 88931 - DNA, 487 bp, Glycine max
  Peptide Sequence Number=SeqID_180616
attaagtccgctggtcgattgctcagttgttactagcaatcttggactgatatccgcatttgtggagaggtggcacaacgagaccagcaccctccaccttccagtaggagagttaacgatcacattggatgatgtgtcgtcactccttcatttgcctatcactggcgcgttgtacagttttcatgctctttctatggaggaggtgagatttttgctgacacagttacttgaggtgtctaccgaggaggctagagccgagacagcactgacacgtggggcatacgtacgactaggatgggtattcggtactcgagatgatgttttgcaatgggctcgaatagttgcccatgaaaatggatttgttgcagtgattatgaggtctgacacagagaccggtagcaaaggaagaagttcatttgtcttaattgggtgtgaaaggagtggtacgtacaagtgtatgttagacaaatggcctcagttatcttaa

SEQ ID NO: 88932 - DNA, 1034 bp, Glycine max
  Peptide Sequence Number=SeqID_180617
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctg

SEQ ID NO: 88933 - DNA, 363 bp, Glycine max
  Peptide Sequence Number=SeqID_180618
atgccaatctccccctgcaaaagtatcagttggtctgtgtcgtcccaacatggaatcgcacccacaaagacacccagtgacccgagaagtccaacagggccctggggtttccagctctggttacgggcctctgtagtctacagggtgcccgttccccccgacaagggattgtgcccgcaagacacccagtggacccaaataagtccaacagggtcttggagttgtcaagctctaattacgggtctatgtcagttctacggagtacctgtcacctccagcaagggcatcaagccccctactaatcgagcttttatcaagaagtactgcatccccaggcaggcgcagggcgaaacaccacagtag

SEQ ID NO: 88934 - DNA, 312 bp, Glycine max
  Peptide Sequence Number=SeqID_180619
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagggggaggaagcggggggtcctctag

SEQ ID NO: 88935 - DNA, 1029 bp, Glycine max
  Peptide Sequence Number=SeqID_180620
ccgttccttgaaggcctcgtcgtgttcccagacccggcggttggtggtgtagaccgtgccggtccagtagtcgtggccgaggtcgcggatcatggtcgaaaccgcacgctgcagcgcgaaggccggcagggccgggacttccggcggcaggtaatcgcccgaggtaccctcgccacggatcgcagcgatcggcagcaccaggtcacccagctggttcttgcgcttgaggccaccgcacttgcccaggaacagcaccgccttgggcatcaccgccgacagcaggtccatgatgatcgcggcattggggctgcccatgccgaagttgatcatggtgatgccatcaatggtggcactggccatcggccggtccaggccgatgaccggcgcgccggtcagctcggagaacgtatgcaggtagcccccgaagttggtcagcaggatgtgctggccgaactggtccaagggcacgccggtataccggggcagccagttgtcgacgatttcctgcttgctcttcatgggcggtccggtacggcgggggaccgggtattttcagccacccggccggtgccgtcgagctaccgtcggcaggcctgtgaagaaggctgcaaggggaactgcatggcatcgacgttgttgcgcgctggggtagccctggcactgctttcattgagcacggctccggcggtgggcgcctcgcgcttcgtcgccgatccctactccagcacctaccaggcccatcctgatgcgccgatactgatccagaacgccacggtgctgaccggtaccggccagcgcctggacaacgccgacgtgctgctgcgcgacggccgcatcgtcgccgtcggccgccagctgcaggccgatgccggtgtcacccgcatcgatgcgcagggcaagtgggtcacccccggcctgatcgacgtgcattcgcatctgggcgtgtaccccagccccggcgtcggcgcgcacagcgacggcaacgagatgaccgcaccggtcaccgccaacgtctgggccgaacactcg

SEQ ID NO: 88936 - DNA, 156 bp, Glycine max
  Peptide Sequence Number=SeqID_180621
atggcctccatcattgatggccaatttgctcttttatggcctccatgtcgagccttcatcttctcttgcacctcctctgcttcacccattactctagctctagcacgagttcgaaatgggtttatgatcccaacatggttgggtgggatcctctag

SEQ ID NO: 88937 - DNA, 135 bp, Glycine max
  Peptide Sequence Number=SeqID_180622
atggcggatgaacaccaacagagagttacccttgaggactattcaagcagttcaatgtcgcaattctttaccagcattgcacgtcctaaagagaagccaagaggtggctccactcatttaagggtaacagtctaa

SEQ ID NO: 88938 - DNA, 816 bp, Glycine max
  Peptide Sequence Number=SeqID_180623
atggcatccttcagccacatgcagtcccaacttcagtcgcagatgcaatctcagggacttgcagtgcctcctaaccctctggttggtccctccgatcctcgagtgagcacaaaggggagttgtgttgatccctcaggaaacgatcctaagacgggtgactctgacaggtgcggcttgtacatagaagcagatcctacccgcctggtggccatggggagagtttatgagggatccacagttgttcataacactcctttgttgcctggccaagtaaaggtgagtgtgaaggaggttacagatgcagatgctccagttcctgtacccactgctgaggtttccttagtgaggcaggcacttcacaccttccttgcttggccgacacatctgatcaagtctttatcaaaccaggtagttgtgtctccgccaaaaccacctccgaagcccgatccggaggtcgatgatccgctttatctgatgacattgagcatcccagagcttttcttgagaccttatcaggttagatgggatgccaccgtgttcggggtagttaatccagatttccccctgtacataaagcacgaagacctctctgaaatcgcacacggtggtcaatgtctcagcatatcagtgttacagttgtggattctgcatctcactgaaacatgtatgcgagcggggaattatgatatctatggattcctcgagcctcagtccattcagaggtctgggcaatcacagtttgaatctgaaagttacataaagagttggatgcagagttcaacaacgcgatgtgtatcttggagggggatcctctag

SEQ ID NO: 88939 - DNA, 399 bp, Glycine max
  Peptide Sequence Number=SeqID_180624
atgaaggccgatctatcggccttaaaagatcaaatggcttccatctcgaaggtcatgttaaaactccagaaaaccatagaggataaagccaccgcaaccgcctccagtacagttagggaagcggagccggtgctgcagcccgccttgaatccgggcctagacagaaacacggccgtgttcggccgaaggtatagtccgcaagcttatccttatggcctgcctccggacttcaccccccatgccaacctagaagatttaagccaagcccctacttttgaggggcaactcccaccttatgaagactatcccgggcaagactatggggaaggagatacccatcttggccccctgctccacctcaaagatccatccccgcatgaactaccccagccgaacata

SEQ ID NO: 88940 - DNA, 869 bp, Glycine max
  Peptide Sequence Number=SeqID_180625
ggtacatcctttgtggcacaagtagagggtacatctacttgggttgttatactgagaacaagagagggtacatctcttgtggattagttcaagtggagggtacatccacttggttgttcaaagagaacaagggagggtacatcccttgtggatctttggcttgtaaaggattttacaaggttgaaagaaatcttaagaaccgttcattgcttggggactggattaaaagcctacgcactagcacaacaacacaaaaacctagatataaatggattgaagaggatagaagaagaatccaatataatcttaaagccaaaaacctcatcacctctgccctaggaattgatgaatattttagagtgtcaaactgttcaaatgcaaaggagatgtgggatactctccaacttacacatgaaggcaccactgatgtgaaaagatctaaagaacatgaaatggaacttcaacgcctcaaccaaaataaagagaccgacaaaaggaaaagaagcatagcactcaaagtctcctcctcaatgcaagaagaagaagaatctgatgatgaagaggacttctcactttttgtgaataagtttcataaatttgtcaaaaatagaagaatggagagaagccataacttcaacaatgggaagagatcccaagaagtttctcctacacttaaatgctacaagtgcaatcaacccggtcacataaaagcaaactgccccacaaatgagtcatggcccaagaagaatgagaagaaaagctataaagaaagaagatccaagaaggcgcatattgcttgggatgacaatgactcatccgatggtttggagaaggagatcaaccttctatccaaaggtgggatcctctag

SEQ ID NO: 88941 - DNA, 762 bp, Glycine max
  Peptide Sequence Number=SeqID_180626
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgccatggatagaattgatacgatgcgcgtcttcacgcgtgtggtagcgcgccgcagcttcacaagggcggcggaagacctcggcctgccacgctcgaccgtaacggacgcgattaagcaacttgagtcgcgcctgggcattaagctgctggaacgcaccacgcgtcacgtcagcccgacgctggacggtgaagcctactacaagcgctgcgtttctatactggacgatatcgaggggtaccgagctcgaattcgtaatcatggtcatagctgtttcctgtgtgaaattgttatccgctcacaattccacacaacatacgagccggaagcataa

SEQ ID NO: 88942 - DNA, 312 bp, Glycine max
  Peptide Sequence Number=SeqID_180627
cttgggaggattgatggggacctggcgttgagaggaacgaggataagggctatgtgggagtacgtgagctcagttgagagtggtacctggagatatgtcgcgggggtcaggagaccttggggacgtcaggcgagctcctggcagtcaacagataaaaggaacgaagaccacaaagcaaggaggcttgtgtggtggctggccagctgtgaactttgtttgatatatgggatatggcctctggtaatcgattaccaagggcttgaaaacgaggtcaggaagctaggagggcttctggtaatcgattaccaagcg

SEQ ID NO: 88943 - DNA, 1054 bp, Glycine max
  Peptide Sequence Number=SeqID_180628
gtcgactctagaggatccccggagccgccgtgcggatccgacccagggtcagatccgcaaaggggctctgacccggcgcaacaggacatcgcctgtccggaagtacatgagcatcgaacagctggctgaaaccgcccaggccatggttgccccgggcaagggcatcatcgcgatcgacgaatccaccgctaccatcgccaagcgtttcgctggcgtcggtatcgagaacaccgaggagaaccgtcgtgcctaccgcgaactgctgctgaccacgccgaagctcaacgagcacatttccggcgccatcctgtttgacgaaaccatccgtcagtcgaccaaggacggcgtgccgttcgccaagtacatggccgaccacggcatgattccgggcatcaaggtggacaagggtgcgcacccgctggccggctgcccgggcgagctggtgaccgaaggcctggacggcctgcgcgagcgcctgcaggagtactacaagctgggtgcgcgcttcgccaagtggcgtgcggtgatcaacatcggcgaaagcattccgtcgggcacctgccatcgagtccaacgcccacgcgcctggcccgctatgccgcgctgtgccaggaaatgtggcctggtgccgatggtcgagccggaagtgatcatggacggcgacacgacatcgagacctgctacgaagtcaccgaagccaccctgcgttcgctgttcgacgccctgccgacgtcgaggaagtggccgagtcgaccgtgatgtgcctgaagagcaccgtgccggccatcctgccgggcgtggtgttcctgtccggtggccagagcgacgagcagtccaccgagcacctgaacgcgatgaaccagctgggcaacctgccgtggccgctgagcttctcctacggccgcgccatgcagcaggccgcgctgaagctgtgggccaaggacatgaagggcaactacgctgctgcccagaagaccgtgtacgagcgcgccaaggacaacggcctggccgcgctgggcaagtggagcggttgatccgtcccatcgctggatga

SEQ ID NO: 88944 - DNA, 180 bp, Glycine max
  Peptide Sequence Number=SeqID_180629
atggtgcctatttataccaatcctagtctaaaatttcaattgaaaattattgtgaaaacaagtgccaaaactagagggaattggaaaggaggattggtgccatatcttgaaggatttgagtcaagaaggaaggggccaaccaccttaggagctattggactaagaagcactccaaattga

SEQ ID NO: 88945 - DNA, 519 bp, Glycine max
  Peptide Sequence Number=SeqID_180630
atgtcgacggtggctttggtggttgtggggagcatggtggtgggtgtggcggcgggcgtcgacgccggtgagaggcagagcaaaaggctgaggggcgaagacgcgaacgacaacgagaatgacgacatgtgtggcttcattacagagcttccatgggaagctgccatgggaagtgatgctggcttgggtgtgggattaggtggcttgggtgcggggtatggaatcggaggcagcataggaaggggaggaggaacatcggacggcggcggtgatcgctgggctgaagaaggaaacagtagtggcggcggcagcggcggttgtggtggcggcaccgatgaaggaaacggggatcgttggcgtaatatcatggtatccaattgctggctaatgagatcgagtttgaagagcatggatgtgtggaacgcgtcaagtcggaggctggcagcggaaggtgcggcatctgccattgaagagcggagaggagggcaggtcggaccaattgttatgaatagtaactag

SEQ ID NO: 88946 - DNA, 3207 bp, Glycine max
  Peptide Sequence Number=SeqID_180631
atggctgcaatatcatgttcctatgtattcacctatgatgtgttccttagcttcagaggctcagacacacgccatggttttgttggcaatctctacaaagctcttaatgacaagggaatccacactttcattgatgatgagaagcttcagggaggagaggaaataacaccaacacttatgaaagcaattgaggagtcccagattgccatcactgtgctctctcacaactatgcttcttcctcattttgtttggatgaacttgttcacatcattgattgtaagaggaaaggtttgctggttttgccggttttttataacttggatccttctgatgtgagacaccagaaaggtagttatggagaagcattggctaggcatgaggaaaggttcaaagctaagaaggagaggttgaaccaaaacatggagaggttggagaaatggaagatggctttgcatcaagtagctaatttgtctggatatcatttcaaacaaggagatggatatgaatacgagtttattgggaagattgttgaaatggtttctggcaagactaaccgggctcttttacatattgcggattatccggttgggctagagtcacaagtattagaagtagtgaaacttttggatgttggagctaatgatggtgtccacatgatagggatccatggaattggtgggataggaaaaacaacacttgctctagcagtttataattatgttgctgaccattttgatggttcgtgttttcttgaaaacgtgagagaaaattcagacaaacatgggttacaacatctccaaagcatcattctttctgaattggttaaagaaaataaaatgaacatagcaactgtgaaacaaggaatttcaatgatacaacataggctccagcgaaaaaaggttctcttgattgtagatgatgttgataagcctgagcaattgcaggctattgttggaagacctgattggtttggttctggcagtagaatcatcatcacgacgcgcgacgaaaaactgctggcatctcatgaggttagaagaacatatgaggtgaatgaattgaacaggaatgatgctcttcaattgctcacatgggaagcttttaaaatgcaaaaagttgatccaagttatgaggagatgttgaatcgtgtggtaacttatgcttctggccttccattggctttgaaagtaataggttccaacttgtttggaaaaagtatacaagaatggaaatctgctatcaatcaataccaaagaattcctaataaccaaatcttaaagatactcaaagtaagttttgatgctttggaggaagaagagaagagtgtttttcttgacattgcttgttgcttcaaaggatgtgaattggaagaggttgaagatatacttcatgctcattatggagactgcatgaaatatcatattggggtgctgattgataaatccctcttaaagcttagtgtgcatggtacaatggtgacattgcatgacttgatagaggacatgggtagagaaattgtacgacaggagtcaccaaaagatccagggaagcgcagtagattatggttccatgaggatataattcaagttttagaagataacacaggaacaagtgaaattgaaatcatatgtctgaatttccccttacttgacaaagaagatatagtagaatggaacagaaaggccttcaagaagatgaaaaacctcaaaactctgattattaaaagtggtcatttttgcaaaggtcccaggtatcttccaaatagtctaagagtattggaatggtggagatatccttcacatgatttaccatctgattttcgttcaaagaaacttggcatatgcaagttaccccattgttgttttacatcacttgagttgaaatttatgagtatgagagttttgaatttggacaaatgcaaatgtttaacacagatacctgatgtatctggtctcccaaatttagaaaaactttcatttcaacactgtcaaaatttaactacaattcacagttcaattggatttctatataaacttaaaatattgagtgcttttggttgcaccaagcttgtgagttttccacccatcaagttgacctctcttgaaaaactcaatctctcgcgttgtcatagtcttgagagttttccagaaatattaggaaagatggaaaacataagggaacttcagtgtgaatacacttccataaaagaattgccatcttcaattcataatcttacccgacttcaagaattacaactggctaactgtggagttgttcagttaccaagtagcattgtaatgatgccagaacttactgaacttattggttggaaatggaaagggtggcaatggctaaaacaggaagagggtgaagaaaaatttggatcatcaatagtatcttcaaaggtagaattgctttgggcctcagattgcaacctgtatgatgatttcttttcaataggtttcacgcggtttgctcatgtgaaagatttaaacctatcaaagaataatttcacaatgcttcctgaatgcatcaaagaatttcagtttttaaggaagcttaatgtgaatgactgcaagcatcttcaggaaattagaggcattccacctagcttaaaacatttcttagcaacaaactgtaaatccttgacttcctcaagtacaagcatgttcctgaatcaggaactgcatgagactggaaaaactcagttttatttgccaggagaaaggattccagagtggtttgatcaccaaagtaggggaccttcaatttctttctggtttcgcaataagttccccggcaaagttctttgtcttgttattggacctatggatgatgactctggaatgttaatatctaaggtgatcatcaatggcaataaatatttccgtggtagtggttatttcatgatgggaatggatcatacatatctttttgatcttcaaataatggaatttgaagataatttgtatgtacctttagaaaatgaatggaaccatgcggaggttacatatgagggtttggaagagacctcaacccctaaagaatgcggaatccatgtattcaaacaggaaagtagcatgaaggatattcgatttgctgatccttatggcaagagaaaattaggcaatgatcgcaacagtttggaatcacaaaaccaacaattgctaaaaaaacataggtttgtggacatggaagtttcatag

SEQ ID NO: 88947 - DNA, 288 bp, Glycine max
  Peptide Sequence Number=SeqID_180632
atgaaaacagaggcagcactggtgcaagaccagactgtatctaacattgaagaagagcacattgttaaagcaagctcaagccatctgacgcctaatcacagtagcgctttgccacgtccattccacctgccttatggtgaggttagtaggagttttgttgtcagatggaaaaatgacttagatgatacttggcatcttttatacaaagatgacaacgcaaaggttggaagttacatggaagttacaaaaacttccatcaacggttggaagttacatggaagttactaa

SEQ ID NO: 88948 - DNA, 79 bp, Glycine max
  Peptide Sequence Number=SeqID_180633
atggtgatggaggagcaagaagaaaacgtaggggaagaaggagaagaggctggaaatttctggaggaaagagagagaag

SEQ ID NO: 88949 - DNA, 339 bp, Glycine max
  Peptide Sequence Number=SeqID_180634
atggctgagaagacaaataaaatactggaagaagctgcccagtccggaagcactgagggcatcattgaccctccatctcccatcagacgccacgtgaagtggaagctggcccgcaccaagaaaactgggcagatgacgtctgaggcagcaaaggaaatagctgagaagattgattctttggatgagcaggcgtcacagggatcgttcgtccccccatggatgtcaagatgtcctaactgctgccattgggcaaccagagcaccctggccgggtccgtgccgctggagccggtgtcaccataaagcaatacttcggatcggctccacgaatgtcgtgtag

SEQ ID NO: 88950 - DNA, 192 bp, Glycine max
  Peptide Sequence Number=SeqID_180635
atggtgccaaaaacttgttcgaacccggcaagtgcaccggattgcgcaagtagtataaaacgcctaatcctgatcaaacatcatcctcagattcctcttgttagactaaactcgaccagaaccgcattaagacaaacatacaaacaactaggttaccataccccgatccctcctgataatacgataaactag

SEQ ID NO: 88951 - DNA, 636 bp, Glycine max
  Peptide Sequence Number=SeqID_180636
atgagtcttcattcttcatctagtgttaatggtgagggttctactcctaaggaccccttgtataagatattagatgagttgagatcccttaagttgtggaaagaaaaacaagagagaaaagaaaaaggtaaaaaaagagtggaagaaataagtcaagatgaaagagagaaaataagagaggaagaaagaagaaaaataatgaaagaaatgaaaagagaaaaacatgtctcctatagtagtcataactcttgcaagagcctaagtgaagaacttcgtgactattatgaaggaaggcataggtcacatcttagacctcactcccataggatagaaaatgaaagaaagcctcaagaggttaacattaaactcccatacttccatgggaaggacaatgtagaggctaatttagattgggaaataagggtagagaaacaacttaaaaggaagtctacttcaaaatcttatggctctcactcttatccaaagaaagaccaaggtcaaggcatcttaggaggacatattacttctcaatgccccaccaagaaaaccatgattatgaggggccaagacatttatagtagccaagatgaggctactacttcatcttcctctagtggaagtgaagaagcaaaatag

SEQ ID NO: 88952 - DNA, 462 bp, Glycine max
  Peptide Sequence Number=SeqID_180637
atgggtgactctgacaggtgcggcttgtacatagaagcagatcctgctcacctggttgccatggggagagtttatgagggatccgctcttgttcataacactcctttgttgtctggccaagtaaaggtgagtgtggaggaggttacagatgcagatgctcaagttcctgtacccactgatgaggtttccttagtggggcaggcacttcacaccttctttgcttggccgacacatctggtcaagtctttatcacaacaggtagttgtgtctccgccaaaaccacctccgaagccccatccggaggtcgatgatccgctgtatctgatgacattgaccatcccagagcttttcttgaggccttatcagtattttaacgaccctagaccattggagcctgagagattaaaagcattgcggatccagtgggcacagttttatctccgagttagagatcaggcctag

SEQ ID NO: 88953 - DNA, 240 bp, Glycine max
  Peptide Sequence Number=SeqID_180638
atgaaccccaaggaacgttggtcccttgtgtctagtgataacaaccaagaagtgacacccacttcttgcaatgaacccaaaaaagacgttggtcttttgtgtctagtgatcaaccaagaagcaaatcctgcttcttgcaatgaacccaaggaacgttggtcccttgtgttcaatgttttcaagagtaggtctcttgaaaagctttttgtaagaatggaggagaggaagaaaatagaatag

SEQ ID NO: 88954 - DNA, 402 bp, Glycine max
  Peptide Sequence Number=SeqID_180639
atggatggcaagaggtcttcgtacgtcattgggagtaggggggcctccctatggacgggcgcgggcgccctaggttgtatgggtgctgagttagaggagtccccgacgcaagctgagaagctcggttgctccaatcctcctagcgttggtacctgtggaggagacataatcgaacttccctctcttcaagcccacttcgatcctttccccggcgaataccaagtctgcgaagctggagggcatgtccctccaacgctgagcgtactctttaaaggacttgctttcccttttaaccatgttctgcagctgagtccgatcggaagccatatcagagttgtactgatactgcctaaggaaggcggtaatcagatccttccaagtgcggatgcaggaagcttctag

SEQ ID NO: 88955 - DNA, 753 bp, Glycine max
  Peptide Sequence Number=SeqID_180640
atggacctgaacgaatcccgccgcctctaccagcaactcgccagcgaactcaagcagcgcatcgaagcgggcagttatgccgtgggggcaaagttgccggcagagcggatgattgcggaggcgcaccaggtgagccgcaccgtggtgcgggaagcgatcatcatgctggaggtggaaggctacgtcgaggtgcgcaaagggtccggcattcatgtgatcagcgaccagccacaaccgcgcgacagcgccgccgatcagctggagtttgccagctatggcccctttgaactgttgcaggcgcgccagctgattgagagcaatgtcgccgaatttgccgccacgcagatccgtccacaggacatcgtggcgctactggcaattcaggaaaaagcccggcaggaagatcatgcgcgcgattcgacatgggatatggagtttcacgtgcgcattgcccaggccacccaaaacagcgcgctggctgctatcgtagagaaaatgtggcggcaccggctgcataatccttactggctcaagctgcacgagcacattgacgcacgccatatcaccagctggtgcgacgatcacgatcagatcttaaaagcgctgatgcgcaaagatcccgccgccagcaaactgacgatgtggcagcatctggaaaatactaaacagatgctgttcgacgccaccgccgatgatttcgagttcaacgttgaccgctacatgtttgcagaaaatccggtgatcctgccctga

SEQ ID NO: 88956 - DNA, 265 bp, Glycine max
  Peptide Sequence Number=SeqID_180641
tcattcatctaggccagcaatcgctcactggctcaagcagcctacccgggttcagtacgggccgtaccatgtgaacccctatttggccttgctccgggtggagtttaccgtgccacggactgttgccagccgcgcggcttgcgccccccaggcgttacctggcaccctgccctatggagcccggactttcctcccctctgcccgtctcccccgaaagggacgacgacaaagcggcgactgtctggtcagcttcggcgcgggataa

SEQ ID NO: 88957 - DNA, 72 bp, Glycine max
  Peptide Sequence Number=SeqID_180642
gaatttcgcaaaggtttcaaccgttcttcgacgttcttcattcgttcttcatcgttcttcgatcttcaacgg

SEQ ID NO: 88958 - DNA, 279 bp, Glycine max
  Peptide Sequence Number=SeqID_180643
gacagggatggaaattctcatcctgggtcaaggtttatggtggtttgaggtcttgggtcaaaaggcttgcagaacggccagacatgatgtatgtcaaggtgttggtattttgctacctaagcatattgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgagatctacgaactttttagtgaaag

SEQ ID NO: 88959 - DNA, 1332 bp, Glycine max
  Peptide Sequence Number=SeqID_180644
agcactgcacaagtcctcgccttcagagggacgcacgccctcaccttcagagggctgcttgccctcgccttcagaggactacacgtcctcgccatcagagggctgcacgtcctcaccttcagaggacaacacgtcctcgccatcagaggactacatgtcctcgccttcataggacaacaagtcctcgccttcagaaagctacacgcccccggcttcagaggactacacgtcctcgccttcagaggcactacacgtcctcgccttcagagggctgaacgccctcaccttcagagggctacatccctcaccatcaagggctacatgcccttaccatcagaaggactacacgccctcacctttagagggctacatgccctcaccttcgaagggctacatgcccttaccattagaggactacacgtcctcaccttcagagggttgcatgccttcaacttcagagggctacacgtcctcgccttcaaagggttgcacgtcctgccttcagaagggctaccacacgccctcaccttcagaagactacacgtcgtcaccttcagagggttgcatgccttcaacttcagagggctacacgtcctcgccttcagagggctgcacgtcctgccttcagaagggctactacacgccctcactttcagagggcgacacgtcgtcaccttcagagggctgcacgccctcaccttcagagggctacatgtcctcgtcatcagagggctacacgtcctaaccttcagaggactacacgtcctcgccttcagagggctgaacgccctcaccttcagagggctacatgccctcaccttcaaagggctacatgcccttaccatcagagtactacacgttgtcgccatcataagactacacgtcctcgccttcagaggactacacgccctcgccattagaaggctacacgccctcgccttcagaggactacacgtcctccccttcagaggactacacgtcctcaccttcagagggctacacgtcctcaccatcagaggactacacgtcctcgccatcagagggctgcacgccctcaccttcagaggactacacgtcctcgtcatcagaggactagacgtcctcgccttcagaggactacacgtcctcgtcattagagggttgcacaccctccccttaagaggactacacgccctcgccatcagagggatgcacgccctcacctttagaggactacacgtccttgccattagaaggctgcatgccctaaccttcagaggactatatgtcctcgccatcagaggactgcactccctcacctatagaggactgcacgtcctcaccttcagagag

SEQ ID NO: 88960 - DNA, 714 bp, Glycine max
  Peptide Sequence Number=SeqID_180645
aagctcctggctgagaagacaaagaagaagctggaggaagctgcacagccaggaagcgttgatggcgtcatcgaccctccatcctcggtcagacgccacgtgaagtggaagatggcccgcacgaagaaaacaggggagatgacgactgaggccgtaaaggaaatcgctgagaagatcggatccttcgtcccccatggacgtcaggatgttctcactgctgctattggacgtccagagcaccctggacgtgttcgtgttgctggggccggtgtcaccatcaagcaatactttagatcggctccacggatgtcccacagctcttcctccctgcctcctgaagaattgcaacagttgacccagcaaatcagggaccagctagaggagtccatcacagaaaaagtgacgcggcagctcatggcatccttcatcctggtgcagtcccagatgcaatctcagggacttgcactgcctcccgagcctctggttggtccctctggtcctcaagtaagcacaaaggggagttgtgttgatccctcaggaaacgatcctgagacggctgactcagataggtgcggcttgtacatcgaagcagatcctgcccgcctggttaccctggggagagtttatgagggatccactgttgttcataacactcctttgttgcttagccaagtaaagatgggtgtggaggaggttacagatgcagatttctag

SEQ ID NO: 88961 - DNA, 429 bp, Glycine max
  Peptide Sequence Number=SeqID_180646
atgagggtttttaaccgctgtggaatgcaagaggtgcagttgtggagtgatactgagggccctccaaagggttttgtaggggtataccaccaactgcttgcccttcagtggtatatccgagccaaggctcgaagtcgtctagattgtgatggggaatttcatgggtctcttccacagtttaagagacatgtgcatgatcagtttggggttgctggctttcaatgggccggatggggacgtcgggttcaccttagcaacaacgctggtagcggcaatgcaaccgcattggcttccattatcttcttcacgctcatcatggcctccatcattgtggccattttctctttaatggcctccatgtcggccttcatcttctcttgtatctcctctacttcacccattactctagctctagcacgagttcggtaa

SEQ ID NO: 88962 - DNA, 219 bp, Glycine max
  Peptide Sequence Number=SeqID_180647
atggatgatgttgctacttcacaaccttcttcccaacgaccaccactccaatctccccctgtcgaagtggatcacacccgcaagacacccaatggacccgaagaagtccaacagggccctggagttctagctctgattacgggcctccgtcagttctacggagtgaccaccacttcgatctccccctgccgaagtgtcaactggtttatgccatcatga

SEQ ID NO: 88963 - DNA, 312 bp, Glycine max
  Peptide Sequence Number=SeqID_180648
atgaagaatgatgaagaacggtggaaatcttcacgaaatcgcttcacggaaacaatttttctcattaatttcaagggaaaagagggaggtggttgccgcccagctcgcccaggcgagctgggttgcttccaccagaaggcaccgccttctgttggaacaccctggaagtgtcatgaaactttatggattatgcaacaatgcttgctttcgacatctagaatattacagaactttatggattgcgcaacaatgcttcctttcgacttctggcatgtcgcagaacttcacgaattgcctaacgatgggtgttaa

SEQ ID NO: 88964 - DNA, 462 bp, Glycine max
  Peptide Sequence Number=SeqID_180649
atgttgctaagtagcaacatcatccatatctatgtgagggtggtcatgctggtgcgcatgatccgcacccgtctccttgcggcggttcgggcgaagtcttgcctcgccaggggcctgactcctcctttggctgtattcgcactgctggccctctcccaagatcagtgggtgtcccaagaactaactgagggcatctccataaaaaggaatccactggcccctcacccaggagcatatatcttaggccccctccacggtaggccaggcattagcgtagaactccatgactatctcctgatcaaatttagccatgggtgtcacaagcggtgcccagcgcctgcgggctatctctccttgaaagttaggaaactcatcgtccctcagttggacctatctctctctgaggaacgaccatcccttgatggtcttgaaacgctcttggtgttctgcgctccagaaccg

SEQ ID NO: 88965 - DNA, 153 bp, Glycine max
  Peptide Sequence Number=SeqID_180650
atgtgcgctagaagttggttgtggagtgctgaaaatacgggttctatgagctataaagttgttgctgaatgtgctaatgtaatgaatgaaatggtttcagatgatgaaggtgaaatgatgggtgctgctagtgtcactaatttggaggaatga

SEQ ID NO: 88966 - DNA, 276 bp, Glycine max
  Peptide Sequence Number=SeqID_180651
atgatgagtgtcacaacctaccctttgacggagggcgaggcgaaaagaaaaaaggagcgtcttccaaaaaaggaaaacgtgtgggagtcgccactaacgtttattcgaggaaaacattataaaaaaccaaaaagaaagttgttaactttcaatccctctaagagacaactttacggcgctaatgatcggttaagattaaactttacaaaagaaaggagattaccgatgatagaagaaggagatgaatatgcacaaaacaacaaaggggacccctaa

SEQ ID NO: 88967 - DNA, 327 bp, Glycine max
  Peptide Sequence Number=SeqID_180652
atgtcaatccttaccctcggaagcaaaaaagaaaagaaggaaaatttccaatcaaagaaaaagagaaggaaaatttccaatcaaggagaaagcaaaaaggggagagaaggaaaatttccaatcaaaggaaaaaaggaagcaaggaaattcccgatcaaagagcgggagaaagcgaaaagaaaggaaaggaaattccaagtcaaagaaaaaagaatgggagaaagtaaaaaaaaaaagaaaactcctggtcaaagaaaccagaagaaatgtgcagagaggtctttggaccggacaatatctgaacaatacagaattgtcaccacatga

SEQ ID NO: 88968 - DNA, 51 bp, Glycine max
  Peptide Sequence Number=SeqID_180653
atggcatcaaggtcggaccaagggtcgggcctccaccgatctactgataag

SEQ ID NO: 88969 - DNA, 444 bp, Glycine max
  Peptide Sequence Number=SeqID_180654
atgaatgctctcctagaacctaagtttttgcatcttagaaaaaccatgaattgtttgcagcccagcctcattacaagccaagaaagtccttcagattcaatttgtgtgccaaaagaagagaaggttattgcagctggtgtctcgctaagcgaggcacacagctcgcttagcgtgttgggaaaccctagaagaggatcagccagagagatgcacgctccgctagctcatccagtgagtcatttgtcccttctcgcatttagcgcgcccagctcgctaagccaaaattcactaactcgtgagcgagccttcagaatctacaacatcaaggagcctttaaaacaccgaagtggacgtaaaataagagaggagtcgaaaaatagagcaagaaaagaagctagaacgatagaacctcagcctccaagaaagtttaggttagaggagtga

SEQ ID NO: 88970 - DNA, 189 bp, Glycine max
  Peptide Sequence Number=SeqID_180655
atgactaaagcacgtcaaaagggggtacggaaagaaaaggaaggagatgcttgccacccagctcgcccaggcgagctcagctcgtctaggcgagctaggttgcttcctccagaagcaatcaccttctggaggaacatcctggaaggcccaagtgggcctggttgctatttgaacccccatttttactaa

SEQ ID NO: 88971 - DNA, 306 bp, Glycine max
  Peptide Sequence Number=SeqID_180656
atgtctcagaaaaatgacgatctcggactcattcaccgttggatcgtcgtgaaatttgagcaccacattcgcaacccaattactagcattctcaccgttgggaatttcaatgttatgtctgagctaagagaaatacccctcgcattggagaaaaataaatcgcatggtgacagtacaagtggaggcttcaatcccttctctgtctctttgacgtttgggaactctatcgaagcagttagaggaaaaaattggaggaatctcagggaaccactagagatgctgctattgctggctgaagacacgtga

SEQ ID NO: 88972 - DNA, 339 bp, Glycine max
  Peptide Sequence Number=SeqID_180657
atggagtgtcttccaaaaaggaaaacatgcaggtgtcgccaccaacgtttattcgaggaaaacgttagaaaaaccaaaaagggatctgtgaattttgaaaataagggttcgagagttgtttacgcatggggaagcctaaagtcttttggtggcccaagtgagccaaaggctagcctgggcgagccagggtctaggaaactcaagaaaaagacctttttgcccccatttttggtatctttcgcattcttgatcaaaacattgaatgatctttcattttgtgcgataactagtgtcgaacaacgccagtcgactagcaaggatcaaaagatcaacgaatga

SEQ ID NO: 88973 - DNA, 798 bp, Glycine max
  Peptide Sequence Number=SeqID_180658
atggctaccgcgaagataggactcggagttggtcccgtcccaacaaccactcaccgagtcaccgccgtcgccgcttcttcctccgccgcattctccccgccgccgcaccgcctcttcttcctcaactcgagccggccgcccctccgacctcgccccctccccctccgcgtcgccgccgcgtcctcctccccctccgtcgccgcgccaggaaaaggagttgagaatgtggtaattataggttcaggccctgcaggatacacagcggcaatatatgcagcacgtgccaatttgaaacctgtggtgtttgaggggtaccaagctggtggtgtccctgggggacagttgatgactacaactgaagtggagaattttccaggattcccagatggcataagtggacctgatctgatggataggatgcgacggcaagctgaacgttggggtgcagaattgtatcaggaagatgttgaagttattgatgtgaaaagtagtccttttactgtccaaagtagtgaacgtaaggttaagagccatactgtcatttatgctactggagctactgcaaaacgacttaggctaccacgagaagatgaattttggagccgaggaattagtgcttgtgcaatttgtgatggagcatcacctctcttcaagggtcaagttcttgctgtcattggagggggggatacagctacagaagaagcattatacttaacaaagtatgctcgccatgtgcatttacttgtacgtcgggaccaactgagggcttccaaagctatgcaagataggtgtgtctga

SEQ ID NO: 88974 - DNA, 408 bp, Glycine max
  Peptide Sequence Number=SeqID_180659
atggcggtttttcatggcggattttcgaaaaaacgccaccgaatagcggtggcgtggcgggtttgggatggcggtcgtggcggggtggcggaaatggcggaaattcgtttggcttttgtccgcgcttgcgttcagaacagcctgcctgcgtccctccaacagcttgccttcagaacctcccctgcctgcgtccctctcgcaccccgccgcacccagccgccaccgcgacaccaccccttgctcgcagttcgcacgcgcatgcatcgcgacgaggcccgcaacgcacgaacggcgacgacgagctctgacgacgagccccagcaacgcacgcatcgcgacaccaccccttgtttctgtctcgcgaaggaagaagacgaagaagaggaagaagacgcgtgggtcagctga

SEQ ID NO: 88975 - DNA, 516 bp, Glycine max
  Peptide Sequence Number=SeqID_180660
atggttgaaaggaagttatttcatctaacttcaatgagcttgtcatggatacatgacaaaaatatgcttcgtgagctatgggcagaagcaattcagtgtgcctgtcatattgagaaactcatggatggatactttgtttctctgtcaaagtatgctaaaaatctgttaaatcaataccagatgaatgaagcaaaggaggtatgtaaagaagacaggagaatttgggctgaagtatggaagacacaaagtattgggaaaatacccaagtctcatatcggctggctcaatccttggagtgtagcttatatacctgttggacaacttcacttaatgtcaattggttttgagatgaaatctaacatggtatcaaagcgggctctaacctgggacctcgccttcgcttccgctgcgacgagcacccatcatttgtggttcacgcaccaagataggaggtcaacctcaagccattgtttcttgtttggttcagtagctattacatggtgtagcgggaaataa

SEQ ID NO: 88976 - DNA, 522 bp, Glycine max
  Peptide Sequence Number=SeqID_180661
atggctaagctcatggacaattctggaaggaggttgagttgtatagaggcactgaacgaaggccaattcgctaagcgtaccatcttcaccttcaaactgagcgaggagttgagttttttgggagtttttggctgtggagcaactaagaaagaactaagcttgaagaggaagccgtcttgcagaactttggatgagattttgagagattgtgagaagcttccccgctatggagagctaaatcctcagttggttcttcctatggggaacgttggtcccttgtatccagtgataacaaccaagaagttatacccacttcttgcaatgaacccaaaagacgttggtcttttgtgtccagtgatcgaccaagaagcaaatcttgcttcttgcaatgaacccaaggaatattggtcccttgtgttcaatgtttgtaaccaagaagaccttctcttgaaaatagtcaccaagagtaggtctcttgaaaagctttttgtaagattggaggagaggaagaaaatagaatag

SEQ ID NO: 88977 - DNA, 504 bp, Glycine max
  Peptide Sequence Number=SeqID_180662
atgtcagagctggttgtcgatgtctcagatagggctacctacgaaggtgtgagactcgttgagaagtcaacaatcagagatgttacaaatgatattatagcaaacctctcttccagtacggtgcaattgaaggatgaattaggcgaaagccagtggcatgtaaaccctggcgaatcacaccagaatgagagggatctagaggttgtacaaaaagagtcattgatcataagagcaatcaaacaatgtcagagttggttgttgatgtctcgaaaagggctacctatagagaattttaatcggtggatgattttgaccaacgaggagttgagtgaaatgtcatggtgtgagagtgatatgaatgccaatggaatggagaaggaagagagagagaggagacgtcacgtcaaggagaagatgagtctagaagaagctcaccaccataggaggccatggataagagcttggaggaagaaggagatgaatgaagggagaggaagagaataa

SEQ ID NO: 88978 - DNA, 576 bp, Glycine max
  Peptide Sequence Number=SeqID_180663
atgcaagaaaatttgaagaaactgaaagaggtgaataggaatcttcgtaaggagattaggcagagaatgggagattgtatgaatgatctaggcttagaagatctcaagctccttgaggaagaaatggacaaggctgccaaggttgttcgtgagtgtaaggcaacgaaatttaatgatgttaaatcaagcaaaggctctccatactggatggcccttgaggtttctaacttaaagaaccaaggtggttatgggctagcagttgatatatggagcttagggtgtacagttttggagatgttgacaaggcagcctccttattctgagttggaaggagtgctgcctcctatagcacaaaagcacgtgattcaactcatactttctcacgaaagaaacttcagggctgatgagctaatggagttctacaaaagttactcccaacaagctgtttccaagggtcacaaagcagtagctatattgttgtgccaactgccaatgctcaccctcaaagttgaggctaaatttcagctagaagttataaatatgcggagaaaaaaatcagttaaagaatgcaagtga

SEQ ID NO: 88979 - DNA, 243 bp, Glycine max
  Peptide Sequence Number=SeqID_180664
atggtggttgtccctccttcaacgaaatggcataggggtgggaaaccttgtaaaaccaagacagatagtcaggggtgcaaacccaaggactcctacatggcacaacatcacccagaggaacaatgtattgctgccacttcgctcacgcctaatgacaaagctgatatgtcagacgtcagtcccgcatttgatgaagtcagagaaaagggtctcttgtgcgaaaggcctcacacccctatgtag

SEQ ID NO: 88980 - DNA, 489 bp, Glycine max
  Peptide Sequence Number=SeqID_180665
atgtataggatattagatgagttgagattccttaaattatggaaagaaaaacaagagataaaagaaaaaggaaaaaaaatagtggaagaaataagtcaagacgaaagagagaatataagagaggaagaaagaagaaatgaaaagaaaaaaaaacatgtctcctatagtagtcgtgattcttgcaagagtttaagtgaagaacttagcaactattatggagggcgacataggtcacatactaaacatcactcccaaagaagagaaaaggatagaaggcctcaagaggttaacattagcctcctatatttccatggaaaagatagtgttgaggcctacctagattgggaaatgaaggttgaacaactctttgcttgccatcatattagtgaagagagaaagttccattggctacccttagatttcaagggtatgccctctattggtggacttccctcgttagggaaagaaggattcatggggatcctctag

SEQ ID NO: 88981 - DNA, 874 bp, Glycine max
  Peptide Sequence Number=SeqID_180666
gattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataagtaaatacgttaaaagtagtggtatttcactttcgctgtttccagctcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 88982 - DNA, 139 bp, Glycine max
  Peptide Sequence Number=SeqID_180667
atgacccttccatcacccattaccttacaccaccaaaccacgcttcctttttctacgacctccactttaactccaaggaaatcattctctcaacgcgattgccgccatgactttcggttcatcaactggctcaagcaag

SEQ ID NO: 88983 - DNA, 321 bp, Glycine max
  Peptide Sequence Number=SeqID_180668
atgtcaaagaattgggtgttcaaaaagcataacaagacgttctgtgattgcaacaccggtgtgcgcaccgatgatataggatttacgttggtagacctaaagaaacttggttaccacaatgaccctttcatcatggcagaacaagctagacaaggcaaaacaattggtgttaatgtagaagatgatgattcatacatggacacctatgttagtcctttgaccgctcaaatcactgctaacgttgtcggagagaagaagctgacgacgttcatgctaatcgaaatgatcatgatgaaggagaaattgattaacatcggctaa

SEQ ID NO: 88984 - DNA, 360 bp, Glycine max
  Peptide Sequence Number=SeqID_180669
atggttacccgcacctttcatcaaccaggggcaaacgagcccattgacgtgcagagactaacatcgtcttctgcaacttttgccatccaaggacaacgagtcaggtggcaggcggtgataccttatggtcatccgcacctttcgtcaactgaggggaacgaattcgacgttatcaggatgatgttttactctcgtcgtccgaaaacattcaagcccgatgacgcgcgagattcttctctgttgggcgagggcgatcgagtgcgatggcgtagggaagtgtggtggttgtccaactttgccgctttcaagacactaaagtttgttgacgcttctgatgcctttgcttttctttctgaatga

SEQ ID NO: 88985 - DNA, 323 bp, Glycine max
  Peptide Sequence Number=SeqID_180670
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccagagtgagagtggtttgatgaagccgttaataaaaccgcgggcggggaaaacaaacgttaacgagaggcgtgttgtaatttga

SEQ ID NO: 88986 - DNA, 96 bp, Glycine max
  Peptide Sequence Number=SeqID_180671
atgatgcatgcacctgacctcaactttcagatgcaatgcgtatttgtcgaggccacccagtcatgccccgtaactcccccccccccccgtaggtga

SEQ ID NO: 88987 - DNA, 291 bp, Glycine max
  Peptide Sequence Number=SeqID_180672
atgggtccagaactgaccggctcgcacgtgattggtctcgagcgtggctcatccaccattttatcacggcaaagcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 88988 - DNA, 153 bp, Glycine max
  Peptide Sequence Number=SeqID_180673
actcatcttctccttgaagtggcatctcctctctctcttgctttcttcattccgctgtcattcatcttccaagaagcaaaggaatccattgatgaagaagatcctaggcctacaagctccaatgggccaccaaataacttcatgctgaagtaa

SEQ ID NO: 88989 - DNA, 312 bp, Glycine max
  Peptide Sequence Number=SeqID_180674
atggaagacgcacccgtgagccctcgcctcgctcacccgcaaaagggtaggttgcgacacacaaggatggaaattctcatcctgggtcaaggtttatggtggtttgaggtcttgggtcaaaaggcttgcagaacggccagacatgatgtatgtcagggtgttggtttggccagcggttcagggataaagggaatgtcccacatttatttccatgacacacatacaacaatgatgatttggaaattttatgcaaaacgggtcatgcatgcacccatgtggacactcaagcatcaagtttttatggtcatgtga

SEQ ID NO: 88990 - DNA, 213 bp, Glycine max
  Peptide Sequence Number=SeqID_180675
atggctgagtggttgatagccccggtcttgaaaaccggatctcatgtctcaattaagaggagtcatggaaagaactggttcaaaatctcgatcaattcctttttcaatcctgcggcagctgcgcgagctcttcccgcgtgccataaatggcctacaataggaagaatcctagaacaaatgagaagtagctaccaacttctaggagaaacataa

SEQ ID NO: 88991 - DNA, 252 bp, Glycine max
  Peptide Sequence Number=SeqID_180676
atgtctttttcaagggatttcctctctgctaatcgattaccaaagtatgtaatcgattaccagtgcccaaaaacgaattacacagcctttgcacattggaatttaaaagttaatcgattaccagtagcaggagcttgcctgtttaggtacgtcacaggttctcactggctgactatgcccgggttgggtcaggattggccaagcttggttttgggcaatagcaccccacctgacgtccccaaggtctcctga

SEQ ID NO: 88992 - DNA, 99 bp, Glycine max
  Peptide Sequence Number=SeqID_180677
atggagaaaaatgaagaaacaacaatggaagagaagcttgcttgtggagcttctatggaggctggatctttgagcttcaatgaggtccttcaatggtga

SEQ ID NO: 88993 - DNA, 237 bp, Glycine max
  Peptide Sequence Number=SeqID_180678
atggagtccttgcttcttgaagatgaatggaaacgaatggagaaagcagaggattggagatgccacttcaaggagaagatgagtcaagaagaagctcaccaccatgagaagccatggataagagctcgaaggaaggagaagatgacgcagagggagaaaaggagcacgaaatttagttcctcaaatgaggtgcatgagaatgtaaagctgaaggacatcactaaagtgtgcatatga

SEQ ID NO: 88994 - DNA, 249 bp, Glycine max
  Peptide Sequence Number=SeqID_180679
atgggtgttgagggaaggagcccagagtatgaagaacctcgggatttgaggtcaaatcctttccaaggtggagggaatgatgtaatcctatcccgcaagggcattgagagcatcttgcaatgtgagttcaagcagacttttcttggtcggtgtcgcaacctacccttcggcgggagggcgacgcgagactcgcgggatgcgtgttccacgaaaggaatacgcgcggagtcgccaccaacgtttatttga

SEQ ID NO: 88995 - DNA, 468 bp, Glycine max
  Peptide Sequence Number=SeqID_180680
atgtctggacctgccttgcgaccatactccccccggaacccaaagactttgatttctcataaggtgccagcggagtcgctaaaagcaacatccgttgccctgaacaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttatgtcactacctccccgtgtcaggctaagcggccatagtccctctaagaagctggccttccgtggagggttacctccacatagctatttagcagctgaggtctcgttcgttaacggaattaaccagacaaatcgctccaccaactaa

SEQ ID NO: 88996 - DNA, 453 bp, Glycine max
  Peptide Sequence Number=SeqID_180681
atgaggtgtaatcgattaccagagatgaaaatccttgagatacctcttttaattgcatggaacttgggagaccctcgaaggcaatgcgaggtgctgattccagggcacgattcgattcacggctacttcattggtgcatcagaggaacccgcgcgcacgcttcagcgccctgtggagtggatattacccacgcctacaccatatcgtctagtggagccagtccaagtgatcgaggtgacgtcatctgaggaagaccctgaggagctacctcctgagcctgctgtggatgctcttgactttctagagggtgatgaggacccacttcctgaggtggattctcccgaggacgttgaaattctgataccaggggacagatgtcgtacaggatgtcacgacatcacgcttcagaacatgcagattgtatgtgtccgtatgaacagattaaacaagtaa

SEQ ID NO: 88997 - DNA, 256 bp, Glycine max
  Peptide Sequence Number=SeqID_180682
atgcatagatataactctcaaacttggatcgatgtcatgaaggatgagatgaaatctatgcaagacaatgacatttggaatcttattgaattgcctaaaggtattaagatactaagagatcgctctcaaggtatcctaaggttgtcacaagagagttatattgataacctcctagatagatttggcatgaaagatagtaaatcaggggataacccgatagccgaaggggacaaatttagtctcaaacaatgccccg

SEQ ID NO: 88998 - DNA, 924 bp, Glycine max
  Peptide Sequence Number=SeqID_180683
atggagttcttctctaatgagaattttgaatgcttccaagcatttgaaaactccaatcttattccatttatgtctctgaaattacctgtctattctgaattagtcaaagctttttattctaatttagaaatccatgaaggtactctaaactctgaagtttatgggatcaagatggtcattgaccaatccctattttatgatttaaccaaattgcctagtgaaggtgtgtcttttgagggtgcactgattgatgaatggaaattcgatttctctgtgcatgatgctcgccggttggtttgcaccaaccaagcggatatgaccgaaagacttcttgccggttcattggcttttgaaagccacatcctccattaccttatatttcgcattttgcttcctagatcttcaaaccttgcccaggtttctgaagaagatctcattgtcatgtgggcctttcataaaggtttacaaattgattgggcacatcttgttagatatcgcatgcataaggcattgcgattgaatgccccattgccttatcctcacctttttaccctcttccttcaacatttcaacatccctcttgattttgaaccttatgttccaatcaagagatcattccttataggcgcttcagtcatagcatccttcggttatattaaggagcatgatggctcatgggtaaagaagggtgctagaaatattggtgaagaaggacatgagagagaagattcatctcttctttcgaagattttggaaaggtttgatggtcttcaaacctttgttggtgagaggtttgatactttagaattgcaagtggatatgcgcttcaatgaaatggagtcaaggatgacaaaggttgaagaagatgtatcttacatccggtcaagcttcgatcttccaccaccgccacctccatcatcttag

SEQ ID NO: 88999 - DNA, 197 bp, Glycine max
  Peptide Sequence Number=SeqID_180684
gggcactaccagtcgcgcccacgcgctgggcactaccagtcgcgcccagcagcagggcgctaccagacgcgcccgcgtcaggggcgctaccctactgctgtctcgtgcgccgcgctgtgccacgtgtcgcgtgctccatggaagcgccttcctggggggcgctttgtaataaaaaaatagaccccccagataaataa

SEQ ID NO: 89000 - DNA, 147 bp, Glycine max
  Peptide Sequence Number=SeqID_180685
atgaatgaggtgaggcgacagggccaagggtggattaagggttggattgtgaagaaggaggaggaggggagggagggaggcgacggtggggatgttgttggaggtgccggggagaaaaagaaaatggaagacattgttagtgaataa

SEQ ID NO: 89001 - DNA, 293 bp, Glycine max
  Peptide Sequence Number=SeqID_180686
gtgctagtgcattaacttcatttgattaccgtaaggatcgtgatagacaatggctgaagaaggacgcgctacctccacaagacgagcatactccttctcctcctactcaacgagatgattcctcaacccttatgaatgaagttctttcagaattatggggcctccacacctatgttggtgaacgattcgattccttggatggtcgctttgatggtctggatacccgcatcacccagcttgaagaggatgtgggttatcttcatcggtgcttcgaccttccaccaccttcttag

SEQ ID NO: 89002 - DNA, 261 bp, Glycine max
  Peptide Sequence Number=SeqID_180687
atgagagtccaaccacattgcaatgccagaacccatgttgtatatttgaaaaaggttgacctccttgcttctctcagttacaatcctctggccgctgagctccctttctcctcggttccacaggagacaaaatatatcccttcaacacaacataggtcatcgaaggatctcgaagacccaccaacgcacgaaagccgggatctttcagaaaatggattcctattcgaagggtgcataaccgcatggataagctcacactaa

SEQ ID NO: 89003 - DNA, 360 bp, Glycine max
  Peptide Sequence Number=SeqID_180688
atgatgaagttaggcggctctatcgttaatttatctgcagtcaatggtctggttggtattccaggattagcgccctacaccgtggctaaacacggtatcatcggtttgacccaaaccgcagcattagagtttgcaacgcaaggcattcgaatcaatgccgtcgctccgggctatgtccaaacgccacgaatgagtgaatttcctgacaatatcgtacgtagtttcgccaatagccaccctatgaagaggatggcaaaaatgcgggaaatagcagacttcatactgtttttgctgtcagaaaatgcggcgttctgtaccggcggcgtttatcccatcgatggtggttatttagctgagtga

SEQ ID NO: 89004 - DNA, 446 bp, Glycine max
  Peptide Sequence Number=SeqID_180689
agcttctgttctcaattacgagtgtctcgatatactacgggactcaatcggacatccgagtcaaaagttattgtcgtttgaatttgctcagagcttctgttttcaattacgagcgtctcgatatattacgggactcaatcggacatccgagtaaaaagttattgtcgtttgaatttgctctagagcttcctgtattcaattacgagcgtctcgatatattaccgactcaatcggacatccgagtaaaaagttattgtcgtttgaatttactcagagcttcagttttcaatttcgagcgtctcgatatattaggggactcaatcggacatcccagtcaaaagttattgtcgtttgaatttgctcagagcttctgttttcaattacgagcgtctcgatatattatgggactcaatcagacttccgagtcaaaagttattgtcgtttga

SEQ ID NO: 89005 - DNA, 288 bp, Glycine max
  Peptide Sequence Number=SeqID_180690
atggtcgaattggatgacgtacaagtgaaggaaaacttgacatatgaaacattgcctttgaggattgaggatagacgaacaaagcacctacgagcgaaggagattccattggtcaagcttcctaagacaggtttgcacagtctgaccattgggatttggaaaataataacttttgatgtctcgctaagcgagaagggcgtgctaagcgcaattccaaccaaagagggaattgcgttgagcgagcaggggcgtgctaagcgaggcatagtgcagtggaagttgcgctaa

SEQ ID NO: 89006 - DNA, 303 bp, Glycine max
  Peptide Sequence Number=SeqID_180691
atggttcgatattctggtgtcctaggcgtagaggaaccacaccaatccatcccgaacttggtggttaaactctactgcggtgacgatactgtaggggaggatactccggggaacagatatccagtggaggaggacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttgtga

SEQ ID NO: 89007 - DNA, 180 bp, Glycine max
  Peptide Sequence Number=SeqID_180692
atgacctttactatagaagctgctcatgaacttggagtacctaacgttctcttttggcctgctagtgcgtgttgtttcttgtccatcatcaactttcccgctctggttgagaaaggtctcacaccactcaaagatgagagttacttgaaaaatgggcatctggactccaaagtagactga

SEQ ID NO: 89008 - DNA, 219 bp, Glycine max
  Peptide Sequence Number=SeqID_180693
atggaaacatctgaagctaacttcaaagtcaatcaacacgcaattcaaaatctggagattcaagttggtaagctagcaaaggaaatggctgaattatcctttttagtcacaagggaagaaaaatttgtagaggttaaagctcatgacaaaagtcttgtagaagagtatgattcaaaagaaaaagaagaaaaatatgaggagagaacacaacaacaatag

SEQ ID NO: 89009 - DNA, 917 bp, Glycine max
  Peptide Sequence Number=SeqID_180694
atgctgccagtggtggagcccttggagacatgactcctgctgaagccagaaatttaattgagaagatggcctccaactcccagcagtttagcgccagaaatgatgccatagtcattagaggagtgcatgaggtagctacaaacccatctgcatcatctgaaactaagaagcttgaaggaaaactggatgcattggttaacttggtaacccagctggccttgaatcagaaatttgtacctgtcgcaagggtttgtggtttgtgctcctctgctgaccaccatacaaacctttgcccttccatgcagcaacctggagcaattgagcagcctgaagcttatgctgcaaatatttacaatagacctcctcaacctcagcagcaaaatcaaccacaacagagcaattatgacctttccagcaacagagacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaacttagcctccattcagagcttaaccaatcagatggacaattggctacccaattgaatcaacaacagtcccagaattctgacaagctgccttctcaagctgtccaaaatcccaaaaatgtcagtgccatttcattgaggtcgggaaagcagtgtcaaggacctcaacccatagcaccttcctcatctgcaaatgaacctgccaaacttcactctactccagaaaaaggtgatgataaaaatttacctaacaatttctgtgcaggtgaatcttcttccacaggtaattctgatttgcagaagtag

SEQ ID NO: 89010 - DNA, 237 bp, Glycine max
  Peptide Sequence Number=SeqID_180695
atgcgggtttaccttgtggttacccgcacctttggtcaaccaggggcaaatgagcccgttggcgcgcggagattaacatcgtcctcggcacctttttccgtcttgacccgtgagggtaaccatatggttacccgcacctttggtcaaccaggggcaaacgagcccgttggcgcgcggagactagcatcatcttctatactgtcgcaacctacccttcggcgggagggcgacgcgtga

SEQ ID NO: 89011 - DNA, 630 bp, Glycine max
  Peptide Sequence Number=SeqID_180696
atgacattgctacttagcaacattctgcccagcgaccgcattgccaatctccccctgcaaaagtatcagttggtctgtgtcgtcccgacgtggggatcgcacccacaaagacacccagtggactcgaaaaagtcaaacagggccctggggtttccagctctggttacgggcctctatcagtcctacagggtgcccgtacccccccggcaaggtcacgtcatcatagggatcgcgcctgcaagacacccagtggacccgaagaagtccaacagggtcttggagttgtcaagctctaattacgggtctctgtcagttctacggagtacctgtcacctccagcaagggcatcaggccccctaccaatcgagctttcatcaagaagttctgcgtctccaggcaggcgcagggcgaaacaccacagcagcctggcgatggccggcagcgggcaacagacgcaccgccacctctagagttcacctcagctcatccgcaaaaaggttagagcgttgcctacgacacatggccgaccagcaggcgaccaagtccaaagccaaaggtaagcaaagtactaggtccgtgacctacaagccatcatgcgtccagctcaagacgttaaagaagcgctactag

SEQ ID NO: 89012 - DNA, 521 bp, Glycine max
  Peptide Sequence Number=SeqID_180697
gcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgatttggcacattctgagaacatggcacaacctccacctcgtgagaggactctaagggaaatggctgcacctgatttcacctatgaaagcttgtgcatccaataccctgatgaggatgtcccatatgttcttaaaactggactgattcatttgcttccaaagtttcatggccttgcaggtgaagacccgcacaaacatttgaaagaatttcacattgtctgctccaccatgaaacccccagatgtccaagaggatcacatatttctgaaggcttttcctcattcattagagggagtggcaaaggactggctgtattaccttgctccg

SEQ ID NO: 89013 - DNA, 204 bp, Glycine max
  Peptide Sequence Number=SeqID_180698
atgaagatgcaaagaaatagtacacatgcagcagaaagtacacaagtgctcaaggttaggaaggtgcagaggtttgggtgcaaagcgcggcaggctgcatgtgacatcctggaaatttctacccggaattttaaaatgggccccgacgggtgcagagaaacgcgaggaattggaaccagagaagcggcacacgggatcctctag

SEQ ID NO: 89014 - DNA, 459 bp, Glycine max
  Peptide Sequence Number=SeqID_180699
atgggtgaagtagaggaggtgcaagagcagatgaaggccgacatggaggccatgaaagagaaaatggccacaatggtggaggccatgatgagtatgaagaggataatggaagccaatacgattgtagttgccattaccagcgctgttgctaagtacggacggccccatgatgtgaaaattcaaaacaagcacgccttcccgccatatggctcgcctcccaaggaggatgtcaataactccgctcccatactcattgaaagccaacaacctcaatctgatcatgcacatgtctctctatccgtgggggagacgcatgaaattccccaccacaatctagctgacttcgagccttgcctcgaatatgccactgaagggcaagcagttggtggtaaaatccctcctattattgaaggaaagggaaaagttggatcatctggaggaaaggctcaaggccattga

SEQ ID NO: 89015 - DNA, 246 bp, Glycine max
  Peptide Sequence Number=SeqID_180700
atgggacaccttagtgatcaaggggttcccacaaacccaaagagaacaaaggtcatccctgagtggcccactccaccaagtgttgagggaagaagcctagagtttcaagaacctctggatttgaggtcaaatccttttcaagggggagggaatgatgcaatcctacccccaaggacattggatagaagactacaagaagattgggccttgtatttagggctccataatgtaggtagggtatcctag

SEQ ID NO: 89016 - DNA, 546 bp, Glycine max
  Peptide Sequence Number=SeqID_180701
atgtgggaaatgcttttcaatggaaatggcccccgaggaaaacttgcctcaaagagatccaggaaggataaagcggccgaaggaaccagttccgctcccgaatatgacagtcaccgttttaggagcgctgaacaccagcagcgcttcgaggccatcaagggatggtcatttctccgggagcgaggcgtccagctcagggacgatgagtataccgatttccaggaggaaatagttcgccggcggtgggcaccactggttacccccatggccaagttcgatccagacatagtcctcgaattttatgccaatgcttggcctacagaggagggcgtgcgagatatgaggtcctgggtgaggggtcagtggatcccatttgatgcagatgctatcagtcagttcctgggataccctttagtgctggaagagggtcaggagtgcgagtatggccagaggaggaaccggtccgatgggttcgatgaggaggccatcgcccatttgctatgtataccggggaaggattttgcccggactgctgccgggagacgg

SEQ ID NO: 89017 - DNA, 222 bp, Glycine max
  Peptide Sequence Number=SeqID_180702
tcatttgtctcacaagttcttcaagggaaggttgcggaggagcctcaactgtctactgtttctggtgctgttgctgatgttgctgctggattggtggaggaacgtatgctctgcttgggccagcaacattttgaaaataaggttgttgttgctgctgttgtaaaggattcgaccatctatggttgggatgattcctccacccgggattgtacctgttggtga

SEQ ID NO: 89018 - DNA, 680 bp, Glycine max
  Peptide Sequence Number=SeqID_180703
atggcgccgcgtctcaacgcgttgcggttggaagatcttaggcacaacaagggcttaatgcgagccgcccggcgctttcgtagccttggcgtcatgaatacgacaccggcaacaaccatcatcagcgatccgcgccgccaagctgccttgctctactggcagggcttctctgtgcgccaaattgcggaaacgctgaacctcaaggggccgaccgtgcagagctggaaactgcgcgataaatgggatgacatcgcgcccatttcccgcgtggaacaaagcatggaagcgcggttgattcagctcatcatgaaagacgtcaaggaggggaaagacttcaaagaaatcgacctgttgggccgccagattgaacggctggcgcgggttaatcgctattcggcgaccggcaacgaggcggacttaaacccgaacgtcgccaaccgcaacaaaggcgagcgcaagcccgccgagcgcaacgtgttcagcgaggccgccgtggagaagctgcaaagcatcttcacagaaaccaccttcgaatatcagatgggatggtatcgcgccgggctgcaacaccgtatccgcaacatcctgaaatcgcgccagatcggcgccacgttcttctttgcccgcgaagcattacttgatgcgctgaccaccggccgcaatcagatttctgtcggcca

SEQ ID NO: 89019 - DNA, 861 bp, Glycine max
  Peptide Sequence Number=SeqID_180704
atggctacctcaccaaaagaaacttccgcttctggttcacccgctgtaccatcatctccgcaccaggaacaaccagaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcggtattgtgagtagcattctgaaagatgcttctgtgcctgatgctgagaaagatgttccaacatcttccaccccagatgtttctgtgcctgatgtcaataaagatgttccaacatcctccgctccaaatgctgaagccctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggttggcacctggcattgcagaaaggttacaaagccgaaagggaaaaactcccattaagaggtctggaagaatcaagactatggcccagaagaagagtgctccaatcactcctgccacatccagaagaagcaaggttgctatcccctccaagaaaaggaaagaaatttcctcatccgatactgatgatgatgtcgaactagatgtctcgacatctaagagggccaagaaatctggaagaaaggtgcctggaaatgttcctgatgcaccattggacaacatctctttccactccattggcaatgttgaaaagtggaaatatgtgtatcaacgcagaacttgcggttga

SEQ ID NO: 89020 - DNA, 108 bp, Glycine max
  Peptide Sequence Number=SeqID_180705
atggaggttgaggaaccttggctggggttatggctaccattgaattatcaagtagatatgggagcaagctttttcgctggaaaattccctccatggttggtgttttag

SEQ ID NO: 89021 - DNA, 640 bp, Glycine max
  Peptide Sequence Number=SeqID_180706
atggaggctagtctatgcattccaggccaaggctttattctaaacacagagggccaaccatggaagctccttagaaaagatcttactaccctggctcagagatggagcgccttctcttactcaaacctcgctcctacctcccgcacttcagatttgaacacaggcagagctaggttggtctatggcttaatcacaaggatggacatgagcattggcaatttgatctctagacagatgaccatgatggctcagtctaactcttctcgcttaggcttctcaactttaatcatagccttgtgtagatcgaagggagttggatctgatgctcttacctcctacgagaacctaagaccggcaaggaagaccaagcttagagcaattgatgttccctcttcctttgcaccaatagctggcatccctgcatcttctacttcagccccacctccaactttagcagacccatctgcccagagctcccagacttcagatgccaaattgcaaagcttgtttgaaggacaaattctcattatgcaaagcttgcaagaactggctcagcaaaggccaattatgagtgtagagcagttcattgaaaaggtggcctggcctggagcccgaccttctttcctgggggataatgaaa

SEQ ID NO: 89022 - DNA, 870 bp, Glycine max
  Peptide Sequence Number=SeqID_180707
gcagctgaaaaggtgcggctgctgctcgactggttcattaaccccaaccacgcagcgatttttgccgctgagtacagcggggcgtttaaacagcaggggctggatgtcgagatgatcgcaccggcggattccgcgtcggtaccgctgttgctggcggcaggcaaggcggatctggcgattagctatcagccgcagctctatacgctggtggacaagcaggtgccggtgatcagggttggcacgctgattaaccagccgctgaacaccctgacagccgtatcgggcgatatccacagtattaaagatttcgccggtaaatcgattggctatgcgattcccggcgcggaagatgtggctatccgcaatatgctgaaatcgcagggcgtcgacgttaacagcgtgaagctggtaaatctgaatatggacgccgtctccgcgctgctgacgcataaaattgacggcgcgctgaccatcttccgtaactacgagttgctggatttgcaggacaaaggcgcaaagccggtgtcgtttaagccggaagattacggcgtgccggcctacgatgagttgatcattctggccaatagcaacacagcggcaaacgatcctcgcatcccgacatttctgcgtgggctggatgcgggcatcgcctggctgcgcgctcacccgcaacaggcgtggcaggcgttcattaagcgttaccctgaactggatacgccgctcaatcatcaggcctggcaggcgacgctgccttattttgcaacgcacagtgcggaatttaatcaggcgcgttatcaggcatttggtgaatatatgaaagccaacgggctgatcaccaacgtggcgccgatggcgcgctattcactgtaa

SEQ ID NO: 89023 - DNA, 156 bp, Glycine max
  Peptide Sequence Number=SeqID_180708
atgacggcttgtggtggccaccagtggtcgtgggtggtggagaagggtgttacacacctcgccttcgctgttgtagagaaatcgtcatggagtgcgacacgaagtgaggaggaacgacgcaaacagggtcagccaatcagtggagatgtggagtga

SEQ ID NO: 89024 - DNA, 198 bp, Glycine max
  Peptide Sequence Number=SeqID_180709
atgacaagaggcgttaatgcacaagctgtcattaaagaaattgccacttggcggagagagggtgacacctttggatcagacccattggggatgacactcggggaaatagaagatttgatggaacaagattggaccggtaagatggaaagtgacccgacgtcgcatcacaaacacttggcaatctttcaatggggatga

SEQ ID NO: 89025 - DNA, 537 bp, Glycine max
  Peptide Sequence Number=SeqID_180710
atgtcagttctagaattgtacgtagaaaaggatgttgctggtggttctatgtttcatgctgcaaattctgttacgtcatgtgaacgtaatgtatctcatcatgagtcggaactgccaagaaatataagcaatttacatgttgatgaacatgatgatgatgatgatgattatcttgcatctaactcatacgttgaagagtctttcgatgaagatgatagtgatgatggaatatctgatacagacaatgaagtcactgacatcgttgaaccattttcaattgttcacccaagcgaagaaattcaaaatccattttggaatgatgctatgcattataataatatcaattggagtcatccggacgaggaggacatttgtggtctggacatgccaacgacttttaatgttggacaagaattatatgttggcatggattttgacagtaaagatgcggtcaaaaatgcactgaaacaatatgtgatgaagatgcatcaaagttttaaggttgttgaaacgaaataccaatgtagttgtctttga

SEQ ID NO: 89026 - DNA, 2108 bp, Glycine max
  Peptide Sequence Number=SeqID_180711
atggacaatcccaaccctacaaatgatgaggaagtgaataaacagatattgcagcatgaaaaatctgctgctggtattttgtgccagcttaggattcatcatggagctcaggcttctcatcttacattgacaaaggatgttgtgggtattgttgctactctgggcaaagttgaggatgacattcttagcagacttttctcagagtatctaggagtggagactatgctggcaattgtttgcagaacttatgaagaggttaaagctcttgaaatgccttatgctggtaattacatgcttgaggatgcacaacggaagttggatattttaatcccaagattgcccaatggggagcttccatctggatttcttggttatgcagtgactatgattaatttagatagctcaaacctattttgtgttactcccagtggttatggcctcagagaaactctgttttataatctcttttcttgtctacaagtatataagacaagggctaaaatgatacaagcacttccttgcataagtgaaggagctctttctttagatggaggaatgccttgttgcagttacaaggaaacagcgtccctcgcacttgcacacttcaggcacttggtgttcaactacgcacgcgccgggagctctcggtgccctccacgcgccggcttcggggttcggagaggctacatcgtcgttgcctcgttgggggacccacccgaagtctggtccggcggcgggattgtcgttcgccccgggaattccaatttcgaagtcgccggcggcggtggcgccccgaactccggcgattcaaaagaggggtgctggggtggctccaatttggggaacagtttcccaacgccaaaggaaatttgcaaggggctcgacaaattcgttattggacaagagagggccaagaaggtgctttctgtagcggtttataatcactataagaggatatttaatgaaacctctttgcccaagtggcctgcaggagattcagataatagtgtgaaagttgatgctgctgatgatgatagagttgaacttgagaaaagcaacatccttctaatggggccaaccggatcagggaagacattacttgccaaaactttggctcgatttgtaaatgttccctttgttattgcagatgcaacttcactcactcaggcaagttatgttggagaggatgtggaatccatattatacaagctcctcatggttgcagattataatgttgcagctgcacagcaaggcattgtttacattgatgaagttgacaagattactaaaaaggctgagagccttaatatcagtagagatgtttctggtgaaggtgttcagcaggcattactaaagatgcttgaggggacggttgtcaatgttcctgagaagggagcccgaaagcatcctagaggtgacaatattcagattgacacaaagaatatacttttcatttgtggaggagcctttgttgacttagagaaaacaatctcagaaaggcgtcatgattcttctattggatttggggctcctatacgtgcaaacatgaggactggtaaagtcacagaagctgctgtggcatcatcattattggaaactgttgaaagtagtgatcttattgcatatggtttaatacctgaatttgttgggaggtttcctatccttgtcagtttgtcagctttaactgaaaatcaactaattcaggtcctctcagaaccaaagaatgctctagggaagcaatacaagaagatgttccaaatgaatggggtaaagctacattttacagaaaatgctctaagatcaattgccagaaaggcaatatctaaaaatactggtgctcggggattacgatcgatactagaaaatgtgttggtagatgccatgtatgagattcctgatattagaacagacgatgatgttatagatgctgttgtcgttgatgaagaggccgttggaggtgaggggcgtgggagaggggctaaaatcctgtatggtaagggtgcattggatcaatatctttcagagcagaaaaatgattcagagaccatggaggcatcagctgcagataatgaagccgatacagaacttccttccattgttgccagcat

SEQ ID NO: 89027 - DNA, 1284 bp, Glycine max
  Peptide Sequence Number=SeqID_180712
atgttggtatttcactatttccactttcagaaagagaacaaggaagagcagtggcagcagcatgtggcgccagaggaggtttctgtggagcattttcctgcagagagttctccagatgttatcaatgaaggaagtgccacgtcgtcaacaccagtgactgaagatagaaaccatgccgttgcctttgcagcagcaactgccgctgccgccgaggcggcggtggcagctgctcaagcagctgctagagttgtaagattggcgggttatggacgccagccgaaggaagaaagagctgcaatactcattcaatcatactacagaggctaccttgctcgacgtgcattgcgtgctttgaagggattggtgaggctgcaagcgctagtgaggggacataatgtgcgaaagcaagctcagatgacaatgcgatgcatgcatgcattggttcgagtgcaggcaagagtaagagctcgcagactggagttgactgaggagaagcttcagagaagagttgaggaacaacatgaatgtcctaagcagtttttgagccccatcaaaatgttagatatggatgcttcccagcacattaaggaaaaccattatttcaggaaacatgaagctgtaatgaaaagggagagagctcttgcttacgctttcaactgccagcggcagctgaagcaatacatgcacatagacccaaatggtgatgatataggatgctacaacactgagcgtgaaagaccacaattggattggaactggttggaacgttggatgtcatcacaacaatcacccaacttaagaccacgtgagaccctttataggactcttgctaatgctaccactgatgacatgtctgaagaaaagacagttgaaatggacatggctgctaacatgggcttcatgaaccaagaatcttatgacacaagcccaatttctaataggtaccaccagcgccagcatagtgcaggtatacctagctacatggccccaaccctgtctgcaaaggccaaggttaggagtcaagggcctcaaggcccgtttaagcaacgtggttcacctgggcctcactggaactcatccaccaggagaagttctgctattgggctaggctgtgactcatctagctccggtgggcccacttcagcccatgtctccccgagaagcccaaacccaaaaattaatgagattcgtctccaatctagacggatttcaggtggcagcccagataatgttcacattgaggattgggcccttccccttggagccaccaatggctggccttga

SEQ ID NO: 89028 - DNA, 132 bp, Glycine max
  Peptide Sequence Number=SeqID_180713
atgaaggttgaggttgagaggcaattgaaatggaaaatgatatatggttgttgttgggctaaagatgtaggaggcaaagggatgaatgttagaggaagaacccataatgttgaattgaggattaatttttga

SEQ ID NO: 89029 - DNA, 480 bp, Glycine max
  Peptide Sequence Number=SeqID_180714
atgttgaaccgaaagaaaaagcctcaagtcagattcgaagtaaatgcccaaaaggacataactagcccacaaaaaaaacgcgcgttatcctcagttgctaaggtagttgataatgaaccgttcaaattgcctcgtgattgcttcatagatgaagtagcaactgtatcaaaggaacttgttgattttggaacaagcaaagagcttcagcatatgctgtcaccgtgtgagttgaaaagcataacatgcttctcagtttgtaatcaaaagcaaaaatacaatcaaaagcttgacattattcccattagaactgtttgtgttcagttctgcatctcaagatcctcagttgggtttgtggaattcggtgggacaggcagacacagtgatgcatattcaggattttcagctccaaatgactatcagaggtgggaattggttcaaatggtcttccttccttctattgcttgtgccagttgtatttga

SEQ ID NO: 89030 - DNA, 1005 bp, Glycine max
  Peptide Sequence Number=SeqID_180715
atggtacttctgatgtcatcaatgcatatctccaccgagcttctgcatctttcaatgagttcaagcagctccacaaggagcttggatcatctgactcatatgaagcacaaaaggcacagaacagagaatggtaatgacagtgggaaggtagtgggaaattcttttcaaagtgttgatattaacaaggagctcagcctttggcatgtgaaatttgatcagttcaaaaggcaacaaagtggcagtgggaatgctgatggtgaaaattttagtcaacaagaagaagaagaaaatgtggatgggggtgaaatgcataagaagaagaaaaagaagaagcaggaagttgagtccttgcacaacatagatagcaccgttaaatttggagtgagggaagctgatggaaagcatgttagttttaggatccctagaattgagaaatgtagttctatgttagataatcttgtgggctcactagatcttcctaagagtaagattttctggtggttaaatttccgcctgaaagatctgcctagctttataaggacaatagatccaaatgatttcatgctagaatatttaattgaagtagcggctagagttcgcagtgcctctgctattgtgtttgatacttttgatgaacttgagagaaatgcaatgaatggtctctcctctatgctcccttttctttgtaccattggtcttttccctttacttttaaatcaaagtccacaaaacaacttcgcatctttaggttccaatctttggaaggaagatccaaagtgtcttgaatggctagaatccaaggaatcagaatccgttgtttatgtgaattttggcagcatcacagttatgtcagcagaacaactcttggagtttgcttggggtttggccaacagcaagaaaccctttttgtggatcattaggcctgaccttctcattggaggttcagtgattttgtcatctgagtttgtgaatgaaactaaagatagaagcctaatagcaagttag

SEQ ID NO: 89031 - DNA, 591 bp, Glycine max
  Peptide Sequence Number=SeqID_180716
atgggatcaagtcaaaagccttcgtttaaaaagaggttctatcaagtcaaaatcaagagcttagaggtcactagtttacgagagttggggcaattaatgggtcaacttcaacggcaagccttccgcaaagcctatggaattagaccgccaaaggcaagtcgaaaatggggtggtcggaataccgagaaaatatttggagggagtcctctttccaaatgtggatgggttggtggacctggcagcgatcgacgttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttttccaagaaggtaggcccgtctatccgctacaaggttaccactctcccgttctcgccataagacagcttggctaccccatgagaggagcgccattaggcgaaagcatcacgcctttcatcgcacggggttttagtgaccacaacgcgagagtactccaaggagttcgcaaggcatgggatgcggcgtga

SEQ ID NO: 89032 - DNA, 225 bp, Glycine max
  Peptide Sequence Number=SeqID_180717
atgacaacattagtctctgcatgtcaacggctgactgtcggaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcaggagttgtatttacgcacggggaaggtattag

SEQ ID NO: 89033 - DNA, 453 bp, Glycine max
  Peptide Sequence Number=SeqID_180718
atgaactacaaacttgcgcttaatacgcaggagcctaactctaacattgtttttaatacaattatgtttgattcttttaagatcaatatagttgagaggtatgctggatcaatgaatgctcggccgaaattgtgtgaagttttattcaaggtgagaactttggatgatgatatcatccagaaaagagatgggaatatgagggtaaaaatcaagggagatacttttgatgattatcagaagttatctcagaaactaaattcttatgaatataaaaataaactgatcaacagaaaagatgctgaacaggattacgttcactttatccttagtctggtattcctatgtttacacctgtcagatttattaggctcaggcaatactgaattgtcggacaactattcctttacgcattcatcaagggaaaagccagccttatatgctatggaattatga

SEQ ID NO: 89034 - DNA, 565 bp, Glycine max
  Peptide Sequence Number=SeqID_180719
atgatagaggctaacttagattgtgaaataagggtagagcaacaacttaaagagaagtctacttcaaaatcttatggctctcactcttatccaaagaaagaccaaggtcaaggaatcttagggaggacacattacttctcaatgccccaccacaaaaaccatgattatgagggccaagacatttatagtagccaagatgaggctactacttcaccttcctctagtgaaagtgaagaagcaaaaggtgaaaaatctagtgaagaaatctacccccaagaagaaagacaaccattagtggttaaagagaagtgtaaggagacacttgctagcattgccacacctcttgggcttgagtttattcctcaagtaaagaaattgttggatgagggtttggttcgcaagagcttaaatccttgtgctttgttggtgcctaaaataggtattattaggcaccaaatccttatgataggcggtatgatgaatgtgttgagtggtgcaatactcttttgtaaaatcactcatgcacccaacatcttcatgatttgtgtacatagggactcattag

SEQ ID NO: 89035 - DNA, 288 bp, Glycine max
  Peptide Sequence Number=SeqID_180720
atgctttcttttgacttccggcatgtcacagaacttcacgaattgcctaacgatgggtgccaagtacctcgaagtggtcaaacgagggtcgcatcccaacaaacagctggtccccgaacgaaattagggtatgacaggtgtcctacaccttctaccatacagagcttcatagggagccatgccaatcgtagagtgaaaactattgttataaacacacgctctcaaaagatcctccaacaactgaatggtccattcagtttggccatcagtctaaggatggtaggttga

SEQ ID NO: 89036 - DNA, 468 bp, Glycine max
  Peptide Sequence Number=SeqID_180721
atgtctcctccacctctaagacctcacaatcactcacaaactcatctcaagctgtcaagacggcttcatcttcaagctctggtctctgcaagtcttcacacagcaaaatctctcaaactctctagaacttggacctttctctctctagaactctctagacatacaaaagcttcaagaaaaggccaaactccctctcaaaatctgatttcaggcttaaataggtggctttgttcgggctctgaatggattaaagtggtgcgcttagtgggatggcccgttgctcagcgaacatgcacagcgttaagattgtgctcagccttattccagatttttcctcacgctcagccgtggagtattgtgctcagcggatggctcgctaagccgacaggttggcttagtcagagggtgaaaatcagcactatacaaactcgcctaattaacctaaaattgagagaaaatgattattaa

SEQ ID NO: 89037 - DNA, 645 bp, Glycine max
  Peptide Sequence Number=SeqID_180722
atgacataccaatttaaggccgtatttcatgttgacaggaatatcattgaggtaccctctgtttatcataaacaatggactccagattacccggattatgtggtgttggactacaatggaaagaagcaccatataagagttagaaaatttagtaaccgagtctacattgttgatggtctcaaacacttcaggagggatatgggaatatatgaaggtgtgatgatcacatttgctgcgccggacaagaattggaagtttgatatccacttctcaccgccactgcatgcacagacatgtggcaggcctgtccattctgccagagaatatgtgtttactgtggatgtcgacaatcggatgattgttagactttatccattggtactgccactcgatgttgtgggttatgttaatgcaggagacggctatgttactgtccttggtgtttgtgggcattgtcacttttggaagttgagtatgcataatgggcttaaatgttttgctgacccatggttccaattcttaacagaaaacgatttgatggccggtgacgaagttgtcttttatttcaggccaaatcaacttctttgggaggttattgccagaaagcaaactgtgtgggacgaggacgaggacgactccccatga

SEQ ID NO: 89038 - DNA, 132 bp, Glycine max
  Peptide Sequence Number=SeqID_180723
atggtgaggatcgtatggctaagctttttgaactggtatccgcagggttctgtttcttccttaaatgcacatagggagtctgtttttgtatatgtcagagcttttacaagaaaggaagctcagaagctgtaa

SEQ ID NO: 89039 - DNA, 477 bp, Glycine max
  Peptide Sequence Number=SeqID_180724
atgcaattaggaggattcgatgaaaggacatcgtttcaaatcctggattttcgaattgagagagatattgagagaaatcaagaattctcgctatttcttagattcatggacccaattcaattcagcgggatttttcattcatatttttttccatcaagagagttttataaaactcttggactcccgaatttggagtatcctactttcacgcaattcacagggttcaacaagcaatcgatatttcacgatcaagaaaaaagagcgattctagttgtaagatatctaatgaaaccattgctggaattgagatctcattcaaagagaaagatatcaaatatctggagttcctttttgtatattatatggatgttcgctaacagcaaggaccatgattgggaatttgttgatcgtctttgtctcgagaaagaggcgcaacataatcaacttggattcgggacagctattcgaaatctatag

SEQ ID NO: 89040 - DNA, 420 bp, Glycine max
  Peptide Sequence Number=SeqID_180725
atgccaatctccccctgcagatgtatcggttgggatcacacccacaagacgcccagtgggcccgaagaagtccaacagggccctggggtttccagctctggttacgggcctttgtcagtcctacagggtgcccgttcccccagcgaggaatcgcacccacaaagacacccagtggacccggagaagtccaacagggccctggggtttccagctctggttacgggcctctgtagtcctacagggtgcccgttccccccggcaaggtcacgtcatcatgacatagggatcgcgcctgcaagacacccagtggacccgaagaagtccaacagggtcttggagttgtcaagctctaattacgggtctctgtcagttctacagagtacctgtcacctccagcaagggcatcaggccccctactaa

SEQ ID NO: 89041 - DNA, 65 bp, Glycine max
  Peptide Sequence Number=SeqID_180726
tcgctaaatccgcccaatttcctcttcatgtatggctaccagatgctatgggtgggatcctctag

SEQ ID NO: 89042 - DNA, 412 bp, Glycine max
  Peptide Sequence Number=SeqID_180727
atggctgaaagaggagaaggaaatagatcaccaaggaggactctaggtgactatgcttatcaacaaggcccaaaacattacaacagcatagtcattccccctttcaacaataaggtcatggaattaaagctagcacttcttagtctaattggctcacatccctttgcaggaatggatcatgaggatccatacacacatttgtctaccttcatggaactatgtagtactatgggagcttctgacgaggatgttgaagttgtctacctcagagctttttcatttttcattagcagtgaggttctttcctccttcaagatttatcagtgcaaaaatctgccatcgcgactttctcccaaggatctgacaaacctctctatgagacgtgggaaagattcaaagctttattatggag

SEQ ID NO: 89043 - DNA, 243 bp, Glycine max
  Peptide Sequence Number=SeqID_180728
atgactcttgggagagtcattgactctcaagagtttccccaaagaaaacttagcatgattatgaggggtcaagacattatagtagtcacagaggaaatacttcttccttcctctagggaagtgaagatgaagtggccaaaggatcaagcccaagaagaatgggaggctacaccttcaaaacaaaagaaaaggtgtaagaccatagagaaatacaccctaagactagtcccaagaaaggactag

SEQ ID NO: 89044 - DNA, 408 bp, Glycine max
  Peptide Sequence Number=SeqID_180729
atggccatagaccaatcctttttctttaaactcacccaattatctagtgatggtgtatcgtttgaagtcaagagatctttctctatcggtgcgaatgtggtctcctcttttgtataccgcaaaaaaagggatggttcttgggtgaagaaggacgctcccgcacaggccgcagaagaatgctctccatcaccacctcctcagagagatgattcttcatctcttatgcacaacattcttgacagactggatggactccacactttcatcggtgagcgctttgattcattggacaaccgcattgatgccattgatgcacggtttgcaggaatggatacccgcatcactcagcttgaggaagatatgagttacattcatcagtgcttcgaccttccaccaccatcctcatag

SEQ ID NO: 89045 - DNA, 985 bp, Glycine max
  Peptide Sequence Number=SeqID_180730
aggtggtagcgacgcaattcgtaggggttcgagtcccctcttgggcaccattggcgcggcggcagaggcaagagagaatcgctgtgctggccgaatatttgccgtctctgctgtttctgatcgttgccaccggtatcggcgttacgctgatgctggttggtcgattcctcggtccccgccgccccgatctggaaaagctgtcgccgtacgagtgcggcttcgaggccttcgaagacgcgcgcatgaagttcgacgtgcgctactacctgatcgcgatccagttcatcgtcttcgacctggaaatcatcttcatcgtgccgtggacccaggtcttcatggagctgggtgcccgttcgctcatcaccatgggcctgttcgtcggcatgctgttcctcggtttcatttacgtctggaagaagggagcgctggaatgggagtgattcagactctcgatggcctcatgaacaaccccacgccggaaggccgggttgatgacatcctgcggccggaaggcgacaacccgctgctggaaaagggcttcgtcaccaccagcgtcgatgcactgctgaactgggcgcgcaccggctcgatgtggccgatgaccttcggtctggcctgctgcgcggtcgagatgatgcacgccggcgccgcgcgcctggaccttgaccgctacggcgtggtgttccgcccgtcgccgcgtcagtccgacgtgatgatcgtggccggtaccctggtcaacaagatggccccggcgctgcgcaaggtctacgaccagatgccggacccgaagtgggtcatctcgatgggtagctgcgccaacggtggcggctattaccactactcctattctgtggtgcgcggctgtgatcgcgtggtgccggtggacgtctacgttccgggctgcccgccgaccgccgaggcgctggtgtacgggatcctgcagctgcagaagaagatctggcgtacacagaccatcgcccgctga

SEQ ID NO: 89046 - DNA, 99 bp, Glycine max
  Peptide Sequence Number=SeqID_180731
atgactgtgaaaaagaggctaagtcatgaagtgctaaaagtgatagttgggcttagcacatcagtgactttagcattgggaaatgtattgttgccttag

SEQ ID NO: 89047 - DNA, 315 bp, Glycine max
  Peptide Sequence Number=SeqID_180732
atggatattgaagaggacactaaaatccccttgatcttgggacgtcccttcatgctaacagccagttgcgtggttgatatgggaaagaaaaagctggaaatgggaatagctgatcagaagatcaactttgatttgtttgatgaagacaagcatttgctcaaccaggatgtctgttcaaaggtagatgaaggatggaaagagatggttctaaagcgcgccctgtgtgctaagcgaatctttgttcacacgctgagcgagtcaccactcgtgctaagcgcatcaacccctactcattggctgaaagggcctcactga

SEQ ID NO: 89048 - DNA, 600 bp, Glycine max
  Peptide Sequence Number=SeqID_180733
gattcctttaaggagcaggccacacaacgatacttcatcccccatggacgtcaggatgttctcaccgctgctattggaccaatactttggatcagctccacaaacgtcccgcagctcttcctccctgcctctcgaagaattgcagtagttgacccaacaaatcagggacaagctagaggagtccatcacagaaaaagtgacgcagcagctcatgacatccttcagccagatgcagtcccagattcagtccctgcaccacctcccgaccctctggttggtccctttggtcctcgagtaagcacaaatgggagttgtgttgatccctcaggaaacgatcctgagacgggtgactctgataggtgcggcttgtacatagaagcagatcctgcccgcctggttgccatggggagagtttatgagggatccactgttgttcataacactcctttgttgtttggccaagtaaaggtgagtgtggaggaggttacagatgcagatgctccagttcttgtacccactgatgaggtttccttagtggggcagacacttcacaccttccttgcttggccgacacatctggtcaagtctttatcacagtag

SEQ ID NO: 89049 - DNA, 188 bp, Glycine max
  Peptide Sequence Number=SeqID_180734
gggcaggatcatcttgggctaccttctggggtggggaccaaacatggacagcagaaaccaatcaaggtagtcccaaggcccaagcaggagaggcgcccccagaagttcccggtgatggagaggaggctcacgaggacgaggagatggccgatttgcttgacttcttgggagggagtggagcttcatga

SEQ ID NO: 89050 - DNA, 295 bp, Glycine max
  Peptide Sequence Number=SeqID_180735
gacctcattgaagctcaaagatccagcctccatagaagctctacaagaaagtttccatcacatcctttgtggtacaagtagagggtacatctacttgggattgactgagaacaagaaagggtggaatggagtggaggttctgaaacaatggaagagatactttgcaggttacatcagcgagaagaagaggcagcagttaaatgagagcgagctatggcatatgcctactctcatcagttctggagaggcttttagtactattttctcaatcacacttagagttttacctagataa

SEQ ID NO: 89051 - DNA, 658 bp, Glycine max
  Peptide Sequence Number=SeqID_180736
catcaaatacaatagcggttctggttttctgccggcgtccttggacactgacaatattgcggagacaatcaagactttctttccagtggaggcgactacgacgtcgtttcagagttacccgccggcgccaccggatttggggcagcaagatctacggctctcgctacagtcctttcaggaccctattatgcttcatcaccagcctcagagtcaccacgagccggtgctctttgccggaaccgccgccgcggcgctcggcttcgacggcggttacgggtggtcagaacaccagcaccagaaccatcactcggaggaacagcgattgctctatgctggtggcaacagtggccatggcggtgggtttgtgttcaacacgccggcgccggtgccggcgtttggccagtttttttctcagaggggaccccttcagtccagtaacaccccttcgattcgtgcttggatagacccttcggtcgatcaccaccaccatcatcatcactacctctcgcagttgatccaccagggttccgtcgccggaggcagcggattctccagtggattctccggcttccgcattccagcacgaattcagggtgaagaggaacacgacggcgtatcggacaagccgtcctctgcttcctctgattctcgccattga

SEQ ID NO: 89052 - DNA, 126 bp, Glycine max
  Peptide Sequence Number=SeqID_180737
atggagttacaattgcgctggattttctgcaagcctgaagaacaaattaccgacatgaagcgacacgacgagaagctcaaggcctacgacactcccattcagaagaaagggctacgagggttttga

SEQ ID NO: 89053 - DNA, 108 bp, Glycine max
  Peptide Sequence Number=SeqID_180738
atgacgacgatgatgatgaagaaggaacggataaagaaagaagaagcaaagtacagctgggaaggaaagaagagagaaggaaatagagagaagtccaaatggagataa

SEQ ID NO: 89054 - DNA, 216 bp, Glycine max
  Peptide Sequence Number=SeqID_180739
atggagaacccaatcgacggtggcgagttcgtgtacctttccgggttcggcaaccacttctcctccgaggccctcgccggagctctgccggtggcgcagaacagccccctcgtctgcccgtacggcctctacgccgagcaaatctctggcacctccttcacctcccctcgcaaccgcaacctcttcaggttcttcttcgcctctttattcaactaa

SEQ ID NO: 89055 - DNA, 72 bp, Glycine max
  Peptide Sequence Number=SeqID_180740
atgacaacggcaatcattggtgatggcggcggcgatagtggtagttgtgctggtgatcttgacataaattaa

SEQ ID NO: 89056 - DNA, 476 bp, Glycine max
  Peptide Sequence Number=SeqID_180741
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccttcattaaagggtatgctaccatagctgcacccttcacggctttaatgaccaaggatcaatttcactggactcttgaagctgatcaagcttttttgaaactaaaggggctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactga

SEQ ID NO: 89057 - DNA, 471 bp, Glycine max
  Peptide Sequence Number=SeqID_180742
agtggtgcctgaggatatgtcgcgggggtcaggagaccttggggacgtcaggtggggtgctattgcccaaaaccaagcttggccaatcccaacccaacctgggcatagtcagccagtgagaacctgtgacgtacctcagcaggcgagcttctggcagtcaaccaataaaggaacaaaagtccacgaagcagggaggcttatcgtgatggcagcgcagttgatccatgatcgcgtcgtgatggtgtgcctagagggtgtttgggagaccctcaaaggcgatgagaggtgccgattccgtggcacagttcgactcactgctacttcgctagtacatccgaagcaacccgcacgcacacttcaacagcttatggagtggatactacctacgcctgtggagtggatactagttgagcctgttcaattgatagaggtgtcatcctctgaagaggatcttgaagaggacccagagga

SEQ ID NO: 89058 - DNA, 219 bp, Glycine max
  Peptide Sequence Number=SeqID_180743
atggccccgaggaagcttgcctcaaagagatctaggaagaacgctgcggccgcagggactagtgccgctcccgagttcgatagccatcgtttcaagagcgctgagcaccagcagcatttcaaagccatcaagggatggtccttccaccgagagagacgcgtccagctcagggacgacgagtacacagattctcgagttttacgccaatgcttgggctaa

SEQ ID NO: 89059 - DNA, 334 bp, Glycine max
  Peptide Sequence Number=SeqID_180744
tggcatcactatcagtggtggttgtgtgatcgccgccgtcgcggaagttgttgttagtggtgaagaggctgtccaatctcgaggccatgtcgtcgttgtcatcgtcatcggcggcagagggagaggagtgggtgtgatggcaacggtggaggaggaaggcggcggcgacgacggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 89060 - DNA, 267 bp, Glycine max
  Peptide Sequence Number=SeqID_180745
aattatctacttttcgagctagaaaagattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 89061 - DNA, 585 bp, Glycine max
  Peptide Sequence Number=SeqID_180746
atggcgctaaagcgcgcgactatacccggcgtcgggcaagaccaagccccgatgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggatgggaacgggcccttcggggcctcttccccgggcgtcgaacagtcaaatcgtcgtctgaacttgggtcataggggcgaaagactaatcgaaccgtctagtagctggttccctccgaagtttccctcaggatag

SEQ ID NO: 89062 - DNA, 57 bp, Glycine max
  Peptide Sequence Number=SeqID_180747
atggctggatataaatatagaaatggaaataaatcaagctatagggctccaaatgag

SEQ ID NO: 89063 - DNA, 309 bp, Glycine max
  Peptide Sequence Number=SeqID_180748
atggcttcttctggagtcttaaatttaatcttcccactggcggaggcatcgaggagctgcttggaatggggtcacaagccatcaatgaagatgttgagctggatcggctcgctgaacccatgtgtaggagtcttccggagtaacccatggaagcggtcaaatgcttcactcagcgattcgtcagggtgttggtggaaggatgagattttcacctttccctcaacggtcttggactctggaaagtacttcttcaggaacttcttcaccacctcttctcatgtccgcaagttgttccccttgaatgggtga

SEQ ID NO: 89064 - DNA, 177 bp, Glycine max
  Peptide Sequence Number=SeqID_180749
atggaaccagagaaatgtctcaatggcaggcagaattactctaataaggccccttcagtagtgataaataggcttactactatccaaagacactttctttggggtggaggtgcagaagccaattggctacctaaatcgtggcttcagtcagctgtgggaaatcaaagtacctcctag

SEQ ID NO: 89065 - DNA, 213 bp, Glycine max
  Peptide Sequence Number=SeqID_180750
atggcacgcagcgtgcttgctccatgcccctattttagggacctatatgggggagagctaaaagggcttttaacaataattcccaaggtggtcatatctctcttgatggtctctagaggtatcatcccctttgaagaacatattgcagcaatagggactactagcaacaatatgttgtcaaagagaaaaactctagatgagggttcactgtaa

SEQ ID NO: 89066 - DNA, 437 bp, Glycine max
  Peptide Sequence Number=SeqID_180751
atgcggtcccagtttctatcgcagatgcaatcacagggactcgcattgcctcctgagtctgaggttggtccttcagctgcttgtgtcagcacaaaggagagttgtgttgatcccttaaggaacgatccaaacacagtcaaggttggtgttgaggaggttagagatgcatatgctcccattcttgtacccactaaagagggagctgtgggaccggcgaaacctgcagataggccggatcatgatgtcgatgatcacctatatctgatgacattgaccatcccacaactttttctgaagtcgttgcaagttatgtgggatgctactgtgtttggggtgtttaatgacaacttccccttatacataaagcatgaagatgtgtctgaaatagcacacggtggtcaatgtctcaacatctctattttacagttatgggttct

SEQ ID NO: 89067 - DNA, 524 bp, Glycine max
  misc_feature (37)..(37): n is a, c, g, or t
  Peptide Sequence Number=SeqID_180752
gccacaagacaccagtcgaccggaggagccaacaggncctggggttccagctctggttacgggcctctgtcagtcctacggggtgctcgttccccccagcaaggtcacaccatcatgacataggggtagcgcccacaaagacacccagtggacccggagaagtccaacagggccctagggtttccagctctgggattgcgcccgtaagacacccagtggacccgaagaagtccagcagggtcttggggtttccaactctgattacgggcctttgtcagttccacagagagcctgtcgcccccaacaaggtcattaggcccccattaaccgggttttcatcaagaagtaatgtgcccccaggcaggcgcagggcaagacaccatagtagcctggggatggccggcagcgggcaacagacacaccgccgccacctccaaagcccctcagctcatccacaagaagttagtacgttgcctatgacccatggccaaccagcagccgaccaagtccaaagccaaaggtaa

SEQ ID NO: 89068 - DNA, 597 bp, Glycine max
  Peptide Sequence Number=SeqID_180753
atgcgcctggaggggttggtgtccgaccccgaatcgctgcccgacgagaagacgccgggcgccgtcgcggccgacctgatccgctcccgcgccagcgagttcaaggagcgcgggaagggcgacagtcttcccaggttgatccgcgtggcgttgagccagcgcgagttccgcaagcagttcacgggcggcccttactcgggctatgagacgtcatgcgatgtcttgccgcccgactacaagtactacgcctgcttttcgacccggcattaccagaacgatgatcgcgtctgcagcacggaagagtattgggccaccggctcggtgtacgtacagcgctatgtggccaaggtggtcgacaacaagccggtgccggtcgcgtcctgctcgtacaacggcaacgatgcgagttgcccgggcagcattgatgacgacgcgcgctggaataccggccccaaggtgaaggcgccgacgtattcgtccaagcccttgccccagctcgatggcgaggtcgacgacagcgacgaccatgcctggatcaaggcctgcctgaccgacagcggcttccctttgtccaacccgacgaaggcgggcggctag

SEQ ID NO: 89069 - DNA, 243 bp, Glycine max
  Peptide Sequence Number=SeqID_180754
atgggacaccttagtgatcaaggggttcccacgaaccctaagagaataaaggtcattctggagtgccccactccaccaaatgttgagggaagaagcccagagtttcaagaacctctggatttgaggtcaaatccttttcaagggggagggaatgatgcaatcctacccccccaagggcattggatagaagactccaagaagattggactagagatgcaggagaagaccctagggttctcatga

SEQ ID NO: 89070 - DNA, 291 bp, Glycine max
  Peptide Sequence Number=SeqID_180755
atgaatacgggagcccgagaaattgtctccttcttagatacaacgtcttggggtaacacggtgcccgactgtggaaaaaggcacgcaacgtgtttgcttcgtgcccctattttagggacctacatgggaatggagctaaaagggcttttagtgataattcccaaggtggtcatatatctcttgatggtctctagaggtatcatccccttcgaagaacatattgcagcagtagggactactagcaacaatatgttatcaaagagaaaaactctagatgagggttcactgtaa

SEQ ID NO: 89071 - DNA, 658 bp, Glycine max
  Peptide Sequence Number=SeqID_180756
gcgtaaacaagatgttgtcgacccaaacaatgcaaacacagctgcattgggtgaagttgtggagactttacaatatatggtgtcaccacaagggaggaacacgtggacggttgatgatctcgtgccttacgtggataagttagcgattatatctgaagagcaagagagaatcactgagccaatgtcacatggtccagcatcagtgcgtgaattcccagccccagagtttcacattcttcagtcaagtgttgaaactcagggcataggcagacgaagggagcctgttgaagccgaacaatattcccaacaaatgatggagcgtggtcatggaatgtattacacgccagcaacattttccgaatatccttcacagatgtatcggtatccttttgcaggtcatgatactgatacttctgagacctcacattcgttcggtggtgttgcggaaacacaacctcatttttcatggcccactatgactccttcacagcagcacgatgcccccatggcaacacctaacgccccatttgctccgcaatggaataagcggggagacaacgcggcggcagaagaaatcctgatcgtcaagtgcgaagatgggatcgaccatgtggcacattctcacgacatcatggacaccataatgattgattttgat

SEQ ID NO: 89072 - DNA, 243 bp, Glycine max
  Peptide Sequence Number=SeqID_180757
atggagctcatcgagaacatggcggccagtgatcaagcaatccttcgtgatcgaagctatgtgcctacaaaaagaagccttttggaacttggcacgcaagacgcgacattttcaggaactttcatccctagcaaagttccatcagctttagtgtgtcatccccatccgttatgtctagagattcttctacgtatggacacagctcgcctcgtcctcgtaaaagagccgtggtggatgatgtga

SEQ ID NO: 89073 - DNA, 543 bp, Glycine max
  Peptide Sequence Number=SeqID_180758
atgggtgaaatagaggaggtgcaagagcggatgaaggctgacatggaggccatgaaaaagcaaatgatcacaatgatggaggccatgatgagcacgaagaagataacggaagtcaatgtggctgcagttgcagctaccagcgccgttgctcaggtggacccgactcccctatctggcctcaaccaaataaatcatccaacctcaaatatggtaggtcaggaaggcaaagagttaggaagtgcaggcagtccccattttgtgcaagttcaaaacgagcatcccttcccgccttatggcttgcctccgaactatatgccacccaatgtggcgcacactcccgatgagaatgtcaataactccaatctcatactcgctgagaaccaacaacctcaatctgatcatgcacgtgtctctcaatgcatgggggagacacatgaaataccctaccacaatctacctgacttcgagcctcgccttggatacaccactaagggacaaacagttggtggtgtagccctaccaaacactttagagggctcttaa

SEQ ID NO: 89074 - DNA, 417 bp, Glycine max
  Peptide Sequence Number=SeqID_180759
atgatggactatataaaaaggttgaaggtttgtatcaggtggttccaagaccttgagattagctactcactagagcaagaaaagttgaagagttcattggaattggcccaacaaaaatgcacgaaaatagagctgctgctaaaaatcaaggaagaaaagctaaattcaattattatggaaatgagaaggaattgcactcctttacaagagaaattggtgaagaaagaatccgaaaaaatagtgacaacagaatctcttcttaaagagagagagactaggcttaactttgagatgtcacagagcacactgcaggaggatcttgcacgggcacaacgcgagctccaaagtgcaaatcagaagatatcatctttcaatgacatgtataagcggttacaggattacataacaagcttgtag

SEQ ID NO: 89075 - DNA, 225 bp, Glycine max
  Peptide Sequence Number=SeqID_180760
atggaggctggatctttgagcttcaatgaggctcttcaaaggagaagaggtgagaggaggcgccatccactagggaataagccatggaagaaggagcttcacgaccaagagagtgccttggataagaagtttagagaggaaacttcaatggaggaaaagaaagaaagagagaaagagagagaggggagcacgaaattgaaggaggaaaagagggagagaagttga

SEQ ID NO: 89076 - DNA, 374 bp, Glycine max
  Peptide Sequence Number=SeqID_180761
atggagaacgatggtgtagaaagattaggacatggagtagagatgagaacaaaagaagaagaagaacataaaactattgaagacaaaaaaggaagtaactggacgaggattgagagcaggtggggatgcgaaatctatgtgtgtttgccactccaaaatgctccacaacgtgctctctccgacgcggagtttgcacatgtcgaggctgagttcgggtttatgttcccgctagacctccacaatgcccacgtcgttgatcttctagtcagttcaagattccctgactggcactcgggcgcaacgcggttggacatacgcatgtccctaaacctttcgatcgcgatgatttcattccaaatttgcacggaacacgg

SEQ ID NO: 89077 - DNA, 804 bp, Glycine max
  Peptide Sequence Number=SeqID_180762
atgcctaaagaaatggaagaaacttacattcaactagtgataattagctcttcatatccccttaatatacctataaaaagcgctccccttaaagatgattacctaacaagtggatcctctggtccttttataggacaagtggatgatgcgactcagagtaaaaaaacatctagcagggcatcccaaagcgttatcattgggggtgaaacaacgtataggctttcagaatcccaacgtagctccaacaacgtatccagctttggaggaaaggtgagtcatgcaattcgaagtgaagtaagatcccaatactccaacagcattggacctagctttggaggacaagtgagccatgcaattcggagtgaacaaccatccaaagagtccaacagtaccatacctagttttgaagggcgagtgagtcatgcaatttggagtgcaaaaacatccaaagagtccaacagttccatacctagttttgaagggcgagtgaaccatgcaatttggagtgaaaagccatccaaagagtccaacagtaccatacctagttttgaatggcgagtgagtcatgcaattgggagtgaaaaaccatctccatactccaacaacaacagacctagttttggagagcaagtgactcatgcaattcaaagtcaagatgcatatacatccctatacttcagcaatatccctaaccctaaccctaaccaagacctagtgcatcataccattagggctaggagtgcacctcttagacgatcgatctcaaagttatggagggcatgcaaatcatgcaatatctcgtag

SEQ ID NO: 89078 - DNA, 304 bp, Glycine max
  Peptide Sequence Number=SeqID_180763
atggcttcatcacttgccaccatgttctcaatcaattccatagctaactctggtgtttacagtttgatcttgccacctgcagaagcatcaaggagtttccttattcatctaggaattaatggaaggatgaaatcattgatgcaattctaccccgcaagggcattgggtagaagattccaagtagattgggctagagatccaagggaaggccctagggttctcatgagccttaggctaagctttagcttctttaggaatcttcttaaggaagcttctcaaggaggtgagcttagttatgagaggg

SEQ ID NO: 89079 - DNA, 270 bp, Glycine max
  Peptide Sequence Number=SeqID_180764
atgggtagagccatgaggtggttgaagggcccctacaacactgcctgtgttcgatgggcccctacagcactgattaataggctaactgccattcaaaggcaatttctttggggtggtagctttgaagggaagaagatagcttcggtagcttggagacagatgtctgcctctagagatttgggaggtttggggatcaaacacattaaggtcctcaacaatgctctcctaattaaatggaaatggttgatgtttcaccaatcaaggttttga

SEQ ID NO: 89080 - DNA, 252 bp, Glycine max
  Peptide Sequence Number=SeqID_180765
atggagttgaacgttttggaggtaggtattaatgatagaactttgtctcaagctgaagtggagctcaagaaataccttcaggatcagctctggaatgcagcttatgcttttgaatcaggccagactgaagtgattattgaggttcttattcagatagcaaagaatgaggaaattgatctattcgtcaattttgttgcaaaaatagctacaaaatctaagcagaacctcagaagagcaatcatggctctttaa

SEQ ID NO: 89081 - DNA, 345 bp, Glycine max
  Peptide Sequence Number=SeqID_180766
atggggttcttttggttttatttccggcatggggtagttttgtacgtgaacagtgcgccatgcaggacccaaaccgccattgccaatggcgagtttggtgtcactgagcaagctgcaaatggcactggcgagacgtgcctaaaccgccattacaggtggcgatttgtacaagcccagaaccgccagtcaaactggcgagttcctttgagctttaaaggggagttgcaactgccattggcgagttgcctggaagttgcaactcccattggcgatttagggctcaaaatagccatcaccagtggcgattttatgcctatatatacgtttcagctgtgtgttttctga

SEQ ID NO: 89082 - DNA, 585 bp, Glycine max
  Peptide Sequence Number=SeqID_180767
atgagacgagggcaaagacgaaggagaggcagggatcatcgaaatcatcatcgtcattgtcaaaagaagaaggtaggtcaaggagagtggcggtggagaggtggttgtaggaagaagaaggtttgtcttttggttggatatgattccttcaatgaggtttgcttcttgccgtctgcgattgtgtctcggtttcaaggaaaacatgatggactatataaaaaggttgaagagctgctgcgaaaaatcaaggaagaaaagctaaattcaactattatggaaatgagaaggaattgcactcctttacaagagaaattggtgaagaaagaatccgaaaaaatagcaacaacagaatctcttcttaaagagagagagactaggcttaactttgagatgtcacagagcacactgcaggaggatcttggacgggcacaacgagagctccaaagtgcaaatcagaagcagtacaatggaaaactgcattcagagctttgtacagttggaaatgaacttaagcgtgtagagaaagataaagctattgtactggagtcccttaccatgttaaagggtcagcttactttgtctatg

SEQ ID NO: 89083 - DNA, 588 bp, Glycine max
  Peptide Sequence Number=SeqID_180768
atggcgattgacctctacattcgggaagtggatggcctaagatttgagctatccatgaaccagtgcagtgataagttgtcagaactggcacatgaaattctaaaagattatcatgtgaatttgatggtccttttgaaacccttaatattaccgtgtaatattttgaatgatgatattatgctctatctatttatccttgaggctttggtcattcatttaatccctctttgtcttctttatgcattacttcttggtgcatcaaggcattgtcctcttggcttggaaattcctttaaaaattatcctgacgtatctcttttgtggcctaattttcagtagacaacccaatcacaagggtggtgagacttcaagttcaactgagagcaatggtggcagtcaaaatgtccgtttgtcaataccaattttaccaaattccagttcttcattagtttcaatgacatactctccttctttcaactctagtcaacttgttgctcagaggaaactgtttgcagaatcccaaataggaaggaccagttttcagaggcttttggagccaaactcaggttcctggaattgctccttatag

SEQ ID NO: 89084 - DNA, 333 bp, Glycine max
  Peptide Sequence Number=SeqID_180769
atggatgccaagcacctcacaaggaccaaagaaaggtcgcatgtcatcaagcaaaggtccccggacgaaattaggagtttactgttaaggaatctagggttacgggtgtcgcaacgtgctcttcgcgggcgagcgagggcgaggctcacgggtgcgctttccgaaggaggaagatgcgcggagtcgccaccaacgtttatttttggaaaacgtcgggaaaaccgatggaaactggtcaaaatgaaaattctaagttcgggagttgtatttacgcttgaggaaggtattagcacctctcacgtttgtcccgaaggacaacagtctattttttag

SEQ ID NO: 89085 - DNA, 363 bp, Glycine max
  Peptide Sequence Number=SeqID_180770
atgacatggcttcacattaaaggtgctctcccattaagcccaaagcagcatttcctacaacatttgggtgtacaacttgctggagtaaggatgaacagatggcaatactggtggttagccttaacgtggtctatttggaagcttagaaacaacatagtgttctccaatgccagtttcaatgctaatgcactgtttgaagatgcgacttttctactgtggccttggctaagggattttgagaaagctgttggaagaggcccaacaattatgggacttggggacaaccataggcttggaagcagacacatgtcacttgtgttttattcaaagctttgcagatatggaggccagagacaaaaatga

SEQ ID NO: 89086 - DNA, 492 bp, Glycine max
  Peptide Sequence Number=SeqID_180771
atgaccgaccctctcgatgagtcgatctcttgctttctcataagggtggacccttgggtactagttaccctcaccttcagaggactacatgtcctcactttcagagggctacacaccctcgccatcagaggactgcatgtcctcaccttcgtagggctacacgccctcacctttagaggactacacgactacacgtcctcaccatcagagggctgcacgccctcacctctcagaggactacacgtcctcgccttgagagggctacccgccctcgccttgggctacacagggctacacgccctcgccatcagaggactgcatgtcctcaccttcgtagggctacacgccctcacctttagaggactaaacgtcctccccagagggctgcacgccctcaggactacacgtcctcgccaacagagggctgcacgccctcaccttgagaggactacacgtcctcgccaacagagggctgcacgccctcacctttag

SEQ ID NO: 89087 - DNA, 378 bp, Glycine max
  Peptide Sequence Number=SeqID_180772
atggctgcaagtgacattgctattctcagagatagaacccacgtaccaacaaagaaaagtcttctggaacttacatcgcaagatgcgttgttggcacagaacaagttgcagggtgtgccatctgtggtgaagctcacaattctggctgttgtatccccaatgaagaacgaactcatgaagtcaattatatggggtaccagccaagacaaaatttcaatgcaggtggatattccaggcttcagcatggtcagccatataattcataacagggacaacggagtaatcaccctggaaaccagttcaacaaagaccatgggtcgtccatctaacaggccacaacaacaagggcctagtctctatgatcaaacaatgaagtag

SEQ ID NO: 89088 - DNA, 159 bp, Glycine max
  Peptide Sequence Number=SeqID_180773
atgggtttacatcattttggtaatcagagctttggttcaagggtggtggtgaacatcattggatggggcacaaagattcttgttggatgctctcaatgctcaaatgcaaagactattgagagaacaacgaggagttgtatgaaagaattgagcgattag

SEQ ID NO: 89089 - DNA, 648 bp, Glycine max
  Peptide Sequence Number=SeqID_180774
atggaggccatgaaagaccaaatgtctacaatgatggactccatgatgagcatgaggaaaatgatggaggtcaatgcagcttcagtcgccactacaagtaccaccactgaggtagacccaactcacccatctggtatgaatcaaggaggcgaagtattgggaagtatgggcggcccccattttgcgcaggtccagagcaagcattcattcccactgtatggcctacctcccaactatgagccacccaatgttgtacatgtgcctgatgagaacatcgaccactatgctcctataccccttgagagccaacaacctcagtctgggcatgcacatgttgctcaacccatgggggagacacatgaagttctagccgacttcgagccttaccccggatatgccactgaggggcaagcatttggtggcataccccagccaaacaccttggggggccttcagtattgcccacaaccacaaccacaacccttacatttttcggtgggaagagtgcctcctgccatggtggaaagggaaaaatatgatcacctagaagaaaggctgaaggccattgaaggaggaggagactacccttttgtcgacatggcagaactatgcctagtgcccgacatcatcattcctcccaagttcaag

SEQ ID NO: 89090 - DNA, 45 bp, Glycine max
  Peptide Sequence Number=SeqID_180775
atgttaaatgtgacatgtgacatcgattttttaaaaactgatgtt

SEQ ID NO: 89091 - DNA, 276 bp, Glycine max
  Peptide Sequence Number=SeqID_180776
atgaagtctgttttcaaattctttctatcattatcaaagaaagatgtggcattgattgagttaggtcctggtggcctcttcttcactggagatgagagtggtttgctgatggtgtggaaatggttggagtctgttttcaaattctttctatcattatcaaagaaagatgtggcattgattgagttaggtcctggtggcctcttcttcactggagatgagagtggtttgctgatggtgtggaaatggttggaggtacccaaggtggcatcctcttga

SEQ ID NO: 89092 - DNA, 330 bp, Glycine max
  Peptide Sequence Number=SeqID_180777
atgagccgataccatgtttccagcagcgaaggtcaatatgagaaagaatccggcgagcaagttctagccaataagctgggcatcaccgatagcgacgaactcgacggcgccgagttggtgttgctggagcagctctaccgttccgttttcgaacagcactttccattaggaagaatcaccgtcgagatgcttaagggatggcatcaccgctggttaggcaatatttatgcgtgggctggacaagcaagagccgtcaatatcagcaaaggaggcttcattgtttgccccttcgacgcgattgcccaaaactactggacgatttcgaagtga

SEQ ID NO: 89093 - DNA, 365 bp, Glycine max
  Peptide Sequence Number=SeqID_180778
cggatgccgggagcagacaagcccgtcagggcgcgtcagcggctgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggttacgccagggttttcccagtcacgacgttgtaaaacgacggccagtgccaagcttgcatgcctgcaggtcgactctagaggatccccctag

SEQ ID NO: 89094 - DNA, 210 bp, Glycine max
  Peptide Sequence Number=SeqID_180779
atggtagccataatcccaacaaagtgggctaagcgagcatccaccgctaagcacaacttcagcgcgcttagcgcaacaaaagaatctcgtagagcatcagcattaaggccgcacattaagcgcgagattagtgcgctaagcgcaacaggtgtcttcagccaggcccagcgcaagactggcgctaagcccaaacccacttactcgcgctaa

SEQ ID NO: 89095 - DNA, 761 bp, Glycine max
  Peptide Sequence Number=SeqID_180780
gctagggcaacagttgaagagctgaaaaagtttctggtagctgactcattggaagaaatgaatagaaaactggataagttttacatggtcctcatcctgaggagtctacactctgactttgatcatgtgcgtgatcaagttcttgctggagatcaagttccatcaatggactatctcatcacaaggttactgcgtgtgcctcatgcgctgaaagaagaaaatccagctgatgtggtggaaacgtcaacaatggttgcatctcgtggaagagggggaggccataatagtagaagaggccgcagtggaaaaggtggacgtcctcaatgcacatattgcaagaggataaagaagaatgaaaactatgtcaagcaagccaacaagaaaaggaaggaagtggtacttgaacccggtgatgatcttggacatttgaggacaaatgttttccaagaaggagggaatgatgagaatcatgaaactggtcaaatacaggctaaaggcccaagtggagaaggacgaaggcccaaggacttttggcatttgataaaatttggtgagagtttctctctgagttccttgttgaaccaatctcagacttatcaaggtaatccttgtggcgtctaccctgacttattttccttcaccggaagtggcgtcaaccaaacctccgtagcctgtatcaaacgatccactcctactcaggttcgcatcatctgcaagagaattgctattccctgcatggatttcctgaaaaagttgccaag

SEQ ID NO: 89096 - DNA, 342 bp, Glycine max
  Peptide Sequence Number=SeqID_180781
atggtggcccgggtgatgttggggtacggctatgagctcggaatgggtttgggcaagaacaacagcggtagaaccagcctggtaagcaccagaggaaaccgtagcaagtttgggttaggctataaacctacgcaagctgacataaggaaaagtatctcagaaaggaagaatagaggccaaggctcgcggttgggacaacaagccgaaggggccccgccctgccacatcagtagaagctttataagtgcgggtttaagacacgaaggccaagtcgccgcgatatgcgaggatgactccccgaggagatcggatttggtacgaccatgtcctcctggtttctga

SEQ ID NO: 89097 - DNA, 492 bp, Glycine max
  Peptide Sequence Number=SeqID_180782
atgactggaaggctgcttgtcggttcattggctcttgaaagccgcatccttcattatctaattgttcgtatcctactccctagatcttcaaaccttgcacaggtttctgaagaagatctactagtcatgtgggcctttcatatcggtcgaaaaattaattgggcacatctattccgatctttcttgatcggtgttgttgtggttgcctcctttggttactgcaaagagcgtgatggctcttgggtaaaaaagggtgctcaaccaaatgatgatgaaggacacttaccagttgaaagggactcttctcttcttcagagtattttggacaggtttgatggacttcaaacctatgttggtgagaggtttaactccttggaacgtcaagtggacacacaattcgaggagatgaactcaaggattacaaaggttgaagaagatgtcaccatcattcacaactaccttgatttacctccaccaccaccaccagtttag

SEQ ID NO: 89098 - DNA, 379 bp, Glycine max
  Peptide Sequence Number=SeqID_180783
agcattgtgtcccgacgtccttcagcacaaagttcctttaagcacttcacctagccatctgctcccccgaacacaaggttcaggatcatcacaggatccaaacacaaacagcaaaccgggacaagcgcatgagacaatttatgctaagactcaagcctatatgcaatgtggtaccatgtcagtgaaaaacctcgtcgggcgcctaggagtacatgacaagacaaaccacacaatatgttttgcgagaatgctccaaccatatgggatcaacataggcttaaaggagcactcaaaccgtgtgacccccaaggcctacactccgaagagtccgtcagggcctctccctcctgattcaggtccaacccagaaaacattttag

SEQ ID NO: 89099 - DNA, 219 bp, Glycine max
  Peptide Sequence Number=SeqID_180784
atgaacctgagagcgttttctctggtggggatgcctgtggcggttgggcttgcgttctggctcgaggtttgttgcgcgggcctaatgttgtatatgattgggaccgccgattgggagtaccaggcctgtcgggcccagttactcacggcccttgatcaaggatccgacggccacaaacaaccgttgctagccgctgtggacaagaacaacaactcttga

SEQ ID NO: 89100 - DNA, 1194 bp, Glycine max
  Peptide Sequence Number=SeqID_180785
atggggagagccactaggtgggtgaagagtttgtttggaataagaaaagagaaagagaagaaacaaaacttcaagtgtggagaggctaaaagcatggaattctgttgttctgagagtactagtaattcaagagttttgtgtcacaatccagggactataacccccaacctttctcaagctgaggctgcttggttacaatccttctacacagagaaggaccaaaacaagcacgccatcgccgttgctgctgccacggcagcagcagctgatgctgccatggcagcagcacaggctgcagtggcggttgttaggctcaccagccaaggaaggggtggcaccatgtttggggttggacctgagatgtgggctgccatcaagattcaaacagtgtttagaggatacctggcaaggaaggcactgagggcattaaaaggattggtgaagttgcaggcacttgtcagagggtatttagtgaggaagcaagcaacagcaaccttgcatagtatgcaggctcttgttagagctcaagctactattcggtcccacaaatctcgcaggctcatgaccacaaagaatgaagcatatagatctcaaattagagcaagaagatccatggagaggtttgatgacactaagagtgagtatgcagttccaatccacagtagaaggtggaagtggacactttcacgcctaagtcaaggaatagaaggacagtatcagattttggtgatgaaccatcacttcaagcactttcaaacagaaccccctacgcgtttgtccataccagaccaaaggaattttcaggactctgaatgggggttaacaggagaagagtgcagattctcctctacagcacaaagcactccacgcttcacaaattcttgtagctgtggctcagttgcagtacctatgacaccaaagagtgtgtgcactgataacttgttcttcctaaggcagtatgggaattttccaaactacatggctagtactcagtcttttaaggccaaattgaggtctcatagtgctccaaagcaacggccagaacctggtccaaggaagaggatttccctcaatgaaatgatggagtctaggagtagcttgagtggggttagaatgcagaggtcttgttcacaggttcaagaagtcattagtttcaagaacgctgtgatggggaagcttcagaaatccacataa

SEQ ID NO: 89101 - DNA, 208 bp, Glycine max
  Peptide Sequence Number=SeqID_180786
atgtcgctttctttaagacgtttcgtggcactgtcaaaaattgtgcaagcagactatcaaccacgacgtccccaggataaaacaactcagatcactgcaaccaaaaattttatagcgacagaaagaaagagggagaagtttgccggaaatgcatcggttgaaatatgggagggagaaagaaaagttgaggaaatgcttctcaactggg

SEQ ID NO: 89102 - DNA, 381 bp, Glycine max
  Peptide Sequence Number=SeqID_180787
atggatgaaatttggtctcagatccacaaaagccaaccacactacaatgaagctaacaatagtcttgccaggaatgagccactactcaaaaggcagcaaacacttggggaaatgactttggaggatttcctagtaaaagctagggtggtacaagaatcatcatcactattcaagtcttcattattatatcaaaatcagattggtaacattgcaagtaatggaccattgagtgcaagttataggttcaggcatgtaatagggacaggatctattataaaggatgtcactacaaatggcgctgtggagaaatgtccaagcttaggagaatcaagtgggaaaggtaataggaaaggatcattgatgaccctcgtgaagtggtag

SEQ ID NO: 89103 - DNA, 1029 bp, Glycine max
  Peptide Sequence Number=SeqID_180788
atggataactcacatgtcacagataatgatggttgttcaaagttgaatggaatgaacgccgaacacgccaacacttgtgaaggtggaggtagcggcggtgttcgatgttgcagtggtcgtcagcggtggcatacgaggtacacaatgttgggtgcgttctggtgtactgcgtttcacacggatcaagttgatctccgagatgatgttttgtggtgggctcaatccgttgcttatgaaaatggatttgtggcagtgattgtaaggaagaaagaatttgttagaagagacactgagactaggaaatataggtatcccttcaagcttcgtggtaagcttgtggtgggaggacaagggtggatgacgaagttgatttgtgggattcataatcatgaattggccaagtcattagttggacattcatatgccggtacttacaaaacaaacatgtacagactctcactgctcgattttgttgaggtgacaccaactgggatgacattctctaccgattttgtatatctggagggtgaacgtcttaataatgtgatttgggctttagaacggtatgctttaaatcagattgctactaaatttgagcgtgttcactatgctggcaacaatccttctagttgtggttgtgtgatgagaacaacacacgatcttccttgtgcttgtgagctatccaaatatgttgttggttgtatcctattggattcaatccatatgttctggaggagactcagtttttcagatcaagggatatttgagcccaagacaaagcttcgaggaattgcataccctgatcaaaattcgatgtgttctcctctagcaaagcaaaataacaattcgtcagtgaggcgtagttcatcatcttctgaccaacccaatccaagaaggatgatgtctatgctggatcaatttcagtcatttatccatgtcttcattgataatatagttgatgttggagctgatggaaattgtggatatcaggcgattgccggtttattaggtatgagtgaagcctcttag

SEQ ID NO: 89104 - DNA, 1782 bp, Glycine max
  Peptide Sequence Number=SeqID_180789
atggagaagaaggttagtcttgaagtgaaaccagaagagggtgatgaggtgaaatgggttcttgattcttcagtggaccacaaaggcagggttccactcagagcttcaactggttcttggaaagctgctctcttcattattgctattgagactagcgagagattgagctacttcggaatagcaactagtttggtcctttacctcacaaaggttatgcatcaagaactcaaaacagcagcaagaaatgtgaactactgggctggtgtcacaactttgatgccactgtttggtggattcatagctgatgcatatttgggccgttactccactgtgctggcatcatccattgtttatctcattggtttggttctccttactctgtcttggttcttaccaagcttaaagccatgtgatggcacagacatgtgcactgaaccaaggagaattcatgaagtggttttcttcctggccatttaccttatatcttttggaactggagggcacaaaccctccttggagagctttggagctgaccaatttgatgaggatcatgatggagaaaggagacaaaaaatgtcctttttcaattggtggaattgtgctctatgcagtggacttattgttggagtgaccctcattgtttacatacaagacaacataaactggggagctgctgatattatcttcacagtggtcatggccttttcactgctcatcttcataattggaaggccattttatcgttatagggtaccaactgggagtcccttaactccaatgttgcaagttcttgtcgctgccatttccaaaagaaagcttccatatccttctaatcctgatcaattgtatgaggttcccaagtataacagcaacaatagaagatatctgtgtcacactaacaaactcaaatttcttgacaaggcagcaattcttgttgatgatggaagttcagcagagaagcagagtccatggaacctagcaactgtaactaaggttgaagaaatgaagcttattatcaacattatccccatttgggtatccaccataccatttggtatgtgtgtagcacaaacagctacattcttcgtcaaacaaggcacccagttgaacagaaagataggtgaagggtttgagattcctccagcttcaatcttcacagttgctgcattgggaatggtagtttctgtggccatatatgacaagattcttgtgcctgcgttaagaagggtaacacaaaacgagagaggaatcaacattcttcagaggattggctttggaatgctcttctctattgctacaatgatagtagcagctttggtggagaaaaaaaggcttgaggctgttgagagggaccccttgaagggttcactaacaatgagtgtgttctggttggcaccacagtttctcattattggttttggtgatggttttactcttgtgggtttgcaagagtacttttatgatcaagttcctgactcaatgagaagcctaggcatagcattttaccttagtgtaattggtgcagcgagtttcctaagtagtatgctgataacagttgttgatcacatcactaagaagagtgggaaaagttggtttggtaaggacttgaatagtagtcgattggacaaattctattggctattggcagccatagccacggtgaatttgttcttgtttgtgtttgttgcccgtcgatattcctacaaaaatgtgcaaaagttagcagtggctgattgctatgaaggcaaaagtgactgtgagggggtggaaaccaaggtttag

SEQ ID NO: 89105 - DNA, 153 bp, Glycine max
  Peptide Sequence Number=SeqID_180790
atgggccctaacggaaggtcctttaattcagccgtgaaactttgctgtgatgatggggtgaacactgagatttttagtctagaggttcgggaagtagtgtggcaagggaggcctaagtgcagacagtgtagcttggttgctgctaggatttga

SEQ ID NO: 89106 - DNA, 204 bp, Glycine max
  Peptide Sequence Number=SeqID_180791
atgactaaggggaagaaagaagaagaaggccgtggcgaccgggaaggaggtcacggcggaggaagaagaaagaaacaacgtatgaggatagagggagggggaggggaggagaagagaagaagaaaggtcaggagaggagaaggagaagaaaaagaaaaaggaagtgtaggttgggagaaggaagtgtactttggggtagggtag

SEQ ID NO: 89107 - DNA, 324 bp, Glycine max
  Peptide Sequence Number=SeqID_180792
atggcattatcaatgccatttctttgttatctgagtcatgttgcttttaggccaagggtaaagatccctacctttgttatcatgcccattgcacatttggtggagtggatatataagcagctaggcccatatgggatgaagctgcctcaactaattccttcaagaataagactcatatcttgcagcagaacttttgattgctcaaaagcaaaggatcgccttggctatgcccccatcgtaacaccacaggaaatgaagtatgagatgttactcttgaatggtgatatttcagtgcaccaaggagggtctgcggaggacaattga

SEQ ID NO: 89108 - DNA, 396 bp, Glycine max
  Peptide Sequence Number=SeqID_180793
atgtcgctttctttaagacgtttcgtggcactgccaaaaattgtgcaagcagactatcaaccacgacgtccccaggataaaacagctcagatcactgctaagaagatgagggaggagtatggaaaattgaataaagtgaaaatgagtatatgggaatgttgtgagatgcttgacaaaattgtggatgtcagtgatcctgatttagaagaatctcaaattcaacatgccttgcagacagtttttacagatttcggaaaggctcttatccttccaagttttggtgggcttcctcaatgggctgttgttgaattgaatgagttggatcaactgcttattgaaggagcggaaagattggatgaggaaccaagtagggctggtcttttggatgatttatga

SEQ ID NO: 89109 - DNA, 360 bp, Glycine max
  Peptide Sequence Number=SeqID_180794
atggttagaatcagaggattgcgtcggactttaggcaaagttttaagaagagccttagggagacaggttagtgatgatgtgaaagaagcccctcaacgtcaaaggccaacaacatctgcacatagacaacaagcagctgcaactgttgctgaggatgaacgtactgagttgaagttgacctctcatgggatgaagatagagaaatttggaaggcctacatctgagattgaaggcatagtggctgctacaggattaagttctctgattacatgtttgttggacactagtgacaggggacttttatctacttttgtggaagctggtacaaggaaactagtagttttcttctaccggaagtag

SEQ ID NO: 89110 - DNA, 572 bp, Glycine max
  Peptide Sequence Number=SeqID_180795
atgacttccatcggagaagagtcgagcaatgatgatggaggggacgggggaggtttgttgtatgtatcttcgaatggtgatagccctaatgcgattaaggacttccgtttatccatcggtctctggatggtacacggtgctaaatcgcaactcggtgccactgagtcgaaaaaggtggcgaccttgtatgcggaatggtgtgggggtaaagcaccaaaatgggcccctttagagaaacggtcgaccaccaccaaaattgtggtaaagccatgggactggggaagtcccatgatgaagtccattgaaatgtccacccaaattccatttggtatagacagaggaggtcccgtcaaatggaatattccgggtgggcatttggatgaagcccaaccttgttccataagtccaaaaaaacaggggactgctaaagtgacctttgtaggtctaccaagaaatcgaatgctgaacactgcacccattgtgaaaccagaggcatcgatttctagtgtgaaagggatggagaaatcaagaggaaccaaaatagaggcagtggtcatggcgtgtttcagttg

SEQ ID NO: 89111 - DNA, 555 bp, Glycine max
  Peptide Sequence Number=SeqID_180796
atggcagctttcttgatgaatcttgaatcaaattttgacaacaagcaacagggacatgagagtagtctaaagttgaatgttaaagtttccattaggccttgcaaatcttgtggagagaagctagagcgagcaaatgtgaaatggcatagtacaagtccttatgcaacaccacttatcagttcgactacatatatattcaagacaaacatattagggtgtccttgtgtgatgatatcaagccctgaggcagctagaattgtgcctgtgactcacgcacatctcttcaagccaacgtaccctccaagcaaagagaagttgatagggccagaggctgtgttctttcaacaaggtgcctatcactccatgctcaagaggttggttcaagcctcatttttaccctccacaattaagcactcagtctttgaggtcgagcgaattgtcatcaaaatggagcttgaaatggaagaaatcagggagctctatcgttgcttggagaagggatacaactcttatccattacatgttcctggaacttcctattggaaggcaatgaag

SEQ ID NO: 89112 - DNA, 228 bp, Glycine max
  Peptide Sequence Number=SeqID_180797
atgaggattgaggagttgatgcactggaggttgatcaaaacattgagggagaactgtcagaaacttagtgggctgccaactaaagtagaacttagaccacattggcagcccactaagagtagaccaccgaagaggaagcaggggtgccaagttcaaaagatgtggcaagacttgaagaaggaaacaacaaattcccaaaaacaaaagctgcacttgctccagggctag

SEQ ID NO: 89113 - DNA, 456 bp, Glycine max
  Peptide Sequence Number=SeqID_180798
atgaaggatggtgagttaatccaatcggaattacctcccacaacacaataccaactaccaaatgtcaaagacagtaataataaacttgtcatggccattccgttcaaaacaaaagatgtcaacgaggaagcaacctctaaagacattaaaagcctaatggaacaggcaaattataccaacaaatatttacaagtttttggagagtccatcaaaactaagcgtacaactgcccctgaccttctattagaagaaagaggtgaaaagaattttaagagttttagtgcaaacaacatctatgaatggaacatagatgcacaaacggagtataatatcatgaatacactccaacatatgactatggtagccacaacctacaaaacctcccatgagtgttcggaagaaacaatcatagatattttagtggcaggatttttcgaacaattgaaaggatggtga

SEQ ID NO: 89114 - DNA, 381 bp, Glycine max
  Peptide Sequence Number=SeqID_180799
atggtcgaagtcagtataaaaaacaaaacgaggtgggccaagtccatcaacagaaaacacattaatgagtggttcctagctatccgtacatgccttatgccaccgccaaactatgtttttggccctcgtgatgctgtcaatgttttcctactggaagcatccgagctaagggatagtaatttggcagattgtggtggtctcattgggtaccataatgggaaatatgtgctgggctttatggtgaaactaggcacatgctcagtttctagggctcaactttgggctatatttcaaggtctgaaacttgctttggacagagagctcaccaacattttgattgaatcagactctactgaggctgaggctgaggctgttcaataa

SEQ ID NO: 89115 - DNA, 1083 bp, Glycine max
  Peptide Sequence Number=SeqID_180800
atggttagaaccagaggtttaggtcgtgccctagaagctgcccttgttgctgaggatgctcctgatatgactgaggacatacttgcacctggtgcagaagttgctgatggttgtgagggatttcctatagatgatgctgagggattcccaggtggatcgcgtgacccatcagtgctgactgagtttggtgaccatgttgcacttagcatatggaatggagaggaacgctctaaattgaagttagcctcccacaaaaggaaagttgagaaatttaggaggcctgctccagaaattgaagggctagtcgctgccacaggattaactcctttgatcgcgtgctcaatagacactggcaattggggagttatatccgcttttgtcgagagcttcgagcctttgcatatggatgaagcgatgttgatgttggtggagttgctagaagtctcgggtgaggaagctagagctgagactacacaatgtcatggggcatatagtggaagctatgcatggggagctaccgccctagtgcatatgtatgatcatttaaatgatgcttgtaagagcggtggccaacagcttgctggttacatcactttaatacagtgttggatatatgagcattttccaagtgttcatgagagcgtgattgatctagagtatgatgagacgtcaccacatgcctgtcggtggcttactatgaaggcttattcgaagggattcccagcatcgacgtactggacacatatagatgcactgacgatccctgatgtatgttggatgccttatggtgggcttagatggggtcccgttgtggtcacacatcgaccagagagagtggtgcgacaatttggatacgttcagaccattcctccactgcctatgggtgccagcttgtcatatgaagatatcgacaacaagtggatgcattactcggaccatttagtagcagttgatccgcccagacatccatctgtcccacaacatgacacatacgaggagccagatatccctgaggtcctagtggcactagaagttggaccttcacatgcaccttctgatgcggagcagcctagacatgctgtg

SEQ ID NO: 89116 - DNA, 582 bp, Glycine max
  Peptide Sequence Number=SeqID_180801
atggagagaatgaggaagaggcagcccatgaaggagccaatggcgaagcccaccatgtcgagccttagggccctgaggttgatgtgggcccgaaagggctcgtcagcgtccttgctgttgagcagatttagcgctaacttcagcccctgcgccgctagaggagtgattctcgaggctgccttaggccggggtggtgagggagaggcccacgaagacgaagatcgtgaagagggagttcacgcttaccaggccgcaacggcgcaacgaaccctaaagggggcggggggagtcaaagagagagaagcacaagagacggtgggggaggttgagccagaaggaatagtagcaggcgaggccatagctactgaagacgatgtggaagatgccgagttccttggcaatagtggcagtccagccgaagaagatgtcaaagatgataagaagtttatgtttatggttttggatgaggatgctggtgctggcttcgatgaggcaaatgatgaagaggtaagggatggcattggtgttctttgtgttgggagggaggccgtggtcagaggagtaggatttggaagaggatga

SEQ ID NO: 89117 - DNA, 231 bp, Glycine max
  Peptide Sequence Number=SeqID_180802
atggaagccaaaactgatgcacatttggtacaaactgtgaatcaaactagtaattcaaaaggcctagctagcctcttctccttccaatcaaccccacgacgtggagcaacttcccgcctcgaacttccaagttgggaacatattcgaacaacagctaatacatacttcactgggctgcaaacggggaaatttgtgtttgcctgcatttatgtgtttacaatgtatatgtaa

SEQ ID NO: 89118 - DNA, 135 bp, Glycine max
  Peptide Sequence Number=SeqID_180803
atggattgggtggtgccggagagtcaccagaagcatcatggtggcggtggcctgcaatggtggtggaggaagattaacccttgtgcttctttaatgattttgccatttggtgaagtttctaaaggtttatggtaa

SEQ ID NO: 89119 - DNA, 288 bp, Glycine max
  Peptide Sequence Number=SeqID_180804
atggattttagtcataacccaacacatcctgataggttcataacaccaacagtgggtaaacatcttagggactttctaggaggatttctcgagtatgatgaacataataaccagggggtgaaggtggaagaattacatgtgaatcaaagtgaaattggatgtgcggggcacaatgataagttttgtgctcaactatttgcaaaggaggaagacgatggagtaaaaaattggagtgttgatcttagagtagatataaggaggataggaggcatagagggaggcaaatga

SEQ ID NO: 89120 - DNA, 234 bp, Glycine max
  Peptide Sequence Number=SeqID_180805
atgaagatagcgtgtggtgagaggaggtttcaaaatacaagagagtggaaagttggtgatggtcatttgataaggaggaaggatggtaatgggactttaactggagaaggtgttggttcgagtgggagaaacaaatgctggggaaattcaacaacaaaatacaaacctgtaagccaaggcaaggaatatgtgacaactggatatggagtcgggacaattcttgatcattcttag

SEQ ID NO: 89121 - DNA, 201 bp, Glycine max
  Peptide Sequence Number=SeqID_180806
atgttgaagaaaaggggcctctcattggaacagaagcgcgagaagatgcttccaatcttttacgagtcacaagacttctacctgcttaggaatgtgtcctgcaaacttgattttgatctagaaagcagtaagaagcggcatgacattattggaaataaatttgtatgtccacgatccaagtcatcatgtaatcaattttaa

SEQ ID NO: 89122 - DNA, 708 bp, Glycine max
  Peptide Sequence Number=SeqID_180807
atgttaatgtgcaatgaacaatactcgtgtgttggctctatagaattattatgtatcgttattagaacaccagatgctatactcaatctgcttcaatcaaccatcactcctactcatgatgcaattattacaacgggaagtggaacataccacgtccaggtgagtttttggggttactcctttactggaactaatccaataagatttgacattccttcgggatgtggcatggagaagctcaaggatttaatcaagcaagttgcacctataggggttccccctaatggaattcacggatcacaattggttagacgattgttctttcgacaaccagtcatgcaaatcgcagaagacattggcgagttcaggctgggggtgacacgtggcactggtctcgccagtgccactggcgatttgagctccatgggactcgccagtttgattgacgagttgagcagttgggatacagggacacatgtaaagataaaggaaggtgaatgtggtgtgaaagatgaaagctgcagctgcaattgcatgagacatcagacatggagtgctctccccgtcggaaagcgagagaaaatattccgtgtatatattcctacctacacaactcgccagtcaaacctggcgagtcccatggagctcaaatcgccggtggcactggtctcgccaataccttctgcgatttgcatggcttttacgtaa

SEQ ID NO: 89123 - DNA, 933 bp, Glycine max
  Peptide Sequence Number=SeqID_180808
atggctgaatccgtttcagtggacatggagatgatctttctcggcggaaaggcagatatgtcatgtttccaaggattatttttctgtccagaggcaacttctttgcttcttcacaacttctgcatctatcatatcagtcctcctgggcatgagttgggagctgctgcaatttgttctgatgatccagtcccttctgctgaagacttagcagatcaaataattgaggttctcaattattttcggcttggtgcagtgatgtgtatgggagtatcgtctggtgcttatatcctttcgctatttgcaacgaaatatagggagcgtgttcttggtttaatacttgtatctcccttatgcaaatctccttcttggactgaatggttttataacaaggtgatgtcaaatttgctatacttctatggtgtgtgtggcttgttgaaagagtgtttgctccagcggtacttcagcaaggaagttcgtggtaatgctgaatttccagaatcagagatagttcaagcttgcagaaaactactagatgagagaaagggcatcaatgtctttcggtttcttcaggctatcaatgagagacctgacataacggaaggattgaagagattaaaatgtcgtacgcttatttttgtcggggacagttctcctttccattcggaggctcttcatatgacttcaaaacttgataggagatacactgcattggttgaagtccagggttgcggatcaatggttacagaggaacagccacatgcaatgctggtccctatggagtactttttaatgggatatggcttgtataggccatgccatttcagtgacagcccaagaagcccgcttagtccatcttgcatctctcctgagcttctttctccagagagcatgggattgaagctcaagcctataaagacacgtgttttgctgtga

SEQ ID NO: 89124 - DNA, 1341 bp, Glycine max
  Peptide Sequence Number=SeqID_180809
atgggtattgagatggagcaaccttgtgtggagctttcaaaagttgcagtttctgaaactcatggggaagattctccttattttgctgggtggaaagcctatgatgagaacccctatgatgaattaaccaatccctcaggagttatacaaatggggttggcagaaaatcaagtttcatttgatttgcttgaaaagtacttggaagagcattcagaggcttccacatggggaaaaggagctcctgggttcagagagaatgctttgtttcaagactatcatgggcttaaaaccttcagaacagcaatggcaagcttcatggaacaagtgagaggtgggagagcaaaatttgaccctcaaagacttgtcctcactgcaggtgcaactgcagccaacgaactcttaaccttcatcctcgctaacccaggagatgctttactcgttccaaccccttactatcctggatttgatagagatttaaggtggagaactggggtaaacatagttcccatccactgtgacagctcaaacaacttccagattactcccgaagccttagaggccgcatacaaagacgcagaagccatgaactccaaagtgaggggagttctaatcacaaacccttcaaacccattaggtgtaacaattccacgttcggttcttgaggagattcttgacttcgtgactcgcaagaacatccatctggtctcagacgaaatctactcaggctcggttttctcttcctccgagttcacaagcgtggcagaaatcctcgaggctcgccaatacaaagacgcggaaagagttcacattgtttatagcctgtccaaagaccttggccttcctggcttcagagttggcaccatttactcatacaacgacaaggttgtgaccacagcgaggagaatgtcgagtttcaccttaatatcttctcagacacagcacttgttggcttctatgttgtcggataagaagttcaccgagaactatatcaggaccaacagggagaggctgaggaagaggtaccaaatgatcattgaagggttgagaagtgcggggatcgagtgcttgaaggggaatgcagggttgttttgctggatgaatctaagtccacttttggggaattataaggccaaaggatcaagggaactaggtggtgaattggagctttggaatgctattctgcatgaactgaagctaaatatctctccaggctcttcttgccattgttctgaaccaggttggttcagggtctgctttgcaaatatgagtgagcaaacgctggaaattgcattgcaaagaatacgtgacttcatggaacgaataaggacagaaagcgtttag

SEQ ID NO: 89125 - DNA, 1557 bp, Glycine max
  Peptide Sequence Number=SeqID_180810
atggagatcactggtttgttccctctcgtgggtgagaactactccctcaagttgaaacgttcaatgcaagaccttttggctgagatccccaaagaatccccaaattttactcctttcgtcgatgcgttttacgaattgatgcaagcgaaggttgatccacccttcgaggtgacatgggtctacgctgcaattaactttcgtggtcgtaactcggagaaaaaaggcgatgccttggatagaatattggccgcaaaagacttgtttcagttgctatctgcatgttcagcttctgttcgtgcttcaaagagcatcgctttgatggctcctgttgttttcgcggtgaacggagtgattcaggagctgtttgggagggaattgagattgaagagagagaagaaagcaatgagggaggtgaagtctttggtggatgtagttcttgggtatataagcatttgctgtgataataataaggtttatgaggaagaacctgattctgtgaatttgatttttccttttactgatttggctcgtgtttgggtggacatgaatgatgatgaagggtttaaatctttgttgcctcttgtgagcggtgatgtctgtggctggattcgttctagagattttcatgggggttacttgggtggtgctgtcatcatggaagcgtttttcatgaaactttgcctttcttttcatttggcaacgtcaaaggatgaattggaaatgaatctcaagagttgggctgttggctcaatatctagctttcaaaacatatactttttggagatccttatgaggaccattttagagacagctttgcctctgatctcaatactgaaacctgaaggtgaaattctatcaaggaaaattctatttgatgctgtactattggtggactacccttttctctatctaaatgccaagtacataaaaaaccttatcttgaccagattgattgttactctcaaggctgtggagtattttagggggcttggtgatcagaatagagctatctcttatattaaggcattttctgcttctcgattgccattgcaaatcattaaatgggttacaagccagaatggtttggaggaaaaaactggcagagcaaatggatcctcccccagagctcttataaattggctgctgagccttgagaatcgagggatcagagtttttgaagatgatattttaaaaagccatgctacatcaggtcatgatatttcccaatctgagcacccagctggtaacttggagggcaaggtagcagatgatgaccttttttatgtggataatatcggggaagagggaaatacaggtgacaatgataagcaaaacaaattggttagtgatgcgtttgtagctgctgcccaaactatgaagttatccgatgatggagctcgaaaacgaaaaggaaaacacagtgaaaagaaaattaaatttgtcaaatatgacctccatcaaaactctgagccagtcaaagcaaggacttcagccgcagatgatagttcaagtggtgagagtgaagttgaggatcctgtttcagatacagatgcataa

SEQ ID NO: 89126 - DNA, 2121 bp, Glycine max
  Peptide Sequence Number=SeqID_180811
atgtgttacctgggaatcaaatccagatctttccctcaggccacatactcaattttttttttcttatttttcagagttcgacaccttcattggagtctccaaactaaccttaaaaaactcacactaccacttagattcctttctttcctcactgtctcagtctccatcatgctccccgccatttctcttccaaccaacataaccgtcaaaacgaacataaccgccacctccacacccagaaccacaaatacacacaaacacaaaacaacaccatttaactcaaccctaaaatctctgtgcaaatggggcaatttggacaaagctcttcgcctaatcgaatcatcgaagcccacacccattgaagaagaagaagaagaagaaagcatctctctcttcctccacgcttgcatatccagaaggtccttggaacatggccgaaaactccacttgcacttgcttcgttctcaaaacagagtcttggagaaccccactttgaagaccaagctcatcacgctatactctgtttgtggcagagtcaacgaggctcgtcgcgtgttccaaattgacgatgagaaacccccagaagaacctgtgtgggtagctatggctattgggtattcgagaaacgggttctcccatgaagctttgcttctttaccgtgacatgttatcatgctgtgtgaagcctgggaatttcgcgttttccatggccctcaaggcgtgttctgatttggataatgcgctggttggcagagcaatccatgcccaaattgtgaagcatgatgttggagaagctgatcaagtggtgaacaacgcgcttttggggttgtatgtggaaattgggtgcttcgatgaggtcttaaaggtgttcgaggaaatgcctcaacgaaatgttgtgtcttggaacactttaattgctggttttgctggtcaaggtagagtatttgagacactttctgctttcagagttatgcagagagaaggaatggggttcagttggattactcttacaaccatgttgccggtgtgtgctcaagttactgcacttcatagtggcaaggagatacatgggcagattctaaagtctaggaagaatgctgatgtgcctttgctaaactcattgatggacatgtatgccaaatgtggagaaattggttattgtgaaaaagtgtttgacagaatgcacagcaaggatttgacctcatggaatacaatgctagctggattttcaatcaatggtcaaatacatgaagctttgtgtttgtttgatgaaatgataaggtatggcattgaaccaaatgggattacctttgttgccttgctgtccggttgtagccattcaggactcaccagtgaggggaaaaggttgtttagtaatgtgatgcaggattttggggtgcaaccatctttagagcattatgcctgtttggtggacatattaggcaggtcagggaaatttgatgaggcattaagcgtggcagagaacattccaatgagaccaagtggcagcatttgggggtcattgcttaactcgtgccggctatatggaaatgttgctctagctgaagtagttgcagagcgattgtttgagattgaacctaacaatccgggaaattatgtgatgctttcaaacatatatgcaaatgcagggatgtgggaagatgtgaagagggttagagaaatgatggccttgacaggaatgaagaaagatgccggatgtagttggatacaaataaagcataagattcatacatttgttgccggagggagctctgattttcgttgttctgctgagtataagaaaatttggaacgagttgtcaaatgccgttaagaatttgggatatgtccctaacacgggtgttgttctccacgatataaatgaagagatgaaagcagtatgggtttgtgagcacagtgaacggcttgctgctgtctttgcactaatcaacactggtgctggaatgccaattagaatcaccaagaatcttcgggtttgtgttgactgtcattcctggatgaaggctgtttcaaaggttacaaggagactaattgtattaagagacacaaacaggttccatcattttgaaaatggctcttgttcttgtaaggattattggtga

SEQ ID NO: 89127 - DNA, 2576 bp, Glycine max
  Peptide Sequence Number=SeqID_180812
atggcgttgggcatgagcaggttcaagagggagcaatgcaaccgcacaaaacatgattctagcttctcccattggaagattctgattggccctcgtgattgggaagaccattcgaaaggaaaggaagggtgttcaaggtacaggattcataacctcccacaacaatcgggtccaggagtctatgagcttggaatagctgctgcggcatcagtgtcagagcgtaaaatttacaagcttgtccctcaccgtcaccgcatagtggttgtttacctcggacaaactgaaaatgtgagagaacgactccggcgttatggcggaaatggggaccacttggaggattcttctctccacttgtttcagcaagtcttttcacaaggattctcaatcctttatagatgggctcctatgcaaaacaaggaagatgccctgcgaacagaaactgagctgctcagtacatttgattatgcatggaacacaagaagtaattgtgtccggaggcctgatgatattcttcaaaagctccatcaaattgcttcaggcactagaacactttcagatattgccagagctcttctgcctttcactcagaagcaagtgggcatccaaattaaatcaatcaagttagatgaagcagacaatggcagcagctataacaatctcctatctcgactattcagctttaacagatctcgtcctaggttagttcaagatatcactggtgccattcaggaacaagagaatggtaaaatttgtggagtggcgctgggtgatggttcaatttgtacaaggccaccagctgaaaaacgaatgaggtgtcctgaacacaaaggaatgagaacaaatgtgtccactgccaaagcaataataggggcacccatgtcagagagccatgatttagaagaccctcctcaaacagtggttgatgaaagtctcacaaacacagattatatatgtggaatcctcttaagtgatggctccacctgtacaagacaaccagttaaaggaaggaaaaggtgccatgagcacaaagggaggagaattcgtgcagcatctattcaaacaaaggacaatggatacaaataccaaaataatgtcagcaatgatgtggaagaccctccacaaacacttgttgatgagagtatcacaaacaccaatatatgtggaatcatattaaatgatggctccacttgtacaagacatccagttaaaggaagaaaaagagcagaaagcatggagctcaaactccgcgcatcaatggcttccattccacgcgcagtcttcaccaattcctcttccttcgttcctttctgtacctacacggttcccgacgctagcaggcgtcgaaacggcaacaccggcagtcgttccactcacaaaatcactcctttgcgtaaggagaaacatcccaatgaacagaaattgaagctcgaccatcaaaaccaaaaccccttgaatgtggacttggtggccctctgtgaagagggtaacctcgatcaagtattggaactcatgggtcaaggtgctgtggctgattatcgcgtttatctcgcgctcttgaatttgtgtgagcatacgaggtcgcttgaatcggggaaaagggtccatgaaattctgagaagatcggcctttcgtggggacgttgaattgagcaacagattgattgggatgtactgcaaatgtggcagtgtgaagaatgcacgccgagtgtttgatcaaatgctggacagaaacatggctacatggcatttgatgattggtgggtacacgagtaatggtttagggtgtgatggtttattggttttccagcagatgaagcaagcagagctgccacctgatggggaaacttttgaattggttttggctgcatgttcacaggcagaagctgtggaagaagggtttttacactttgagtccatgaaggagtatggaattgttcctagcatggagcattacttggaggttattaacattatggggaatgctggtcaattgaaggaagctgaggagttcattgagaatgtaccaattgagcttggagttgaggcttgggagtctcttcgaaaatttgcacgaattcatggagatttagatcttgaagattgtgcggaggagttgttaacgcgttttgatccttcaaaagccattgctgataaacttccaacacctccaagaaagaagcagtctgatgttaacatgctagaggagaagaatagggccactgagtatcggtattctataccatataaagaagaggataatgagaaattgggaggtttgagtgggcagatgagggaagcaggttatgtgccggatacaagatatgtcctccatgacattgatgaggaggaaaaagagaaggccttgcaatatcatagcgaacgtttggcaattgcttatggtctcatcagtacaccaccaaggactacacttagaatcatcaagaacctacgtatctgtggggactgccacaatgcaatcaaaattatgtcaaagattgttggaagggagctaattgttagggataacaagcgattccatcatttcaaagatggaaaatgctcctgtggagattattg

SEQ ID NO: 89128 - DNA, 924 bp, Glycine max
  Peptide Sequence Number=SeqID_180813
atggcagatgttgcagacggggagaggtttgacagttgcatccaccccactgccgttgttcatcccaatgccgtcattggccagggtgtttcgattggtcctttttgttctgttagctcctctgcaaagctggggaatggttgtcaactacatcctggaagccatgtttttggaagtacagagttaggggacaattgcatgttgatgactggtgctgttgttggtgatgattatcctggatgtactgtcattggaagcaataacacgataggatatcatgctgtgattggtgtcaaatgtcaagacatgaaatacaagccagaggatgaatgttacctggaagttggacacaataatgatattagggaacatacttcaatccaccgatcttcaaaatcaaccgataggacggttattggtaatgccaattttataatgggatcttgtcatattgcccatgattgcaagattggtaacaacaatatttttgcgaacaatactctcctagctgggcatgtcgaagtggaagactacgttcacactgcaggtgcgactgttgttcatcaattctgtcatcttggctctttctcttttcttggtggtggttctgtggtttcacaagatgtcccaaagtacatgatggtagccggagaaagagctgagcttcgtggtctaaatgtagtgggccttactcgatgtggattcagcattgcagagatcaagagcatgagaactgcttatcgaaagatattcatgtgtgttgatgcaaatgctgggtctttagaagaaaggcttgcagaagtggagcagcatgaggaattggttcatgttcctgctgtgcgtgctatgttgcagtctattcgcaactcatttgctgaaaatcgtcgtggaatatgcaggtttagacaatggaatgcctcttga

SEQ ID NO: 89129 - DNA, 402 bp, Glycine max
  Peptide Sequence Number=SeqID_180814
atgagccaaacaagtggttatcttgttccaactagtggtagaagaagcggtgaagacatggttcctgagccagggggagaagccaacgagcatggactccttgaagcctcttccagggacatgataggttccatcgggtctagtgacgacgaaagagaagacaagaaggaaaaggagaagagaaatgaggatggccatgcagcaaaggtaaaaggccaagagcccctgcttgttccagtaagcacccacaaagcctgcaagagagatgaggagtacgaggaggccaagtacgaggacgtgccagcggaagttgtggatgcactcgttgtctgggctatgaagttcaacactgcactcatgttgttgcctacccccatcggatcggatgttttgcttgcttaa

SEQ ID NO: 89130 - DNA, 1008 bp, Glycine max
  Peptide Sequence Number=SeqID_180815
atggtgatcaacaacaaagagataaccaccaatcgctcatccatctcaaacctcaaaatcaccaaaggggtatctcgtaggaaatataagtacagccatgcaatcatcataacaactaatatgatcaaagaaatggggtgtcctagtaagctaaggaaaagcacaagcagtatgataatcaccatttcactccatggtcttgttgtgcctagaccgtcttcaatgcgctctttggcctgtgaaacgaaaactgagtttgaatttgatgaagcctcttctgagattgttccatatgtggctgctagtttcctagatcgtccctttaagtatcgtgtaggcaatgacgaaatttctgtgttctacgataattggctgggtgatggtccaatttgtgattgcatggactacgtgcatattagtgatacgcagcttctcatccgagatgttttggttaacggccaatggagttgggggaagttttattctattattcctgacgaagaattttcactgccaaatctgcctatgagtagtggattcatgagcctgccaatcatagtaattttccaggggactggaactgggtgtgggctagaagacgagagtattattcatttgcttagagattgcagtgaggcgagagaaatttggagtcacataaatatgtatgctgatactgatttctttgcaatgaatggagatacatggttcgtgtggtctgcttggtatactctagcacttcttcaaggttcaacaaaggtcaacaatactccttctcaccgtctggttgcttggacaccacctgtagcagattttgttaagggaaatccgagaatgtctggcattggtgggattctacgggactctaatggtaaatggcttacgggttttagtagttgtggcggtatcactaccaatatgacagcagaattattggcgatcctgcatggcttgcgtgttgcttggaattctggcttcaaacgggtcatttgcgaaactgacttatga

SEQ ID NO: 89131 - DNA, 276 bp, Glycine max
  Peptide Sequence Number=SeqID_180816
atggtggcgtggtgggaacaaaaggttaaagggaacaagggtgatgttgaaaaagccgaaatggtgatgactgatgaagggatagagaaggtggaagtggattgtaacagccagcaggttgtggtgacgagatacgcacacaagaacaaaatcctgaaagcaatgagaaaatctggtctcaaggctgatttcttgtatgctcaaaatgacttgcttaatgcttatgtcagtgctagttatgccaacctccgatttaacaacttcagcatcttctag

SEQ ID NO: 89132 - DNA, 4746 bp, Glycine max
  Peptide Sequence Number=SeqID_180817
atggggaacaaaatcgcgcgcacgacgcaagtatcggcgtcggagtactacctgcacgagctgccgtcgacgtacaatctggttctgaaggaggttttaggtcgcgggcgcttcttcaagtcgattcagtgcaaacacgacgagggtttggtcctcgtcaaggtctatttcaagcgcggcgatttcctcgatctctccgattacgagcgccgtctctctcagatcaaacacatcttcacctccatcgatcaccctcacgtctggccctttcagttttggcaagaaacagataaagcagcataccttttgaggcagtatttcttccataatctgcatgataggttaagcacgcgcccttttcttagtctcattgagaagaaatggttggcttttcagttgcttgtagctgtaaaacagtgccacgagaacggagtgtgtcatggtgatatcaagtgtgagaatgtgctgattacttccaccaattgggtttaccttgctgactttgcatctttcaaacccacttacattccatatgatgacccctctgatttctcttttttctttgacactggtggacgaagactctgttatcttgcacctgagagattttatgaacatggaggggagatgcaggtggcacaagatacccccttaaaaccctatatggatatattcgctgtcgggtgtgtaattgctgaacttttccttgaggggcagccactatttgaactgtctcaacttcttgcttatcgcagaggacaatatgatccaagtcaacatcttgaaaaaataccagatcttggaatccgtaagatgatattacacatgattcagttagaaccagagtttcgattatctgctgaaagatatctgaaggaatatgctgcagttgtatttccaatctatttttcaccatttctgcatgatttttaccgatgctggagtcctcttcattctgatatgagggttttactatgccaaagtgcttttccggagatacttaaacaaatgatgaacaataagtcatctgatgatgcaggtgttaattccgctgaacttttggaagagatggttgctaaagaaagtgcgagtttcatgaaggattcactgatgaagagagaggacataggcaaaggcttagtccatgatcactatgaacttctaggtgatattaatagcctactgagggatgctaaaaaaaataataatccatcgcatgtagcagaaaatgcacataattctacttttcctgaaaatctgaaaaatttgcaaactggtaaactgcttcaaactatctccaatgcatttcgaggaaatgaccatccctttctgaaaagtattactatgaatgatttaaattcattgatgtctgagtatgatagtcaatcagatacgtttggaatgccttttctaccgttaccaaaggatagtatgagatgtgaaggcatggttttgataacttctttgctctgctcttgcatacgcaatgtcaagttgcctcacttgaggagggcagccgtactcttgttgaaggcttctgccctatatattgatgatgaagatcgtttgcagcgtgttatcccttatgtgattgtgatgctctctgattcagcagcaattgtgcgttgcgctgctttggagactttatgtgacattcttcccttagtgcgggattttcctcccagtgatgcaaaaatatttccagagtatattcttccaatgctttcaatgcttcctgatgatccagaagaaagtgtgaggatatgctatgccagcaatatagctaagctggcactgactgcttatggattcctgatacgctcaataagcttgagtgaggcaggtgtccttgatgaattgagtttgccacagaaaccattgacatcatccactcagacttctggaaggatgaagaggataaatggcgatgcccaacttctgcagctgaggaaatccattgcagaggttgtccaagaacttgttatgggtcctaagcaaaccccaaatataaggagagcacttcttcaggatattggtaaactgtgctgcttctttggtgtgagacagagtaatgactctctcttacctatccttcctgctttcttaaatgatcgggatgagcaattaaggacagtattctacgaaaagatagtttatgtctgcttttttgtgggccaaagaagtgtagaagaatatttattaccttatattgagcaagctttaagtgatgtgacagaagctgtcattgttaaagctgtagaatgtatgactattctatgcaaaagcgggttcttcaggaagaggatattgcttcaaatgatagagcgtgcctttcctttattgtgttatcctagtgaatgggtgcggagatcagttgtctcttttattgctgctagcagtgagaacttgggtgcagtagattcttatgttttcctcgctcctgttatacggcctttcctccgaacgcaacctgtgtctcttgcttcagagaaggctctgctctcatgtttaaaacctcctgtctcaagacaggttttttatgaagtcttggagaactccaggagttcggacatgctagaaagacaaagaaaaatatggtatagttcttcccaatctaaactatgggaaatggatttactgaaaaaaggaattgatgagttggattcattaaagaactggactgacaagcaacaaggtcctggggttcaacaaacagttggcactgccttccaacagccagggataactgattgtgacaaagctgaggcaaaattgagagatatgggggcctttatgcataatgatagcaatactgtaggacatcgtgatacccaatgctcagagaagttgcagttttcaggatttatgtcaccacattttagtggtatgaatagtttgacgtatgaaaagccatcagaaggcatacctttgtactccttcagtgtggacaggcgaggaatgggaatcccttctgcagcatctgatcctccactgccaatgaattctctgggtgttagttcatctgcaatgccttgggttaatccacttagtaagtcctttaatttggctaattcagttccagcaccgaagctcttttcaggttcttatagtatcagcaatggttctaaacagttccatcgagtggtacatgaaccagatgccagggaaaatgagacagcctatgttaataacacatttcaagatgtgggattatctgctaatattaaaggtacttcaattgcattggaagatgcaactgcccaaacggatctatctggatttccatcatttgctcgagcttccattcctgactctggttggaggccccgtggggtgttggttgcacacctccaggagcaccgttcagctgtcaatgacatagctatatctgctgatcatagcttctttgtgagtgcatctgatgattctacagtcaagatttgggattccagaaagctggaaaaggacatttcattcaggtcaaagctaacttatcacatggagggaagccgtgtgttgtgtgcaacaatgcttccaggttctgcacaagttataattggagcatctgatggatttattcatatgttttctgttgatcatatctctagaggtctaggaaatgttgttgagaaatattctggtattgctgatatcacaaagaaggatatcaaggaaggtgccatactcaaccttttgaattgtcctgtggataattataccatcatgtatagcacccagaactgtggcattcatctgtgggatactaggtccaattccaatacctggactcttcaagctactcctaaggagggctatgcttcttctctggcatcagggccttgtggtaattggtttgtatcggggtcatcccggggggttattacactttgggacctgaggtttcttatacctgtgaattcttggcagtattctcttgcttgccctatagaaaagatgtgcctctttctgcccccttcaaatgcttctgtctcttcagctgctaggccccttgtttatgtggctgctggttgcaatgaaatttctctttggaatgcagagaatgctagctgccaccaggtcctaaggatgaccaattatgacagcgatgccgaaatgtctgatctgccttgggccttggccagaccttctagtaagccaacttctcaatcagatctaagacgaaatggtaatcgtaagtatggagttgatgagctaaatgaacctcctcctcgtcttcctggtattcgttcattacttcccttgcctgggggtgatttattgactggaggtactgatttaaagatacgtcgatgggatcattacagtcctgacagaagttactgtatttgtgggccaaacttaaaaggaataggaaatgatgatttttatgaaacaaaatctagttttggggtgcaagttgtacaggagaccaaaagacgtcctcttacaatcaagctgacagcaaaggcaattcttgcagctgctgccactgattctgctggttgccatagggattctattgtttctttggcttctatcaagttaaaccagagacttttactttcaagtggtagagatggggcaatcaaggtactaacccaccaggtagtcattagagccccctccctatttctctctgatacttttccatttttgtgtacacctgatctgtaccagcaggaaaaagttgcgattttgatatttttagatagacctcagttttatttgaaggtgtcaatcgtttga

SEQ ID NO: 89133 - DNA, 99 bp, Glycine max
  Peptide Sequence Number=SeqID_180818
atggactattatcgtggttggtgcactggtaaagcagaatgtgttgaggggcaaggaggggacaagtatgttgttcctattcccattcctactcaataa

SEQ ID NO: 89134 - DNA, 1320 bp, Glycine max
  Peptide Sequence Number=SeqID_180819
atgtcgaggatgaattcagagaagaaactgggtgcaggacgtgtggtggctgtggcaattgagaataacaagacaagccaacacgctgccaaatgggcagtggataatcttcttcccaaagatcaatgtctcttactaatccatgttagacaaagagcatcttcggctccatcatcggatcatttgagcgaagctgtggccgacaaagaatctaaggaactttttgaatcatttcgagtcttctgcaatagaaaaagtatacaatgcaaagaagtgctgttggaggacatggatatatctaaggcattaatagacgccatttccacgaataccatcgagcttcttgtacttggggcgccatcaaggagtggccttgttagaagatttaggacaactgatgttccaagcactgtgtccaaaggggcaccacaattctgcacagtttatataatttctaaaggaaaaatctcaagcgtgagatctgctactgctccattggctcttaagaaagctgccattgccgctgcctcacctcgtaaccaattgcagccacaacaacaacaaccacacccgcagacaatgccaagtcctgaaagattttcagatcctcagctaccccgcaactacccaccacgacctacatcagagagggcagcgccacatgggagtcatggggcacgccccaccatgatggatgaagatgatatcatatcaccgttcacaagggctgggaaaacatacgagtcttcaaagcttctggattctgatatatcattcgtgagcagtggaaggccaagtgtggaccgaatgttcccaacaatgtatgaggatatggacagtgcgatgagtggaattgcccccggtaggttctcagactatgatggcagaagcagcttcgcttcctcctactcttcacaatcgcaaggcatggatgactgctactccttctcctcccaatcaaggttatccgactgcagcaccgatgatgtcgaattcgagatgaggaggctgaagctagaactcaagcagactatggagatgtacagctctgcctgcaaggaagccatgacagcaaagcagaaggcaatggagcttaaacgtttgaaagtggaagaacagaagaaactggaagagtcctcgtcgttatcgtcggggggtgaggctgctgcagcagcatcctccatggcactgatgatggagatggagaaggaaaagatcagagaagaagcactccgaattcgtaatcatggtcatagctgtttcctgtgtgaaattgttatccgctcacaattccacacaacatacgagccggaagcataa

SEQ ID NO: 89135 - DNA, 468 bp, Glycine max
  Peptide Sequence Number=SeqID_180820
atgaggttgtctgagtatgttgaagtcatgcaattaggggttattcacccaccaccaataaattttgatttatgtgaaggagaacatttcaatgatagttgtcatctctactccatgaaaaattcttggtgggagaaagagttacacccttacaatcaatatgaagaagaaaaactttctaatcttgagaatgttaaagctaatgaggagagtcttgtagaagagcatgattcaagagaaagagatgaagaaaaaggtgaggagggaacacaacaacagtggaagaagtgctcacaagtagaaattcaacaagaaaagcaatttcattttgtagaagtggaaatgatgaaggagaggtttgctaagctgcttttggaagaggaaatgcctggaggtggaaaaagggtatgtactgcacttgcaatctccaatgcaataaccaagctgcttttggattttggagtataa

SEQ ID NO: 89136 - DNA, 805 bp, Glycine max
  Peptide Sequence Number=SeqID_180821
atgcccaaccaaatccacatgaaatgcatcaacatcatcctgcattttcatgattctgcatatccaaaaaggaagttggataagaggtacttaatgttagttgaccatcattgttcattgtatgttgttaatgctacacttgcaattattgagatgcaattttttaatctcattgttgccattgatcatcagaagggcaacagaagtttgccttacgttgaaagtgttcatcatccttatgaagaattcatctctattgctaggaaggcttcatatgcttttaatgaagacaactggttttcttgttttggatttagagatggaccatgggatatgaagacatttgatgatattatcccttcttggccatttgacaatttaaagtttttgaaatttgttgaaataatgaatattgtagtgtttgttcaagagttgcaattctgttttgtgccacatggacgtgtgctatttgggaaagctattgctggaattcttggaagcttatataattcccttgaggatacaattgttcagacttatagaatcatgaatgacaagggtgtcattactaagaatgaggctttcatgactgaagtgctggccatgcatggcgccagtgctgatggcgccttcgacagggacgagccacgtggccatggaagcaccattcccagcagcgctttcccttttgctgagcgttgcaaattggcctgcaatagggaagcgccagtggtggttgcgattttggaagcgccattggttcctgcgacttgcatgaaaacgtcaatggtgatggcgtttgaag

SEQ ID NO: 89137 - DNA, 348 bp, Glycine max
  Peptide Sequence Number=SeqID_180822
atgccttcatcgtcttcgtcttcttcttcttcttccgctctaaccgttcccaatttgcatcttcgcgccctcagaatttggtcctccaagtactacgcaatcgccgcattcatcttcctcgtcctcttctctctccttctcttctcccacttggattcacgttcccgttactccaacctcattccgttaaccctcctccgcaacgccaaccaaacgcttgcgctatgcttggacgggagcgcccctggttaccatttccgaagccggttcggatccggatcccgcaattggctgatccacattggggtttctggctcccttgttgttaaaaatgagtttggtttctaa

SEQ ID NO: 89138 - DNA, 452 bp, Glycine max
  Peptide Sequence Number=SeqID_180823
acgttggttacttccggaagaacacttcttcgggaaactttccggaaaacgttcttccggaacttccggaagaacccctaaggggtcttccggaagactcctccgtcagcgatttccgccattttttccggcgtcctctcgtcttctcccctctcgtcttctaccctaggtttcgtctctaccctaaggccacctacctcgaaagcaaatgggtccaagggctgtcggagaagctcgcggagaagaagcttgtcggggaagagagaagagaagaagctttttgcgaaagagacacagatatggctgaggtggtgaaatcagaggagtgttgtcaggagaataagcaatctactgctgcttcttgctcctctgtatccgaaggcagtggcagtgcaattcacaagtctccggggagatgtagccctgcatccacatcgccctcacatcggtaa

SEQ ID NO: 89139 - DNA, 333 bp, Glycine max
  Peptide Sequence Number=SeqID_180824
atgttgacaagtgcttttgacactgaatgcttgagtctgcgccaagctggtgaaattgatccacttccaccaaatgttgttggagcaagtaatattgatttgcaaaccccctccaccatgctagtggcatccactgttcagacacctgaattatttaaaggggttcttaaagaatataagccaaaaggtcttcagtggctcgcttttggtatctttcaaggtttaaatgttattctagcagataagatgggacttggaaagaccattcaggccatggcttttttggcccatttagctgaggtagctattcaaccacatgttttgggtaaatag

SEQ ID NO: 89140 - DNA, 465 bp, Glycine max
  Peptide Sequence Number=SeqID_180825
atgaagaagatccaaggcctacaagctccacatggagctacatcagaaacaaaattcttaatgctctctttgcttcttaacttccctttgatgaaatttcaacttccaaaacaagatgatggttttgattattataggaatagtagtcaggatgagagcagagacaaccaaggtggggggattacaaatcacagtaatgggaatgtgcatgaaaaggaagtgaatttgttcaagaagagaaggtggtctctaaatagtgacaacaaggaaaagagcagtttttacggggcacacatgatggaggagcaatatcgatcgatgctgggagagcatattcagaaatacaagaggaggtttatgggtgccttaagtagtcctgtccaaaatcaggttattgctccacttgtgaaaagcaacatagtggaggaggattacatgtggcagagagtacatcagaatggatga

SEQ ID NO: 89141 - DNA, 165 bp, Glycine max
  Peptide Sequence Number=SeqID_180826
atggctccacctaaagaaattgcgactgtcatttactacaacggtcacattgcagacaacccagttcagggatcggtggtcagacacgttatatttaagcacaactactcaacaatgacgatctcagaggcgcggtggaaacaattctctagaatccacaattga

SEQ ID NO: 89142 - DNA, 399 bp, Glycine max
  Peptide Sequence Number=SeqID_180827
atgttggttccaacgatttcttacgaggagatatcgaccctggtttgtggtgggtgtggacacaacgatagttggaggaggaaggatcgtcgtcgtggccacgatgatgaaggaggtgttgaaggttacacatacatgaagaagatgtactggcgacatcttggggatatccgtgcgaataagccaagtgcaactagatggctggatcatgtacccaaaaattgttgggtacaatgcttcgatgaggggaaacgttggggacatatgactacaaatttgtctgagtctgttaattccatgttaaaaaacacaaacatttgccagtgtcatccttggttgaggagacgtacttcaagactgcacaactctttgctagtagaggccaaactcaagcaatga

SEQ ID NO: 89143 - DNA, 282 bp, Glycine max
  Peptide Sequence Number=SeqID_180828
atggctccaaaggatcccaagcaagttgctgatgctgcttcttctggtggtgggggtggcttttttgcttctattgcttccagcttgtccaatttcggtagtgccatgtccaaatccgttaatggtttggtgggctacgaggggctggaggttgttaatccagatggaggaactgaagatgctgaagaggaagcaagaaagggacgatggaaacaagaggatgagagaatcatccgagtcgaagaaagtttatcatgcgaggaagctattcctctatactga

SEQ ID NO: 89144 - DNA, 675 bp, Glycine max
  Peptide Sequence Number=SeqID_180829
atgcaatgtggaaaagatgtatatagtaattgcacgagacaaatagtttacaaaaaattaagagagaggccaaaccaatatgtggctagaggtctggttagaacagatgaaagcaaacagaacattggtgctgcagatgacgttattgttggggatataagagatgctgaaagtattgttcctgcaattcaaggtatagatgccctcataatcctcacaagtgcagttccacagataaagcctggttttgatccaaccaaaggacaaagaccagagttctattttgaggatggggcatatcctgaacaggttgactggattgggcagaaaaatcaaatagatgtcgccaaggctgctggagtgaagcacattgtgttagtagggtctatgggtggaacggaccttaaccatcctttgaacagcttgggtaatgggaatatattggtttggaaaaggaaggctgagcaatatctggctgattccggcatcccatatacaattataagatacggaacaaaagtgaaatttggaaggacaagaaaacaacatgactcaatgactcttaggaatccttgtaagatttacagagtcaagatagggaactcaatttgcaagatatcaccaaggcacctatttatactagaagtggtgcaagcaccatctcctaagaattaa

SEQ ID NO: 89145 - DNA, 441 bp, Glycine max
  Peptide Sequence Number=SeqID_180830
atggcgacacatggtgccctcggaggcgacaacgatggagcaggagtagcggagcttgtcaggtatgggggtgtcggagaagaaggagaggtcgacgcgacggagggaggcgaggagggaaggggggacaccgtggttggtgatgtggaaggcgccctgttggcggcaggcgtatacgagggaatctcgatcgaggtagagggggagtcaaaaagtgaaataggaaaggtggaacttacagctcatagtggagacgtggttacagggaggacttattgccaccagagtggggttagcggtggcgaagtctcacacgtgcgaaagacacgcgtgcgtagtttccaacaagcaggcaaggttgaagtacgcagagaggatggggcaaggttcttcgcggtgtgttgttcgttcgacgtttcttcttgtggggaagggacttga

SEQ ID NO: 89146 - DNA, 195 bp, Glycine max
  Peptide Sequence Number=SeqID_180831
atgaacgttacgactttcaactcagaagttgtaacatctgttaggacttacctcaaaatgggtaataatttaaaatcaactccgagttgcttgacacatgtggaggagggtcccacatggattggagattacgtgtgtggtgtggtgtgggaagtgtgtggagcctgtgaatgtggaagtgatggtgcaacttag

SEQ ID NO: 89147 - DNA, 78 bp, Glycine max
  Peptide Sequence Number=SeqID_180832
atgcctactgccaggcccactatcataagaaagggatatgcatcagcccacctaaacgagggtaataagtcaaattaa

SEQ ID NO: 89148 - DNA, 459 bp, Glycine max
  Peptide Sequence Number=SeqID_180833
cttcagaaaacggttacggcttgggttgtgtgggtgtgggtgtttgacgtagtacttgtggttttaggccgcgtgagtgagtgggttactgtgtttgcggtgttggtggttcacggtggctgtgttggctcggccgatggctgggcttggccgatggtggttttcggtggctgtgttggctcggccgatggctgggctcggccgatggtggtggttcagtggctgtgttggctcggccgatggctgggctcggccgatggtggtggttctcggaggaggaaaggggctgagtggtggctagtggtggctcttggctgttccggcgttttgactgtgcaccactcccgaatgagtggcgtgaacatgatggccatttggaagctttaccatgatcgtgttgatacgttcgtaggaatggagattgctcagggaacaagttacatgatctgtagctcttga

SEQ ID NO: 89149 - DNA, 207 bp, Glycine max
  Peptide Sequence Number=SeqID_180834
atggttaacgagacaaggattgtagttttatcaaggcagctgtgggtttttacaggaaagaaaaaggctacaatgcaaaaaggtatttttctcagctcaaacatgatatcaaaattcccaacggaaaaagaaagagttttgaaaaaagaagagagaaaaaacgaaattgagaaacaaaggaagctaaggagtcagtctgaaaactga

SEQ ID NO: 89150 - DNA, 330 bp, Glycine max
  Peptide Sequence Number=SeqID_180835
atgataggttttgtttcatatttttacttttgtaataggccttggctaaggacaaacattgttggtaacaacaatgtgggtaccctccttggtcagattgcatctatgtcttctacttcatcggtgtcatttggtatatctagcatggagattgttcctttgactggcatacctattgtggagaaaaagacatctgtcgatgctgagatagtgaaaaatctgaacaaagcaagggagtctgggttaccatttaaacttgctgcagttgtcaaagatgcatatgaaaatttgggcattaatgctagtggtggaaaatcagtaaagatgtga

SEQ ID NO: 89151 - DNA, 576 bp, Glycine max
  Peptide Sequence Number=SeqID_180836
atggcgcaaggcatgaccccggtcctccgcgccggtgaacacctccgccgcgtgatgaatagcgacaactgctcccctgattggcgggtgcagttgtatgtgtctccctatgtccacacccgattgatgttccacaagcttagaagacgtttcttgaagaagaggattatcggcgtgagggaagagtcacaagttcgagaactagatttcgggaactttatgattaagccgatcttgaatatcatagtatatgtcggcacgacatttcaaactctacacaacattaatccatggtattggttatgtatcacggtccaacaagaacctatagcagtaataaggagtttgcaaataagcctcagggatagaatagaaggaagggttgaggcaatggagaggggttcaaggagactaatgaacagtttcaaaggattgaagacatgtaaactgagtaattgggaaataggcatccaaggagacagtgaactgagttgggaaagaggaggaggaggaggaggcagaggagatgaccaatttaggagcccaactatctcacaagctcaatgcaaatgttaa

SEQ ID NO: 89152 - DNA, 312 bp, Glycine max
  Peptide Sequence Number=SeqID_180837
atgaaggttgaaggcatagggagtgtaaggataaagctccatgatggtgctattcgaactttctcaaatatgaagggagatgacattacaagggtacaaatatgttggttcaaagtagggatgcaaagtgtacaaaggaagacacttggtgttgcgagagagaaaaataaaggtaacatttgctattttgatggtcaagtcttgaagaggaaccatgatagcaaagtgaagaagaaagtgaagttttctaatgttgtgaaagtgttgggagatacttccattagagagggagtttgttcactttcaaattga

SEQ ID NO: 89153 - DNA, 265 bp, Glycine max
  Peptide Sequence Number=SeqID_180838
gaatttacaagatagtggaactctcaagagggttgcttggggactagacgtaggcacaaggagactacttgaccaagcagctggaaaagattcactacaaaaagctgcacctagggcagtgcatgaacatcttgcactaagaagaatggattgttactggtgcataattgtacatgctctggccaatggttgtggagctccaggaataagtttgccaaagtatcctgagttgactagccacccaagttttgtgatgggagactga

SEQ ID NO: 89154 - DNA, 177 bp, Glycine max
  Peptide Sequence Number=SeqID_180839
atgagggttgcagtgaccatgatggatatccctggtgaggaaaatagaatggtgaatacttgtacttgggggcatgccactcggtttggaattctcttgaaacttaggttgatgactattgggggggaggagttgcctgtgcacgacaaggtgatctcaacacttgctgcttgctag

SEQ ID NO: 89155 - DNA, 1353 bp, Glycine max
  Peptide Sequence Number=SeqID_180840
atgccttcaaacgatgcaatccgcgagtgcgatcctgatcgcgccacgtgttccaatctccacgtcatcgtccgacgtggcgcgcgctataaccctgtaattgatacgctgtcttcaaacttcaaacctctcatcggagttttcctcgccatgaccgaaaccgaagctttggaggatgcgaaggaggtggtggtgttggaggaagaagagtgcgcggagaaaatggtgtacatgtggggataccttcccggagcctcgccggagaagtctccgatactgtctccggcgccggtgaatctctccgatcgttcactcgccggagattcgtggaaggacgtgtgcggcggtggttgcggattcgccatggccatctcagagaaagggaagctcataacgtggggttctgcggacgatgaagggcagagctacttaatatcggggaagcatggggagattccagggctttatcagcttcccactgaggcttcagtggtgaaggctgctgctggttgggctcactgtgcttcagttaatggtaatgcttcttgttctttcttgattcagtggttgtgtgaagacgatgctgtggtgagccctggtgcagcggtaaagttgtgccttggtgacttgttggtcatggaagaaggtgaggtatatgcctggggctggaaagaatgtgtgccttctgggaaagttattactgatttcatcactgtgggaagtttccaaaaggatgttgccgggaaacaaagttcatcaatacctgaacaaggaagcccacaaagctcaaacacgagcagtggatcagattctcatcatgacaacaagaaagtgggagatgaagtattgaagcgaaggaagatcactttttctagacaggattctgacagccaagcatctggagatgaattctttactgtgtccccttctcttgtgacccttgccagtggagtgaagattacctctgtagcagttggagggcggcataccttggcactgtcaggttcaatgaagtatgaagataaggatgatgtgggacaggtctggggttggggttatggaggtgaaggacagctaggattgggttctcgagtaaagatggtatcatcccctcatcttataccttgtattgagtcttctggaaaggataaatcatcagcttttcatcaaggaagtggtgctggagctcaagggtcaaatgttactggaagttatgtgatggacattgcttgtgggggtcggcatagtgttgtgataacagatgctggggcgcttcttacattcggctggggactgtatggccaggataagatagagctggcacatgttgaaaactctcacattttattatga

SEQ ID NO: 89156 - DNA, 546 bp, Glycine max
  Peptide Sequence Number=SeqID_180841
atggtggctgagggcaataatttcttggtgaaaagaaagaacaaacagaagccaagtcaaaccagcgtgaaccatattacgaccacaagttctaggagatcaatctccccaataacgttcaccgatgtcgacttcacgggagtcgatcctgagcaagacgacccaatcgtgattacggttggaatcatcaattgggatgttagaaaagttttgatagacgaaggaagctcgattggtctacttttcctttccacttttcaaagaacatcgttgaaagccctaggcgtgattgtctcaatgccgcatctcacgatgaagttccccaaccctaatggcggcatactcacggtcaaggcagatcaaatggaagctcgagaatgttatgccaaaagcctacttatcaagccatacatactcacctccacgaagctcgccaaagtagtagatgttaacaatgtggaaggagctttgccgagctgggccaattttgacccaaggagagatgaagaagacaggaggccaacaccaatagaggagttacattag

SEQ ID NO: 89157 - DNA, 81 bp, Glycine max
  Peptide Sequence Number=SeqID_180842
atgaataagaaggttaagtggtggttggacagaaatatagaaatggcaataaatgaagctacaggactccaaatgagatga

SEQ ID NO: 89158 - DNA, 2010 bp, Glycine max
  Peptide Sequence Number=SeqID_180843
atgacgctttctaatcagtatcctaatacagtggttggaacagctgtggttactcgtagtgatggaagattagcattgggaagacttggagctctctgcgagcagcttaaagagctaaataacaacgattatgaggttatattggtgacttcaggagcagttggtcttggccggcaaagactaagatatcgaagattggtcaatagcagcttttcggatcttcaaaatccacaaggagatcttgatgggaaagcatgtgcagctgttgggcagagtagtctcatggctctctatgatctcatgtttagtcagcttgatgttacttcatcccaacttcttgtgaatgatgggttttttagggatacagctttcagaaaacaactttcagacaccgtgagctcgttactagatttaagggttattcccattttcaatgaaaatgatgctgttagtactaggaaggcaccctatgagggcaagaactgtctgcaggattcttctggtatattctgggacaatgacagtttggctggtctattggctctggaacttaaagctgacctccttgttctattgagtgatgttgagggtctttatagtggtcctccatctgatcccaagtcaaagttaattcatacatatgtaaaagaaaagcatcaaagcgaaattacttttggagaaaaatcaagattgggaagagggggtatgactgctaaagttaatgctgctgtttgtgctgcttatgctggcacacctgtgattattactagtggctatgctacagacaacatcatccgagtgcttcgaggagaaagaatcggtactgtctttcacaaagatgctcatttgtggaccagcataaaggaagtgagtgctcatgaaatggcagtggcagcacgtaatagttctagacgactccaggcaagtaaagtcctaaattctgaagaaaggaggaaaatattgctggcaatggctgatgcattagagataaatgaaagtgtgataaggcttgagaacggagctgatgttgctgatgcagaggagatgggatatgagaaagcactcatatcacgtttaaccctgagacctgagaagatctctagtcttgtaaagtctgttcgcatgctagctgacatggaagaacccattggtcagattttaaagaggactgagctagcagataaactcatcctggagaaaatatcatgtcctttgggtgtcctcctggttatattcgagtctcgaccagatgcccttgttcagatagctgcattggcaattcgaagtggaaatggtctactgcttaaaggagggaaggaagccaaacgatcaaatgcaatcttacacaaggtcattacttcaattattccagatacagtgggtgacaaactcattgggcttgtgacttcaagagaagatattccagatctgctcaaggcaaatcttgtggtccccagaggcagtaataagcttgtctctcaaatcaagggtacaacaaagattcctgttcttggtcatgctgatggaatatgtcatgtatatgtagacaaaacagctaatattgatatggcaaagaagattattagggatgcaaagattgattaccctgcagcctgcaatgcaatggaaacacttcttgtacacgtagatctgtcaaggaatggtggacttgatgaacttgttgctgaactccaacgtgaagaccatgctgttaaactggaaaacatgtacaatagggataacatgactgctatgatgtatttgctgccattgaccacatacatcaccatggaaggcaaattcaagttcccctacaaaatctatgttttgattctctatatcataaacattataatcttaaaaatctatttctttctgtcctgtttctgcagtgctcatactgaatgcattgttgcagaagactctgaagtcgccgaagctttcttaagtcaggttgacagtgtcaagttccaagagatactaatgtggcaaattggtatggtagtttaa

SEQ ID NO: 89159 - DNA, 354 bp, Glycine max
  Peptide Sequence Number=SeqID_180844
atggcatgggcaatcgagaagatatggttagcttcatcttgtgcgataactagcaacaatgtgctaatcctgtttgagcagcgaccacagtcttgggaaaagaagattacgaagctcccaaaagttttggcagtttggcatatgattcttgtaggatgggatataattcatgaacgttttgatctctgcaatcaacatcttgatggagacgcttgggtttgttttgacaattggttggatgatctgtgctatgacgtgtttgtcaagtttccgattatcttgtctgagcattggcgcaagacaagtgtgatgacctctgatattcttgataatagatttgttatgcctatttaa

SEQ ID NO: 89160 - DNA, 410 bp, Glycine max
  Peptide Sequence Number=SeqID_180845
gaagagccttagggaaacaagttagtggtgatgcggaagaagcccctcagtgtcgaaggccgacaacatctacatgtagacaacgggcaactgcaattgttgctgaggatgttaaccatgtggatcatgttgctgacgaggttcatgagcagcctcaagagctagttacagatcatgtcggtgttgatacaaagggttttccagacgaatctcatgatacattagtgttaacgtcatatgctgatcatgaatgtactgagttgaagttggcctctcatggaaggaaggtagagaaatttgaaaggtctgcacttaagattgaaggcatagtgactgttataggattacgttctttgattatatgttcgttggagattcgtgataggggacttttatctgcttttgcatag

SEQ ID NO: 89161 - DNA, 141 bp, Glycine max
  Peptide Sequence Number=SeqID_180846
atgggggttcgacgacaagcaacggtggcttgtggtggccatcggtggtcgtgggtggtagagaatgagatctcgcttagcgagctcgtcttgctaagcggaaatccaatttttgctcttagcgcgacaattcgtgcttag

SEQ ID NO: 89162 - DNA, 138 bp, Glycine max
  Peptide Sequence Number=SeqID_180847
atgactatgtcaggcttaaaggagcactcaaatcgggtgacccccaaggcctatactccgaagagtctgttagggcctctccctcctgattcaggttcaacccctaaaatcatttttgcaagcagacactgtttatga

SEQ ID NO: 89163 - DNA, 337 bp, Glycine max
  Peptide Sequence Number=SeqID_180848
gaatgtgagacacaaaggcactaacatcgaaaagaaagcaaacatggggtgtttttgcttccgagctagaaaggaaggagatgataacaaatacaagcccaatgatattatgacagcaggtgctgctgctgctgctgctgctgctccaaccaaaacttgtgatgaaactcatggtaccactacagatcataatcatggaactcatgataccacagctcatcatcatggtagtcatgataccacaggccatcatcttcatcatcataccgttggtcatgatggaggcgctcattttagtgatggaggcgctcattttagtgatggtggcggtttctga

SEQ ID NO: 89164 - DNA, 156 bp, Glycine max
  Peptide Sequence Number=SeqID_180849
atggatttggatttggaactaagaacgggacggcccacttccactccggaagtctccaatgaggtaaaacttgagaaattggatcattccaatcgaatgtgcattatgatcatgaaaacgagacgacccacttccactccagaagcctccaatgag

SEQ ID NO: 89165 - DNA, 444 bp, Glycine max
  Peptide Sequence Number=SeqID_180850
atggagggggtctgttttggacacgtgacagcggacagtggatttcgccattgttgttggcgaaacaggacacgtggcagggatttcgctactcctagtggcgaaacaggacaaaaacaagacacgtggactaaatgtccgtttgagacccataatatgtcaaaatactcgaaattgaaggaggaatcccctggcaaattctcgaaggggatttggtcaactgatttttccaaaaataggaatttcatcattccttggggaatggtgatccagcggcggtcgaaggacacgtgggggttgctgttagcaaggaggggaacgaccgcaatgggaagcggagccagaaagggtgtgtgtgggatgcggctgtatgagtgcggggggtggaggcggagtcgacatggacggcggaggtggcatgggcggcagaatcggcatggttga

SEQ ID NO: 89166 - DNA, 156 bp, Glycine max
  Peptide Sequence Number=SeqID_180851
atggagcattacttgagctgggcacaggctttggcttcagcatggggattcatgttggtggtggctcttatgtgttgttgcctcagcaccaaaccaagacaagatagtgatattatctctggcatagaagtctcttctttttctccggtggtatag

SEQ ID NO: 89167 - DNA, 309 bp, Glycine max
  Peptide Sequence Number=SeqID_180852
atggaaaatggtcctgttgcgagggtagcctccaacgccttggtgtcagctacattgatctctattatcatcaccgtgttgacaccactgtacccattgaagacactttttctttggatatggcagatgggagagcttaaaaagctggtccaagagggaaaaataaggtacataggattgtgggaagctagccttgacacaattagaagggcacatgctgtttatcccattagtgctgtgcaaatggagtggtccctttggactcgtgaaattgagcaagatattgttccactttgcaggaacaactaa

SEQ ID NO: 89168 - DNA, 681 bp, Glycine max
  Peptide Sequence Number=SeqID_180853
atgtcgtattttatctttcaagtcttctactttaacaagcagacaacatggatccttgataacacccacaacgacacagtaatggttaactgcttgcataacttgattaaccagttctctaagtccagcatatttcccacgaaggttctttcgttcttacgccgctctctcatccgtggtcgccctctccttcaaccgcagtcttacgccgccgtttcgttcttacgccgccctctccttcaaccgcaatctcttggaaacaaaaccccccatcacacagtgtctcccaacgccacgaagaagaggaaaagccacaaagaaagttatatcaagggcactgatacttttccttttgggactgttacttcaaggaacccgatatttttttctcgactgcaggctgaagtgactcagcggttgactagtgcaaaagagtcatcaagtaaacctgcattgcagagtcatgaggatcttgcaaagaaacttcagcagactcaagtgcagaaattgctaaagcaattagctgatgagaggttttctgaggcttcaaatcatagttcgaatgtcaatcttgctgataaatcaagaaaagtaaaggacaacatttcttccattccattaattgcttttataaatgaaaggctcaagaaagtacagaatatgattttagggagtttttaa

SEQ ID NO: 89169 - DNA, 396 bp, Glycine max
  Peptide Sequence Number=SeqID_180854
atgactgtgagtttcctttttgtttcccagtttggttttagctctggtgttccattggttgtgagaacaaaaggtttttccccggttgacaattttgttttgcagtttagttttgctgagtttgatcgggagaagctaagggtttgggattataaatttatggcacgtgttgctgataaaataaaattgatagacggatcaagggaagctcttaagctttctataaggattactgatctttggtatattgggattcccggaaagactgaacaagtcgaaatggtggttattgattctgatggagacgaaatcgatgttgtttgcaagcaggatcagctgaagtctcgcaaggctgatttgaaagaaaatttgacttatgtgatgcataattttaaa

SEQ ID NO: 89170 - DNA, 300 bp, Glycine max
  Peptide Sequence Number=SeqID_180855
atgagtattgcatcttccaccgcttcaaccagaatgagatatgcaattgtaagaccacctgcaatcatccaattcagagcggctttgcacaatgaccagacattcaaagaaatacccccattctaccatgaacaatgggcaccgaattacccacaagaggaaatcccatcacatgcaaggaaatatctggaagaatgtgacaaccacttgacaattataaggaagaatgcacctcctctgcaatgggacgtcgttacactcgaccgcggcattaaagataaaagtatctcccagccatga

SEQ ID NO: 89171 - DNA, 507 bp, Glycine max
  Peptide Sequence Number=SeqID_180856
atgtgctcaacatcttcccttggaaacaccaattttgaagcgaatggagaatgcacaaaagggaagggcactaacaaacaagggaatcactcaacacttggtcccacatgtgagactatgcatgacccagtgacgtgggcctcaagagtcaatgctgattttaaaggccaacaaagaccaactcgcctatgcaaatgcatataccaatcactatggagctcccatgagtgggccaacaaaaatgcacaatgtaaaggtctcggactcgcacataacatgggctctaattctaatgataccatggagattttaccctcaccaactcatatggatggaatgaacatggccagtgaccctattatggtcatagcaagaatatctaaaatggtgggtatgtgtggaagaggttggataggtgtatggctaatccagcttggagattgctctaatctcatggtctcgtggaggtcatcaatccctatgcttcagaccataaccctctactag

SEQ ID NO: 89172 - DNA, 300 bp, Glycine max
  Peptide Sequence Number=SeqID_180857
atgaagtctttcagtaaactcatttgtgaaaggatactggaagaatatgaggctagactatctcaagctaggtttgatgctacattaagtgttggtgaatcacaactcactcctttagaccctgctgaagaacaaagacttaggactcagtgttgggttgtagctgcgggaccaaagtgtaagggatgcctttacggtactggagaccttgctcatccttataaatgtggagatgacagcttcatgcaacataagcaaggatcttccagttgcactcaagatgtcgtagatattaactga

SEQ ID NO: 89173 - DNA, 615 bp, Glycine max
  Peptide Sequence Number=SeqID_180858
atggatttgtattttacttctcaaaatgtgatcaaatctcttaagcctatgagctcaattcgttcatatgcttcaattgtgtggttgaatggtgaaatgtatgtttttggtggtggaaatggttatgtttggtatgacacagttgaatcatacaatccaattcatgacagctggaccttgtgcccctctttgaaccagaataaagggcgcttatcaaaagttgctctgaatgacaaaatatttgttgttggtggtggaaatggagttgattgctttccagatgttgagatgcttgatttagatattaggtggtggatccctacatgctcaatgctagacaagagattttcttttgttgcagtgcaactcaatggtgcaatctatgccattggcagatttgatggaaatgattacttaagggtgttatgttttattcgtaccaatgtgaatacacttctacataattgcaggtatgcacttggtggctttgatggtttctttcttgatctgtcatcagtaatacttcatactccatgcctgtacagggactacaatctaactttcttaactttgactgcaactatatgggaccggtttaaaatgtttcaggattaa

SEQ ID NO: 89174 - DNA, 732 bp, Glycine max
  Peptide Sequence Number=SeqID_180859
atgggaaacctagcaaaactacccatcatatctcccaaaacccaatacccacgaaaatcaagtgagaaagaagtctacccaaacctgaaatttcgaggtcccacacgtagagatgcgcttcacgactccgaaaatgccttcctttcgcgatttggagcagaaatgatgaccaaaggttggagctttgttggagcttcaatggaggatgagaggggagaaaaagctacctatgccacatgtctccatttgagtggagcaaaagggcccactttttctcttgatgtgactcatgcacagtcacaagaagaagagaaaaatctgacctttgaaatgctaaaatcctacctcggtttgcgtgccatttctctggttccaatccctcgtgtttctctgcacccgtcggggccagtttttgaaaccattcaaaatgcaccgtttacaaaaattccgggtagaaatttccaggatgtcacacaaaccaacaccctgacatatatcatgtccagtcgttctacaagccttgagccaaagtcccaactcaccataaacctttccctcaaaagaaaacaaaaaggagaaaattcccgatcaaaagaatcgacaaaaagcaaaaagagaaaattcccaatcaagaaaaaaatgggagaaagcaaaaaagaaagaaaattcctgatcaaggatcggaagaaaaatgggctaagtgagccttcctcgctaagctcccatacttag

SEQ ID NO: 89175 - DNA, 582 bp, Glycine max
  Peptide Sequence Number=SeqID_180860
atgcactacactttccttgcttggccaacacatcttgtgaagcgtttatcagaacaggcagctgtgtctccagcaaaacctccagaaagcccggatgaagaggtcgatgatcccctgtacctgatgacattgaccatcccacaagtgtttttgaagccgctccaggttatgtgggatgctaccatattcggggtgtttaatcaaaacttcccgttccatctgactgagacaagtgtgcgagcggggaattttgatgtgtatggattcctcgagccacagtccattcagagatctgggcaatcacaatttgaatccgaaagttacatcaagagttggatacagagttcaaaacgagatgtttaccttggagcctatctgaataggccagacaactaccttaagggaataattaacagtgctttgaaaggacttgatgatactccacaaccgaaatccaaggctgttgctaggtggattgttgttaagtattttaatgaagttagaccattggaagcagagagattcaaggcacttcgcatacagtgggcacagtattatctaaaagttagaaatcaaacatag

SEQ ID NO: 89176 - DNA, 261 bp, Glycine max
  Peptide Sequence Number=SeqID_180861
atgggtagcctggccagggacttagcctcctcctcacaaggacgacgaggatcccaccgctcagccactcgtgaaaagtctcctgaggccactctaaagcctccgacaccagtggcagataccacttctccacaacaggtagcagatccttcaacgcttgaagatcaaaccaccccagtcttgtctccaaacacctctcctgtagctactcctgtactttatttgtcagaagaggaggagggccagacacaggaaacctag

SEQ ID NO: 89177 - DNA, 78 bp, Glycine max
  Peptide Sequence Number=SeqID_180862
aataggactctatctttattctcgtctgaggatcaggggttcttcaagggatctatcagattaatggaggaacaataa

SEQ ID NO: 89178 - DNA, 1449 bp, Glycine max
  Peptide Sequence Number=SeqID_180863
atggtaaactgtgcggccggccactgcgccggacccgctcttttcccccgccagtccatctcttctgcctttccgggagcccacgccatgcagaaacccgccgtaaccgtcatggtcaaggccgcccgcctcgccggcaacgtcctgttgcgcaacatcaacaagctcgaggcactgaacgtggtgcagaagggccggatggactacgccagcgaagtggatgcggacgcggaaaaggtcatcgtcaaggaactcaagcgcgcctacccggactacggcatcttcggtgaggaaggtggcgtgcagggcgagcgccgccagatgtgggtcatcgacccgctggacggcaccagcaactacctgcgcggcgtgccgcactactgcgtgtcgatcgccctggtcgaaaacggcgagccgaccgatgcggtcatcttcgacccgctgcgcaatgaactgttcaccgccagccgtggcgcgggtgccgtgctgaacgaccgccgcatccgcgtggccgaccgcaaggatctggaaggcacgatgatccacaccggcttcgccccgcgcgagcgttcccgcgccagcgcccagctcaaggcagtcgacgccctgctggtgcacggcgaggacatccgccgtaccggttcggcggcactggacctggcctacgtggcctgcggccgcgccgacgcctacttcgaagccggggtgaaggcatgggacatcgctgccggcctgctgctggtccgcgaggcgggcggcaaggtctgcgacttcaagggcgcgaccctgggccgcatggacaaccgtggcccggagacccaccagatcgtggccggcaacctgaaggtggccgagtcgctgcagaaggtgctggtgaacaccgcgatccatggagacggcacctgcgaaggtgccgttttcgtatccgcggtgatcgtgcttgtcactttctttgcgcgcaaagaaggtaaccaaagaaacgctccgccggccgcgagccgacgcgctgcgcacgccggtgccctgcgctcctcggcccgccgagggacggtgcgggaactcgctgcgctcagacacccacacctcttcgccctcgccggacctgcggtgctcggctcgcttgaaggcggactggaagctgtagcatttgaccttgggtccgccttgagcgagccgagcatcgcaggggaatcaggggcgaaggggcgccgatgtttgagcgaagcgagttcggcgccgccccctgattcgccgagaagcgcagggtaccgtcgcgtagcgacggctcgcgccccggcggcgtgtttctttggttactttctttgcacgagcaaagaaactgacacctccccgcaggcgcggaaacgatccgccaggcacgacccggcatcagcaatgcatccccacaaacaaaaacgcccggcgcgaggccaagcgttcctgcactag

SEQ ID NO: 89179 - DNA, 328 bp, Glycine max
  Peptide Sequence Number=SeqID_180864
gaactttagcactgggaagtgtactgtttcctcaaaacttgatagagcagggctagataactgcattgctagggatagattgcaggacattgaggcagcaacaactccagaagaacctctatcttctgaagcatcttctagttttccaactcaggggcaatctcatacaattttagctgaagcaaatatcatggctgaggagccaagaagagttactctggaagactacttaagctcaagtgtgtggaaattctttactagtattgcgcagccgaaagttcaagaacaaaatatcacctacccacacttattaatccagttgatatag

SEQ ID NO: 89180 - DNA, 483 bp, Glycine max
  Peptide Sequence Number=SeqID_180865
atgtgggccgttcataaaggtttacaaattgattgggctcatcttgttagatatcgcatgcataaggtattgcgattgaatgccccattgccttatcctcatcttattacccttttccttcaacacttcaacatccctcttgattctgaaccctatgttccaatcaagagatcattccttataggcgcttcagtcatagcatcctttggttatattatggagcatgatggctcttgggtaaagaagggtgctagaaatgttggtgaagaaggacatgagggagaagattcatctcttctttcgaagattttggaaaggtttgatggtcttcaaacctttgttggtgagaggtttgatactttggaattgcaagtggatatgcgcttcaatgaaatggagtcaagaatgacaaaggttgaagaagatgtatcttacattcggtcaagcttcgatcttccaccaccgccaccaccatcatcttag

SEQ ID NO: 89181 - DNA, 118 bp, Glycine max
  Peptide Sequence Number=SeqID_180866
atgagagatgagagtatgaaagatgtcagatatcgcccttattttagggattgtattggtgcaatagatggtcgggaaggttctgcacatgatactaagatatctatggaggctttac

SEQ ID NO: 89182 - DNA, 414 bp, Glycine max
  Peptide Sequence Number=SeqID_180867
atgaccatgattacgaattcgagctcggtaccccacccccgcccccgcttcaccctctctctccttttcgccaccgtttccgccttctccgccgctctctccctctctgccgccgctcccgccgcccacactctccccggcgtctcccggttagggtttaggggtttcctcgtcggttccctcttcggcgcgcattacgtcttcaagcgccgatgggttcttcacttccccattattcagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 89183 - DNA, 533 bp, Glycine max
  Peptide Sequence Number=SeqID_180868
gccgaagggcgtagtcgatggacaacaggtgaatattcctgtactacccttttggtcccgagggacggaggaggctagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatca

SEQ ID NO: 89184 - DNA, 345 bp, Glycine max
  Peptide Sequence Number=SeqID_180869
atggcaggagttggtgataatggtggtgtatatcatcaactggacggatctcagtgcttattactggacacgatgactacacaaatacaacgtttgttgaaccgtaaaaatgaagagctctacaagcgaatagaaggactagagcaccaaatgaatccaaatgttgggagaccttatggtggcaacagaagggtcaatgatggatcaatccgaatagaggggcaagacagaattgagggagtaaaactcaatgcttttaaaggcaggagtgacccagacgcctaccttgactgggagatgaagattcaacattcattctcctacaatgattatcctgaagagtag

SEQ ID NO: 89185 - DNA, 270 bp, Glycine max
  Peptide Sequence Number=SeqID_180870
atgggagaagtagacgaggtgcaagagcaaataaaggccgacatagaggccctgaaagagcaaatggccacaatgatggaggccatgatgagcttgaagaagatgatggaggtcaacgtggctgcaattgctgctaccagtgtcgttgttgaggtggacccgactgccccatctggcctcaaccaaataaatcatccaacctcggatatggtaggtcaggatgtcaaggagttgggaagtacgggcggcccccattttgtgcaagtttag

SEQ ID NO: 89186 - DNA, 450 bp, Glycine max
  Peptide Sequence Number=SeqID_180871
atgaagaagcagcaacaacagaggcaaatggtccctcccaacagaggaataaacaataacaacaacaacaacaacaacgttgttacggttgggaacgttgttaatgggttgggtttgtctggttctgcatgggttcctcctcctgggtctcgcatgagggctgtttttctcgctgggaaaatagaaaaaagcaccggaactggcgtgttcttgcctcgctgtgttgatactcgcaataataatgattctcgcaataataatgattctcgcaagaaaccagggtgcattactgtgttggttcctgatagagtggcgcaggtgttgaatctgaatctggacggtgtggtgggtggtggccacaagcagcagcacaagcctcgtttcattggggaaaatggatcggctgtttcagggttaggagtaacaattacaataataataatcatcatg

SEQ ID NO: 89187 - DNA, 448 bp, Glycine max
  Peptide Sequence Number=SeqID_180872
atctgcacgacgacgctccgccgggctcgcgcctgggtttgcagcgaccgccgcgcctcctactcatcggggcttggtccttgccccgacggccggcgcgcagttgggcaccgtaacccagcttccggttcatcccgcatcgccagttctgcttaccaaaaatggcccacttggagctctcgattccatggcgcggctcaacagagcagccgcaccgtcctacctatttaaaggaaacttcggagggaaccagctactagacggttcgattagtctttcgcccctatacccaagtcagacgaacgatttgcacgtatgctctcactcgaacccttcacagaagatcagggtcggtcggcggtgcaacccacagggggatcccaccaatcagcttccttgcgccttacgggtttactcgcccgttgactcgcacatgtcagactccttg

SEQ ID NO: 89188 - DNA, 253 bp, Glycine max
  Peptide Sequence Number=SeqID_180873
atgggggtgcaaatagcacccaggcccatttgggccctccagaagattcctccagaaggcggaaatgaagaaggaaggggtccagcccccttaggcacttctctctctttcgaatttgcttggaaaaattgtttccgtgaagaaaatctaagccgagcgcttccgaaacgtttccgtaacgttttccgtgaggaatttcgcgaaggtttcgaccgttcttcgacgttcttcatcgttcttcgatcttcaatgg

SEQ ID NO: 89189 - DNA, 354 bp, Glycine max
  Peptide Sequence Number=SeqID_180874
atgaggataactaagctgacacgccggagttggctgctggcacaacagggtggtgccttaccgcaccgcaggcgaacgcgcggtagcgttcgtggtggtgcttcaggattccaatgtactgcgtccaagatcagaacgagcttgccggcggaccactgccgtcccattcttgagaccgggaaacgcggcggcataggaaccacgggaccccctactagtaaagggaaaacggaagtgcgcgttagcgcaccagctgaaaaagccctttccccttactctaacaaattgggtgctggatacgggatcctcgtagtaggctggaccaacatccagccgagagagggcagcctttag

SEQ ID NO: 89190 - DNA, 123 bp, Glycine max
  Peptide Sequence Number=SeqID_180875
atggcatcttcaggcactcctgctatcttcaccgtgttgcagatcttgatttggatgaggaaatatggatatgaaatgttggctgcctgcacatctggtatggctatgctggtgaagtattga

SEQ ID NO: 89191 - DNA, 405 bp, Glycine max
  Peptide Sequence Number=SeqID_180876
atggaacttcaacgtctcaaccaaaatgaagagaccaacaaaaggaaaagaagcatagcactcaaagcctcctcctcaatacaagaagaagaagaacaagaagaatctgatgatgaagaggacttctcactctttgtgaagaagtttcataaattcatcaataatagaagaatggagagaagtcataacttcaacaatgggaatagatcccaagaagtttctcctacacttaaatgctataagtgtaatcaacccgatcacataaaagcaaactgcccctcaaatgagtcatggcccgagaagaatgagaagaatgaaaaagaaacaagcttcatgatgatgaatcaagttgattcaagtagttttgatgatgacaaagatgatgacaaaatgtccaaagaatga

SEQ ID NO: 89192 - DNA, 144 bp, Glycine max
  Peptide Sequence Number=SeqID_180877
gccacgggtaagggttggggtcctggcgctgcttgtgcagtgtatactggtagcaaatatcattcaactgcacctggcccctatggttggccgcctactggccaaccaaatgctgcatgtagagctccatcctctgcatgtgag

SEQ ID NO: 89193 - DNA, 189 bp, Glycine max
  Peptide Sequence Number=SeqID_180878
atgagtcatgggcgactatatcagagcagagtgaaaaaagcttttaacaaaagagtgtgcccgctgttgttcctttgtacttttattgtcgttgggcatgaacgtacactctcgttcttgctcactcacatgaccgatattctagagccattcggcacatttagcaggggtgccttatgcgttaagtaa

SEQ ID NO: 89194 - DNA, 582 bp, Glycine max
  Peptide Sequence Number=SeqID_180879
atggcggaaggacaactggttatagtgttaggggaagaaaagatactagtgagttgtccatcctctacaccctatgtggaagctacgaaagagtcattggaaacatcttttcaagcactagaaattgtggacaatgcttatatggaagctcctccgatgcaatcgcatttatctggtgcctccttgatggtagcccgagttatgttgagggatgggtatgagcccggaatgggtttaggccggaatagtgataacacgacaagcttggtgaggttcattgaaaaccatggaaggtacgatctgggttatgagcctacacaggctgacaagagaagggtcgccttagaaaggaaagaaagaagcctgacccattcacaagggcggggaccacagatggagagggtctctatctaccgcattagcaaaagctttgtaagcacggggtggatgcatgagaatcaggttgctgtgctagacgaagaaaccaaccaaaagaagccaagttgggtgcagctgtgctccctgggtttcgaattggcgatcgtggagcgacccgagatttcggtgtcaaatccaatgtaa

SEQ ID NO: 89195 - DNA, 180 bp, Glycine max
  Peptide Sequence Number=SeqID_180880
atgatggcacatcacaatgataagttgctgaagcaatggccaccgcaggggagggatccaatgcagccccgcaagcggagattgagtttgacggacaccatttctgaagcgaggagcatcagcaccgcttcgaagcaattaaggattggtctttcctcaaagaaagacgagtccaactaa

SEQ ID NO: 89196 - DNA, 627 bp, Glycine max
  Peptide Sequence Number=SeqID_180881
atggctaaatatgaccctgagatagtcatggagttctatgcaaatgtctggcccactgaagaaggagttgtggataagtgctcttgggtgtggggccaatggatcccctatgatgaagatgctatcaaccaatccctagggcatccgttggtcctggaggaggggcagcgttgtgaatacaccgaaaaaagaaggcaggtctcaggttttgatgaagaggccataggccagctactatgctacccgggacaggatttagcatggagcgtgacagggaggcagatcagtgttcatgtagcacagcttatctcggatgccatctacaagtttgtaggtaatcacatcttcgagacaccaagtggacccagaaaagtccaacaggacactgagatttccagcattgatcacaggtctctgccaattctgaggcaacagcatccggccacagacgcaccattgccacctccacatcagccaccatctctagagtccatctcggctcacatgcagaggatggagctctacatgcaacatttggttgaccagcaggcagctaaccataggggccaagtcccacagaggcccgaggagatgaaaatagagctgaggaagattgagacatggtag

SEQ ID NO: 89197 - DNA, 162 bp, Glycine max
  Peptide Sequence Number=SeqID_180882
atgggcggcgaggatgataaagtatgtgaaaagtatgacataagcaaagagaagtggaaccagttttgtcagagccgtaaagacccttcatgggagaagaaaattgatggaggacaagaaaaagaaacgattggaggaagtagcccaatccaggagcactga

SEQ ID NO: 89198 - DNA, 327 bp, Glycine max
  Peptide Sequence Number=SeqID_180883
atgtatgagaatttgaatgacgcgtcaaagagaagcgccatgcaacttgcaggatatatcacacttttacagattatcatgagaggaaaccacgtgcttgttgttggaggtctgggaaggcattaccaatgtcgaagtatcatggggttcgtccactgtcatataccgatcagagagggttgtgcgacaatttgggaggcttgccaagaaataacaaaaagcttagaatgcttgatcaacccaaaggtagtcactgaaggaatagaagcatacactgtgaccgaggagtgcctaaggatcgccagaggtgtgactgcacaacgaaat

SEQ ID NO: 89199 - DNA, 252 bp, Glycine max
  Peptide Sequence Number=SeqID_180884
atgattacaaccaagaagttatgcccacttcttgcgatgaacccaaaagcggttagtctattgagtccagcgataacaaccaagaagttgtacccacttcttgcaatgaacccaaaagcagttagtcttttggatctagtgatcaacgaagcagcaaatccgcttcttgcattgaacccaaaagaggttagtcttttgagtctagtgtttaaccaagaagaccttctcttgaaaaacagtaaccaagagtag

SEQ ID NO: 89200 - DNA, 521 bp, Glycine max
  Peptide Sequence Number=SeqID_180885
gatttgaggttaaagctataggtgttggcggtggtgagaaaagtgatcaaaattcaaagagagtcattgtgggggtaaaggtgaagaggggccaaagatggcatgggttaagtgggaaaaagtgtataccaaaggaggaaggggctgggtgggtgtggctagaaacaaggtcgatagatggtggacggatattgaaagtgtatagggatgttgggttcaatgagggtgctttggtcacaaagtaccctagaaagattgtgtcattggggagatgggtgggtggtgggaagggtcatgggtttggaggttggcatgcaaaaggaagtggtttgaatgggagaaacctatgggatgaatataaaatcttgctacgtaatgatattgtgggtgatgatttagtggtgttcaagaggatgtggaagtatgcagccccatcaaatgtcacacccttcacttggagactattattggataagagtatagaccaaaagcaatttgagaatcaggaatgttgtgcttga

SEQ ID NO: 89201 - DNA, 486 bp, Glycine max
  Peptide Sequence Number=SeqID_180886
atgtgggcctttcatactggccgaaaaattgattgggcacatttagtccggtatcgcatgcataaggtattgcgattaaatgctcttttaccatatccacatttagtcactcttttccttcaacatttcaacatccctcttgattctgaaccatatattccaatcaagagatctttcttgatcggtgctgttgtggttgcgtcctttggttaccgcaaagagcgtgatggatcttgggtaaaaaaggatgctcaaccaaatgatgatgaaggacaattaccgattgaaggggactcttctctccttcaaagtattttggacaggtttgatggacttcattcctatgtcggtgaaaggtttgatgctttggaacaacaagtggacatgcgattcgatgcaatggactcaaggatgacaaaggttgaagaagatgtcaccatcattcgtgactgccttgatttacctctaccaccaccattagtttag

SEQ ID NO: 89202 - DNA, 411 bp, Glycine max
  Peptide Sequence Number=SeqID_180887
atggaccgtttaaaaaaattggttcgtaacccgtgcgaacggcgggccccgtgggccagcccatggacttgggcccgtgtacccacccctagatttgtgacggtgattttaaggtcggatacaaacacaggtagtagaggaaggactatgtttgtgttaattggctgtgaaaagactgacgagtataggtgtagaaaaaaagaatttatcagaagagacattgggactaggaaatatgagtgtcccttcaagctttgttgcaagccagtggttggaggagaatgttggatggtgaagttgatttgtggagtgcataatcatgaattagccaagtcattagttggacatccatatgcagggcgattgactaaagctgaaaaaacacttattgctgatatgacgaagtccatg

SEQ ID NO: 89203 - DNA, 420 bp, Glycine max
  Peptide Sequence Number=SeqID_180888
atggtagccataaccccagccaaggttcatcaacctccatttttccgagaatacgactcgaacgcaacgtgtgcttgtcatggagaagccccggggcattccgttgagcattgtagggttttgaagcgtaaggtgcaagtccaacccattggtctgtttgctcaagcgacctgtgctcctgagtttggacttccaagcccgttcaatcagagattactcttcttgcacgttggggggggtcccgtaaatcaacaaggacaacccttcccttgtgttcaagaatcccctacaacaatagacccacggtctcttaatcccttttcagaaataagaagaagagaagaagagatctctcttaaaagagatggattgtacaatgaagatcaatcaaaattctttattgaatatgcaagtgattga

SEQ ID NO: 89204 - DNA, 680 bp, Glycine max
  Peptide Sequence Number=SeqID_180889
tggatcccccgggctgcaggaattcgattgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggctcaccatatgtattctatgccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactgg

SEQ ID NO: 89205 - DNA, 348 bp, Glycine max
  Peptide Sequence Number=SeqID_180890
gaaaataggggaggagtttgccacccagctcgcccaggcgagctaggttgcttcctccagaagcaaccgccttctggaggaacatcctggaaggcccaaggatcatgtaatcatccctttttacctttcggaacgttacgaaactttacagattgcgcactaacacttccttttaatttccggcatgtcacggaacttcacggattgtgctacaatgcttttcttttggcttccggcatgtcttggaacttcacaaattgtctaacgatgggtgccaaatacctcgaagtggtcaaacgagggtcgcatcccaacaacggatggtccccggacgaaattagagtatga

SEQ ID NO: 89206 - DNA, 687 bp, Glycine max
  Peptide Sequence Number=SeqID_180891
ttaccctcaccgttgagaggactacacgtcctcgccttgagaggactacacgtcctcaccatcagagggctgcacgccttcacctccagaggactgcatgtcctcaccttcatagggctacacgccctcgccatcaaaggactgcatgtcctcaccttcgtagggctacacgccctaaccttcggagggctacacgccctcgccatcagaggactgcatgtcctcgccttcagagggctacaagccctcaccttgagaggactacacgtcctcgccaacagagggctgcacgccctcaccttgagaggattacacgtccgcgccatcagagggctgcacaccctcacctccaaaggactacacatcctcgccttgaaagggctacacgccctcacctttagagggctacgtgtcctcattttcagggccagtagtttccttttaacgattcttgggccaccccctgatattggaggagggccaactgtgcgagcacaaccagagagggaggctattacactgctactatgcataccgggggatcgcacccacaagacacccagtggacccggaatagtccaacagggccctagggtttccagctctggttacgggcctctatcaatcctacagggtgcccggatcgcgcctgcaagacacccagtggacccgaagaagtccaacaag

SEQ ID NO: 89207 - DNA, 591 bp, Glycine max
  Peptide Sequence Number=SeqID_180892
atgtctcctttccttgtgagggatttcggcgcacaaaattccaagactatacaaagaatccataaggcgtgggaaaccccgttaaagaaagatcaagagcttagaggcattcgtaatggcatcattggtgggtaccacgaatggctgaaagttcatatacgaggagcaagcttccgcaagacttacggaaagatcttagagttgaccatagcagaggtgtccatagaagccattgcatcacttacccaatactacgaccagcctttgaggtgcttcacattcgcagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggattggaccgcataaaacagactcggaatggcatagcgggcctaccacagaagtacctagaagacaaggcgaggggtatgggccaatcaaggagactgggtcccgtttatggatgtgtagctttgctaattttggggtcgtctctttccaacgtgatgggttggtag

SEQ ID NO: 89208 - DNA, 276 bp, Glycine max
  Peptide Sequence Number=SeqID_180893
catttcgggttttataaagggacatcatttggaaatttcgaccacgccaatgtgaccggggttcagtgtagggtttcatcagagaacaacggcgatttgtggtggctaatggtgattatgggtgatggagaaagatcttggaatgttggaaatggttttggaagaaagaaagagaagaaaatgacatttttcctaagctacacgaaagcaaaggctgaaacgctcaagaaagctggagttgctgcacatgatgtccaacgttatgtcaaggaataa

SEQ ID NO: 89209 - DNA, 363 bp, Glycine max
  Peptide Sequence Number=SeqID_180894
atggttgtcattttgcctaagggaaatgttgttatctggttttgttcgttgcataataggccagacaactacctcaaaggaattattaacagtgctttgaaagaactaaatcatactccacaaagtaaatccaaggctgctgctaggtggattattgttaaatgtaatagacaaaaaggaagcactgagtatgggtattacgtcatgcactggatgtcagctataatcttaggaagtttcaagaataattgggaaacgtatttcaatgatgttaaaccattggaaccagagagattgaaggcacttcgcatccattgggcaatctattatttgaaagataaaaatgaaacaattagtgtttaa

SEQ ID NO: 89210 - DNA, 716 bp, Glycine max
  Peptide Sequence Number=SeqID_180895
atggtgaaagttggaacctcttacgtgccgatcaacgtctcattttcgccaaaagttggccccagggcttccccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgtcctcgccttcagagggctacacgtcctcaccttcagaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 89211 - DNA, 636 bp, Glycine max
  Peptide Sequence Number=SeqID_180896
atgaccgatcctctcgatgagtcgatctcttgctttctcataagggtgaacccttggggctacccgccctcaccttgggtactagttaccctcaccttcagagggctacacgccctcgccattagaggactgcatgtcctcaccttcaaagggctacacgccctcgccatcagaggactgcatgtcctcacctttgtagggctacacgccctcacctttagagggctacacgccctcgccatcagaggactgcatgtcctcacctttagagggctacacgccctcgccatcaaaggactgcatgtcctcacctttgtagggctacacgccctcacctttagaggactacacgtcctcgccaatagagggctgcacgccctcaccttgagaggactacacgtcttcgccaacagagggctgcacgccctcaccttgagaggactacacgtcctcgccaacagagggctacacgccctcaccttgagaggactacacgtcttcgccaacagagggttgcacgccctcaccttgagaggactacacgtcctcaccaacagagggctgcacgccctcaccttgagaggactacacgtcctcgccaacgatcgaattcctgcagcccgggggatccactag

SEQ ID NO: 89212 - DNA, 120 bp, Glycine max
  Peptide Sequence Number=SeqID_180897
atggaggttgaggaaccttggctagggttatggctaccattgcatcatcaagtagatatgggagcaaggatgacctttgtggataacttggtggtgggtaaggagaagggttgttattga

SEQ ID NO: 89213 - DNA, 159 bp, Glycine max
  Peptide Sequence Number=SeqID_180898
atggtgtggtgtctccaatcatctttcttcctcctccattcttccaccattgatcttcaagaagcaatggactccattgatgaagaagatccaaggcctacaagctccacatggagctacatcaaacaacctattagagataggggaacaacaacatga

SEQ ID NO: 89214 - DNA, 111 bp, Glycine max
  Peptide Sequence Number=SeqID_180899
atggcgaaaaatcctggtgaagagtcaaatgatttggcaatttctcacggggggctgaatcaagataattttgaatcagagttttcgatttttgttcatccttcgctgtaa

SEQ ID NO: 89215 - DNA, 72 bp, Glycine max
  Peptide Sequence Number=SeqID_180900
atggcgactaagatgaagcgatgcccattggaagccttgggtgaagcattatcattatcagtgaaggtctag

SEQ ID NO: 89216 - DNA, 210 bp, Glycine max
  Peptide Sequence Number=SeqID_180901
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcatcgaattcctgcagcccgggggatccactag

SEQ ID NO: 89217 - DNA, 157 bp, Glycine max
  Peptide Sequence Number=SeqID_180902
gaattcgattttcgcaagttgggtgataaatgcgcagagacaaattctgcaccccttgtcattccgcacaccttttcgctatccagaggcgatcgtgtccaacaaaacgcggagacaaattatggttccgctgacagggaggttcactggccgaaag

SEQ ID NO: 89218 - DNA, 2036 bp, Glycine max
  Peptide Sequence Number=SeqID_180903
atgagagagagggatagtgagagagactatgagggtttgagagagagagacatagggacagagagagagagtgggtgggagagggttaggaccagaggccgaacaacagcgggagatagagtacatcctacggggagctcacgatggataaacccagcaaatttaggaagaaaccagcaagttcacacttcgaactggagggataaaaaggatatatcctccttctacttcactcgattctcagatgagatcacggagaaggatctgtggcggcatttcaggcagtggggggttcatgatacgcatcaactagcaaaacaactagacggacttctcatcggggggctgaagatgtatgtgaacataccgcggtacagcagagaagggccaaggcagtgcgtcacgggtaacaagatttgcgaccgaaaggaaagcaaccctgaggtagccgttcgcagccatagacaacaccacataaaccagggctcatacgctgaggttctgagaaggaatgtggatattgagagaccacgagtgctccataacagccatctccatggatatcaagcttccatgttctcggtccatttaaccttagaccccgatgacactgacgagatgctatgggaaacgagactagatatatcacctaagtatctaggtgatgatcaagttttgctacttggactcaccaacagaggagccgaacaactcatgaacgacaggcaacagggggggcgaccgttgttcagtacaatagaaaaatggaacccatccttacatacaaccttcaggctaacatgggtccaagtctggggcataccacctcaggcatggaacttgaagcacatcaggagcatactagcggcaatgggggacacggtggacgtcgatgatgacacagaagccaaacggaggcttgacagggcaagggtgcttgtaaagacccaatggagaccgacaatcaatcatatggtggacgttcatattagcggcgacatcggcaatagctttaaagtgtatattgttgaggaaagcggaggtggaagccacgaatgtcgtagaagacgatgtagtctgagtgggacgtctgacaaaatcgtctccgacgattcctctctcggacatttttctctgcccagcagttcttgcaactaccgacacactgcggaccagcccgacgaggttgggcggttccgacgaacaccacacggacgaaacagtggtgcttcaatccagcgcaaaaaccagcaccagtcacatcacaccagaactggtggggtcagccacaacggctacttatccgaacgagttgagtactgcacagggatgggtgaggagtgttggggatgcaaccgctgcaggagggagccagttgaatcacgatataggaaacaatgggagaaagaaataagaaaggaagaagctggtttgcatgcttctgatgttgcagatggtgacgtggcaaacatattaaacgtggcagagacttatgaagctggggtagcaaatattacaagtaatgaaggccagaacaagagtcatctcttcaccaaggtactcaggaacctgatggtctattacatcaagaggcttcggaagtctggaatcgagccaagatgttgggggttacagaagaagaaggcgcgcattcagtcatacccagactcaaggatatggagagtagagataagaaggaagcagaaaggttgggaaatagttgtggagcatgttgatatgatctgcattcaggagacaaagagagagtcggttgataaatctttgtgccaatcattgtggggagacgtcggagtcagttgggagatgcagtcagctagtaatacagcaggtggtgaatgggtgaaggaagctcaacaagtcagtgttcttacaatttattctccctgcgaaattcaaaacaagagggaccttcatgagagatttgggatatgtcaaaggggttcaggccccctaaaagatttatctaacatccagcaatctaggactcctaaagggtttaggcccccagcaatcag

SEQ ID NO: 89219 - DNA, 438 bp, Glycine max
  Peptide Sequence Number=SeqID_180904
atgtgctcaatgagatactgggacgacaagatattttcagtttttatatggcaaggtcaaggcatttatctatctttgttgcttcttcagaacagtttctccggtattagtggtgcaagctactacactggaactttcaatactgtcaatcgctctccggatgggaggtatgttgttgtgatggcatttgcttttgcttctatttgcttgccattatggctgccacataatagagcagttgccagaagaatccagaacatgcgatggagagctgatggtggaaatgatcctagaagaaaatttttgcttcatggagaggtcactattgacacaatgacagatgatgtggaattcacagaacatggttatgaccggactaagttcttgaagctctctaacagaatagagtacacaattcgaacttggtatcttctataa

SEQ ID NO: 89220 - DNA, 474 bp, Glycine max
  Peptide Sequence Number=SeqID_180905
atggataatgccgaagtttcgtggttattgactggaaggaatggcaacctaacagtcaactcaaacatcgaggcgcatgcagcaaaaatctcacctttggaaagctacctcaacaaccacgagcctcaggtgtattctcgtgggagctggtctcaaaggagacaccaaaggcaggaagggcaagtgaatgccaatcaagagcaggcaaataacacacatgcagacagtagaagcaatgctcctcacagtgggacaagagacatcagaagtgacttcaataaggaggcagttgaagctgtgactagagtgaggaagaactattctctcacttgcttactttatttcattcaaaataacatatatatacatcaaggaagaaagggacagcttgacaagacaagccatactgttgtcttctacaacaagctaagcaggaaaactaagaaagctaaacaacaaaaaatctctcaatag

SEQ ID NO: 89221 - DNA, 207 bp, Glycine max
  Peptide Sequence Number=SeqID_180906
atggccttggataagaagcttagagaggaagcttcaatggaggaaaagaaagagagagagagagaaatgggcgggggggggggggtgatgcaatcctaccccgcaagggcattggatagaaaattccaagtagattgggccaaagatgcaagagaaggccctagggttcttatgagccttagggtagatttcgggcccatgggctaa

SEQ ID NO: 89222 - DNA, 972 bp, Glycine max
  Peptide Sequence Number=SeqID_180907
atgaggtcctctaatggtgattatccaccatggagatgcagcggaagacaaaagagaagaggtgagacgaggcgccatccactagggaataagccatggaagaaggagctttaccaccaagatgagccttggataagaagcttggaaggatgcttcaatggaggaaaagaaagagggagagaaagagagaggggggagcacgaaattgaaggaataaaagagggagagaagtggaactttgaaggcatttccacttcttgtttgagagaggaatggtggccggagaagtgtttggttgaatgggtgaagagaagtgatcttgttggagcagaaatggaagccattggatgggtgggtgggagccacattgatgaagccaccctctcggcgctattcaagtcgcaacagagccacctgaacttcttcttcgaccacatcgaccactcccaaaccctagccttcacgtgcgcgctcctcaatgccgccggcatcgtcttcttcaccgatgtcgaaaaatccggctttgtcgcacacaagatctcgcagacgctcgtctctctcgccagtggatgctttccacgcaagtcctatgccactgaggagctcctccgccttgtgctgtgtgcgggggccaaaggcgcgctcctcatcgcgctcacctctgtcgaaggcaacgcgctcaccacggcgtgcgacatgtccgtgcatttgccgctccggagagagctctgtccaatcaacctcgcaccagtgacatccactgctattcaaatggtgttcggcgacaccatcgccatcgcactcatggaggcgaggaatctcaccaaggaggagtacgccgcgaaccatcccgccggcaagatcgggaagagccttttcttgaaggtgaaggatgtgatgaagaaacaggacgagcttccaatttgcagagaatcgaatttctttgattctgttccaatttttaattggtaa

SEQ ID NO: 89223 - DNA, 447 bp, Glycine max
  Peptide Sequence Number=SeqID_180908
atgcctaggactcctgaacaaaataataaaaagataaaccccaaggcgagtcgttgctttttcattggatattcagattgcgctaaaggatgcaggttctttcatccaagtaaggagaacaaaattgtagagtgcatgagtgctaattttttagagcttgatgtagcggaccctgttattcccttttatggcactgatgtcgagtcacatgagattgtttctttgccactacctattccagttgttagtgtttcaaatgttgttttgattgagactagggttcaaattgtcgcaactaagactagggtcccaattgttccaattaagaccacaattgtgactggagatatagttggctctcatgccaatgatatgcttgatcctcctactatgaatgagaatgcacaaccagttgagcaagttccattaaggaggacaactagatag

SEQ ID NO: 89224 - DNA, 297 bp, Glycine max
  Peptide Sequence Number=SeqID_180909
atggaatctgtgtttggtcaagcaatcaaccaacatggaatctgtgtccacatgatccaccactatggaaccatctttgacaagatctctaacagtcagatacttcaactccaagatatcgcacccccaaccattataaagatgtatccagaagtcgatctcctatcattggagaatccaccaagatctgaatctatgtaccccataacctccaagttgtcaactctcctatacatcagcatatactacttggtcttttggaagtacctcatcattttcttagtagccatccaatga

SEQ ID NO: 89225 - DNA, 234 bp, Glycine max
  Peptide Sequence Number=SeqID_180910
atggagatgcagcagaagataaaggagaagagcttggagaggatgcttcaatggaggaaaagaaagagagatagaaagagagggaggggggagcacgaaattgaaggaggaaaagggggagagaagttgaactttgagttgtgtctcacaagactctcattcatcaaagttacaaaaattgttacgcatgtttctatttatagcctatgtagcttccttgagaaacttccttga

SEQ ID NO: 89226 - DNA, 387 bp, Glycine max
  Peptide Sequence Number=SeqID_180911
gaacaacaagctgagtgggtaaatgcgcagagacagattctgcgccctttatcattcaggagcagcgaggcgggtgataaatgcgcagagacaaattctgcgccctttgtcattcagatttcgcaagttgggctcgatcgtgtccaacaaaacgcagagacaaattatggtcattctgtgtcttgtatcaaccatgaggagaaaattgggcagtatcaggatgatgtgtcgttaaaaggaagtgttagtgcgcaatctgtaaagttccgtaacattctcgaaggcaaaaaaggggatgattacgtaatccgtaagggggtgcaaatagcaaccaggcccacttgggccttccaggaagttctccagaaggcaccgccttctggatga

SEQ ID NO: 89227 - DNA, 456 bp, Glycine max
  Peptide Sequence Number=SeqID_180912
atggccagaacacgaggtttaggtcgtgccataggtagagttgtaggcagagatagacctgttgacgaggatgctggcgatgttcccgagaggcgtaggcctacggcctcagcccgtaggctacgcgttcatcagatgactacggagggacgtgatatggctgaggacgtcgctgacatgactgatgatgtccctgagcagcctacggaggcacctgagatgcgtgcggacgcacagggtgctgatagtggtgaggggaagctgactctgattgggaggccagtgcctgagattgaaggcctggtggctgccacaggattaagtccactgatagattgttcagttattactggcgatcctggacttatatccgcatttgtggagaggtggcacagtgagactagcaccttccaccttccagtagatcgaattcctgcagcccgggggatccactag

SEQ ID NO: 89228 - DNA, 294 bp, Glycine max
  Peptide Sequence Number=SeqID_180913
cttcaatttacaaccagattgttgaagttgttaataaagatgaaggtggtatgttttttctctatggatatggaggtagaactgcacattcaaaattcaaaattctagttccagtttttgaagactcaacttgcaatatccatcaaggaactcaattagctgaactattaaatcagacgagtctgatcatttgggatgaagcacccatggctcacaaattcttttttgaggcacttgatcacaaccttagagatatcatcaaacataactcaaaggacaataaaatctttggag

SEQ ID NO: 89229 - DNA, 213 bp, Glycine max
  Peptide Sequence Number=SeqID_180914
atggtaaaggaagcaatgaagatcctccaaaaagaagtcaaatccaatgatgaacatccaaaagttaatggaaagcttcaaaagaagtatatccccttgaaatcccggataaaccatgtattggtgataaatctgcaaaaggctctttatggtttgaaacaagcccctagacactctgcgttaaatgatttaagcaattttcctgtgacctaa

SEQ ID NO: 89230 - DNA, 777 bp, Glycine max
  Peptide Sequence Number=SeqID_180915
atggttgaagcactctcgcaaaacatcgtgaccctaactggtcttcctctgatcttacttagtgagagtgacctaacaaactcattgtgtggtgtgtcttgttatgtactcctaagcgccccagggtggtttttcactaacatgagggtgtcacagttttcactagccaatgttccactcctagaagaagagctaagagcaaaaatcacattgaatgagcgaatagaaatctatgttactcgcctcagaaagcgaatatcaaacgatacacgcaatgctttgttgatgggtgctattctcttcgtaacaagcacgtacgaagcagcacttagcccccccggtggagtttaccaaggtgaggctagtagtgtcacaacctcaaagaaaactagggcatcattgcttcagagggattatgcaacgccagaaattgtagggaaagtggtgatgaaaatgcaaacgttcttctggttttggtccttcaatacatggtccttttatctatcaattttgatgatatgtttgctaatgccacgagggcgcatccgccttatagttactttcccactttctatcttttctgggttctacgtgttctcgatgatggttatatcacccagcctcaggttaaacactgccactgtggttatgccatgcatatttatcgtcttctactgttggggaagttcgatatacattaggttagccaaaaaacttaaaatgtacggtcatagacaaaaagacgcgttgaagttttccagagaaaatagatggtaa

SEQ ID NO: 89231 - DNA, 201 bp, Glycine max
  Peptide Sequence Number=SeqID_180916
atgggggtgcaaatagcaaccaagcccacttgggcctccagaagattcctccagaaggttgttgcttctggaggaagcaaccctgctcgcctaggcgagctgggtggcaagcttctcccccaattttctataaatagggggagaaatgaagaagaatttcgtgcagccctcctgaaaattcgagtcgaggcgcttccataa

SEQ ID NO: 89232 - DNA, 142 bp, Glycine max
  Peptide Sequence Number=SeqID_180917
atggaggataggcaaccaacgctaggcaatcatcaagcttatcgataccgtcgacctcgagggggggcccggtaccagcttttgttccctttagtgagggttaatttcgagcttggcgtaatcatggtcatagctgtttcct

SEQ ID NO: 89233 - DNA, 150 bp, Glycine max
  Peptide Sequence Number=SeqID_180918
atgagtatgaggcctgatgaccttgttgagggtgacgggaacttcgtagaattgacagaggcccgtaatcagagctggaagccccaggacccggttggacttctttgggtccactgggtgtcatgcgggggcgatccccgcaaacaatag

SEQ ID NO: 89234 - DNA, 306 bp, Glycine max
  Peptide Sequence Number=SeqID_180919
atggtactgtggttggaaaagcaatgtccatctgatgttggtgtcatagtagccttctttgttaaccatgtgaaagtcgctccggacgaagccttattccttggagcaaatgaacctcatgcatatatctgtggtgagtgcattgaatgcatggcaacttctgacaatgttgtcagagctggcctcactcccaaacacagagatgtccagagtctttgttccatgctgacatacaaacagctccatggagatttctttctcacagataagaaggaagaaaacattcttggatggggctataaataa

SEQ ID NO: 89235 - DNA, 567 bp, Glycine max
  Peptide Sequence Number=SeqID_180920
atgaagaacgtcgaagaacggttgaaacctttgcgaaattcttcacggaaaacgttatggaaacgtttcggaagcgcctcgggggagatgcttgccgcccagctcgcccaggcgagccaggttgcttcctccagaagcaacagccttctggaggaatcttctggagggcccaagtgggcttggttgctatttgcacccccatttttactaagtacaccccccttgcctttttttggtgattctttttttcgtaaagttacagaaacttacgaatttcgtaacgatacttgttttctttccgtaatgttacggaaccttgtggattacataatcatcccctttttgacttacggaatgttacggaacctcactaattatgcaacgatgcttccatttgatttccggtgtgtcacagaaccttacggattgtgcatcaatatttcttttgtttccggcatgtcccggaatttcacaaatcgcctaatgatgggtgccaagcaccttacaagggccaaacaaaggtcgcatgtcatcaagcaaaggtccccggacgaaattagggtatga

SEQ ID NO: 89236 - DNA, 465 bp, Glycine max
  Peptide Sequence Number=SeqID_180921
atgcgttgcatagatgcaacgctattgggtaacatggttaacatgagcacggcgaatctgacgacggacatgaacggcgagaaacaatcatcgcaaggcggcgaggggcgcaggcttctggcgctgccgggtatcatcactgttgtttcagcgctgattacggcatcaatatccttcgccattctgattggtattaccccgatcacgcctgaccggactgtcacgctggcattggtcatcatcaatgtcgcgttgattctgttccttattctgctgatttgccgcgaagtctatcgtatcgtcatggcccgccggcttggaaaggccgcttcgcgcctgcatgtccgcatcgtcgcgctgttttcgttgatcgcggcggttcctgccatcgtggtggccatcgttgcttccgtaacgctcaatctgggtcttgatcgctggtttgacaccaatacccgcgacatt

SEQ ID NO: 89237 - DNA, 309 bp, Glycine max
  Peptide Sequence Number=SeqID_180922
atggcttacacccacattccgctttcaaaattgccccatgtgtggcatttcttgtcaatgttaggatttacacgcaattctcctcaaatttcagccagcccgtatcaattagacttcacactttatgcttcggggtcatacaatgctcaatggaatgccccagggctcctccacgataagcacacgttgcattcgagtcgtatcctcagaaaagtggaggttgatgaaccttggctagggttatggctaccattgaattatcaagtagatgtgggagcaagtcagcataggacactggaattggggtga

SEQ ID NO: 89238 - DNA, 879 bp, Glycine max
  Peptide Sequence Number=SeqID_180923
atggggtcgagtcaggcgcctccgcttaaaaagaggttctatcaagtcaaggtcaagagcctaggaatcaccagtctaaaagagttagggcagttgatgggtcagctccagcgacaagcttttcgcaaagcttacggtaaaatctgggacctagccatggcagaagtctccatagaggccattgcctccctcgcccagtattatgaccagccgttgagaaagcaagtcgaaaatggggtggttggagtatcgagaaaatgtttggaggcaaaagcaaaagcaagaatcttggtaggtagaggcgaatgggccccgttcatagacatcctcgcacttttgatcttcggaggagtcctctttctaaatgtggatgggttggtggacctagaagcgatcaacgcttttctcgcctatcatgatcgcaaggaaagcctggttgtcgctatactagcttatctatatgacaccttcaaccgaagatgtgagaagagcagtacaaggattttttgctatactctggccctctatgtatggttggtttcacactttttttgccaagaggtgaggcatgcttgcccgctagaaagccaccgttcatgcacagagaaaagaggggcaaattgggaccgactcttagcaagcaaagaaggagcatctgtcaactggttccctcgttggaaagaaggaagaaccggggttcttatttcgtgtagaggatttccaaatgttcctttgatggggacaaggggttgcatcagttacaatcccattcttgctataagacaacttggctaccctatgagaggggcaccactagaggaagagctcgcacctactattgcacggggtttcaataacaccaacgtgggggcgctttag

SEQ ID NO: 89239 - DNA, 165 bp, Glycine max
  Peptide Sequence Number=SeqID_180924
atggtggctgacttgttggctgttgggggtgactggaccatttcaaatggagaatccgatttgaggacaaatccttctcaagagggagagaatgatgaggacatgaccaagagcaagggcaaggatccacttgaaggacttggaggacctatgacaatgatatga

SEQ ID NO: 89240 - DNA, 243 bp, Glycine max
  Peptide Sequence Number=SeqID_180925
atgaaaggaaaccaacaaaggggtaagtcacgatccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcatggggaaggtattag

SEQ ID NO: 89241 - DNA, 615 bp, Glycine max
  Peptide Sequence Number=SeqID_180926
atggacctcatcaaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgctgtaatcaacaaatacctgggcagaccaactgaaggagtggtggatattgatgtttctgagcatcaaattgccaaggaaatcactgccaaacaagtccagcattggccaaagaaagggaagctttctgcagggaagctaagtgtgaaatatgcaatcctgcataggattggcactgcaaactgggtacccaccaatcatacttccactgttgccacagaatcttttgctgtcaaattacccattgccttccctactgtattgtgtggcattatgttgagtcaacatcccaatattttaaacaacattgactctgtgaagaagagagaatctgctctgtccctgcattacaaactgtttgaggggacacatgtctcagacattgtctcgacatcagggaaagctgctgcttcagtgctgtgtccaagatgctttgattgctga

SEQ ID NO: 89242 - DNA, 578 bp, Glycine max
  Peptide Sequence Number=SeqID_180927
ggctacccggtatcaacaaggacaccaggatttatttattctgcgaagtgatcttccgtcacagctgtccctcctgttcagctactgacggggtggtgcgtaacggcaaaaagcaccgccggacatcagcgctggcaagtgtagcggctgcgcaactgttgggaagggcgatcggtgcgggcctcttcgctattacgccagctggcgaaagggggatgtgctgcaaggcgattaagttgggtcaattaaacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccggatatattccgcttcctcgctcactgactcgctacgctcggtcgttcgactgcggcgagcggaaatggcttacgaacggggcgggagatttcctggaagatgcagaagatactaacagggagtga

SEQ ID NO: 89243 - DNA, 663 bp, Glycine max
  Peptide Sequence Number=SeqID_180928
atggcagagccatcgaagaagagaaagggatcatcctccaccgccgctgctgctgcccatcgccgccacgggccatctgaagcatccacaacacctattcatccatctttatcatctccaagatcatccacattgttttcttccgatgatcaacgtctacagtacctctctcaattttcttctaggatcatcttagaccctaagtacctagatgtagaattctttaatgatgaaacgtttgattgctatcaagtgtttcaaaattctggccttgctaatttcatgtcattaaaactgccacattatcctaaacttgtaaaggtcttctactgcaatttgaaaattcaggatggcattatttcctctgaggtgcatgtgacttcctttggttaccgtaaggatcagaatggtcaatggctgaagaaggacgcactccctcctcaagatgagcgtactccttcacctcctcctcagcgagatgattcagcactcatgaatgaagtccttttcgaattatggggtcttcgttcttatgttggtgaacgtttcgactcattggatacacgttttgccggcatggatattcgcctcacacagcttgaagaggatgtaggttacattcgtcagagtttcgatcttccaccgccacctccaccttcttag

SEQ ID NO: 89244 - DNA, 403 bp, Glycine max
  Peptide Sequence Number=SeqID_180929
atggcttcaaaaaaagttgtggaatggtcaatgtcatcagatataggggatcatcgacttcatgattcggcctatctgcagccaagcaaggaaggtgttaagtgtctgccctatgaccttaacctcttcagcgggtacaagaatgggagcatctgcatctcaaacctcctcaacaccaaccttgacttgatcatgcaacaaaggaatgttgtgaacgggattgtcgcaacctatccttcggtggtagggcgatgtgagggctcacaggtgcgtcttccaaggaaggaaaatgcgtggagtcgccaccaacgtttattcaaggaaaacgtcggaaaaaccagaacgtatggtctacgaactttaattgtgaaaggtttaggagttgtttttacgcacggggaag

SEQ ID NO: 89245 - DNA, 189 bp, Glycine max
  Peptide Sequence Number=SeqID_180930
atgacgatgacggaaaccgtttgtacggataaccgcttgggtatctccatacgtcacctgacttcacgggtcacgataacaaaaggtggggtggtcgacaaaagcggggcttttgctcctacgtatcctccatttgtgatgaggaactcagacctacgtagttcttgcttttgtgatgtgcgagactaa

SEQ ID NO: 89246 - DNA, 522 bp, Glycine max
  Peptide Sequence Number=SeqID_180931
atgccgaaattcgccgccaatctgtccatgctttataccgaacatccgttcatggaacggttcgccgccgccgctgccgatggttttgcggcagtcgaatatgtcagcccctacgaggaggcggcagagacgattgcagcggagctcaagaggtgcaatctcacacaggctctgttcaacctgccgcccggcaactgggccgcaggcgagcgcggcatcgccagcctgccggacagggtctccgaatttgagacgtccgttgaaacggcgatccgctatgcaaaagttctgggatgccgaaagatcaattgtctggccggtatcaaccgcccggtgtcgatccgcaagttctggaagacacgcttgtcggcaatctcggccacgctgcgcaacgtctggcggattccggaattgcccttgtcttcgagcccatcaatacccgcgacatacccggctatttcctcaccaacaccgatcaggccgagcggatcatggaccgtgtcgggcattccaacctgctga

SEQ ID NO: 89247 - DNA, 244 bp, Glycine max
  Peptide Sequence Number=SeqID_180932
atgccagttttcatggaattatcgaaaccgcgtatgaaaaaacgtatacctaccctgctggctaccatgattggtgcagcgctttatagtcagcatgcactggccgacgatctgatgtcgcagtgtatgctgggcgtgccgagctacaaccgtccgctggtcagtggcgacgcaaattcgctgccggtaaccatcaactctgactcagcaaaagggaactatccgaacgacgcggtgttcaccg

SEQ ID NO: 89248 - DNA, 204 bp, Glycine max
  Peptide Sequence Number=SeqID_180933
atgtccgattcaggcgcattatatatcgagatgctcgaaattgaacaacggaagctcacgagaaattcaaatagtcataattcttcactcggttgtccgattaaggcgcaaaatatatcgagacgctcgaaattgaacaacggaggctcttcagaaattcaaatggtaatcattttcacacggatgtacaattcgaggacataa

SEQ ID NO: 89249 - DNA, 738 bp, Glycine max
  Peptide Sequence Number=SeqID_180934
atgggcttgttcgtagttgtagggcaaaatattgtgcttgcgggcttgggaaaagtgtttgagaattcattcaccatacgtaatattcgttatgaaaatgatgttgttaaggttcaggttgtcagaacatacatgcctcacgctgaggccgttggcacattcgtcgcatggctgacacatcttgttagggaagtaactaatgaggtggtcgtaggacccgataagcctccatcaaagtctattggagaaccgaacaggttaacatctgtggccatagatggcccactgggagaattggttaagaagtcatatgtggtttacacaaagccaatggagttggcatgggatggggcgaaatttgggttacctaatgccacaaatggttttttcgtcacacatgcagatctgtggatgatgtttatgaatgattggagtacaagcattggtttttctccagtgtacggtttccttgagccccagtctatacgctgcacaaaggacacgtgtgaagaatgtcaaaagtacatagaaacgtgggtcaaggagtcacatcgagaaatctacttaggaccttacttcaatcaggcacattggcaacttcttgtgttgtgtccaggagagaacattatagtatggttctgttctgtacgaagaaagcctgatgttcacattaagtttgcagtgaacaagtacttcgcaaccttattcaatttagcattggtcattacttggagatga

SEQ ID NO: 89250 - DNA, 165 bp, Glycine max
  Peptide Sequence Number=SeqID_180935
atgaagaatcttgttcataaggtgatgcaatcctaccccgcaagggcattgggtagaagactccaagaagattgggctagagatccaagggaaggccatagggttctcatgagccttaggctaagctctagcttctcatctcaaggagatgagcttagctattag

SEQ ID NO: 89251 - DNA, 240 bp, Glycine max
  Peptide Sequence Number=SeqID_180936
atgtcagtgaaaaacctcgtcggacgcctaggagtacatgacaagacagatcacacactgcatagtcttcaaggaacattcaaactgagtgtatttacccccaagccctatactctgaagagtccatcaaggcctctccctcatgattcaggaattaatgaaacattgggcttaatccggattttggttatggacttgaagagggcaaataaagcagcgcttaccttagttaatttctaa

SEQ ID NO: 89252 - DNA, 243 bp, Glycine max
  Peptide Sequence Number=SeqID_180937
atggattcacaaacaatttatctcacaaacattgcaaagatcataacaaataaagcaccaagataccacaaggaaaaggaatgcgaaaaaatgaaaccaaaagtgcacaaaggaagtttgggggctattgccaatggtggctctcgtaagctcttggtggaggttttgattttggggaagaatggggtgaaaatggcttcacccctacccttttatgttttcacgatagtcatgctcgcctag

SEQ ID NO: 89253 - DNA, 660 bp, Glycine max
  Peptide Sequence Number=SeqID_180938
atgggtctttataaggccacgagtaaggactgggatcttggcactgctgatgtagggtatactagtaaaagctatcattcaactgcacctggcccttatgattggccgcctgctggtcagccacatgctacatatagagttgcatcctcttcatgtgagcagagatggactctagggatggtggttgttgtagaagtggcggtggtgtatctgcttctggctgctgctgatagtcctacccctgctgttgggaagaatagaattatgatcactggggaggatgtcactgacaagcagtgtcatccagatatgtgtcaaggtggtcatgctagtgcacatgatctgcacccgtcttcctgtcacacttcgtgcaaagtcctatcctggaatgcacaacagttggcctatggcctcttcatcaaatcccaaagcctggctcctcctctcactgaactcgcaatgttgcccccctcttccaggaccaacgtgaatgagttcaagatattcaagatagaatcaagaacacttcaagattcaagaggaaagttgatttcaagaatcaagaatcaagattcaagagatcaagatttcaagaatcaagattcaagagatcaagattcaagaatcaagagaaggcttaatcaagataagtatgaaaag

SEQ ID NO: 89254 - DNA, 249 bp, Glycine max
  Peptide Sequence Number=SeqID_180939
atggatgacataagtgcttgttatatatacaaaaccaaaataggacataaaaaagtgtgtgttgtggaagcaatgccttccaaggttattttgatgatgccaaaaaatcaagagttaagcaaagtttcaagcaaagattcaagaatcaagtttcaagtttcaagtttcaagaatcaagaatcaagaataatcaagatcaagattcaagactcaagattcaagaatcaagagaagactcaatcaagataa

SEQ ID NO: 89255 - DNA, 601 bp, Glycine max
  Peptide Sequence Number=SeqID_180940
tacactcaccttcagagggctacacgccctcgccttcagaggactacacgtcctcgccttcagagggctacacaccctcgccttcagagggctgcacgccctcacctttagagggctacacgccctcaccttcagaggactacatgtcctcgccatcagagggctgcaagccctaaccatcagaggactacatgtcctcaccatcagagggctacatgccctcaccatcagaggactacacgtcctcgccatcagagggctgcacaccctaaccttcagaggactacaggtcctcgccttcagagggctacacgccctcgcattcagaggagtacatgtccccaccttcagaggactaaacgtcctcgccatcagagggctgcacgccctcaccttcagaggactatatgtcctcgccatcagacggctgcacgccctcaccttcagaggactacacgtcctcgtcatcagagggctaaatgccctcacctttataggactatacgtcctcaccttcagagggctgcacaccctcacattcaaaaggctacatgtcctccccatcagaagagtatacgtcctcacctttagaggactacac

SEQ ID NO: 89256 - DNA, 452 bp, Glycine max
  Peptide Sequence Number=SeqID_180941
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttccgctccaagctggactgtatgcaccgaaccccccgttcaggtccgaccgcctgcgcctttatccggttaactattcgtcttgagtccaaccggaaaagacatgcaaaagcacccactgggcagcagccactg

SEQ ID NO: 89257 - DNA, 153 bp, Glycine max
  Peptide Sequence Number=SeqID_180942
atgacaatcaattcatggggctccggacttgatggtggaggacgcacgaacagcactctaggcaatcatgggagctccgaactcgatggacgcactaacaaatctaggctatcaattcgtggggctccgaactcgatggtagaggatgcctga

SEQ ID NO: 89258 - DNA, 260 bp, Glycine max
  Peptide Sequence Number=SeqID_180943
gtgctccagtggcttctgtttctatcagctgtccctcctgttccagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagaattcgatcttgaagataggacaatcaaccctcagatgtccag

SEQ ID NO: 89259 - DNA, 747 bp, Glycine max
  Peptide Sequence Number=SeqID_180944
atgtctgaaccagcagaaaagagcgttatgaaaccacaagcttcagcacagcgaccctatcaggaagtgggcgagatgcttcgcaatatgattacgcagaaacagtacgcgattggcgagcggttgccgccggagcgtgaactggcgatgctgctgaacgtcacgcgcacgctggtgcgtgaggcgctgattatgctggagctggaagggttgattgaagtgcggcgtggtgcaggcatttacgtgatcaacgacacgccggcaccgcgtgccgctgcgcaaaccgcctgcaatgcggccggtccgtttgagatgctgcaggcccgtcagctgctggagagcaatatcgccgaattcgctgcgttacaggcgacgcgtgaagacatcatcaaaatgcgccaggcgctggcgctggaagagcgtgagctggcgtcaggcgcagcgaacgacagcgaaaacggcgaccgcaatttccatctggcgatagccgaagccacgcacaacagcatgctgctgcatcgacatctgatcaacaccaactaccgcaaaaagtggctcgacgatcataaaaagatcctcgccgccttaatcaagaaagacgcgcgcgccgcgaaacaggcgatgtggcagcacctggaaaacgtcaagcaactgctgctggagttctccgatgtggacgacatcgatttcgacggctatctgtttgagtcatggccgctgtatgccactaacggatcggataattag

SEQ ID NO: 89260 - DNA, 54 bp, Glycine max
  Peptide Sequence Number=SeqID_180945
atggccgaccagcagactaccaagtccaaagccaaaggtagcaagataccttag

SEQ ID NO: 89261 - DNA, 204 bp, Glycine max
  Peptide Sequence Number=SeqID_180946
atgggtgagtgttcaatttttgaacaagacattttggcaaagaagagggaaggagaaagaacaagtataatatctatttgcaaaatttctctaaatctcaccattccttggatgttggataatatcctgattgatccaacactcactaccaccacaattacagtgaacattgctagtgttttgcatgagtttagttttaattaa

SEQ ID NO: 89262 - DNA, 1449 bp, Glycine max
  Peptide Sequence Number=SeqID_180947
cggccaacccagtcgcggtcgtattcggtcttgaagccgaacggcacggtcagcgaagcaccgaagtgcatgttgtcgttctcgccgaacggcacgtggaagtacgcggccggtaccggggcgatcatgccggcgtcgccgccgttgccaccggaatcggcgcgccgttgccgtactggccctggccgcggaacttggcgccgaagctgatggcgctgacgtcgccctggaccagggtgccgtcgagcaggcgcatggaggccggctggaaggcggcagcattggcatcggcggcggccagcgcaccggcaacgccgacggccagcagggtcagtcgggcaatggtggaagcggtttgcatcgtagttctctctccggtaagcggtgatggtgctctgagtgcgcctgcgcccgccgggtcctgggacccatcggagcgcgccggattcccctcccgacatacgacgccgaccgtcgccaccgaaagtggccgcacgctaggctattggcatgttcgtctcgctcccgtcccgcaagaaggcggccctgcgctgggccacgcccgtgctcctctggctggactggggcgccctgtccaccggcctgacccacccgctggactggtgggcgaccctgcaggacggcagcgtgctgcgcctgttcaccgccctgttcctgcacgcggactggtcacacctgctgggcaatctggtgttcctgctgatcttcagcctgcccgccgaacgggtgctgggcccgtggcgcctgctgctgctgttcctggtcggcggtgcggtgtccaatctggtggccatctacaccatgggcagcccggaccagatcatcatcggtgccagcggtgcggtgtcagcgctcatcggcgcctatctggccctgttcccgggcgcccggctgggcgtggtgatcccgctgggcctgttcctggagttcgtgcgcgccccggcctacctgctgatcggcgtctgggcggcgctgcaggtggtgttcgcccatatcggccccagcttcggcatggtggcctggtgggcgcacatcggtggcttcctgttcggcctgctgtacggcgtgtacgtgcgcgccgcgatcgcacgccgcctgcgcaagcggcacggcttctgaacccctggtggtgccggccgctggccggcgtcacgctcacccgctcgttcgtagatcagtcgagcacggctcgacgctacagaatcagggcttggccggagccggtgcgggctttgcttccggctttgcttccggctttgcttccagctttgcttccggtgcttccggtgcttccggctttgcttccggcttcgcttccggcttcgcttccggcttcgcttccggcttcgcttccggcttcgcttccggcttcggttctaccttcgcctatcaagcttatcaataccgtcgacctcgagggggggcccg

SEQ ID NO: 89263 - DNA, 539 bp, Glycine max
  Peptide Sequence Number=SeqID_180948
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccggtgtcattccgctgttatggccgcgtttggtctcattccacgcctgacactcagttccgggtaggcagttcgctccaagctgggactgtatgcacgaaccccccgttcagtccgaccgctgcgccttatccg

SEQ ID NO: 89264 - DNA, 225 bp, Glycine max
  Peptide Sequence Number=SeqID_180949
atgtcagtgaaaaacctcgtcgggcgcctaggagtacatgacaagacaagctacacactagcaagtcaatcagggtcacaatgttttgcgagaatgctccaaccatatgggatcaacatagacttaaaggagcactcaaaccttgtgacccccaaggcctacactccgaagagtccgtcaaggcctctccctcctgattcaggtccaacccagaaaatattttag

SEQ ID NO: 89265 - DNA, 64 bp, Glycine max
  Peptide Sequence Number=SeqID_180950
atgggtttaattagtcgatttattagtgatcccccgggctgcaaggaaaatattcgtccagcgc

SEQ ID NO: 89266 - DNA, 134 bp, Glycine max
  Peptide Sequence Number=SeqID_180951
atgggttccttgatcactaacaattgctttaggtactccaaacctgcagaacagattagacctgacaaaatctgcaacaactttagcatcattaatcaagcttatcgataccgtcgacctcgagggggggcccg

SEQ ID NO: 89267 - DNA, 282 bp, Glycine max
  Peptide Sequence Number=SeqID_180952
atgggatcgagtcaagcgccttcgcttaaaaaacaaaaaagaagaagaaagaagaggttctatcaagtcaaggtcaagagcctaggaaccaccagtctaaaaggattggggcaattgatgggtcagctccagcaacaagcgtttcacaaagcttacggtaaaatctgggacctagccatggcagaagtctccacagtggccattgcctccctcacccagtattatgatcagcccgttgagatgcttcacctttggggacttccagctatcacccatggttga

SEQ ID NO: 89268 - DNA, 53 bp, Glycine max
  Peptide Sequence Number=SeqID_180953
atggataagagcttgaaggtaggagaagatgagaagagggagaaggagagagg

SEQ ID NO: 89269 - DNA, 254 bp, Glycine max
  Peptide Sequence Number=SeqID_180954
atgtcgtttgtacggttgccgggtggcgctgcgcttcaccctacctacacacccggaaatcattcatctaggccagcaatcgctcactggctcaagcagcctacccgggttcagtacgggccgtaccatgtgaacccctatttggccttgctccgggtggagtttaccgtgccacggactgttaccagccgcgcggtgcgctcttaccgcaccctttcacccttacctgatcccgcttgcgcgggccatcggcg

SEQ ID NO: 89270 - DNA, 601 bp, Glycine max
  Peptide Sequence Number=SeqID_180955
ctccaccgcggtggcggccgctctagaactagtggatcccccgggctgcaggaattcgatcccataccaaaatagtcacgcagtcccatggaggtacacacctccgaacaaagaagaagaagaagccaccgacatcagttcgttgtcggccaaggtaaccaatatcacggggctgagcggtgtgacccgtagcggtcgcgtatttgcaccccccgacctactaattcagcccacgaacgttaaggggaaggcaacggtagtggaagaacaagatgataaaatgcccctcacttcgaatgaggatactccggtgaaaggtcttccggagaaaagggatgggttatggcaagaaggagctcaacaaaaccccggccacgatctcgctgttggaattactcatgagctcggaacctcatcgggctctgctagtaaagggctcatcaataatatcactgccaacaactatctcgccttcgccgaagaagaaatccctgccaagggaagagggcataacaaggctttgcacatattagtcaagtgtatggaccatgttgtggccaaacgtgatgcccaaaagcactttggagaaattaccgtttaa

SEQ ID NO: 89271 - DNA, 888 bp, Glycine max
  Peptide Sequence Number=SeqID_180956
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttccttggctgtgtcggattccccttgtccgtaccagttctgagttgactgttcgacgcccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgagaggctgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 89272 - DNA, 186 bp, Glycine max
  Peptide Sequence Number=SeqID_180957
atgagagctcctatgttcatgtccatgcgagagactaggccaaagattagcctagctttgtccactgtcaggtcagaggtgtgcgatgtgggggccaggttggagtatgagagaacactccatacctgggctatcgaattcctgcagcccgggggatccactagttctagagcggccgccaccgcg

SEQ ID NO: 89273 - DNA, 228 bp, Glycine max
  Peptide Sequence Number=SeqID_180958
atgcagactctccaactattctgcacccgagtaggaatcaactcctccttctcatttttgatcatggtgagaccggttttcttcgggactgtcgcaacgttcccttcacgggcgagcgagggcgaggctcacgggtgcgctttccaaaggaggaaagatgcgcggagtcgccaccaacgtttatttgtggaaaacgtcagaaaaaccgaaggaaaccggtcaaaatga

SEQ ID NO: 89274 - DNA, 522 bp, Glycine max
  Peptide Sequence Number=SeqID_180959
gtatatgggattaagatggtcatagaccagtcacttctctttgaactcacccatttatccagtgatggtgtaccgtttgaaggtacacttgatgatgagtggaagtttgatttttctatttttgatgcctgccagttggtttgcaccaaccaagcagatatgaccggaaggctacttgccggatcattggcatttgaatgtcgcatcatgcactatttgattgtgcgtatcctacttcctagatcatctaaccttgcacagatttctgaggaagagttgataattatgtgggttttcttaatcggtcgtcaaatcgactgggcccatcttgttagatatcgcatgcataaggcattgcgatcaaatgctcctcttccatatccccatctgatcaccttgtttttgcatcattttaatgtccctcttgactctgatccctttgttaaagtcaagagatctttctctatcggtgcaaatgtggtttcctcttttggataccacaaagagagggatggttcttgg

SEQ ID NO: 89275 - DNA, 177 bp, Glycine max
  Peptide Sequence Number=SeqID_180960
atggctacagccaggtgggccctcaagcatcctgtttatggcattgtgacactacggttgggaatttacccagacagacccaacgtttccaagacgacgttcctaaatgaaaaactctacacggttccggaatttcaacaaacactattgacaacaacgaaacaagtaccgacgtaa

SEQ ID NO: 89276 - DNA, 495 bp, Glycine max
  Peptide Sequence Number=SeqID_180961
atgtcggtggctccttccttccttttgcttggaggtgcgtacctccacggaactgtgtggctgtttttgtatggaaatggaataggtctaactactttggggtgtcggggagtttggggagctgcatccctagtgaaatgtatcaccaaaggtttaggctttctaagaccttcctcatctgcggattgcatgcatatatgctgctcttcacccccctcatcgctgacttccagccggccttggtctatcattttaataggtctcctactgctaaacatgcttccatgttatgtgaggtttggacctgcgcggcctacccgactagacgacattaacagttccccctccatgattggcaagcgggttgcgttagggttataccactttgggaaaagaggctgctggatccttcagggagatatcacagccatctggttggcgaagagggatggcaagaggtcttcgtacatcattgggatcagggtgaattcttga

SEQ ID NO: 89277 - DNA, 450 bp, Glycine max
  Peptide Sequence Number=SeqID_180962
atggcagctatacaaataaccagccttgtctctatgacgtgttgggcctgtttaagtctgcctctggtcatgggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 89278 - DNA, 1065 bp, Glycine max
  Peptide Sequence Number=SeqID_180963
atgccctcacctttagaggactacacgtcctctccttcagaggactacacatcctcgcccttaccttccgaggactacacgtcctctccttcagagggctacatgccctcaccttcagaggactacatgctctcgcctttagaggactatatgtcctcgcaatcagagggctacatgccctcaccttcagaggactacacgtcctctccttcagaggactacacgtcctcgccatcagaaggctgcatgcccttaccttcagagggctacacgccctcgccatcagaggaatgcatggggctgcacgccctcgccttcgtaaggctacacgccgtcaccatcagaggactacatgtcctctccttccgagggttgcacgccctcgccttcagagggttacacgccctcgccatcagaggactacacgtcctcgccttcagagggctacacgccctcgccattagaggactacatgtccttgccttcaaagggctacacgccctcacctttagaggaatacacgtcctcacctttagagggctacccgcccccgccttcagagggctacacatcctcgccatcagaggactaggcgtcctcgcctatagagggctgcacgcccttgccttcagagggctacatgccctctcctttagatggctgcttgtcgtttccttcagagggctacacgccctcgcctttagaggacttcgcgtccttgccttcagaaggctacacgccctcacctgtagagggctgcatgcctttaccttcagaggacttgacattcttgcctttcgaggactagacgttctagccttcagagggctacacgctctcgccttcagaggactacacgtcctcaccttcagagggctgcacgcccttgcctttagaggactacacgtcctcaccttcagagggctgcacgccctcgccttcaaagggagacacatcctcaacttcagagtgttgcatgccctcgtctttagagggctatgtgtcctcactttctgtgggctccatatccacaccttaagagaatttaaggtcctctgcccttaa

SEQ ID NO: 89279 - DNA, 916 bp, Glycine max
  Peptide Sequence Number=SeqID_180964
atggcagagccatcgaagaagagaaagggatcatcctccaccgccgctgctgcccatcgccaccacagaccatctgaagcatccacagcacctattcatccatctttatcatccacattgttttcttccgatgatcagcgtctacggtacctctctcaattttcttctaggatcatcttagaacctaagttcctagatgtagagttctttaatgatgaaacgtttgattgctatcaagtgtttcaaaattctggccttgttgatttcatgtcattaaaactgccacattatcctgaacttgtaaaggtcttctactgcaatttgaaaattcaggatggcattatttcctctgaggtgcatggacaccattgtgatgactggaaatttgattattctagtcatgatgctcgccgaatggtctgcaatgaccaggctgaaatgaccgcacaagcctctaaggaggatttgattctgatgtgggcttttctcaccggtcatcaaatcgactgggcccatttggttcggtaccaaatgcataaggcattacgggccaatgcacctctaccttatccacagttgataactttgtttctgcgtcattttcaaatttcgcttgatgatgagccatttattcaagtcaagcgttcctttgcaattggtgttggtgctgtgacttcctttggttaccgtaaggatcggaatggtcaatggctaaagaaagacgcactccctcctcaagatgagcgtactccttcacctcctcctcagcatgaagattcagcactcctgaatgaagtcctttccaaattacgaggtcttcgttcttatgttggtgaacgttttgactcattggatacacgctttgccggcatggatatttgcctcacacaagttgaagaagatgtctccttcatcc

SEQ ID NO: 89280 - DNA, 792 bp, Glycine max
  Peptide Sequence Number=SeqID_180965
atggtaacaagaagtacctccaaattaattaatgttattaatgaagatagtgaccaaaactcagataacataactgagttaggatcagtgtcagaaaagaatataaatccaattaattccaaacattggaaaacaccttccaaattatattatcaacgtccagctgcctttgaccttctattagaagaaagaggagaaaacaattttaagatttttagtgcaaacaacatctatgaatggaacatagatgcacaaatggagtataatatcacgaatacactccaacatatgaccatggtagctatggcttaccaaacctcccacgaatgttcaaaagaaaccattatagatatcttagtggcaggattttctggacaactaaaaggatgcgcagttaagacggatctcaacgaaaaagttattactaatgacgatgataaagagattcctgacgctgtcaataccttaatttttacaatagctcaacattttattggagacccatccttatggaaagataggtctgcagaattattatcaaaccttaagtgtagaaccttagcagattttaggtggtatagagatactttcctaactagggtttacaccagagaagatagtcaacaaccattctggaaagaaaaatttttagctggtcttcccagatcattaggagacaaggttagagataaaattcgtagtcaatctgctaatggagacattccatatgaaaacttaagctatggtcagttgatttcctatgtccaaaaggtagccttaaaaatctgctaa

SEQ ID NO: 89281 - DNA, 126 bp, Glycine max
  Peptide Sequence Number=SeqID_180966
atgtggaaattcttcatcgttcttcgtcgttcttcaccgttcttcatccgttcttcattcgttcttcgttcttcaacggtgcgacctttctttggtccttgtgaggtgcttggcacccatcattag

SEQ ID NO: 89282 - DNA, 258 bp, Glycine max
  Peptide Sequence Number=SeqID_180967
atggatacctcagtgccctacactggggcaataagaggcaccgtgcataagcctcaagcgaacctaggggcagatcagaagttctcacttgagaaaacccctgaggttcacacttgcacatttgagaagaaaactcatccgaccaggagctcatggaaaatgcccaaagacaattgtgatagtagggtacacctgatgttgatcgcccatgaaaatatccttaggattcctttcaaatccaacgatagccttcgctag

SEQ ID NO: 89283 - DNA, 387 bp, Glycine max
  Peptide Sequence Number=SeqID_180968
atgaggcatgtaaagcatgaaggacatcgcacaaagtgtgactatctgatgtggcaatggggtgtaataattggacccaaccttggcccatgggctcagaaatctaccctgaggttcatgagaaccctagggccttctttcgcagctctagcccaatcctcttggagcctcttgctcatggatctagtgactggtcccttcctagggaggattgcatcaggatacattgctcttcagatgagaacagcgtggaggacgaaatggatggtggaattggagtatcctgagacccaaagctctgttggcttctactcgaagaaccctttcgcttcttcgatggttctaccatttgagggattttttggaagttttgatcggtggaaataa

SEQ ID NO: 89284 - DNA, 627 bp, Glycine max
  Peptide Sequence Number=SeqID_180969
atgaagacagtaaagataactgtggatggtacaaatgatcaaggaactcctaagtggattgaagtaaagagccatgttcaaagcggaggctatgagtgtggctattatgtgacgcattggatgtggaacatcagcctaaatgaagaacttcatgactattatgaaggaaggcataggtcacatcttagacctcactcccataggagagaaaaggaaagaaagcctcaagaggctaacattaacctcccatacttccattggaaggacaatgtagaggctaacttagattggaaaataagggtagagcaacaacttaaaaggaagtctacttcaaaatcttatggctctcactcttatccaaagaaagaccaaggtcaaggcatcttaagggtgacaccttctaagcccaaagatgataaggggaagacaatagaaaagcaaccccttaaggctagtatgcaagagaagactagctccatgaagtgctttaaatatcttggaaaaggacacattacttctcaatgccccaccaagaaaaccatgattatgaggggccaagacatttatagtagccaagatgaggctactatttcaccttcctctagtgaaagtgaagaagcaaaatag

SEQ ID NO: 89285 - DNA, 273 bp, Glycine max
  Peptide Sequence Number=SeqID_180970
atgaatatcaagagtcatgtttttatagcttgtggggtaggtagtaaatcaggtaaagtaaacaaaaaggaagatgatccttttcgcaaacccaaaccagggatgtggcatcttatggagcaacacttcaactctggcattgccattgatatggataaatccttttttgttggtgatgcagccgggagagaatcagatcacagtgtcgctgatattaaatttgcagaggccattggtttaaaattttatgtcccagaagagtacttcgcttga

SEQ ID NO: 89286 - DNA, 1380 bp, Glycine max
  Peptide Sequence Number=SeqID_180971
atggctcggcgatcttacaagacggagttggggtgcatagcgtgcgaggagctgggcgagctcggagcggggaagccccactggctggtggagacccctcagctcctctgcgccatcgacactcactccctcatcctcgccaaccgctccaccatcctcctcctctcctggtcctccgactcctccgccgcaccgccgcccctgaagattcgacccgacctctcgcccatcgacgccgagtccatctccgccctcgagtggctcgccttccgtgatcaccgcgtcatcgtcgccggcacctcctccggcaacgtcctcttctattccctccgcggagaactgattcaccgccagatgatttatccaagtcgagttttaaagttaagagttcgtggaacaaagaaagatttgattcaagatacctcctcagaagagttttgtctcattatgtcaggtgtaattgcccattttgatggctctgatattcagaatatgctgcagaaatggtttgaagaatcacactctcgattttgggatcaaaacccaaagagccacgattcagaggattttggaaatactgatgtaaaaataccttaccagttgtggaatattggcaagtatggtacttgtgctgaagcagcaattactggcataatgccacctccacttatggaacaacaacagtcaagtcaacgttattattgtgcagtggctgttggagaggatgctgtaatttcggcatacagactttctgagaacaaaggcaggtctttagtgggagctatcttgtctaaagttgtacctgcaacgttttccacaataagttctttttctaagttgatatggcgaagtgaacagtcgtctccaaagaaatcagatcagaagcctcagccatttgctcgagcttcacctctgacatgtttaaaggatcaccctaggaaaggtgagaagcttaccttatcaccgagtggtacgttggctgctataacagattcacttggtcgcatattgctgcttgatactcaagcacttgtggtggtgcgcttatggaagggatatagggatgccagctgtctgttcatggagatgttggtgaacaaagatattgcatcatcaagttcttcttattctgaaccattgaagagtgattactgcttgtgtttggctattcatgcacctagaaaaggcattattgagatctggcaaatgagaactggaccacgtcttagaacgatttcatgtgcaaaaggtagtaaaatgttacaacccagctacaggtttggagcatcaatgtcctctccttatgtccctctcgaagttttcttgttaaatggggactcaggtcagatatcagtcttaaatagaaccttggattcttga

SEQ ID NO: 89287 - DNA, 249 bp, Glycine max
  Peptide Sequence Number=SeqID_180972
atggcgagaatggagagggaggagtggtccgagagatccgcggcgaggggatctaacttctcaaagaagcctgttgagaaagcttctcaaagaagccacgaggaagcttctagaggaagcctcttaatgaagcttctagagaaagctacatgcagctgcctcggtaaaaacgctgcccagccttcattaaccgttggatcttctcgaaatttggtcttaaacttcacaagacaattgtccatgatctga

SEQ ID NO: 89288 - DNA, 615 bp, Glycine max
  Peptide Sequence Number=SeqID_180973
atgctccgaatccccaacttcatcgctgtcaacgtccgtcaccgtctccgtaacttccctaatcctattcctttccttctctccgtttccgtcgctgcatctctccctccgttacggaaccgaagcccgtcacagatggcggctcgcgaatcgatgatggcggattacgcgaaatcggggaagtcgtcgtgcagggcgtgttcccaaaagatcgaagcgaaggcattgaggctggcttcggtctccaaaggaaatggtccgtacgacatcgtcaagtggcaccacctccgttgcttccctctttcctctcactctcactcctctcctgagagcatcagaggcttttcctccttgaagagtagtgaccaggaagctctgaagaagttatttgctgaaaataacaagtctgaagagaaggttaatgaagcagtggaagatgtacgaaatgagctgcaagagactggagagcgtggttcaaagagattaaggataattattctttccaaggctgtccgatcacttgaagcttttaagagtagtgaccaggaagctctgaagaagttatttgctgaaaataacaagtctgaagagaaggtgataacccagttagattga

SEQ ID NO: 89289 - DNA, 1240 bp, Glycine max
  Peptide Sequence Number=SeqID_180974
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaagtgtccatagaagccattgcatcactcacccaatactacgaccagcctttgagatgcttcacattcggagacttccaattagtaccaaccattgaagaatttgaagaaattctaggatgtcctctcgggggaagaaaaccatatctttcctccggatgtctcccctccttgagcagaaattgcaactgtggtcaaggattcagcaagaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagctgtcttggcagatctatttgacacatttgaccgaaggaagggaaagaatgagtccttttctcatgtggaagatacccaaacattcgctggtaggaacgagggggatctcggcgcacaaaattccaagactatacaaagaatccataaggcatgggaaaccccgttaaggaaagatcaagagcttagaggcattcgtaatggcatcattggtgggtaccacgaatggctgaaagttcatatacgaggtttagattggctcgccaagttaaaagtcgtcagcgaagagaattttgaagcaccggaagaggacgaagaagtccaagctctcaaaagcgagttaggaaaggcaaaacttgccaatgagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaagggaagaaagggaccagtcgcgagcacatagcatggttttgaaagaggagttagttgcctgttcaaggtccaaaagaagcttgtctcagcgtttgtgcgagacggagaccaacatgctagctatcatcgccaagtacatcaagcttatcgataccgtcgacctcgagggggggcccg

SEQ ID NO: 89290 - DNA, 231 bp, Glycine max
  Peptide Sequence Number=SeqID_180975
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctcaaaaagagctctgaaatctgaacccactaatccaagatcaattccaagattctccactaagtatgcttag

SEQ ID NO: 89291 - DNA, 909 bp, Glycine max
  Peptide Sequence Number=SeqID_180976
atggggacaaatcaaaacggcaaaaggttttatcaagtcaaggttaaaagtctagatgtcactagcctcaaggaattgggacgattgatgggacccctccaaaggaaagccttccgcaaagtctacgggaagattctagatttgaccgcagcggaggtatttacggaagcccctcgtatccctcgcccaatactatggccaatcgttgaggtgtttcacgtttggggacttccaaatgggggcagcgcgatcaattggtttcctcgttggaaggaaggcaaggaaggagttcttttctcgtgtggggactaccctaatgttccattgatagggactagggggtgtattaattataatcctgcactcgccataagacagctagggtaccccatgaggggagcgccaacggaagggagtctctcacctttccttgtgaaagatttaggcgcgcaaggtctcaaggttatacaaagaatccacaaggcgtggaggagtccgttgaggaaagacaaggagcttaggggcatccgtaatggcgtcatcagaggttatcatggatggctaagaattcacacgcgagggttagattggctctccaagttgaaagttatcgatgaggagaacttcgaagctccgaaggaagatgaagaagtacgagctctaaaattggagctagggaaggcaagactcgccaaggagaagttcaaatcagctgctacacacatccggaaagagtgcaccgagttacaagaggaaaacgcggccactgcaaaagcccttgaacaagaaaccaaaagggcccgcaaggaggaatatggccaagagaaattccgaggagaattgtggggtagcaacaatgagctcaagctccaaaagaggaaagagatcggtcacgggtgcatggcatga

SEQ ID NO: 89292 - DNA, 303 bp, Glycine max
  Peptide Sequence Number=SeqID_180977
atgcctaatcaaccacaaaggcctctccaaaatcacccacaaaatccattcctgcacatccctgaccgagtggaaatcccaaccccaatgcaaacaccaacccaaggaggaactttccagaaagaaaacccgcggagttcaccccgataccaatgtcgtatgccaacctgctaccatctttccttagcaaccaaatggatgtggctcggtggtgaacacagtggaagaatggaagtcttgagggctgaagcagatagaggatgtgtcgacttccaggcggttcatattggaaacattgcgtga

SEQ ID NO: 89293 - DNA, 282 bp, Glycine max
  Peptide Sequence Number=SeqID_180978
atgatgactctttgcaaatctagaagaaggtatcaaagggaaataattgagatttctgtgggaaatctggacacttccagaaggattgcccaaagcgtaagtcttggtttggaaagaaagtgtacgactcatgtttctaatactatgcaaggattccttaccatccaaaccataagcccaaatgagaagttcgtctttatggagaataaagtgaaagctcccgtggaagcattcaggacttatcgtttaaaacttgacactggacatcatttagatttatag

SEQ ID NO: 89294 - DNA, 150 bp, Glycine max
  Peptide Sequence Number=SeqID_180979
atgaagcttgcttctacagatttgaggtcaaatcctcttcaaaggggaggggatgatgcaatcctccctaggaagggaccagtcactagagccatgagcaagaggctccaagaggattgggctagagctgctgaagaggccctagggtag

SEQ ID NO: 89295 - DNA, 317 bp, Glycine max
  Peptide Sequence Number=SeqID_180980
ggtggacccttgggtactagtacctatcaccttaagagggttgcatgccctcaccttcggagggctgcacgtcctcgcctttagagggctccacgtcatcgccttaagatggctgcacgccttcgccttcgccttcagagggctacatgccctcgcctttagaggactacacacccttcctttcaaaggacaacatgtcctcgcattcagagggctacaagcccttcgccttcagagggctacacgccctcgccttcagaggactacacgccctcgccttcagaggactacacgtcctcaccttcagaggagtacac

SEQ ID NO: 89296 - DNA, 801 bp, Glycine max
  Peptide Sequence Number=SeqID_180981
atggctcaagtctttaatttcagttcaggtccggcaatgttaccggcagacgtgcttaaacaggctcaacaggaactttgtgactggaacggtctggggacgtcggtgatggaaatcagccaccggggtaaagagtttattcaggtggcggaagaggcagaaaaggattttcgcgatctgctgaatattccctcgaactacaaagtattgttctgccatggcggcggacgcggccagtttgctggcgtaccgctgaacatcctgggtgataaaacgacggcagactacgttgatgcgggctactgggcggccagtgcggtgaaagaagcgcacaagtactgcacgccgaacgttatcgacgccaaagtgaccgttgacggtctgcgcgccgtgaagcccatgagcgaatggcagctttctgataacgcagcctatctccactactgcccgaacgaaactatcgacgggattgccatcgacgagacgccaaacttcgccagcgatgttgtggttgccgccgacttctcctccaccattctttctgccccgattgatgtcagccgatacggcgttatctatgcaggcgcacagaaaaatatcggtcctgcaggcctgacaatcgtcattgtacgtgaagatctgctggggaaagcccatacgtcttgcccgtcaattctcgactacaccgtgctgaacgataacgactccatgttcaacacgccaccgacgtttgcctggtacctttcgggcctggtcttcaaatggctgaagcaaaacggcggtgtggcgcagatggacaag

SEQ ID NO: 89297 - DNA, 640 bp, Glycine max
  Peptide Sequence Number=SeqID_180982
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgcatgggatactgctctggcgcctgcaaaaagtattccaatgaacgcactcatgctatatatgtcgggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 89298 - DNA, 106 bp, Glycine max
  Peptide Sequence Number=SeqID_180983
atgacaggagatgcatcaaagtttacacatatatctctcaagaaaagcaggcatgtaacttatggtgacaacaacaaaggtagaatccttggagttggtaaaatag

SEQ ID NO: 89299 - DNA, 201 bp, Glycine max
  Peptide Sequence Number=SeqID_180984
atgtgctttccggatttagaagtagcagcaactccagaagaagaacctcgatcttccaaggcatcttctagttttcctattgcaggtcattctcatatagaacctgttgaagatccaatcatggctgaagagccaagaagagtaaccctggaggattattcaagttctactgtgccacaatttttcaccagcattgcatag

SEQ ID NO: 89300 - DNA, 499 bp, Glycine max
  Peptide Sequence Number=SeqID_180985
gtctaattaaagatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttctgcctttcggtttaccggtgtcattccgctgttatggccgcgtttgtctcattccacgcctgacactcagttccgg

SEQ ID NO: 89301 - DNA, 1192 bp, Glycine max
  Peptide Sequence Number=SeqID_180986
gccaaggagaagttcaagttggccgctacacacattcggaaggagtgtgccgggttacgggaagagaatgcaattaccgcaagagcccttgaacaagagaccaagagggctcgcaaggaagagtatggccggaataaatttcgcggagctctatggggtagcaatagtgaactcaagctgcgaagggaagagagggaccagtcgcgagcacatagcatggttctgaaagaggagttagttgcttgttcaaggtccaaaagaagcttgtctcagcgtttatgcgagacggagaccaacatgctagctatcatcgccaagtaccaagaagagttaggtctagccacggcccacgaacatagaatcgcggacgagtatgctcaagtatacgcggaaaaagaggctagaggaagggtgatcgactctttacaccaagaggcaatcatatggatggatcggtttgctcttaccttgaacgggagtcaagaacttccccgcttgttagccaatgccaaggcaatggcagacacctactccgcccccgaagagattcatgggcttctcggctattgtcagcatatgatagactttaatggcccacggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaagacggggaagggacacactggggcacgatggcagccctcacctgggatacaaccgagcggcttacccttatggattgccgcccaactattcaccacccgtcttgcaagaagatgcgggccacattgcttctcccgtccatgaaagagagcctcctcagcagcccgacgaagtccacaaagaccctcaagattatgctcggagggatgtcgagttctatcccccgatccccgaagggccggcaccaggcacgttgcctcaacccaacatcgcagtaccaccaatagttctgtccatggaagggccgcccccagcaactgaagaaaggaggaagctcgatctccttgaggaaagattgagggccgtagaaggatttggggactatccgttcgcagacatgacggatctttgcttagtacccgatgttgttatccctcgaa

SEQ ID NO: 89302 - DNA, 363 bp, Glycine max
  Peptide Sequence Number=SeqID_180987
atgggccaagatccctttgttttgctgagaatcgcgatgatgttgccattggagagaagaaaatgggataaggaattaaccagttttgatgaaggcaacactgatgttgccattatgaaagagttttatgctaacctctatgatcccgaggataaatcacctaagcaggtgagggtgagaggccatttggtgaagtttgatgtagacactctcaacactttcttgaagacccctgtaatcatcgaggagggggagacattatcagcttactctaggtttgcactcctgaggcttgaccctcaggaattggcagctaagctctgcatcccagggaggggatttgagctgaatgctgacagttag

SEQ ID NO: 89303 - DNA, 651 bp, Glycine max
  Peptide Sequence Number=SeqID_180988
atgaggggccaagacatttatagtagccaagatgaggctactacttcaccttcctctagtgaaagtgaagaagcaaaggggggagaatctagtgaagaaatctatccccaagaagaaggacaacctttaatggttaaggaggagtgtaaggaggtaagtgtctcctccaagaggttagctaagaaggaaagacattttgaaataaagacaaatattaaagaaatttcccttcttagaaaacctccacattttctcctttgtaaaaagacacttgttagcattgccacatctcttaggtttgagtttattcctcaagtaaaggagttgttggatgagggtttggttcgcaagagattaaatccttgtgctttgttggtgcccaaaataggtattattaggcaccaaatccctaaaataggtggtgtgataactgtcttgggtggtgcaacactcttttgtaaaatcactcgtgcacccaacatcttcatgatttgtgtacatagggactcattaggtaggaataatcaacatgaaaatacagaaaaaggggttcccatgaacccaaagagaataaaggtcattcctgagtggcccgctccaccaagtgtgttgaggaaaaaagcccagcgtttcaagaacctcgggatttga

SEQ ID NO: 89304 - DNA, 543 bp, Glycine max
  Peptide Sequence Number=SeqID_180989
atgatggtggcccgggtaatgttggggtatggctatgagcccgaaatgggtttaggcaagaacaacggcggcagaaccagcctggtaagcaccagaggaaaccgcgggaagtttggattaggctataaacccatgcaagcggacataaggaaaagtgtcgcgaaaaggaagagcagaggccaaagttcgcagttgggtcaacaagtcgaaggggtcctgccctgctacatcagtaggagctttataggtgcgggtctaggacacgaaggccaagtcatcgcgatatgcgaggatgactctccgagtaggtcggatttggtactatcatgccctcctggtttccgactaggaaattggcgagtggaggagcgcccgggcatttatgcgacaagcataatatccgacgacgagtccctcgaaggtactaatacctgggacccgaccaccgatttcaagcaagaagccggtcagatggagagtgaagaggacgaggatgtgggacttcccctggagttggagaagatagtcgctcaagaggactga

SEQ ID NO: 89305 - DNA, 361 bp, Glycine max
  Peptide Sequence Number=SeqID_180990
catatacggaggagcacatgagtctggttgttgtataccccttgaagatactgcaaaggaggtgaattatatgggaaatcagcatggaccagggttcaatacaggtggatttgtaggttaccagcaaggtgcccattttaatcagaatcaagggaagtggaggaccaccaagttgaaggagactttggctcaattcatgcaagtttcgatgtccaatcacaagagcacagagtttgctataaagaacctggagattcaagtaagacaactagccaagcatatagctgaaaattcttttggaggttttggggccaatactgaaaaaaatcccaaagaagaatgcaaggctatcataacttga

SEQ ID NO: 89306 - DNA, 390 bp, Glycine max
  Peptide Sequence Number=SeqID_180991
atgaccggccctctcgatgagtcgatctcttgctttctcataaggttgaacccttgggtacacgtcctcaccttcagaggactacatgtcctcactttcagaggaatacacatcctcaccttcaaaggactacacgtcctcaccttcagaggactgcatgtcctcactttcagagggctgcacgccctcgccttcagaggactagacgtcctcgccgtcaaaggactagacgtcctcgccttcagaggactagacgtcctcaccttcagaggactacacgtcctccacttcagaggactacacgtcctcgcctacagagggctacgcgctctcactttcagtgggctccacatctgcgccttaagagaatttaaggtcctctgcccttaa

SEQ ID NO: 89307 - DNA, 399 bp, Glycine max
  Peptide Sequence Number=SeqID_180992
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcacccactggcagcagccactggtattgatttagagagttag

SEQ ID NO: 89308 - DNA, 152 bp, Glycine max
  Peptide Sequence Number=SeqID_180993
ataactctttgaaagatgaagatgcaggatttcaggataaggattctgctcctaaaaatgaaaccaaagttgaagaactagaacaaagcaaagaaatctcaaccacacctcccaaggacctccctagagaatggagaactcaaaaagtgtaa

SEQ ID NO: 89309 - DNA, 603 bp, Glycine max
  Peptide Sequence Number=SeqID_180994
atgttcatgatcaataaacagggccatcaaaacgaagaaagcaatttagggttggagatgatgattttaaagagaggtgaggactatattgaggttctttgtggcgctacaaacaaaaaatatggagattatgttgggaggctaaaaattaataacgaaggtcaatatttcatcacttgtgagtgttgccctgagtgtcccttggtgaatgtcactctagaagcatttgagaaacatgctttaagggaagggagcggaaggtggaagagaaacatctgggttcattgtgaagacgaagacaaagttccactctggaagacacctctgataaagtattatacacaccaggcaaatgtggctaaccggaaagactctgcaatgaggaaacaaaactttcacagggatgagttcctacgttgcacgagatgcgggaaggagcgcaggttccatctcaagagcagaccagacattaagaactaccatgatgcttcaaacaacaaatgctggaattgttctctttggccttatcaaaattggtacttagtcttgcaaaacacattatatgctggaaaaagatactggggactcacgatgtgtcaataa

SEQ ID NO: 89310 - DNA, 605 bp, Glycine max
  Peptide Sequence Number=SeqID_180995
atggaccatatcgtagccaaggtgctcatcgataatggttccagtttaaacgtgatgcctaagagcactttggagaagttaccattcaatgcttcccacttaaaaccaagttcaatggtggttcgggccttcgacggcactcgccgagaggacgaggaagatatcttggtaagctgcccatcctccatgccttatgtggaagccgcagaagaatcgttagaaactgctttccagtcttttgaggtggtcagcatttcctccgtggactccctctttgggcagccttgtctgtctgatgcagcggtaatgatggcccgagttatgttggggaacggttatgaacccgggatgggtttaggcaaaaacaacggcggcataactagcctgataaatacccaaggaaatcgtgggaatgaaggaagcccgccctgccacataagtagaagctttataagtgcgggtctgggagacgaaggtcaagtgttcgcgatatgtgaagatgatgttccaagtacttcggatttggtccgaccatgccctcctgatttccagctgggaaattggcgagtggaggaacgccccggcatttacgcaacaagcataat

SEQ ID NO: 89311 - DNA, 282 bp, Glycine max
  Peptide Sequence Number=SeqID_180996
atgagtacgaccgggcgtgggaggcactcggtcctccggattttcaagggccgccgggggcgcaccggacaccacgcgacgtgcggtgctcttccagccgctggaccctacctccggctgagcccccctccaggatctgcaccgacgaccgctccgcccgggctcgcgccctgggttttgcagcgaccgccgcgccctcctactcatcggggcttggtccttgccccgacggccgggtataggtcgcgcgctttagcgccatccattttcggggctagttga

SEQ ID NO: 89312 - DNA, 360 bp, Glycine max
  Peptide Sequence Number=SeqID_180997
atggaggccataaaagagcaaatggccacaatgataaaggccatgatgagcatgaagaagataatggaagccaatgataaatggccactattaagcgctgtcgctaaggtgaacccaatgctcccatctggcctcaagcaaatgaatcgtccaacctcaaatatgctgacttcgagccttggctcggatatgccactgaagggcaagcagttggtggtatacccttttgaaaacactttggagagccctcagtttcccccacaaccacaaccattgcatttttgcggtgggaagagcccctcctgctatggccgaaaagggaaagacggatcatctaaaggaaaggctcagggccattga

SEQ ID NO: 89313 - DNA, 415 bp, Glycine max
  Peptide Sequence Number=SeqID_180998
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacagactataaagataccaggcgtttcccctgcggctcctcgtgcgctctcctgttcctgcctttcggttaacggtgtcattccgct

SEQ ID NO: 89314 - DNA, 438 bp, Glycine max
  Peptide Sequence Number=SeqID_180999
atgattgatacctcaaagccttacactggggcaatgaggggcaccgtgcatgagcctcaagtgaacataggggtcgatcaaaaaggactacacgtcctcgccaacagagggctgcacgccctcaccttaagaggactgtgtgtcctcactttcagaggactgcatgtcctcaccttcagagggctacacgccctcgccatcagaggactgcgtcctcaccttcagagggctacacatcctcgccattcagaggactccgtcctcaccttcagagggactacacgccctcgccatcagaggactacacgtcctcgccttcagagggtacacgtcctcaccatcagagggctgcacgccctcacctccagaggactacacgtcctcgccttgagagggctacccgacctcgccttgggtactagtaagactcaacgttga

SEQ ID NO: 89315 - DNA, 414 bp, Glycine max
  Peptide Sequence Number=SeqID_181000
atgatcggccctctcgatgagtcaatctcttgctttcttataagggtggacccttgggtacatgcccttgccttcagaggactacacatcctcaccttcagaggactgcatgtcctcactttcagaggactacacgtcctcacctttagaggactacatgtcctcactttcaaaggactacacgtcctcaccttcagaggactgcatgtcctcactttcagaggactacacgtcctcaccttcagaggagtacacgtcctcaccttcagaggactagacgtcctcgccttcagaggactacacgtcctccactttagaggactacacgtcctcgccttcagagggctacgcgctctcgccttcagtgggctccatatccgcaccttaagagaatttaaggtcctctacccttaa

SEQ ID NO: 89316 - DNA, 290 bp, Glycine max
  Peptide Sequence Number=SeqID_181001
atggattttatgggggagacctttgtggttgagtggacaatctttgttggatgggcgccggattgggaggagtttcgatgttggctgaataattgcactaatgcggggaatatggctgaagttatggcatgggcgtctccctccttcttcttagctccacccattttggacctcctattgcttgtactcgttgaaacgaacactggtaatgtatctaccatcatggttatcatctccctctccatcatgggaggtgctacttgggctgccaaatccctccacctttacgc

SEQ ID NO: 89317 - DNA, 174 bp, Glycine max
  Peptide Sequence Number=SeqID_181002
caaaataggggagaagcttgccacctcgctcgcccaggcgagctcagctcgcccaggcgagctcagctcgcccaagcgagcaaggttgcttcctccagaagcaacagccttctggaggaaggatctggaaggcccaagtgggccagattgctattggcaccccatttttactaa

SEQ ID NO: 89318 - DNA, 213 bp, Glycine max
  Peptide Sequence Number=SeqID_181003
atgttgggtcccttagtgtctaacaagggtcttgaggttgatatggccaagattgatgaggttcatccaggacttcaacaaagttgcattggccttgtccaacctcttctagaaggatgtggagtttgtctttcatcaaccatgtcaagtggaggtggccttctaggagctgaaaaagaggcttaccacaactctcataattcaagcacctga

SEQ ID NO: 89319 - DNA, 759 bp, Glycine max
  Peptide Sequence Number=SeqID_181004
atggtcattgaacaatcccttttccataacttaacccaattgtccagtgacggtgtaccatttgaaggtacaatgaatgacgattggaaatttgatttctctgcatatgatgcccgccagttggtttgcaccaaccatgcggatatgaatggacgcctttttgctggttcattggcttttgaaagccgcatccttcattatctcattgtgcgtattttgcttccacgatcttccaaccttgcccaggtttctgaggaagatcttgttatcatgtgggcctttcataccgagtgtcaacttgactgggcacacttagtcagatatcgcatgcataaggcattgcgattaaatgctccattgccatatccacaccttgtcactctctttcttcgccattttcaaattcctcttgattctgaaccttatgttccaatcaagagatcttttttaattggtgctgctgtgattgcctcctttggttaccgcaaagagcatgatggctcttgggtcaaaaagggtactcaacccgctgatgatgaaggcaacctaccagttgaagataattcctctcttcttcgaaggcttttggacaagttcgatggtcttcaaacttttgttggtgacaagtttgataccatggaattgcaagtcgacatgcggttcgatgccatggattcaaggatcaccaaggttgaagaagatgtctccttcatccgtacttgctttgatccaccaccaccgcctccatcatcatcttag

SEQ ID NO: 89320 - DNA, 351 bp, Glycine max
  Peptide Sequence Number=SeqID_181005
atggcgactagtaaatatttgactgctcctggggctttcgacagtagtcccagtgtgtccattcaccacatggcgaagggccaaagggagctcaagctatggatattgtcaagaggggtgcatggaatgcctatgaattgtgaagtcgaggatgtctaccctgagtgtcagcaaaaagtagtcggtgcgcaccactttggttgcaagggagcttccttcggtttgaaggtcgcaaatcccttcatgaagttctctcgtgacatagtctgccttgtctatgctgagagtttggagggtctcctagatgatagtcttgaggtgcctagtgttttttggtgctggccagcttag

SEQ ID NO: 89321 - DNA, 96 bp, Glycine max
  Peptide Sequence Number=SeqID_181006
atggaagtttcgccaatgcccggaaatgtcatcatggatagcatgacagtccatgggctttacaccaaacaagagacagtgactagccaaagctga

SEQ ID NO: 89322 - DNA, 501 bp, Glycine max
  Peptide Sequence Number=SeqID_181007
atgattatgaggagccaagacatttatagtagccaagatgaggctactacgtcaccttcctctagtgaaagtgaagaagcaaaaggggaagaatctagtgaagaaatctacccccaagaagaaggacaacctttaatggttaaggaggagtgtaaggaggtaagtgtctcctccaagagattagttaagaaggaaagtcattttgaaataaagacaaatattaaagaaacttcccctcttagacaacctccacatcttttcctttgtaaaaagacacttgttagcactgccacacctcttgggcttgaggttattcctcaagtaaaggagttgttggatgagggtttggttcgtaagagcttaaatccttgtgctttgttggtgcccaaaataggtgtcgagggaaggaacccaaagtatgaagaacctcgggatttgaggtcaaatcctttccaaggtggaggggatgatgcaatcctaccccccaagggtattggatag

SEQ ID NO: 89323 - DNA, 135 bp, Glycine max
  Peptide Sequence Number=SeqID_181008
atgccacatcaaggagaagatgagtcaagaacaagctcaccaccacaggaagccatatataagagcttgaaggtaggagaagatgagtggaaggagaaggagagaaggagcacgaaattttatgcctcaaatgag

SEQ ID NO: 89324 - DNA, 489 bp, Glycine max
  Peptide Sequence Number=SeqID_181009
atgggtgatcaagaggagacacaggaacagatgaaagccgacatgtcggctctgaaagaacagatggcctccatgatggaggccatgttaggaatgaggcagctcatggagaaaaacgcggccaccgctgtcgctgtcagttcggctgccgaagcagacccaactctcttggcaactgcgcaccatcttccctcaaacatagtaggacggggaagggacacactggggcacgatggcaaccctcacctgggatacaaccgagtggcttacccttatggattgccgcccaactactcaccacccgtcttgcaagacgatgcgggccatattgcttctcccatccttgaaagagagcctcctcaacagcccaacgaggtccacaaagaccctaaagactatgctcgaagggatgtcgagttctatcccccgatccccgaagggccggcacccagcacgttgcctcaaaccagcatcatgacacaaccaata

SEQ ID NO: 89325 - DNA, 171 bp, Glycine max
  Peptide Sequence Number=SeqID_181010
atggagtcaggttttttactcaagtcgtccggagacatgcaagcccgacgacgcataagattcttctttgttgggcgggaggcgatcaagttcgatggcgtggggaagtgtcgtggttccactggtcgggatattaaccgatcgaatgatgttccgctcgaacgaaattag

SEQ ID NO: 89326 - DNA, 234 bp, Glycine max
  Peptide Sequence Number=SeqID_181011
atgggccccaaactacgaagggcttttgttgtgaagaagggcttttccggaggagccctggtgcttaccaacatggatggcgaagagctaccttcacccgggcaggatcatcttgagctaccttctggggtagagacaaaacatgaacagcagaaaccaatcaaggtacatagggacggatgcgagtgggggtggggtcacgaccgaccgatcgttgccccttctctgcgctaa

SEQ ID NO: 89327 - DNA, 492 bp, Glycine max
  Peptide Sequence Number=SeqID_181012
atgggatcgagtcaggcgccttggcttaaaaagaggttctatcaggtcaatatcaagagtctaggagtcgccagtctgaaagagttaggacaattgatgggacaactccaacgacaagcctttcgcaaagcctatggtaagatctgggacctaactttggcggagatcttcacggaggccgctgcctccctcgcccaatattatgaccagcctttgaggtgcttcacctttggggacttccagttaacacccacggtggaagagtttgaagagatcctgggatgccctctaggaggaaggaaaccgaattggatcggggaaagcaagtcgaaaatggggtggttggagtaccaaggaaatgtttggaagcaaaggcgagaacctttgcaagtcaagacgaatagccctgttcatggacgtcctggcgctcttgatcttcggagtggtcctctttccaaatatggatgggttggtggacctggcagcgattga

SEQ ID NO: 89328 - DNA, 382 bp, Glycine max
  Peptide Sequence Number=SeqID_181013
atgactagaggcaatccatctgacttacaaccctttgatcctgagatagataggacatttcatagattagttaggcatcattttatcccttttgatcattctgagcattccataactggtgaatctgtgcattctgttattggtgattttgaacatcctgatcttgagcattataattttgaacattctgattctgagcattctgattttgcacattcacagaacatggcacaacctccacctcgtgagaggactctaagggaaatggctgcacctgatttcacctatgaaagcttgtgcatccaataccctgatgaggatgtcccatatgttcttaaaactggactgattcatttgcttccaaagtttcatggccttgcag

SEQ ID NO: 89329 - DNA, 171 bp, Glycine max
  Peptide Sequence Number=SeqID_181014
atggaaatttcttcattccatcaattttccgacgaatccctcagtgaggtgctcgaccgtttccacagactactcatgaagatgcctacacatggtacagtgaaccggagggacgatcaagctatggacaccggaggaggcaatggaactcctagacgacatggcggctag

SEQ ID NO: 89330 - DNA, 433 bp, Glycine max
  Peptide Sequence Number=SeqID_181015
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggggtttccccctggcggctccctcgtgcgctctcctgttcctgcctttcggtttaccgggtgtcattcccgctgttatggccgc

SEQ ID NO: 89331 - DNA, 465 bp, Glycine max
  Peptide Sequence Number=SeqID_181016
atgagtaacattcaatgttactattgtggtgagaatggtcatatgcaagtgaggtgcaaacaaatgaaagaggacttgaagaaattaagagatatgaacaaagatggcaccaactcccaagctaatgtagtaaaaagtgttgaagatgaagatgatatggttttggcaaaaaatgatgagattgctaaaacaaaatgggtgatggattctgctgcctcaaagcacatttgcagagatcaagagatgtttgatactttgaaaaccgatggagaattcagccatttcaagttagggaatggtggaaaaatgaaggttgaaggcatagggagtatgaggatgaagtttcatgatgtcttgaagaggaaccatgatagcaaagtgaagaagaaagtgaagttttctaatgttgtggaagtgttgggagatacttccgttagagggggagtttgttcactctcaaattaa

SEQ ID NO: 89332 - DNA, 408 bp, Glycine max
  Peptide Sequence Number=SeqID_181017
atgaagaactggatgcagaattcaaaacgggatgtctacctaggagtctacctgaatggtgcacattggcaaatggtcgtcattttgcctaaggaaaatcttatcgtctggttttgttccttgcataataggccagacaactacctgaaaggaataattaacagtgctttgaaaggacttgacgatactccacaacctaaatccaaggttggtgctaggtggattattgttaaatgtaatagacaaaaaggaagcactgagtgtggctattacgtgatgcactggatgtcaactataatcttaggaagtttcaagaataattgggaaataaccattggaatcagagatattaaggcgctttgcatcctgtgggcaaagtattatctcaaagttagaaatgaaacttag

SEQ ID NO: 89333 - DNA, 183 bp, Glycine max
  Peptide Sequence Number=SeqID_181018
atggggttgtcccctcctatccctcttaagattattgaggccacaaggtccaacaccatgaaaaccatgattatgaggggccaagacatttatagtagccaagatgaggctactacttcaccttcctctagtgaaagtgaagaagcaaaagtggaagaatctagtgaagaaatctacccctaa

SEQ ID NO: 89334 - DNA, 807 bp, Glycine max
  Peptide Sequence Number=SeqID_181019
atgaatatcttgacagcacatgatcaagggtgggagcaggagttaagtccgtacaatcaatatgaaaaagaaagaactcctaatcttgaaagtgtgtttgaggaattcatggcatatcatgctagctcaaaagccaatcaaaattcaatgaaaaatcatgaaattcattttggcacgagctactcaatagaaaactttcaaggggaaccagagttacaaccttactatcaaaatgaagtagaaagaggttccaatctagataaattgttgatgcaattcaaggaaacaactaaatcaactcaacgagcactccaaagtgtagaaatccaggttgaagctcaagaggaaaaccctgtaaaaaagcatgagtcaagagaaaaagatgaggaacaagcacatcaacaatgggagaaatactcaacagtagaaaacaatccagaaagtattctccaaatcaataaccttcctcatcaacggattgacaagaaaagaaggcaaggagagcatgaggaaaccttaagcgccattcttgaaatgttttggattgtacttccattctacatgaagttcacggaatttctagctaaaaggcgaaattgcaaggaagatgtgttctatgtgactccttttgctaagtgcaagccttgcactaagcgcatatttgttcatgcgctaatctgcaagtctcaagcgcttagcgcccaacccttgcatttgaggctaatttggtccgctaagctggccaaggttgagctaagccaacttaaattcgatttgaattcggctaagctgcagcctgatcgctaa

SEQ ID NO: 89335 - DNA, 399 bp, Glycine max
  Peptide Sequence Number=SeqID_181020
atggtgaatcaatatccggatcttcctggaaaagatgagttggggatgggcgttaaggtatttttaggagagatgaactgggatctgaaatcgccatatccggcaatcggaagaaagattgaagtggattttggaaaaggaaaatttgtattggattataaagataataaaacgatgtcttttagtggtacagaagcttttaaaggtatttcagatactgttgagtatacggcaactgagattgcaaaaaatatattcatggtgtattggcatgaacctaaaaccggtgaaaatgttacccatattcaggattataataaaaacataatttatacgaatattgctggaaaaaacggatcgttcgatcattttaaagtaccgtttaaaatcttgaaataa

SEQ ID NO: 89336 - DNA, 603 bp, Glycine max
  Peptide Sequence Number=SeqID_181021
atgggttcgacgaggaggccattgcctagctattatgcacactggggttggatttcgcccggaccgctgccgggaggcggtgatcataactccgaccttcctctgccgaagtgtcagttggtgtatgccatcctgacacggatgaacgtccatgtggctcagttgattgctgacaccatctatttatttgcagcattgatcacgagcctctgccagtcattcgaggttcccgtcacacctagtaaggtgatccgaccgccgatcacctgggccttcattgagaagtattgcacgcctaggcaggcacaggacgcaccgccaccacctcatcaggctgatcccgctgggtcactaggcatgggcagtatctatagcacttggttcgccaaagcggccaaccaccgggggcaggggcagggtttcgctccttttgcgtgccctactccagagcagtttggtgttgaggtcgcatggcccggagactggcccgaggcccaggtaggggaggcgcctgcaggatcccccagcgatgcagaggaggcccgtatagatgaggagatgacggaattgctcggtttcttgggaggacgcggagccacatga

SEQ ID NO: 89337 - DNA, 489 bp, Glycine max
  Peptide Sequence Number=SeqID_181022
atgatgcatacacctgactcaactcttagatgcaatgtggtacgtaccaacaaccaaatcccaggaaatagcctaactatgaacatgggaaaaagcaagtgctcaaagaccatggaccaattaaagcgcctaagcatcccctcaaaaatgcttagattctttaaccacgcttgtcacccacgtctgggcccattcgacaaggtcagtgcactctacccccccatgaacatacactacatacgaggtatgaatgtggcccaaagcaagtgccaaagaccctggaaggtcagtgcacttcgcccccccacaaacatacacaacatcccaacgtatgaacgtggcccaaagcaagtgccaaagaccctggaaggtcagtgcacttcgccccccacgaacatacacaacatgcacatgccaatgcatttccaacatcaatcaacattccatttccatgtcattctcaacataaatatcatctcatctcaatga

SEQ ID NO: 89338 - DNA, 513 bp, Glycine max
  Peptide Sequence Number=SeqID_181023
atgactcaagagctggtagcccgcggagacaccttacggttatccgcacctcgtcattcagtgaccccaagtgtgattgacgagcagagaccaatatggtcatctgccccttttccggagatgtcatcattttccgatggagacttttcaagtctcacaagttatcaagaaactacaggcggcgggcccgatgatacgcggagatacctttacggttatccgcaccctttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 89339 - DNA, 606 bp, Glycine max
  Peptide Sequence Number=SeqID_181024
atgtcggctttgaaagagcaaatggctttcatgatggatgccatgttaggaataagacaactcatggagaataacatggccactactgccgttgttagttcggctgccgaagcagacccaactctcccaactatcacgcaccatcctctcccaaacgtgggatacaaccgggtggcttacccttatggattaccacctaattacatgccaccagtcatgcgtgatgaagctggtcacgtcccttcccccatccttgaaagggagcctcctcgacagtcggacgaggttcacgaggatcgtagggagtatgcccaaggagacatcgatttctaccccccggtacccgtcgaggggccagcgcccaacacattgcctcagcccaacctcccagcacagccaatattcttgtccacagaaggaccacccccggcagcggaagaaagaaggaaactcgatctcatcgaagagagattgagagctgttgaaggctttggcgactatccatttgcgaacatggcagatctttggttggtaccggatgtcgtcatccccccaaaattcaaggtacctaatttcgacaagtacaaaggacgacttgtcctatga

SEQ ID NO: 89340 - DNA, 498 bp, Glycine max
  Peptide Sequence Number=SeqID_181025
atgcagctggcacgacagggaacaaaagctggtaccgggccccccctcgaggtcgacggtatcgataagcttgatagcggaatcagaaacaaaggacctgatggaagaaagatgtaccttgaagtgaggaagacgatcgaaggagagaaagaaatcgcaaaacggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 89341 - DNA, 162 bp, Glycine max
  Peptide Sequence Number=SeqID_181026
actcatcttctccttgaagtggcgtctcctctctctttccctttctccattccgctgccattcatcttccaagaagcaaaggaatccattgatgaagaagatcctaggcctacaagctccaatggagcttgcatcaaagtccacaaccaaaatccggattaa

SEQ ID NO: 89342 - DNA, 763 bp, Glycine max
  Peptide Sequence Number=SeqID_181027
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgattctcctgcctcagcctcccaaacagctgggattacaggcacaagccaccatgcccagctaatttttgcatttttagtagagacggggtttcaccatgttggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaagggctgcaccggatatattccgcttcctcgctcactggactcgctacgctcggtcgttcgactgcggcgagcggaaatggcttacgaacgggggcggagatttcctggaagatgccaggaagatacttaacagggaa

SEQ ID NO: 89343 - DNA, 207 bp, Glycine max
  Peptide Sequence Number=SeqID_181028
atgcttttcattggttgcattgctcattgcattctttccttgagagggctgcactccctcaccctcagaggactgcacgccctcacctttagagggctacgcgtcctcattttcagtgtgctccacatccacaccttaagagaatttaaggtcctctgccctcaaatgcttaaccgagacttgcactcccggttaaggggccagtag

SEQ ID NO: 89344 - DNA, 456 bp, Glycine max
  Peptide Sequence Number=SeqID_181029
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgggtttccccctggcggctccctcgtgcgctctcctgtgttcctgcctttcggtttaccggttgtcattccgctgttatggccgcttttgtcctctttccccgcccttgacactcaggttccgg

SEQ ID NO: 89345 - DNA, 255 bp, Glycine max
  Peptide Sequence Number=SeqID_181030
atgtcaaatcataaaagcactgagtcagcacttaagaaccttgaggtccaggaggaatgcaaagctgtgatgacaaggagtaaaaggtttgtgaaggctgaggatgaggatagtgttgtgcataagaagaaaactgttgacaagaaaggtactgatggcaagaaaaatgaggagagaggtgaaagtaatcaagaaaaagaggaacaaataatggtcaagaaaaaagaattgaaggaccaagaaaaaggaaaataa

SEQ ID NO: 89346 - DNA, 87 bp, Glycine max
  Peptide Sequence Number=SeqID_181031
atggagaaaaatgaagaaacaacaattgaggagaagcgaaagataaaggagaaaatgagagataaggtgtcatccactagggaataa

SEQ ID NO: 89347 - DNA, 633 bp, Glycine max
  Peptide Sequence Number=SeqID_181032
atgtggatggactttcaaaaagcctccacttttgattatgatggaagtgacaatgttgagcatcgcgacgtcgatcaagtgttatgtcttgttaggaagtaccaatttgatgatgcttgtgtttacttcacaaacgatgctaacaacacttataatctaaagaaaatgactgaagaccaaatgctagctcatgtgactcagttccatgaagctcggcaaaagagaaaggctgaagaagaagaaattgttgttgttactatgaaagatgttgcctcaatccaagctgaagcatttgctaaagttgtggacgaaaccattgtatgtggggtcatcattgatcttaccaacactggtgtcatgaacgaaactcctaaagcatctaatgcaaccatagcttatgaagttgaacacaatgttatagaacctgcatccaagcagtcaataacttcaaatgaggctacttctagagacaagggcgaacctgatgttgtcattgtctactccaccaactcaggtcctactcctctgaactatgcacaacccaccactgctactagggatcaagtgcaagatatgatagggcaaaggctagacattcatggtaacagtgtagaagtcacaagcagttcttag

SEQ ID NO: 89348 - DNA, 123 bp, Glycine max
  Peptide Sequence Number=SeqID_181033
atggataagagcttgaaggtaagagaagatgagtggaaggagaaggagagaaggagcacgaaattttgtgcctcaaatgagggtggaacctttgaggaaattgatccatggaagatattttga

SEQ ID NO: 89349 - DNA, 165 bp, Glycine max
  Peptide Sequence Number=SeqID_181034
atgtcgtggaacttcacggatagcttaacaatgggtgtcaagttcctcgaagcagtcgagcgaaggttgtatgacatcaaacaatggtccccggatgaaattaggagactgtcttttatagacttcggtgaaggatctattatgggatcaacgttgattccttga

SEQ ID NO: 89350 - DNA, 524 bp, Glycine max
  Peptide Sequence Number=SeqID_181035
gaatggctccgaagaaactctccacgaagaggtctagaagggacgccactggagaaggctccagtgccgcctcagagtttgatagtcactgtttccagagtgccaagcaccagcagcgcttcgaggccatcaagggatggtcattccacagggagaggcgtgtccagctcatggaagacgagtaccctgacttccagggagagatagctcgcaggcattggccacgactagtgacccctatggctaaattcgacccggagatagaagaccagcagtgtgaattcagccagaggaggagccaagaaaacggttttgatgaggaagccatcgcccagctattgtgcataccggggcaggatttcacccggaccgctgcaaagaggcgggtgcggatcatgcgcaccagcatgactaccttgacccagatatggatgacactgctgctcaacaatgtcttgcctagcgaccataactccgacctccctttgcctaagtgccagttggtgtatgtcatcctgacatag

SEQ ID NO: 89351 - DNA, 459 bp, Glycine max
  Peptide Sequence Number=SeqID_181036
atgatttctgttaatcctaactcgagaagtcaggtggcaggcggagatactcaagtggttatcggtacaaaacgatttctgttaatcctgacccgagaagtcaggtggcaggcggagataccttatgagacggcgagtccgatgacatgcggagatacccaagtggttatctgtacaaaccaacttctattaatctcaacccgtgaattcaggtggctggcggaaataccccaagtggttatccatacaaatgcacttctgttaatcctgacccgtgaagtcaggtgtcaggcggaaataccccaagtggttatccgtacgcgcacagttttactaccccgacctgtgagaagtcaggcagcatacggagacgccctatacggtaatccgcacacatttcgaagacaacaatgtcttcacctcaaaaacttcaatatctttttcccttgtgcttcgtag

SEQ ID NO: 89352 - DNA, 222 bp, Glycine max
  Peptide Sequence Number=SeqID_181037
atggagggagacatagatctcatactagacctcactcccaaagaagagaaaaggatagaaggtctcaagaggttgaacaactctttgcttgacatcatattagtgaagaaagaaacgttccattggctacccttagcttccaaggttatgccctttattggtggacttcccttgttaaggaaagaaggattcatgggatcctccagtagagtattggaatga

SEQ ID NO: 89353 - DNA, 327 bp, Glycine max
  Peptide Sequence Number=SeqID_181038
atgaggcttcactgttatcaagcaagtcagagacccagcatgaccacagatcgacctccactccttatggctcacatagacccgggtataggtcctaatatctcaatgtgtgtgcaaagttgcagctcacccaggcaagctggagctcgcccaggcgagctaaaacttagtgctgaagcaatgagctcgcccaggctatctggtttcttaaccatgaagctatttggtggcccaggcaagccagaggctagcctgggcgagctagggtccaggaaaactaaggaaaagacccttttgcccctttttttggtattttcgcattcttga

SEQ ID NO: 89354 - DNA, 489 bp, Glycine max
  Peptide Sequence Number=SeqID_181039
atgactcctacctgtaattttaaggtttcctatacaaaaattgccttacacaaggttttacttgttggcactgatacatcttgctacattgggaaaccaattgtaacaaatgttgtagtatatgcaacactgaaagagaagggtctagaacccaaagtaatcgtcttcaaatataaaaggaagaaacactatcgcaaaaacattgggcatagacaaaaacctactgcggtgaattggatcgagggacgtgggaaattggttgtttgtgaagcaattatcaaagaagaattagtgcagaaggtattgaagaccaacgtgtctgccctggtacagcttaacatgctcaaaaaccttgttggttctgttgtctccgatgctattggtgggtttaatgctcatgctagtaacattgtttctgccatctttatagccactggccaagatccagcccaaaaagttgagagttcttgtaacgccttgaaattttga

SEQ ID NO: 89355 - DNA, 189 bp, Glycine max
  Peptide Sequence Number=SeqID_181040
atgggatacattgcacctgaatggctaaggaatgcaccaataactgccaaagttgacaaatacaattttggggctaaggaatgcaccgtacttccggtgggagttgctatcatagcaattacatcaaaacattcaaacaatgcatcagtaccagcaatcaatgcattgcaattcacatacctaaactag

SEQ ID NO: 89356 - DNA, 528 bp, Glycine max
  Peptide Sequence Number=SeqID_181041
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgccttttcggtttaccggtgtcattccgctgttatggcccgcgtttggtctcatttccacgccctgacactcagttccgggtaggcagttccgctccaaagctgggactgtatgcacgaacccccccgttcagtccgaccgctgcgccttattccg

SEQ ID NO: 89357 - DNA, 193 bp, Glycine max
  Peptide Sequence Number=SeqID_181042
atggagagtggaccccaatctgaaccgtttgatgtagaaatgggagatcgcttggaagatatgattcgtgaccttggacaagagtcttttcagcaagcacatgcccctatgtatgatacattacaaagtgattcaaagaagcctttgtatccggggtgcaacaatttgttgacgctgttgtcggcgacgttaa

SEQ ID NO: 89358 - DNA, 177 bp, Glycine max
  Peptide Sequence Number=SeqID_181043
atgaaggcagcatgttttggaggcctctggtttcatgtcctgaggctgtataattcgagtttagcctctggtaatcgattaccaaggctgtgtaatcgattaccagagatgaaaagccttgagataccccttttacttacatgtagtggttatgagacgcattgtgttgctccgtag

SEQ ID NO: 89359 - DNA, 360 bp, Glycine max
  Peptide Sequence Number=SeqID_181044
atgcgttacctgtttggcggtgcgcataaatgcgcaccctacatatctggcgctgcgctgggtatcaatccgcgccctgcttcgccggtatacggtgcgcataaatgcgcaccctacatatctggcgctgcgccgggtatcaatccacgccctgcttcgccggtatacggtgcgcataaatgcgcaccctacatttctggtgctgcgccgggcatcaatccgcgccctgcatcgccggtatacggtgcgcataaatgcgcaccctacacatctggtgctgcgctgggtatcaatccgcgccctgcatcgccggtatacgtgcgcataaatgcgcaccctacatatctggcgctgcgccgg

SEQ ID NO: 89360 - DNA, 639 bp, Glycine max
  Peptide Sequence Number=SeqID_181045
atgacggaagggtgtggtgaagggtttgccttgcaaaccttcccgtctggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggtggatcatcatgcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcggggatcctctag

SEQ ID NO: 89361 - DNA, 258 bp, Glycine max
  Peptide Sequence Number=SeqID_181046
atggccggcaacaggcaacaggcaacagacgcaccgccatcacctctagagttcacctcagctcatccacaaaaaggtaatggtaggacacacctagttgctcatgatcctaggaaattaaataaaatgagcacaagctcagaaggacatcccctttattctcgaaccgctggccaaaccctgacatatatcatgaccagccgttctacaagccttgagccaaaatcccaacttatcataaaccttgacccagggtga

SEQ ID NO: 89362 - DNA, 210 bp, Glycine max
  Peptide Sequence Number=SeqID_181047
atggaggttgaggaaccttggttggggttatggctaccattgaattatcgagtggatatgggatcaagtttagcatatgacaacggaatttggggctttgtggttgatttagggatggcctttgtggataactgggcggtgggtaaggaggaggtttgttattggctgagtaatgacattgttgggttggtgggaaacttggccgtatag

SEQ ID NO: 89363 - DNA, 141 bp, Glycine max
  Peptide Sequence Number=SeqID_181048
atggggttgtttcctctgattcagaagccattctcttatcctgggggaaaactgccaggaaaccacattacgaacgaaacctcaaagagagttgggcttcgtctcaaaaggaacaacaccagaaaaactagccttccatga

SEQ ID NO: 89364 - DNA, 270 bp, Glycine max
  Peptide Sequence Number=SeqID_181049
atgctcgtggcaggtgcttggtcattaacggatgctctggttgatcctccagtagtcatatgcttgtctcaaagattaagccatgcatgtaattctagagctaatacgtgcaacaaaccccgacttctggaagggatgcatttattagataaaaggtcaacacaggctctgcctgttgctttgatgattcatgataactcgtcggatcgcacggcctttgtgccggcgacgcatcattcaaatttctgccctatcaactttcgatggtag

SEQ ID NO: 89365 - DNA, 1216 bp, Glycine max
  Peptide Sequence Number=SeqID_181050
atggttagaggaactatatgtggagcaattagacataaattgataccgactcctcagaatttggtgacttcaactccattaacaactacttatgaatctttttttggattacatccattatctcaagttttggatcaaactaatccattgacccaaatagttcatgggagaaaattgagttatttgggccctggaggattgacggggcgaactgctagttttcggatacgagatatccaccctagtcactatggacgcatttgtccaattgacacgtcggaaggaatcaatgttggacttattggatctctagcaattcatgcgaggattggtagttgggggtccatagaaagtccattttatgaaatatctgagagatcaaaaagaatacgcatgctttatttatcaccaagtagagatgaatactatatggtagcaacaggaaattctttggcacttaatcgagatattcaggaggaacagactgttccagcccgataccgtcaagaatttcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgg

SEQ ID NO: 89366 - DNA, 2209 bp, Glycine max
  Peptide Sequence Number=SeqID_181051
atgaaccaaagtctgcttgtaactaaacgcgatggccgtaaagagcgcatcaatctcgacaaaatccaccgggtcatcgattgggccgcagagggattacacaacgtctcggtttctcaagtagagttgcgttcacacattcagttttatgacggcatcaaaaccgccgacattcacgaaaccatcatcaaagccgcagccgatctgatctcccgcgatgcgccggactatcagtacctggccgctcgcctggcgatcttccacctgcgtaaaaaggcttatggccagttcgagccgccgaagctgcacgctcacgtgacgcgcatggtcgagatgggcaaatacgataagcatctgctggaagactacagcgctgaagagttcgagcagatggattcctttatcgatcactggcgcgacatgaacttctcttatgccgccgtcaagcagctggaaggcaagtatctggtgcagaaccgcgtcagcggcgagatctacgaaagcgcccagttcctgtacatgctggtgtccgcttgcctgttctccaactacccgcgtgaaacccgtctggactacgtcaaacgtttctacgacgcgatttccaccttcaagatttcgctgcctacgccgatcatgtccggcgtgcgcaccccaacccgccagttcagctcctgcgtgctgatcgagtgcggcgacagcctggattccatcaacgccacctccagcgccattgtgaaatacgtttcgcagcgcgccggcatcggcatcaacgccggccgcatccgcgcgctgggcagcccgatccgcggcggtgaagccttccataccggctgtattccgttctacaaacacttccagaccgccgtcaaatcctgctcgcagggcggcgtgcgcggtggcgcggcaacgctgttctacccgatgtggcacctggaagtggaaagcctgctggtgttgaaaaacaaccgcggcgttgaaggcaaccgcgtgcgtcacatggactacggcgtgcagctgaaccgcctgatgtaccagcgtctgatcaagggcgaagacatcaccctgttcagcccgtccgacgtgccggggctgtacgacgcgttcttcgccgatcaggacgaattcgaacgcctgtacacccagtacgagaaagacgacagcattcgccagaagcgcgtgaaagcggttgagctgttctcgctgatgatgcaagagcgcgcctctaccggccgcatctacatccagaacgtcgaccactgcaacacccacagcccgttcgatccgcagatcgcgccggtgcgtcagtccaacctgtgcctggaaatcgccctgccgaccaagccgctggaagacgtcaacgacgaaaacggcgagattgcgctgtgcaccctgtccgccttcaacctgggcgcgatcgacagcctggacgatctggaagagctggcgaccctggcggtgcgctcgctcgacgccctgctggattaccaggattatccgatcaaggccgcgcaccgtggcgcgatgggccgccgcaccctgggcatcggcgttatccacttcgcctattacctggcgaagaacggcgtgcgctactccgacggcagcgccaacaacctgacgcacaaaacgttcgaagccattcagtactacctgctgaaagcctccaaccgcctggctcaggaacaaggcgcttgcccgtggttcaaagagaccacttattcgcagggtatcctgccgatcgacacttacaagaaagacctggatgcggtctgcagcgagccgctgcactacgactgggaaaccctgcgtaaagagatccaggaaaccggcctgcgcaactcgaccctgtctgcgctgatgccatcggaaacctcttcgcagatttcaaacgccaccaacggcatcgagccgccgcgcggccacatcagcatcaaggcgtcgaaagacggcatcctgcgccaggtagtgccggagtatgagcgtctgaaagacaactacgagctgctgtgggaaatgccaagcaacgacggctatctgcagctggtggggctgatgcagaaattcatcgaccagtcgatttcggccaacaccaactacgatccgacccgcttcccgggcggcaaggtgccgatgaagcagctgttgaaagacctgctcaccacctacaagttcggcgtgaaaacgctgtactaccaaaacacccgcgacg

SEQ ID NO: 89367 - DNA, 297 bp, Glycine max
  Peptide Sequence Number=SeqID_181052
atgattaatcagggatatataactatcctcaaagtattccgcttagcgcccctttcctgccgatgcggaaaaataacgcgccggagaatcgccaaaggctttgcgaaacatggcgataaaattactcggcgaggcatatcccagcgtttccgcgatctgcagcacggtttcgccgcgcaggcactcaggaactacggtacagaactgcaaacgcggggcgcggcggcgatacgcctttcacgcctggcgtccgaacggctgcagcaaaaccgtgacgccggcaactcggcgccatga

SEQ ID NO: 89368 - DNA, 200 bp, Glycine max
  Peptide Sequence Number=SeqID_181053
gttgtaggagagcatcatccacagaagatggttcaagccaaatttgtcccaaatttgggggaggtatgaaagctaagtgcctaagaaaaaagggcaagtatgaggaaggaatgaatgaaaaagtgaaggttattctatggatgaatgctctcctagaacctaagcttttgaatcctagaaaaaccatgaattgttggtag

SEQ ID NO: 89369 - DNA, 243 bp, Glycine max
  Peptide Sequence Number=SeqID_181054
atggcttacgaacggggcggagatttcctggaagatgccaggaagatacttaacagggaagcgtttccccctggcggctccctcgtgcgctctcctgttcctgcctttcggtttaccggtgtcattccgctgtatggccgcgtttgtctcattccacgcctgacactcagttccggtagcagttcgctccaagctggactgtatgcacgaacccccgttcagtccgaccgctgcgcttatccg

SEQ ID NO: 89370 - DNA, 258 bp, Glycine max
  Peptide Sequence Number=SeqID_181055
atgtttgtcttttccccaatttatggttctttttgtaggctagcaactggtgtctcgctaagcgagacttatgcgcttagcgagaatcatgcgctaagcgaggcactcagcctgcttagcgagttgagagaatctggaggagaatttgataagcatctacatgctcagtgcgtcatcaactcactcagggaggcatttgtctcttcccgcgttaagcgcgcccagctcgctcagcggatattcactaactcgcactaa

SEQ ID NO: 89371 - DNA, 372 bp, Glycine max
  Peptide Sequence Number=SeqID_181056
atggcgcctagcaggcaccctttggatccagataagtccaacggggccctgggatttcccgcactgatcacaggactctgccagtcgttcggagtccccgtggcacctaccaaggcagccaaccaccgggcacatgtgcagacccatgattgtctgtaccagatgagcctcaacatgcagagccagggcttcgcttctttttcatgccctactccagaccagttcggggcagaggtcgcatggcccggggattggcttgaggcccaggcaggagaggcacccccagaagctcccggcgatggagaggaggcccacgaggacgaggagatggccgatttgcttgacttcttgggagggagtggagcttcatga

SEQ ID NO: 89372 - DNA, 237 bp, Glycine max
  Peptide Sequence Number=SeqID_181057
atggcaaaggtgtgcggaatgaccataatttgtctccgcatgtcatcggctccgccgcctctggatgacaaaagggtgcagaatgaccataatttgtctctgcgtgccatcgacacgactatgtctgaatggcaaaagggtcagtatgacagagattgtggggcggccgacaaaagcaaggctcttgctcctacgtatcctccaatgaggaactcagacctacgtagttctagataa

SEQ ID NO: 89373 - DNA, 83 bp, Glycine max
  Peptide Sequence Number=SeqID_181058
atggcggatggcgtagcggaaaatggcggatgtcggcaaattgaccaaagcgggttccttttagaaacttattcccaaaagag

SEQ ID NO: 89374 - DNA, 519 bp, Glycine max
  Peptide Sequence Number=SeqID_181059
atgggtgccaagtacctcgaagcggtcaagcaaaggttgcatgccataaaacaatggtccccgaacgagattagggcaatcaattcatggggctccgaactcgatggtggaggatgcatgaatggcaatcaattcatggggctccaaataagatttgatggtggaggatgcacgaacagcgctaggcaatcaatttgtggggctccaaactcgatgcgccaggcaatcaatttgtgtggctccggactcgatggtggaggatgcatgaatgacaatcaattcatggggctccgaataagatttgatggtggaggatgcatgaacaacactaggctatcaatttgtgtggctccggactcgatggtaatcaattcgtgtggcttcggactcgatggtggaggacgtatgaatggcaatcaattcatggggcttcgaataagatttgatggtggaggatgcacgaacaacgctaggcaatcaattcgtgtggctccggactcgatggtggaggatgcatga

SEQ ID NO: 89375 - DNA, 360 bp, Glycine max
  Peptide Sequence Number=SeqID_181060
atgacacatcatcgacctagcaaggaatttgaggaatcgcctaggtgtaggtggtctgacagcagaagacagaatgctcatgtaactgacgatgatctacagattgtatatggtcttaaatctggtatcaagatgaattgggtacttttgattgaagacattaagttgaagagtcgtcagttagtggattatgaattttcgtatgttgtgcttgcctcaagattcattaactatttcaatgtcgatgtagtggattttactaaagcatctagtgagatcatcgaaaggcatctcaagaagcttgggatcaggtttgttgaacatgagtggattatggctagagagccaccaacaacatga

SEQ ID NO: 89376 - DNA, 144 bp, Glycine max
  Peptide Sequence Number=SeqID_181061
atgcccaaccttaaaagtgatgcaatccctcctaggaaaggaccaattactagagccatgagcaagaggctccaagaggattgggctagagctgttgaagaaggtcctagggttctcatgaacctcaggggctccataatgtag

SEQ ID NO: 89377 - DNA, 138 bp, Glycine max
  Peptide Sequence Number=SeqID_181062
atgatgcaatcctatcccgcaagggcattggatagaagactccaagaagattgggccagagatgcaagagaaggccctaaggttctcatgagcctcagggtagatttcaggctcatgggctatggctccataatatag

SEQ ID NO: 89378 - DNA, 466 bp, Glycine max
  Peptide Sequence Number=SeqID_181063
atggcggattttttttgttttttgtccgcggtaggagttgggctgacccgacgcaaccctacccgtgcaacgaggaaaaataaggcagacccaggctggaaatattgtcattcactagtggaaggagatacaagcaccattgtttgtaatttctgtggaaaaatcacaaagggaggaataaccagagccaaacaacacctgattgggaagtcgggcaacgttgcagcttgcaagaaaacttccccaaatgtagtcgaagagttgaaggaatatatggctacaaaaaaaagtgggaccacttacagtatttctggcagtggtaatatggcaaatataagagactttgaatttggtgaaccgattggatgtgatggaagtgaagaagatgagtttgcggactcttgtaatgttgctgcaagtgcaaagacaaagtgtgagactaaaaaaagaccaatggacaaatttt

SEQ ID NO: 89379 - DNA, 213 bp, Glycine max
  Peptide Sequence Number=SeqID_181064
atgtcccatgctgtcaagggcaatcgaggaaaatgggccccaaactacgaagggccttttgttgtgaagagggctttttccggaggagccctggggcaggatcatcttgagctaccttctggggtagagacaaaacatgaacagcagaatgaacagcagaaaccaatcaaggtacatagggacggatgcgagtgggggtggggtcacgactga

SEQ ID NO: 89380 - DNA, 366 bp, Glycine max
  Peptide Sequence Number=SeqID_181065
atggcggcgcagctaatccatgatcgagtggagatggagtgcctagagggagcttgggagaccctcaaaggcaacacgagtacgcttcagcgtgatgtggagtggatactacccacgcctacaccatatcgtttagtggacccagtccaagtgatcgaggtaacgttatccgaggaagaccctgaggaggatcttgaggagccacctcctgagcctgctgtggatgctcttgactttctagagggtgatgaggatccccttcctgaggtggattctcccgaggatgtcatgtcggcatccgaggcagactctacggaggatagtggccctggagagatggcgatcagtggaggctcttcatcctag

SEQ ID NO: 89381 - DNA, 663 bp, Glycine max
  Peptide Sequence Number=SeqID_181066
atggagggggattcagtcatacacacagtggcatatgcagatgatgttgtcagggtaagtgtagaaacagttattgatcctgaggctgaggtcccctatgccacgtcagaaatacaatatgtgaagcaggccgtcgatacatttgtagcttggcccacacaccttgtgaaagctatattagatgaggttccacaaagtattccacacaacgaggatgcacatgtgccgaagccgactaatgtggacgcagatgatccgttgcgtggattgataaagtatagtttcgatatttacgacaacccacttgaaatcaactttgatgggagctttcttggaattgtagatgcatctgcatcgatattcattacatattcagatgttagtgaaataatagcaggagacaaaagtctgaacatatctgtcatacaattatggttaatgtatattcatgagtggagtcagatattcagtcaaggtttcatgtatgcattccttgagccacagtcgttggtttgttcaaaggaaagacgcagcgaatgcgaacaatatcttctaagatggcttaaggaatctgaccgagaggtgtacattggaccttacttccatcagaaacctgatatgcatatcaaagctacaattaataggttatctcataccatataa

SEQ ID NO: 89382 - DNA, 186 bp, Glycine max
  Peptide Sequence Number=SeqID_181067
atgaagggaaaccaacaaagggtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttaagtga

SEQ ID NO: 89383 - DNA, 459 bp, Glycine max
  Peptide Sequence Number=SeqID_181068
gcccacttggaccttccagggtgttccaacagaaggcggtgccttctggtggaagcaacccagctcgcctgggagagctgggcgacaaccacctccctcttttcccctataaataggggaatgagggcagagcaaattcgttcaaccctcctggtatctgaaattcacttgaaattagtgagaaaaattgtttccatgaagaaaatccaagccgaggcgcttccgagacgtttttgtgggcgatttcatgaaggttttccactgttcttcgtcgttcttcattcgttctttgtcattcttcggtcttcaaccggtctgatttcctcatcgcaattgaggatatgtaggagcaaaagccccacttttgtcgaccaccccaagagatcgttaatggtccaacaccttaacgtttctctctcctttcaaaaacaagagatcgttaatggtccaacgccttaa

SEQ ID NO: 89384 - DNA, 366 bp, Glycine max
  Peptide Sequence Number=SeqID_181069
atgtaccctctcttgttctcagtcaaacccaaggaatgggaaaaatcaaaagaattctcagactatgtcgttttgaattctttgacatcggaagaagggagacacaaagaattcaggcgattagtcctttgttcttttggaaaagggagaagagagacacaaaaagaattcaggcggttagtccttggcgaattctttttggcaaagggagaagggaatgaaaagatgaatagcacaagttttcaaggtttagaaaaccagaaaacttcagaaagcttttggtacaaagaagaagaagaagaagttcaaagagatacaagacttgtaaaggattgtaagaataagtgttcaagattgaatgaatga

SEQ ID NO: 89385 - DNA, 405 bp, Glycine max
  Peptide Sequence Number=SeqID_181070
atggataaatttgacatccttgcttattcaacttccaccggaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 89386 - DNA, 148 bp, Glycine max
  Peptide Sequence Number=SeqID_181071
aagtgatattgattattcaagaatcgaagtcgatttgctttataaaaagagtatatcaatgaacttctatgaaatggtttcacgggattcagccaattgtctggatcgtgggatatcattgagaaataggaatctggggatcctctag

SEQ ID NO: 89387 - DNA, 1179 bp, Glycine max
  Peptide Sequence Number=SeqID_181072
atggtgtatcaggaagatgtgatcaaaatttcccagtattttggaggattaacattagcagatggagatattctccggagagcgatgagcgggaaaggccgctccattgaaaagcttcgggaagtaaaagcaaatttctttaaatcctgtgaagataaaggacattcgttggaactgactgctgaagcataccgccagatagaatcgtttgctggttattctttctgtaaagcccattcggcttcctatgctgtagaaagttatcagagtttatatctgaaagtatattaccctctagagtttatggtttccgtgatcaataacatgggtggattttaccgcaccgaggtgtacattcatgaaaccaaaatgtcgggtggaattgtctgcaacccttgcgtgaacaccagtgattttcaaaccaccctgcacggaaaagaaatttatctcgggttaatgcatttacaggggcttgaaaccaggattgcccattttatcgttgaggaaagagccagaaacgggaattataaatccctggagaattttatccgaagagtccctgtcggacttgaaaccgcacaaatacttattttcatcggagctttccggtttaccggaaaacagaaaaacgaactactggtggaagtaaggatgctcctggttaatttcaaaccggaaaacagaggattgatgctgatcgaagaacctgttaagaaatacaagcttccccggctgaaaagagagacttttgaagatgcttttgatgaaattgaaattctggggtttaccgtatcatgcagtccttttgacttgctgaaaaccggttacagaggttccgtttttgtgaaagacctgctacagtaccataaaaaacaggtgaaaatgctggcctacctcatctccagaaaacatgtccctaccaaaaaaggaacgatgtatttcggaacctggatcgatgtgaacggcgattactttgatactgcccattttccggacagtcttgaaaaatatgcatttcagggtgggggatgctatcttcttttaggaactgtggaagttgattttcattttccgaccattacggttaccaaaatggccaaaatgccattcattcctgatccaagatatgcatatgacaaagaaatgcaatacgatattcataaacagatcagagaggac

SEQ ID NO: 89388 - DNA, 150 bp, Glycine max
  Peptide Sequence Number=SeqID_181073
atgggaggcaccatgcatgagcctcaagcgaacctagggatagatcagaagttctcacccgggagaagggagacacaaaagaattcaggcggtttgtccttcgttctttggaaaagggagaagagagacacaaaaagaatcaggcgatag

SEQ ID NO: 89389 - DNA, 498 bp, Glycine max
  Peptide Sequence Number=SeqID_181074
atgcctccaaaatgttcttttacgatgccattgggatatattcaacggtgctccttagctcctgaaaatctcgataactcaaaaaatacgcccggtagtgatcttattcattatggtgaaagttggaacctcttacgtgccgatcaacgtctcattttcgccaaaagttggcccagggcttcccggtatcaacagggacaccaggatttatttattctgcgaagtgatcttccgtcacagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 89390 - DNA, 405 bp, Glycine max
  Peptide Sequence Number=SeqID_181075
atgattgcagttcacacggtcaatgcaacacaaatactgggatttgtcaatgtaacaccaactatattcaagatgactgctcagaattatacatcccatgtccaaacaattgcagctcacacggtcaatgtaacactaatactggtatttgtaaatgtgatgacaattatattcaagatgattgttcagaattatttatcgaatgtacagatccaacatgttcatctcaaggtcattgtgatacatcaaatggcatttgtaattgtgataatggattcggtggtgacaaatatatttacatttattcaaaagtaccacaaaacatattcgaatgtccaaagaactgttcatcacatggatatactttttatcatactcagattggatcaatgctcggagttttaa

SEQ ID NO: 89391 - DNA, 192 bp, Glycine max
  Peptide Sequence Number=SeqID_181076
cctaaatcaaaggcttctgctaggtggattatcgtcaagtattttaacgatcctagagcattggagccagagagattaaaagcattgcggatccagtgggcacagttttatctccgagttagagatcaggcctacgatttaaggacattttataacattttttacattttgtacattttctatgtaacatga

SEQ ID NO: 89392 - DNA, 489 bp, Glycine max
  Peptide Sequence Number=SeqID_181077
atggaaaatgaaataatgaaaaagagcataaaatttaacattgacagaggtggaacattcacagatatttatgcagaattcccattcgaaccatattatattgtagaaaagttattatcagtcgatccagataactactcagatgcaccaagagagggtattagaagaatcttagagagaatacaaaagaaatcaataccaaaagataatgttgatacaacatgcattaaatcaattcgtatgggaactacagtaggcacaaatgcattactcgaaagaaaaggtgaacgtgtacttttggtaacaagtgaaggttttaaagatttattacaaattggtaatcaagctagacccaaaattttcgatttaaatattgttaaacccgatttaatttacgattcagttttggaagtagaagaaagggttcaaatcatcaataatcagcatttactatctcaatacaatgatgaggaactaggaacaatttaa

SEQ ID NO: 89393 - DNA, 435 bp, Glycine max
  Peptide Sequence Number=SeqID_181078
atgaagcttgcttctacattttccttggtgaagcttgatgtaatcctccctatgaagggaccagtccccagagccatgagcaggaggctccaagaggattgggctagagatgctagaagaaggccctacggttcccccccccctcatgaatctaagggtagattttttgagcccatgggccaaggtgatgacaaaaagctcaaaggtcaatcaaagaaagagttcaagatgtttaagatgttcaagattgaatcaagaacacttcaaggttcaagaggaaagttaatttcaagaatcaagaatcaagaatcaagaatcaagattcaaggttcaagcttccaagaatcaacatcaagattcaagactcaagattcaagaatcaagagaagacttagtcaagataagtatgaaaaggttttttcaaaaactgagtag

SEQ ID NO: 89394 - DNA, 624 bp, Glycine max
  Peptide Sequence Number=SeqID_181079
atgggatcaagtcaaaagccttcgcttaaaaagaggttctatcaagtcaaaatcaagagcttagaggtcaccagtttacgaaagttggggcaattaatgggtcaacttcaacggcaagccttccgcaaagcctatggaattagaccgccaaaggcaagtcgaaaatggggtggtcggaatactgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaaagattctatcttcatgcgaaggatgtccaaatgttcccttgatgggaacaaggggttgtattaattataatcccgttctcgccataagacagcttggctaccccatgagaggagcgccatag

SEQ ID NO: 89395 - DNA, 582 bp, Glycine max
  Peptide Sequence Number=SeqID_181080
atggcagaaccatcaaagaagcgaaagggcgttttgacttcatccgcagtcatcggaactcgaagtcacagatcatccaaggtgcatacaacccaaattcctccctccatatcatctcctacgttgttttccttggatgaacaacgtatctggtacaattctctcttttcttctcgttccattatcgaccctaagttcgtagacttagctttctttgatgatgaagtgtttgattgctttcaagcatttcaaaattctggtttaattcagtttatctccatgaaacttcctttttaccctgaattggttaaagccttgtattctaacttggaaattcaagaagattccttgatttccgaagtttatgggattaagatggtcatagaccagtcccttctctttgaactcactcaattatccagtgatggtgtaccatttgagggtacacttgatgatgagtggaagttcgatttttctgtttctgatgctcgccggatggtttgcaccaaccaagcggatatgaccgaaaggcttctttccggttcactggcattcgaatgccgcatcattcactacttgatt

SEQ ID NO: 89396 - DNA, 243 bp, Glycine max
  Peptide Sequence Number=SeqID_181081
atggttttcggagcttctgtggcttccgtaaaatttccgaaaaccttgggtaagcatattccacttaacattggtgaaagggaagagaaaaaagatgaaaatcaaatccaaaacacttccgggaggggggagctgtttcaaaatgttcaagaccccttggctatgcatttcggctattttgggcaaaaaacacgttttcgtgaagaaaaatcgagtcgaagtgcttccgttacgcttccgtaa

SEQ ID NO: 89397 - DNA, 180 bp, Glycine max
  Peptide Sequence Number=SeqID_181082
atggatggctcaaattctcacaaagattctaaaatgacaatcacccataaacacaagcacatgaggatcaaaaggtcttttaaggttgtaatggggccaaggacaaggtatggaaaaatatggaataagtggctaaatcccaaaggaatagaggagcaaaggggaataagtgcatattaa

SEQ ID NO: 89398 - DNA, 724 bp, Glycine max
  Peptide Sequence Number=SeqID_181083
acatttgcttctacaagacaaagagcttaggggcatccgtaatggcgtcatcggtggttatcatggatggctaagagttcatacgcgagggttagattggctctctaagttgaaagttatcaatgaggagaacttcgaagttccggaggaagatgaagaagtccaagctctaaaattagagctagggaaggcaagactcgccaaagaaaagttcaagtcagccgctacaaacatccggaaagagtgcaccaagttacgaaaggaaaacgcggccactgcaagagcccttgaacaagaaaccaaaagggcccgcaaagaggaacatggtcgagataaattccgaggagctttgtggggtagcaacaatgagctcaagctccgaagagaggaaagagaccagtcatgggtacatggcatgattttaaaggaagaattagctacttttgcaagatccaagaggagtttggctcaacatttggaagccacgaagcaaagcatgctagctatcatagggcagtacaaggaagagttaaaccagcctgtgacccatgaacaaaacctagtagaagatttcgcacaagtgtacaccgaaaaggaagcaagagggagagtgattgatgcattgcatcaagaagcgactatgtggatggataggtttgccttgaccttgaatggaagtcaagacgtcccacgactactagccaaagcaaaagccatcgctgaa

SEQ ID NO: 89399 - DNA, 828 bp, Glycine max
  Peptide Sequence Number=SeqID_181084
atgcttccatttgatttccggtgtgtcacggaaacttacggattgtgcatcaatattttttggttttccggcatgtcctggaatttcacaaattgcctaatgatggatgccaagcacctcacaaggaccaaagaaaggtcgcatgtcatcaagcaaaggtccccggacgaaattaggggtaaatttgacatccctgaaggaacagctacgaagaagaaggtcatgtccacggttgcgactagatggaagcaatttaagtcatccctcaccactagatatgtatatgctgataaagatggtgaagataaccatgatctatctgctaagtatggtttggatcgagaaacatgggaacaatttgcaaagagtcgacaaacccctagttggcagggaatacggaaaaaagctcaggaaatacaaaaatttaatgactctcctcacttactatcttgtagagggtacgatcttcttgaaaaaaagttgttggctgagaaaacgaaggcaagaggtcatcaagcggactatactgaaaatacagctatggtcgtagaccctccattccctattgcaagacatgtgaagtggaagatggctagaacaaaggcgtatggccaaatgacatctacaacagctaaaggaatttctgaaaaatttggctccaacacttctttggcggtgatcaccccagatcaattagtggaaatcataggaaatctaaagcaagagtggaggaaagaggtagaagatgaaaatagaaggactatggacataatgaaaaaagagttggacgcgatcaagattgagttatcccaaatgcaaacgcaatag

SEQ ID NO: 89400 - DNA, 398 bp, Glycine max
  Peptide Sequence Number=SeqID_181085
atgccgattccgaggttgagcaacccacctaaccatgtacatggtgagcaagtagttgtagggtggccttcttgcctctccaaggttgttggggaagctattaatggattggtccctacaacagctgacacttttcacaaacttaataaggctgtagttggtgtaatcgctggtgttttggctcagcatccttccaaaagagtttctttcacaagagatgggaaatttgcagcaatatgcacaaggcgtgattgcatggactacataaatctgttatattgtcacacatgggaaatcatgggcaattttgcagtcgacactctacacttagctgatatcaaatggtcacctggtgatagtgctatagtgctaagggattcacttaccttcattacaag

SEQ ID NO: 89401 - DNA, 399 bp, Glycine max
  Peptide Sequence Number=SeqID_181086
atggcatctagcagaggtgggaatggaagagggataggaggttgcaactctgaatggaggctcttgtctcttgctgaaattgcatattctggatggtcatttgcctcactaactcttcaaaggaaggttgaggaggggcctcagttgcttgttgtctttgtttttgctgctgctgtattggaggaggaacatatggcttgcttggaccagcagcattctagaaaggaggcacaagttgttgttgttgtggaggacttgcccatctcagatttggatgattcctccaacttggattgtatctgttgcatgaaagatcataattattctgttgttgttggttttgctgttgagggggtctattataaatgtttgcaacataagtttcaggttgctcattga

SEQ ID NO: 89402 - DNA, 180 bp, Glycine max
  Peptide Sequence Number=SeqID_181087
atggtggttccaaaggttcctctcggtgtggggtttcaacggagaactacgacggttcgtggtggctactggtggttgtgggtggtgaagaagaagcttgggacgttggggaagggttttggaagaaagaaggagaaaggaatggttgttttccaaggctacacgaaaaataagacttga

SEQ ID NO: 89403 - DNA, 357 bp, Glycine max
  Peptide Sequence Number=SeqID_181088
atggcaggagctagtgatggtagtggtgattatcatcaattggacggatcccaatgtttgttattggacgtaatgactacacagatgcaacgattgttgaaccgtaacaatgaagagctctatggacgaattgagggtctggagaaccaactgaatcagaatactggaagacattatggtgggaacagagtggacaatgttggacccaagcaaaacagagtggaggggcagaacaggattgagggagtaaaactcaatgtaccccctttcaaaggcaggagtgacccagacgcctaccttgattgggagatgaagattgaacatatattctcttgcaatgattatactgaagaatag

SEQ ID NO: 89404 - DNA, 237 bp, Glycine max
  Peptide Sequence Number=SeqID_181089
atggatgtcattggagggagagagcatccttcagcaaaatacgcaggaggtacaactattagatacaaaacatccacttcaatagaggatggtgaggatgagttttctaaggatatgatgcaatcctacccctcaagggcattggatagaagactccaagaagattgggccagagatgcaagagaaggccctaagattctcatgagccctatggtagattttgggcccatggactaa

SEQ ID NO: 89405 - DNA, 432 bp, Glycine max
  Peptide Sequence Number=SeqID_181090
atggagaagatgaatatgcacataataacagaggggacccctaaggtgcctcaacttcacttttcttccttcttcctcttatttctctcattctccttctttttcccaacctctgaacccttaaacccctcccctagcatcgctatttatagggaaaagtcattttggggcaggcgaagctcacccaggcgagctggttgcttaggcatgaagccatttcatggcccaggcgagccagatgctagcctgggcgagctagggtctagaaaaatccaaaaaagacccgtttgcccccttccttggtatctttttgttttcttgatcaaaacaccgagcgattccttgcttcgcactgtaactgacaccaaatatcataattcgactagcaagaatcaaaatattatatcgaacgatattccccggacgaaataa

SEQ ID NO: 89406 - DNA, 303 bp, Glycine max
  Peptide Sequence Number=SeqID_181091
atgtcctcatctacatttcgaagacggcaatgccttcagtcattgcatgccttcaaaaggcgacaatgtcttcatttacattttgaagacgacaatgtctttagtcattgcatgccttcaaaggtgacaatgtcctcatctacatttcaaagacgacaatgtcttcagtcattgcatgccttcaaaaggcgacaatgtcttcatttgcatttcgaagacgacaatgtcttcacctcaaaaatttcaatatctttttccaatgtgcttcgtaggactcgacgtcctatgtttgtacgcttttaa

SEQ ID NO: 89407 - DNA, 198 bp, Glycine max
  Peptide Sequence Number=SeqID_181092
atgaaactggatgaggagttaaaagtgtgtcctggtctccttgtggaagtagatgagccactacaacttcatatatcagtcagatatgaggttatggaagttcctatcaatttaccattccaaaagcctcctgctgagaaacctaaccccaaacaaggaatcagtaagctacacgtctctaattttcaaatgccataa

SEQ ID NO: 89408 - DNA, 426 bp, Glycine max
  Peptide Sequence Number=SeqID_181093
atgagtgagatagaggaggtgcaagagcagatgaaggctaacatggaagccattaaagagaaaatgaccacaatgatggaagccatgatgagtatgagaaaaatgatggaggtcaatactgctacagttgttgccacaagtaccgccacagaggtggacccgactcacccacctggtttcaatcaagtaaatcgtcctacctcggatatggtaggtcagggaggcaaagtgttgggaagtgcggcattccttccccccatgtggattgcctcccaacttacaccacccaatgttgtacacgctcccgatgagaatgtcgacaactacgcacccgtacccattaaaagccaacaaccccaatctgatcatgcacatgtctctcaacccatgggggagacaatgaagtaccccgaggccacactctag

SEQ ID NO: 89409 - DNA, 303 bp, Glycine max
  Peptide Sequence Number=SeqID_181094
atggaacttatgagactccatcaacatgaagagaatgataaaaaaaggagaggaataacacttaaagcctcatcatcttttattcaagaagaaagtgacaaagaggacttgactgaaatagaagaagatgatgatttcagtggttgctccaaacacatggcgggagatgcatctaagattattcatatttctcccaaagatagtgaatatgtgatctatggagacaacaaactaaggccacttgatcaacaagcccaacaagtggtatcaaatgataccaaaaggtcacttgtctttgattga

SEQ ID NO: 89410 - DNA, 585 bp, Glycine max
  Peptide Sequence Number=SeqID_181095
atggatgaagctgctggggtagatgggcctggaggtgctggtgctagggtagcagatgtggatggagctggtggagtagaaaaagaaggaacatcaactggtcttgtccttgccttccttgcccctctaaaattaactgctctcctagatcaaactatcagaagtaactcctctagctctgcagagagtagtaatcaaggttggaaatctgagcctagaggagttactttgagcaatagaagaaatttgacccgagacaagggcgccaatgttcatacccatatgggttaccaagccgttggagtaagatgggacactccaagtctgggccaatgtgtcctttctgaggagcttccatggattggacctcaacctacagaatctagagtaggcggggttatacaagttggcataaaattctttgacaatcgccacatcaatgcttccctcctggaggatattctagccgagaatgttatctgtgtatctgttccaggcttccaaggaatggaatcgcttggtgtcatattgagcttgtggcctagaaactgtgctttttctctttctggatgccatctacaatga

SEQ ID NO: 89411 - DNA, 966 bp, Glycine max
  Peptide Sequence Number=SeqID_181096
atggttgaggttgatttcagtatagcacttgagaataatgatgaaactagatctatgactgccggaccaaatcagcaaatgtcgtcaccagatctgctactaggcggttgtggtgggagttattgttggtgcgaagtcggatcttgctatgacaacagtgctaacagggaaagggggcttggcaaggacgataaacttgattggggaggagtggtcaaaaacatagttgaaggggtgaacactcttcatggcaggtacgaggaactttgttgtgttctttgggtccacgaacactttatttctgatggctatggtttcaattttcatggcgaggtagtagctaaagatgttggcttggacccacgtgtcagtgaaggactgttccgtggtgcttcacacaattcaacccctgagtctttagaagctccaccactttcgccgatgattaagaatccaaaaatcttttgggtaccggctatagctccaatggctcgtcaagggccaacatcaatcatggaattcaaatattatgcaagttgttcttgttacaagcatgttgtcattagcggaatagctataggaagaagctttgctcttactgataatacactgcacgatgggaacaaagaaatgatcgctttcagccttattatgaacttgttcggttcatttacttcatgttacttgacttgtgcatcctcaccgcactggtggagaatgaccacgcttccccgaatggctcacacttcttccaccataaaccctcgatttctatctccgtcttcgtctcactctcctcgtcctcctcctcctccttctccaccaccatgcacctcattccgacaatgccgaagccctaccggagcggactccctcctcctcctccctcgagttctgctagtccatgccggtgaatgtgccgcttataccgatgagaagacaccaccaccgtcgcttacgtcctaa

SEQ ID NO: 89412 - DNA, 207 bp, Glycine max
  Peptide Sequence Number=SeqID_181097
atgaagaacgtcgaagaacggttgaaagctttgcgagattcctcacggaaaaccaaaataggggagatggttgccgcccagctcgcccaggcgagctcagctcgcccaggcgagcatggttgcttcctccagaagcaaccgccttctggaggaatcttctggagggcccaaatgggcctgggtgctattgcacccccattttactaa

SEQ ID NO: 89413 - DNA, 885 bp, Glycine max
  Peptide Sequence Number=SeqID_181098
atggttagaggaactatatgtggagcaattagacataaattgataccgactcctcagaatttggtgacttcaactccattaacaactacttatgaatctttttttggattacatccattatctcaagttttggatcaaactaatccattgacccaaatagttcatgggagaaaattgagttatttgggccctggaggattgacggggcgaactgctagttttcggatacgagatatccaccctagtcactatggacgcatttgtccaattgacacgtcggaaggaatcaatgttggacttattggatctctagcaattcatgcgaggattggtagttgggggtccatagaaagtccattttatgaaatatctgagagatcaaaaagaatacgcatgctttatttatcaccaagtagagatgaatactatatggtagcaacaggaaattctttggcacttaatcgagatattcaggaggaacagactgttccagcccgataccgtcaagaatttcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccatttaactatatatcaaacgttccaacaaaaatacttgtatgcatcaaaaaccccaggttcgccgag

SEQ ID NO: 89414 - DNA, 477 bp, Glycine max
  Peptide Sequence Number=SeqID_181099
atggaaaccatatcgaaacgctttgagcagctcgatgtttgtggtaaagtacatttgaagtcaaagctgcgagaaattgcttatcatgatatgaactccatgtttcctcctccaaaaaagatgaagaccaagggtgctccaaaaaaaccgttgaccaaacaacaaaagttaacaaaacgtgatacgtcttattgggagtatgttgatgcattacactttgtgcaaaatattgcattattgggtatgggtgaagaatcatggtcattggtgcgcaaccatttgcataaagaactgataagctggtccgaagagtatatcaacctggttggtggcatagagagatttgaggaattaaagcattctctacttgttgacggattatctatggttaccatggataaatggatgaatattacggatatgggatatgtcattgcttcacaatacaacgtgatcattatttctctttcacgataa

SEQ ID NO: 89415 - DNA, 114 bp, Glycine max
  Peptide Sequence Number=SeqID_181100
atgacgaacgatagttcgaagatgacaagcaagtttgcgaagttggacaatacaccgatgccggtgtatatggaagatgaaactctagatcaaacaaggaaacgttcgaaatga

SEQ ID NO: 89416 - DNA, 147 bp, Glycine max
  Peptide Sequence Number=SeqID_181101
atgagactatttcgcagtctcggccggaagatgctgacatctcttgggaaggtgcagtctcagccagaagacgctgacgtctccagggaaggtgcagatgacgatgttagtcactgcatgctatcaggctttgagtcttacggatag

SEQ ID NO: 89417 - DNA, 317 bp, Glycine max
  Peptide Sequence Number=SeqID_181102
tctggtgacatgcggggttaccttatggttatccacaactttggtcaaccaggggcaaacgagcccgttgacgcgtggaaactaacattgtcttctaaaccttttgtcgtcctgacccgtgaatcaggtgacatgcggggttaccttatggttatccacaactttcgtcaaccaggggcaaacgagcctgttgacgagcggggactaacatcgtcttctgcaccttttgtcgacctgacccgtgaagtcagggtttcgttatggttacccgcaccttttgtcaaccaggggcaaacgagcccgatgacgcaaggaga

SEQ ID NO: 89418 - DNA, 647 bp, Glycine max
  Peptide Sequence Number=SeqID_181103
ctctcaaaaatgagttaggaaaggcaaaacttgccaaggagaagttcaagttagccgctacacacatctggaaggaatgtgccggattacgggaagagaatgcaactaccgcaagagcccttgagcaagagaccaagagggctcgcaaggaagagtatggccgtaacaaatttcgcggagctctgtggggtagcaacaatgaactcaagctgcgaagggaagagagggaccagtcgcgagcacatagcatggtcttgaaagaggagttagttgcctgttcaagttccaaaaggagcttgtctcagcgtttatgcgagacaaagaccaacatgctagctatcatcaccaagtaccaagaagagttaggtctagccacggcccacgagcatagggtcgcggatgagtatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcggacacctactccgcccccgaagaaattcatgggcttctcggctattgtcagcatatgatagacttaatgacccacataattagaaatcgctag

SEQ ID NO: 89419 - DNA, 793 bp, Glycine max
  Peptide Sequence Number=SeqID_181104
atggcttcccgaattttatgcaaatctatatgtccctaaggacaaagaaccaaagcaagtaagggttcgagggcacctgataaaattttatgctgattccctcaacacctttttggagactctagtggtcgtggagcaaagggggatcttgccctcttactccaagtttgctagattaaggcttgatcctcaagagcttgcagcccggttgtgtctccctgggagaggatttgtacttaatgtcgagggtctgtcatggaagctcttgaggaaagatcttactactctagcccaaacctggagtgttctatcttattctaacttggccccgacatcccatacttctaatcttaatctggatagggacaagttagtctacgggcttgtaataaagatgaacatgaacttaggatcacttatttttggtcagatttcactcattgctcaatccaactcctcgcggcttggatttccagccctgattactgccttgtgcatggcccgaggagtcacctcagattctcttaccttcgagtcactcggcctagccattcatttggcctatattaagaagaattgttggaaccttgatgaccttttgttcacttttccagggacccagaaatctagggctagaagatctgaggccccatctccttcagctgcccctgctccccctacttcggctccctctacttctgctcttccttcaccaccagcaactccagttcttctaggtccctctgctcagaccttagagcctttgatctctttgttgcaaagcctgcattag

SEQ ID NO: 89420 - DNA, 285 bp, Glycine max
  Peptide Sequence Number=SeqID_181105
atggcgactaaaatgaagcgatgcccatttgaagccttgggttcgatggccctgatcacatctatgccccacattcagaatggccaagatgctgccaagatgttcaatggtataggtggagcattaacattatcagtgaagtaccaaggcttaccatcctccccttcttctatcaaacaacaatgtgcaagctcactacgacatctgaattcgatgtacggcaaatctccatgcgggctcactttgaacatggatgccaaagtggcaaaggcgttgaccatttga

SEQ ID NO: 89421 - DNA, 375 bp, Glycine max
  Peptide Sequence Number=SeqID_181106
atgtttgcacattcgattaaaggctgccgtcccttgggacggacatcacgtcttttctggtttttccgacgttttcctcaaataaacgttggtggcgactccgcgcgtattcctttcgtggaacacgcatcccgcgagtcacgcgtcgccctcccgccgaaggactactacttaaaagtagtctttgtcgcaacctacccttcggcgggagggcgacgcgtgactcgcgggatgcgtgttccacgaaaggaatacgcgcagagtcgccaccaacgtttatttgaggaaaacgtcggaaaaaccggaaaagacgcgatctacgaacttttaagtgaaaggttcgggagttgtatttacgcacggggaaggtattag

SEQ ID NO: 89422 - DNA, 312 bp, Glycine max
  Peptide Sequence Number=SeqID_181107
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggcttgggaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctag

SEQ ID NO: 89423 - DNA, 56 bp, Glycine max
  Peptide Sequence Number=SeqID_181108
gaaccatgtgttgaaggacgtcgggacacaacgctctgataggatgtggcattggg

SEQ ID NO: 89424 - DNA, 177 bp, Glycine max
  Peptide Sequence Number=SeqID_181109
atggaatacgattcgctttcaagatgccttggtggtgaaatggtagacacgcgagactcaaaatctcgtgctaaagagcgtggagttaaacccaatgattcgttattggagcagatagcaacaaccatctcatctgggaaaagccatctttttctcaacaatgtctttgtcatttga

SEQ ID NO: 89425 - DNA, 474 bp, Glycine max
  Peptide Sequence Number=SeqID_181110
ttaccctcaccgttgagaggactacacgtcctcgccttgagaggactacacgtcctcaccatcagagggctgcacgccctacctctcagaggactacatgtcctcgccttgagaggctacacgccctcaccttgggtactagttaccctcaccgttgagaggactacacgtcctcgccttagaggactacacgtcctcaccatcagagggctgcatgccctcacctccagaggactacatgtcctcgccttgagagggctacacgccctcaccttgggtactagttaccctcaccgtcagaggactacacgtcctcgccttgagaggactacacgtcctcaccaccagagggctgcacgccctcacttccagaggactataagtcctcgccttgagagggctacacgccctcacctttgggtactagttacctttcaccttcagaggactacaacgtccctcgcctttcaaagg

SEQ ID NO: 89426 - DNA, 234 bp, Glycine max
  Peptide Sequence Number=SeqID_181111
atggtaatgacaccaaccacaaaaaatcatcaaagaacaacaaccaggtcaaggaggagacctccaacaagcaccattatagctttcggtgggacccttaatcataatcaaatgaccagagctgtggcaactcaggaaccggatcgaagaagaggaagtcttattgggttgatgacaaccctaatattcggtgattcaggtttgcccttagatgatcgacctgaaggtgcttga

SEQ ID NO: 89427 - DNA, 2125 bp, Glycine max
  Peptide Sequence Number=SeqID_181112
gggacatcggcctgctcggctcgctgttttacctgagctacggcctgtcgaaattcgccgccgggctgtggcacgacggccacgggcagcgcaggtttatggggatcggcctgttcgccaccggcttgctgaacgtggcgttcgccttcggcgaatcgctgacgctgctgctggcggtctgggcgctgaacggcttctttcagggctggggctggccgccctgcgcgcggctgctgacccactggtattcgcgcaacgagcgcggcttctggtggggctgctggaatatgtcgatcaacctcggcggcgcgatcgtgccgctgatcagcgccttcgccgcccagcgctggggctggcaggcggcgatgctgatcccgggcgccgtcagcatggtgttgggcatctggctcacgcggcggctgacgggcacgccgcaggaagaaggcctgccgtcggtcggccggtggcgccacgatccgctggagctgcgccaggaacagcaaagcccgccgatggggctgtggcagatgttgcgcaccacgatgctgaagaacccgatgatctggctgctcggcgtctcttacgtgctggtctacctgatccgcatcgcgttgaacgactggggcaatctctggctgacggaaagccacggcgtcaacctgctcagcgccaacgccacggtgatgctgttcgaggtaggcggcctgctcggcgcgctgttcgccggctggggctcggatttgctgttcggcgggcagcgcgcgccgatgattttgctgttcacgctcgggctgatggtttccgtcgccgcgctgtggctggcgccggtgcatcactacgcgctgctggcgggctgtttctttacggtgggcttttttgtcttcggcccacagatgctgattggcctcgccgccgtggaatgcgggcacaaaggcgcagcgggctccatcaccggttttctcggcctgttcgcttacctgggggccgcgctggcgggctggccgctgtcgcagatcatcgaaggctacggctggtcaggcatgttcagtttgctgtcgatcgccgccgttcttatgggtttattgctgatgccgctgctgatggcgagcgttaccacctctaccgagagaaggataaaacaatgaaaaaaaccttagtcactaccctgatagcttccggcatcgcgctggccacgctgagcggcgccgcgcacgccaagggccgcctggtggtctactgcagcgccaccaatgaaatgtgcgaagcggaaaccaaagccttcggcgagaaatatgacgtgaaaacctcgttcatccgcaacggctccggcagcacgctggctaaagtggacgccgagaagaaaaacccgcatgcggacgtctggtacggcggcacgctcgatccgcaatcccaggccggtgatgccacaattccgcgatccggcgaagctgagaggcactactcctcggcggtctacgtcggcattctcggctttggcgtcaatacccagcacctgaaagagaaaaacctgccggtgcccaagtgctggaaagacctgaccaagccggaatacaaaggcgagattcaaatcgccgatccgcagagctccggcaccgcctacaccgcgctggcgacctttgcccagctgtggggagacgatcaggcgttcgattacctcaagcagctgaacgccaacgtctcgcagtacaccaaatccggcattgccccggcgcgcaacgccgcccgcggcgaaacggcaatcggcatcggtttcctgcatgactactcgctcgaaaaggaacagggcgcgccgcttgagctgatctcgccttgtgaaggcaccggctacgaaatcggcggcgtcagtatcctcaaaggcgcgcgcaacctcgacaacgccaagctgttcgtggattgggtgctgtcgaaagaggcgcaggaactggcatggcagaaaggcaagtcctatcagatcctgaccaataccaccgccgctacctcgccgaactcgctgaagctcgacgatctgaagctgatcaactacgacatggacaaatacggctcgaccgaggtccgcaaggcgctgatcaataaatgggtcagcgaagtcaagatgggtaaataa

SEQ ID NO: 89428 - DNA, 556 bp, Glycine max
  Peptide Sequence Number=SeqID_181113
ttggacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccggtgcgtcagcagaatatgtgatacaggatatattccgcttcctcgctcactga

SEQ ID NO: 89429 - DNA, 214 bp, Glycine max
  Peptide Sequence Number=SeqID_181114
ccctctgatggtgaggacgtgtagtcctctcaaggcgaggacgtgtagtcctctggaggtgagggcgtgcagccctctggtggtgaggacgtatagtcctctcaacggtgagggtgataggtacaagtacccaagggtccacccttatgagaaagcaagagatcgacttatcgagagggctggtcatcccaaatccacaagatttggacattag

SEQ ID NO: 89430 - DNA, 465 bp, Glycine max
  Peptide Sequence Number=SeqID_181115
tccagagacgggtgactcagacaaatgcgggttgtacatcgaagaaaattcttcccacctggttgctctaggaagagtttatgagggatccacatcggttcacaacatccctttgttgcatggccaagtgaaggttggtgttgaggaagttaaagatgcagaggctcccattcctgtacctactgacgaggttattttagtggggcaggcacttaacaccttccttgattggccaacacatctcgtgaagcctttatcagaacagcctctccaggttatgtgggatgctaccgtgttcggggtgtttaatcaaaacttctcgttgtacataaagcacgaagatctctctaaaattgcacatggtgaaagttacatgaagagttggatgcagagttcaaaatgtgatgtctaccttggagcctacctgaatgggccagacagctaccttaaaggaataattaacag

SEQ ID NO: 89431 - DNA, 189 bp, Glycine max
  Peptide Sequence Number=SeqID_181116
atgcccactgatgccatgatcaaaatcaatctcccagcattcagggaaatgcttgtaggcctaggatcttcttcatcaatggattcctttgcttctaggaagatgaatggcagtggaatgaagaaggaagagagagaacagatgccatttcaaggagaagatgagtctagaagaagctcactgccatag

SEQ ID NO: 89432 - DNA, 1101 bp, Glycine max
  Peptide Sequence Number=SeqID_181117
atggcatccttcagccagatgcagtccaagtttcagtctcagatgcaattacaggaacttgcaccgcctccggagccagaggttggtccctcaggtgctcgtgtcagcacaaaggagagttgtgttgctccctcagggaacgatccagggacgggtgactcagacaaatgcaggctatacattgaagaaaatccttcctgcctggttgccctgggaagactttatgagggatccacaacagttcacaacatccctttgttgcatggccaagtcaacgttggtgttgaggaggttaaagatgcagaggctctcgttcctgtacccactgacgatgttaccttagtggggcaggcacttaacaccttccttgcttggccgacacatcttgaagctgtgtctccagcaaaacctccagaaagcccggatgatgaggtcgatgatcccctgtacctgatgacattggccatcccacaactatttttgaagcctctccaggttatgtgggatgctaccatattcggggtgtttaatcaaaacttcccgttgtacataaagcacgaagatctctctaacattgcacacggtggtcaatgtctcaacatatctgttatacaattgtggattctacactggcaaatggtcgtcattccgcctaaggaaaacctagttgtctggttttgttctttacataacaggccaaacaactaccttgagggaataattaacattgctttgaaaggacttgatgatactccacaacctaaatccaaggctgctgctaggtggattgttgttaaggaacccgtcatagccactagcggcaagggtgaacccgccatagccactggcggcaaggatgaacctgctagtgccaatggcgttataggccacgtaggagggaaagaggagagtgtcgccaatgcgaatggcgacacacctcctgtgccagttggaactgccaggcctgatggcgatacaggccacgtgggactcgcccacagtgacggcgagataggccacgtgggactcacccacagtgctggcgagacaggccattcacgtgaagctctaggggtcacaggctgggtcacaggcttgtag

SEQ ID NO: 89433 - DNA, 743 bp, Glycine max
  Peptide Sequence Number=SeqID_181118
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgggctggaaaatccaagatcaggcagccacatctggtaggcttccgggtgagaaggcaggaggctgccacttcagttttctcttccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 89434 - DNA, 174 bp, Glycine max
  Peptide Sequence Number=SeqID_181119
ctgaaaggtgctgccttgcgatggaaggctaagtatctctattgggaaattctggtgaaacttgatgctaagttcaacgagacatctgagaacgagggtttaattagaattagtccattcatgcaaggaatcggtgtttggtattttagtcctcagcatagaacacaaaaataa

SEQ ID NO: 89435 - DNA, 583 bp, Glycine max
  Peptide Sequence Number=SeqID_181120
ctcacagtcgtccttgcccactgtgaacccaacccctgacccagccgccccagcagagcctcaagcccctgaccctgacctttcccttcctttactggatgacaacgctcgtcgcgccgaactaaatgagcgcgggggggttcttcattttggggacttgtcggatcagcagaaaagacaaagtgctagacgcacaacgggggtatcctcaaataataacgaggcccgtcccagaaatggggcggggaaggagaagtgggcatgtgggtctccttcacttgactatttaggatatcttggttttggaaaactggttaaaaagacgaatgctcctccatctgtggaatcggagagatctttgaacagcagaaaagacggatctcagaacatagccatagttacggtttcagggcttagagagactggactggacgcgtaccgaacgaagatcgtgtctatttacgctcaaacaatccatataggtggaaagctggaagcttcaatagttccccgcgggaccttagagtgctatgatggggtatttcagttcgtccttacgagtccattcgaccatagcgtgatg

SEQ ID NO: 89436 - DNA, 393 bp, Glycine max
  Peptide Sequence Number=SeqID_181121
atgcttccttttgacttctggcatgtcatggaacttcacggattgtctaacgatgggtatcaagtaactcgaagtggtcaaacgagggtcgcatcccaacaaacagatggtccccggatgaaattagggcatcaaaagcgtgcggatgaccataatttgtctccgcgtatcatcgagcacaatcgcctctggatgacaaaagggtgcagaatgaccataatttgtctctgcgtgccattggacacgtttgtatctgaatggcgaaaaggtgagcggaatgaccataatttgtctccgcctgtcatcgggcacgatcgcctctggatgacaaaagggcgcagaatggccataatttgtctctgcgtgccatcagacacatttgtgtctaaatga

SEQ ID NO: 89437 - DNA, 315 bp, Glycine max
  Peptide Sequence Number=SeqID_181122
atggtcttggaagtccaaactcaggagcacaggtcgattgagcaaacagaccaatggcttgcacccacattccggatttacacacgattctcctcaaatttcagccaacatcaattagaccttgccccttacgcttcagagcccgacaatgctcaatggaacgccccggggcttctccatgacaagcacacgttgcgttcgagtcgtattctcagagaaatggaggttgatgaaccttggctagggttatggctaccattgaattatcaagtagatatgggagcaagtcagcctaggatactggaattggggtga

SEQ ID NO: 89438 - DNA, 746 bp, Glycine max
  Peptide Sequence Number=SeqID_181123
agctgtagctatgagtgcgacagaaggtctaatgagaggaatggaagtgattgacacaggagctgccctaagtgttccagtaggtggagcaactctaggacgaattttcaacgtgcttggagagcccattgataatttaggtcctctccttatcgtcgtggaggaaaaaataggacttttcggtggagctggagtgggtaaaacggtactgattatggaattgatcaataacattgccaaagctcatggaggtgtatctgtatttggcggagtaggtgaacgtactcgtgagggaaatgatctttatatggaaatgaaagaatctggagtaattaatgaacaaaatattgcagaatcaaaagtagctctagtatatggtcaaatgaatgaaccgcccggagctcgtatgagagttggtttaactgccctgactatggcggaatattttcgagatgtcaatgaacaagatgtacttctatttatcgacaatatctttcgcttcgtccaagcaggatctgaagtatctgccttattgggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaag

SEQ ID NO: 89439 - DNA, 219 bp, Glycine max
  Peptide Sequence Number=SeqID_181124
atgtcggctttgaaagaacaaatggcttccatgatggatgccatgctgggaatgaaacaactaatggagagtaacacagccaccgccgccgctgttagttcggctgtcgaggcagacccgactctcccgactactgcgcaccaccctattccaaacatggtgggacgagagagaagcacaccggggcacatcagcaacccttatccgagatacaactga

SEQ ID NO: 89440 - DNA, 342 bp, Glycine max
  Peptide Sequence Number=SeqID_181125
atgcctcaaaatgttctttacgatgcattgggatatatcaacggtgttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 89441 - DNA, 522 bp, Glycine max
  Peptide Sequence Number=SeqID_181126
gatcacgcccgcaagacacccagtggacccgaagaatttcaacagggtcctggggttctagctctgattacgggcctctatcggttctacggagtgtccttcacccccaacaaggtcatcaggccccctattaaccgagctttcatcacgaagtattgtgcccccaggcaggcacagggcgaggcaccacgacagcctggggacagccagcagctggcggcagactcatcgccaccacctttggaatccacctcaactcatctacaagggctagagcattgcctacgatacatggttgaccagcaggcacccaaccaccgggacaggtacgagcagctccccgcaaagaagtccaggaagggcaccattgaaaaggattgcaatgtggccccacaagccaacacaggatggtcattcctcagacagagacagacgcaactgagggatgatgaatttccgcacttccttggaggaggcggagccattcaaaaagatgtgatctcgggcatcagctgtgcccag

SEQ ID NO: 89442 - DNA, 662 bp, Glycine max
  Peptide Sequence Number=SeqID_181127
gtaacccttgtggcgtctacccagacttatcttcctttaccggaagtggcgtctacccagacttatcttccttcattggaagtggcgtctacccagacttatcttccttaaccggaagtggcgtctacccagacttatcttccttaaccggaagtggagtctacccagacttatcttccttcattggaagtggcgtctaccctgacttatcttccttcacgggaagtggcgtcatccaaatctctgtaacctgtatcaaacgatccgctcctactcagacttatcaaggtaacccttgtggcgtctacccagacttatcttcctttaccggaagtggcgtctacccagacttatcttccttcattggaagtggcgtctacccagacttatcttccttaaccggaagtggcgtctacccagacttatcttccttcattggaagtggcgtctacccagacttatcttccttcactggaagtggcgtctaccatgacttatcttccttcactggaagtggcgtcatccaaaccttcgtagcctgtatcaaacgatccgccccgttcctggttgaaccaattatcagacttatcaaggtaatccttgtggcgtctatcctgacttatcttccttcactggaagtggcgtcatccaaatatccgtag

SEQ ID NO: 89443 - DNA, 396 bp, Glycine max
  Peptide Sequence Number=SeqID_181128
atgatgagaatcatgaaactggccaaatacaggctaaaggcccaagtggagaaggacaaagcccccgagtggagaaggatgaaggcccaagtggagaaggatgaaggcccagaggcagagacactatcaagactattaattgttgctgaaggcccaagtaatccttgtggcgtctaccctgacttatcttccttcactggaagtgacgtctacccagacttatcttccttcaccggaagtggcgtctacccagacttatcttccttcaccggaagtggcgtctaccctgacttatcttccttcactggaagtggcgtctaccatgacttatcttccttcactggaagtggcgtcatccaaaccttcgtagcctgtatcaaacgatccgccccgtaa

SEQ ID NO: 89444 - DNA, 930 bp, Glycine max
  Peptide Sequence Number=SeqID_181129
atggcaagagtagcaaaagtggtcaagatctcgacacaagaattaggtcgagtgaaacaaaatagaaatggggtggttggaataccaaggaagtgcttagaagagaaggcaaaagctttggcaaatgaaggtgggtggacttcattcatttatgttttagcactgttggtgtttaggatcatcctctttccaaatgtagatggactagtggatctggcggtgatcaatgcttttcttgcttatcatcacagcaaggaaagcccgatcgttgttgttttggtcgatgcctatgacacgttcgaccggagatgcgagaagagcagcacgagaattgtctgttgcacacccactttttatgtatggctggtctcccacatttttcgtcatgaaagtatacccatctgtcccctacaaggtcatcacatgtgtgccaagaaagggaaagcaaattgggaagaactcttggcagtgaaagcaatgccaaaatgctttagagtctggaaagcgtggaatgcaatggaaagaaaagatgaagagcttagaggaagcagcaacggtgttatcgacgactatcataaatggttgaaggctcggacgcaagggataacttggctctcgaagctaaagatttctagcggggaagaagctgaagtccctgaggagagagaagaagtgcaagccttgaaagtgaaacttgaaagaacgcgagtggtcaaggaaaagttcaagatgacagccatcagggtctggaaagactgtaaggagctgagggatgtcaacatggtcgcgaccgaagcattagagcgagaaacgaagagggcccgaaaagaagaatggggccaaaacaagttccgaggggctttatgggcagcaacagtgaactcaagcttcgaagggataaaagggacaagtcgagggtggaaagtatga

SEQ ID NO: 89445 - DNA, 264 bp, Glycine max
  Peptide Sequence Number=SeqID_181130
atggggctcgaaatctaccctaaggctcatgagaaccctagggctttcccttggatctcttgcccaatctacttggagtcttctatccaatgcccttgcgggataggattgcatcgttccctccaccttggaaaggatttgacctcaaatcccgaggttcttcatactttgggctccttccctcaacaccttaaggtaaggtctgaaaacccatttcctgggcatcttcccctgaaggaacatggtttctcaccaactcaatga

SEQ ID NO: 89446 - DNA, 897 bp, Glycine max
  Peptide Sequence Number=SeqID_181131
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatgggaaagacgtatattccttgctaattatcagacaattacttattcacaaaccttgcgggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcggtcttttagtgaactatctctccagggattgtgaaagatgttctactagaaatattcttgttattgcttcgactcatattccccaaaaagtagatccggctctaatagctccgaataaattaaatacatgcattaagatacgaaggcttcttatttcacaacaacgaaaacactttttcactctttcatatactaggggatttcacttgggtgggatcctctag

SEQ ID NO: 89447 - DNA, 231 bp, Glycine max
  Peptide Sequence Number=SeqID_181132
atgaaagagagggaggaactggtgtgggtgggtctccagaggttcctcagcggcggtggccaacagcggtggtggtggaggaagatccctttcacttctttaatgattctcccatttgaaggtgtttcagctgattttgatcggtgggtttggaaaagaattgaaaaagatgaagattgggctttgtttgaagcgatctggttacgaaatgagagagataccaagatttga

SEQ ID NO: 89448 - DNA, 264 bp, Glycine max
  Peptide Sequence Number=SeqID_181133
atggaacttcaacgtctcaaccaaaatgaagagaccaacaaaaggaaaagaagcatagcactaaaagcctcatcctcaatgcaagaagaagaagaagaagaatctgatgatgaagaggacttctcactctttgtgaagaagtttcataaattcgtcaaaaatagaagaatggagagaagccataacttcaacaatgggaagagatctcaagaagtttctccaacatttaaatgttgttggatcaaatggcttcagaataattaa

SEQ ID NO: 89449 - DNA, 219 bp, Glycine max
  Peptide Sequence Number=SeqID_181134
atgcttacccaaggttttcggaaattttacggaagtattacggaagccacggaagccgcggaagccccgaaaaccatttttcaaaaacgtggaggagcttgccgcccagttgcttcctccttaagcaacccaacttccaaaatgttccggatggacctagatttgaattgctatttacacccctatcttgataagttcaccccctaccttttttggtga

SEQ ID NO: 89450 - DNA, 270 bp, Glycine max
  Peptide Sequence Number=SeqID_181135
gtgatgtaatccagtcatatgctcaggctatgtcttctctagatcctagaattgaacctttgttggtgcaagttgggttttcagatgttgtaaagcttagacaagttaaaattgacaatggtttagtgattgctttggttggaaggtggagacctgagtcaaacacctttcatcttcttgttaatgaatgcacaatcaccttggaagatgttgctcttcaactgggtttacacattgatggaagaccagttactgacccaacatattatg

SEQ ID NO: 89451 - DNA, 645 bp, Glycine max
  Peptide Sequence Number=SeqID_181136
atggttgctttgttttctcctactgtgttctcaaccaagggatggctcttagaggaggagccattaagctatgatgtgtcctcaaagaactcatttccctatcaattttattcactacagacacagattgaggttgaaatagaaaggtcaactgcaccatcccctgatgaccctgccatggtcaagaagcttagccacaacgctagtgaacgtgatcgccgcaagaaggtcaataatctggtttcttcacttcgtttacttcttccagtggaagatcaaacgaaaaaaatgagtattccggcgacagtttcgcgagtcttaaaatacatacctgagttgcaacaccaagtgcaagcactaaataagaaaaaagaggagcttctgtgcagaatttcaaaaaatctcaaaggagattcagtgaacaaagaatctcaaaggagaatttcccaccacaattctgattttgttgtttcgactagtaggctcaacgattgtgaagctgttgttcacatttctttttatgaggctcacaaggttccactatccgagatcttgcactgtttagaaaataatggccttcttctgctaaatgcttcttcctctgaaacctttggtggaaggttcttctacatcttgcatttccag

SEQ ID NO: 89452 - DNA, 285 bp, Glycine max
  Peptide Sequence Number=SeqID_181137
atgatgatagacaatggccaggcagcatctccaaccatatggcgccagctcagcaagtaccaactaattctattaggcaaaatccctgaggtgtcttggtggaatgatcttcctcttgggtctctcattcgagcttgtggtgggattctgctgcatcttctccttcctatcatcccttatgccatccaaaaacacattgtcctcaagatgggtgtgggcatggtaatgaagggaaaaggtcttgtggagggtagtataaatgcaggggtggttggtggtggatag

SEQ ID NO: 89453 - DNA, 1275 bp, Glycine max
  Peptide Sequence Number=SeqID_181138
atgggttgctcagcctcaagaaccatcaccatagtggccaacaacaataaccaattagaggatccatcttctgcttctcttgcttcttctttctcttcctcttctgcctcacacaaatccattaactctacttcttcaccagcagcagcaccagttagaagaagagctctttctctcccaatgcctcttgttcatcaccctcccataaaaaagggtgacacacaccaccttgtctccctcacctccaccacctatggctcccttctcctcattgaccaaaaagacccaaacttgacccaaaaaaaccaaccccgcctcaccaaaacctcaaaccaaactgacccagcacactcactctccccagactcagtcatcaacacttgggaactcatggatggcttagatgaagaagaagaagaagaagaagaagaaattgccaatgccaagaagaagcctccttacacttccattttggacaaaccaagttcatgcaggtacacagcatttgatggttctgcaaggaagaaactgcttgattcctttgaatcactgaaaacttcacagacagcaatggaaaaggaaaactcttcttcttctccagcaccaaccaagaagccactttggcagcacttatccgaggaagctttgcttgctaagttggatccgagtgtggcttggagttacagaagagcattatcatcaaggaatctaggtagaaacaccttatctagagatgtaaggtcaatggggtctagccctttgatatttcattcttcttctttttcatttggtaagaacaatagtttgtgccgtttgtctggcactgaggacagaatagtgctttattgcactagtttgagagggatccgaaagacctatgaggattgttgttcggttaggatgattctgaggggcttcagggttgcggttgatgagagggacatctcaatggactcgtcctataggaaggagttgaaggatgctcttggtggaaaagcagtgacattgccacaggtctttatcagagggaggtatgtggggaatgctgagcaaatgaagcatctgaatgagtctggagaattggcaaggcttttggagggtttccccactcaggatcctgggtttgtgtgtgacaactgtggtgatgccaggtttgtgccatgccccaattgcaatggtagcaggaaggtgtttgagcatgaggaaggagggttgagaaggtgccctgattgcaatgagaatggcttgataagatgtccaggttgctgcccatga

SEQ ID NO: 89454 - DNA, 326 bp, Glycine max
  Peptide Sequence Number=SeqID_181139
atggtgccacctgatgcagcaaagggttctattgggtccgcacccatgcttcaaagaaaagggaaaattcatgatccacgccctcacccattcaagaaccagattcatgtggagaaaatgattcttgggtcaatgctcccacccatcgacgttttcttcattgccacccccacaccctgtggtttaattggaatcttcgtcaggaaaaggactattcctgccatagatgtagtagtggcttctatttacttgatttggatgccagattggacgaaggagatggacatcgaggctgcgatgctttggtgcttgctaaagcactctag

SEQ ID NO: 89455 - DNA, 684 bp, Glycine max
  Peptide Sequence Number=SeqID_181140
atgggagggtcatcggaggatttctcggtggtggtgctggcgtcggacctcggcgtcgatgcacgacccttcctcgaacacgaccaacagcaacaagaagaagagaattggcacgactgttcccagtacctctcccccgacgaggacttctccgatctcgatcagttgcaattcctccgcctccaaggctccgacaaaaactccaatcgcattctccgcatcgtcggcaatgctttcaaatggtgtgcagcaaccgttgtgagtgcggagcggctgaagagcaccgttcagaaggaggacaattcccctggcatcaccatcttgagctggatctatgaagaacttcctgctgatttcaaggacaggcttcaaactgtgtatttcatacaccctggctttcggtcccggctggtcatagctactcttggccgcattttcttgagcggaggattatattggaagatcaagtatgtaagccggcttcagtacctttgggatgatataaagaaaggagagattgagataccagattttgttaaaagtcatgatgatattctggagaatagaccactcacagattatggcattgaacctgacccctttcacttgactggaattccttcaactacctactcatttggaaagtacgaggagagatgggcgggaaggaattatgtgtcttag

SEQ ID NO: 89456 - DNA, 213 bp, Glycine max
  Peptide Sequence Number=SeqID_181141
atgacccctccggatcgcgaggagttaactcctcgcggtccggtggggtcgaggccggaagagactcctcgccgcgagtatgcagcggtgcgcgtggaccagacggccctccacgctgaaagtgacgtcgctgaaggcctgcccgttgatgaggaggttgagatagagtttgctgttcctgatgtactgtgctgtcgcctcaacgctctctag

SEQ ID NO: 89457 - DNA, 693 bp, Glycine max
  Peptide Sequence Number=SeqID_181142
atgacaggatattcaaccacatgcatgaatccgttgctattaaaggatatatctaacgaagttaaggatgagggtaatcaaccaattagtcatgtcaacaagctagtcaggttgcagaggaattttttatggggtgggtcgtctgagcaaaacaagattgcttggatccgatgggatatggagtctagatggagctcggagggccagtatcgaatccatatggtggagggatttgaagatggtatcccaacatcctcatcagggacagcagttgaacagatcaacattatggaagggtgggagtggcaatttcagtggagtagaccattgtttgatagtgagatagagatgacggtcgcattcatacaagaagttgaagggtacaaaatcaggtccaacattgatgatcagtgggtatgggcgacagagtcaagtggcagttattcggctaggaatgcctacagagtgattagagaaggtatatcagaaggggaacaggatggacagttcaaggaattatggaagcttaaggtcccatcgaaagtggctacgttcgcatggaggtcaacggatgagagcgcaagtcatttattctttcattgtagcaagattctccctatatggaatgcaggcgaacagatgaaaatgatggtggttagcactgacttggactatttggaagcacagaaatag

SEQ ID NO: 89458 - DNA, 1737 bp, Glycine max
  Peptide Sequence Number=SeqID_181143
atgtggggtaaagggtcttttgtttggaccaacaatgggaaagtgtttgaagggttttgggaagatggtttgccaaaagggaaaggcactttcaagtggcacgatgggagtttttatgagggaaatttcagcaaggatggtaaggatcagaatgggacataccatccctgtgagtcatcagagggggaagggcatagtgaatgggaccctcaacagttgtataatgagttgaacgggtattcagtttgccctggggagaaggttcaggttatgccatcacacaagaggcttgcgatttggaggtctacaaagacaggggagagtgctaaaaataggagaatgtcagtggatgggagggtgagtgttggcttggagaggccaagtgataggttgcaaatatgggatggtggggagagtgatgctagaactccaactatggggagtgatttggatgaagatttgatggctttacgtgtagatgatggtagtgaaagtttgactcaactccaacctctgaaagcacccaagaaatcaaagaggcagggagagaccatatgcaaaggacacaaaaattatgagcttatgcttaatttgcagctgggaatcaggcattctgttgcaaggcctgctccaacagcatcacttgatctcaagccttcagcttttgaccctaaggagaaagtgtggacaagatttccacccgaaggatccaaatacactccaccacatccatcatgtgactttaagtggaaggactactgcccggtagtttttagaactcttaggaagctattcaaggtggatccagctgattacatgttatccatatgtggaaatgatgcccttcgtgaactttcctctcctggaaaaagtggtagcttcttttacttaacccatgacgaccgttacatgattaagacaatgaagaaagctgaagtgaaagttctattgagaatgcttccagcctattacaataattttcgagaccaacaaaacactcttttgacaaagtattatggcctgcattgtgtaaagttaaatggacctattcagaagaaggttcggtttatcataatgggcaacctcttctgttctgagtatatcacccacagacgctacgatttgaagggttcttcacttggacgcttctctgataagcctgagacagagattagtgaaaccacaatccttaaagatcttgatcttaattttatatttcgactagaaaagtcccggtttgaagaattttgcagacaagttgataaggactgtgagcttctagaacaggagggaattatggattatagtttgctattgggcatttatttcaaagatatatcgccagatggggaaattattcctttacaatctcatactcctactggtgattcggaaaatgaaggaactccccatacttcaagtgaagatacagatcaatctcattatgatccttccagtatcatattgggtatgaatatgccagcaaaggttgaaagaacaataagaagaagcggttgcgaattacagcttgtaggagaaccaattggagagttctataatggtgtgttgacttttggtatcattgacatacttcaagactatgacattagcaagaagcttgagcatgcctacaaatccattcaatatgatccgacctcaatatcagcggttgatcctatacaatattcaaggcgttttcgtgatttcatatttagaatattcactgaagactcttga

SEQ ID NO: 89459 - DNA, 1170 bp, Glycine max
  Peptide Sequence Number=SeqID_181144
atggctaagaatgagtacaaggaaagagattctgagtttttcatgaataagatcaatgagaacgaagaagaacaggacatagaagctatcgggtaccatagtgatattaatgatcagtgtggcagtgacaatgaggggaatcgtagaacagaacctgattcttcctcttctcagatatggcctcaaagttacagagaagccactgattcttattcaatttctgctgctccaaatcttgaatcaattatacgagcaccgagtgtgatttattcaagctttattggtggcggtggttttggtggtgctggttttggttcaaagagttacttagaacacgacgaaaggacttcttttttatctggtgaggaactcgctaatcaagggatcacaagaaggcaatcaacatggtgggagaaagcttcaattcaaatgcaaattcctgaagaattacctgttggttatggatgtagcctcactcaaacaatatttaatgggattaatgtgatggctggagttggccttctatctacaccttatacagtgaaacaagctgggtgggctgcagaccttatgaaacactgctttgaaagcagagaagggatcattagctatccagatataggacaagctgcatttggaagatatggcagacttattgtatcatcatattgtgtggagtttatcatcttggaaggagataacctcaccaggctgtttcctggaacatccttacactggggaagtttccagttagactccaaacacttgtttggaattttaacagcacttgtcattcttccaacagtttggttgagggatcttcgcataatctcctatctctcagctggaggggttgttgctacagcattgattactatatgtgtgtttttggttgggacaacagattctgttggattccatctcactggtccattggtgaaatggagtggcatgccctttgcttttggtatctacggattttgctttgcaggacattcagtttttccaaacatttatcagtctatggctgacaaaagagaatttaccaaggcagtgattgcaagtgttgcagtcatgggatatctcatgtttggtgaagggactttgtctcagataacattgaatctaccaccagatgcatttgcttccaaagttgccttgtggacaata

SEQ ID NO: 89460 - DNA, 3054 bp, Glycine max
  Peptide Sequence Number=SeqID_181145
atggcgagcacccacattgggaatgccggagacgccgacgcgaaggccttgaagggtcgccccaagaagccctccgacgacttcatctccctcttccatggctccgatccgaaagatagagagcttggggatgcacttgcggaaattaagtcattgaggaattcagagcgtcttaaggaaaagggggttgaagagctaacagatgagctgatcaaggtggatgaaaagctaaaagcagctgaagctcttctggaaagtaagaaccttgaaataaaaaaaatcaatgaggagaaaagggcagcactggctgcacaatttgctgcagaagccacacttcgaagggttcatgctgcacagaaagacgatgaaatgcctcctattgaagcgattattgcacccctggaggcagaactcaagcttgctaggatggaggatgacaacagagcactgggtcggctaaccaaatcgaaggaggctgctcttcttgaggctgagagaactgttcagattgctttggcaaaagcatccttggttgatgatctgcaaaacaaaaatcaagagttaatgaaacagattgaaatatgccaggagaacaaaatcttggacaaaatgcttcggcaaaaggttgctgaagttgaaaaactaactcaaactgttcgtgagcttgaagaggctgtcttggctggtggggctgctgctaatgctgtccgtgattaccagcgtaaagtgcaagagatgaatgatgaaaggaaaattttggagcgggaagtagcacgtgccaaagttactgcgaacagggttgcgactgtagttgcaaatgagtggaaagatgctaatgataaagtgatgcctggtgaaatgcaacaattacgtgataaattggctatagctgagcgcactgcaaaggcagaggcacaaatgaaggaaaaatatcaattgcgcttcaaagttttggaggaaagggttaagacatctaatggtaattccaaattcactgtatcagatggaagaaacattgccactgggccttcgcggagacagtcttttggtggagctgagagtctctctgcatcttcttccaatggatatcaatctaggaaaacctcaatttcgagaccagggtctctaagatcaaacagtgctaatgtgttactaaaacatgccaaactttcatcgagatcattcgatggtggtagtagaaacttggagagagagaggccaacttcagatgccaatgggctagataacatgccaagaaactccaacattcagaccatcaccagtgaaacaattactacacacgaggagagtgcaaatggtactccagtcaaaaaatctaaatcagaaaatgaagactatgtttcaggaatgctgtatgacatgttgcaaaaagaggttatatctctgaggaaggcttgtcatgaaaaagacctgactcttaaagataaggatgatgcaatagagatgttggcaaagaaggttgatacattgagcaaggctatggaagttgaggccagaaaaatgcgtagggaagttgcttctatggaaaaggaggttgccgcaatgcggattagcaaggaacatgatcatagggcacggcgagcaagtgctcctaggggggctgtaaattcccagtcaattccttccaggacgagttttcctctgagaaaattttgggctccctgttcggttccaaatgcggtcactccaagggcgtttatgtcttctatctcgaccaccgaagcttttcacaatagtgaaagtcccacagcttatagttctgatcaaattcaggtgcttgaaggcttggaccctgtgaggaaaaggcccgggatgtatattggaagcaccggcccacgagggttgcaccatttggtgtatgaaattttggataatgctgttgatgaagctcaagctgggtttgcttccaagattgatgttgttttacttgcggatgattctgtgagcatcacagacaatggtcgcggggtcttgcatgctggtggaaaattcggtggtgccaacagtggctactctgtttcaggaggtttacatggtgttggtttgtctgttgttaatgctttgtctgagttgctagagataacagtttggcgtgatggaatggaatacatgcaaacatattctcgtggaaagccagtgtcaattctgaaatgccttgtgcttccagatgaaaggaaagatcttcgagggacacgtgttagattttggcctgacaaagaagtattcaccactgctattcagtttgatcacaacacaattgccggacgcattagggaattagctttcctcaacccaaagcttacaatcacgtttcggaaagaggacaatgatccagaaaaagttcaatataatgaatatttctatgctgggggattggttgaatatgtgaaatggcttaacaccgataagaaagctcttcatgatgttctgagttttagaaaagaaacagatggcatcacagttgatatagcttttcaatggtctgaagatgcatattcagatacaatactgggatatgctaatagtatacgcactattgatggtggcactcatattgatgctatgaaggcttctataacaagaactcttaatagtcttggaaagaagtccaaagttattaaggagaaggatattactctaagtggcgagcatgtgagagagggtctaacatgtgttgtctcagtcaaggtcccaaatcctgagtttgaaggacaaacaaagacaaggttaggaaatccagaggtgcgaaaagtggttgatcaatctattcaggaatatcttactgagtatttagaattgcatccggatgttcttgattcagtactttctaaagctcttaatgcttttaaggcagctctggcagcaaaaagagcaagggaattggtgagacaaaagagtgttttgagatcttcatcccttccaggaaaactagctgattgttcatctacagatcctgaagaatgtgaaatctttatagttgaaggtgattcagctggaggaagtgctaagcaagggcgtgacaggcgcttccag

SEQ ID NO: 89461 - DNA, 522 bp, Glycine max
  Peptide Sequence Number=SeqID_181146
atggaggtagtagattgtatggattttagcctcgtgaaaagagatagaggaagaccggaaaggatattggagaatattgttaaaagagttctcatggccattctccctctgaggggtaagattctgaatattgaaaggagggatgaagcagcaatgtacaaaaatgaagagatccaaaatttaattcttggtcttggtctcggggtgaagggagaggattttaagaaagatgcactccgatatcataagattattattttgactgatgctgatgtggatggtgcccacatccgaacactgctactgacatttttcttcagatatcagagggctttgtttgatgaaggttgcatatatgttggtgttccaccattgtacaaggttgtaaggggaaaacaagtgcactattgctatgatgatgctgaccttaaaaagcttcaaagatcattccctcctaatgcatcatacaacatgcaaaggttcaaaggtatgatgagaagttattttagttgcatgcattag

SEQ ID NO: 89462 - DNA, 186 bp, Glycine max
  Peptide Sequence Number=SeqID_181147
atggagaacaacgaagaacaaactgatagatgctttggaggaattagaaagcttagtgacgaggagatccaaagatgggagaagcataacaattcttcccgcaactcaggaatccccacagggactgttccattcaaagccctgcagttagggaaagattccttatggggacggggatggggataa

SEQ ID NO: 89463 - DNA, 426 bp, Glycine max
  Peptide Sequence Number=SeqID_181148
atggcgcaaagtggaatttacaaacgaggagaaggtttagatagaagcttcaatggagagtgggaagattctcactcagggatctttcaacaacaaggctttcatggtaacaatagggcaaatttggaaggtgcgtcagggtacagaaatcaaagaagcaagaaggaacctttacacttcaagtttccaaatgaaaaggatcgagcactggttgaagaaggaggagatacgaaagacattgatctagatgatttaccctatgggacatggatgaaatcatctcccatgagagcaaacatggagactggaattaggaatgaggtaaagattgggatctttagaaggaggatatattacttggacaagggctcgattactaggaaagaaaaggagacaaaacaggccataccactgatgatggtgaag

SEQ ID NO: 89464 - DNA, 465 bp, Glycine max
  Peptide Sequence Number=SeqID_181149
atgttggaagggggcagttctattgatggttcaaccttagctactggcaagggttccacaaaaggctcatcctcttcatttgggaaagctctcacaaaggctaaccgtgatgattgctggtgcagctattgtaggaagccaggtcatactaaggagacatgttttagacttcatggaaaggagaaggatcttgtcacagggaggacgattggaattgctaaagagcaaggcgagttatactacttgcagcatgaggacaataaagagtgtaccagacagaaggttctcacttccactcatcgaacaagttcagaaccttggtcatcctcccaaatatggcttcagcacaggcatctgggtcatcctttgttcagtgtccttaagtctttatttccttttttgtttacaaaaatgtcagtcgagtcttttcattgtgatgtttgtgagtttgttaaacaccattga

SEQ ID NO: 89465 - DNA, 1158 bp, Glycine max
  Peptide Sequence Number=SeqID_181150
atggaaacaactcccaagagatcacctaaaatggatttagctcctctaaatgatgaggtgtgtaagggaatattgctagaaagagagaactggaatgtccatcagccaaagcaagttccgactttcttaaaaccaacatttggaagcttcaaacaatattttgaagacaactcagagatcttggtgaagttggggaatatcactagaaagagagaggagaggaaatcgttgcagaaacgcacaagcagtgaagcacagcagaagtcaccgagaaacattgtagggagcctattaccagaaatgaaggccagaaatgtgagcggacgtgccgtcaagcgtcggaacagtgggatgctcaaatggtgtttggcatgcaaacgaaggtcaccggccggaaaggttgctggagaattccccagagttgcgccggtgactagaaaagaagtcggaaaagggggaaattgctggaaagaggggcatcaggcaaaaaaagtgaaagaaatttgccagaaaaagagaaaatatagagggataatgagtgaaaaccgtttgtccaagagaccctacgaagatgatcctacagcaaaccttgtcactcctggaccatatggccttatatttgcttcatttctaccctttttctttgacattccggtttcaacacggtttcgtgtgtttagcttcctcttctcagacaagtcattcatatatctagctggtcttcagcttcttttgtcgtcatggaaaaggtctatcttaccaggaatgtgtggcatccttgctggttccttgtaccgtttgaatgtcttttacatccgcaaagcaaagttatatctatatgttcataccatggtagtaagtattgctcgagttgcgatatgttacatgcgattcggaggaccagcaatgcaaatcggactgcgtatccttgtagctgaaccgttgcctgaattgtgcaaatcacatgagaattgctatttgtttgaattgcatgattctggaacaagttgggttgcggagtcctctatgaaggcaatcgcagctgccttatatgccatagatttgtgtcgcatcacgagtgttgcgttgttggtcaggcacagcacaactacaaaaatttctgatgtgttgcagaagaagatggcatttagggtttag

SEQ ID NO: 89466 - DNA, 1416 bp, Glycine max
  Peptide Sequence Number=SeqID_181151
atgggtatcccgttgctgaagggcatgtacggtgatgactcgggaacactaatggttcagattgtggtgcttcagtgtatcatctggtatacccttatgttgtttcttttcgagtataggggtgcgaggcttttaatagtggagcagtttcctgatacagcgggttcgattatctccttcaaggttgattcggatattatttcgttggatgggaaggagccgcttcagacggaggcggaggttggtgatgatgggaagcttcacgtcacggtgagaaagtcggcgagttcgcggtcggagattttttctaggcgctcgcacggtggcctgaactcggtgtcgttgactccgaggccttccaacttgaccaatgcggagatttactcgctgcagagctccaggaaccccacgcccagaggctcgagttttaaccacacggatttttactccattgtgaatggtggtggtgggaggaacaacaacgtgagtgtgagtccgaggcagagtaatttcggggggtttgatgaggagagtggtgggggtatgagggtgaatggtgggtaccctgggcctgcgaatgcggggattttttctccggtggcgaagaagaagggtggtgagagtggtggtggtggtggtggaggagggaaggatctgcacatgttcgtgtggagttccagtgcttcgccggtgtcggagggtggtatccatgcctttagaggtggtggggattacgggagtgaccagcttcccgtttgtggggtggctcaccagaaagattatgatgagtttggtcacgatgagtttagcttcgggaacagaaccattgctaatggggttgacaaggaagggccagtgctttcaaagcttggttcgagttccacggctgagcttcaccccaaagcacaaggtgaatccaaacctacttccatgccacccacaagtgttatgacaaggctcattttgatcatggtttggaggaagctgattaggaaccccaacacatactccagcctctttggtctcacttggtctttgatctcattcaagtggaatgttgttatgccagcaattgttgctaaatcgatatcaattttatctgatgctggtcttgggatggcaatgtttagccttgggttattcatggcattgcagccaaagattattgcatgtggaaactcggttgcttcctttgctatggcagttcgttttcttactggtcctgcagtcatggctgttgcttcaatcgttgtagggctcaggggagttctattgcacattgctattgtacaggctgctctgcctcaagggattgtcccttttgtgtttgctaaggaatacaacgttcatcctgacatactaagcaccgggtttgtattcctctattcttcatttgcttttgctattttatcatag

SEQ ID NO: 89467 - DNA, 555 bp, Glycine max
  Peptide Sequence Number=SeqID_181152
atgggacttcatcgacgcgatgaactccttcgtctttggcttctcagcgaactccgccacaaagtcctccaccacgacggcactggcgacggcgctggcaatagcggtggagatggcgaggcgcttctccttgcgattgatcttaatggaccagtcgcggggcttcgggccgaagatgacgcctccgccggggcggaggaagtgcggttggagccgcggcaggcgcgaccggtttttttttgcgggaagggcttccggtcgccgcctcggacctcgctgcgggtgagggtggaggcggtgccgcggtgcttgttctggaggtcgatgtcgcgacgcttgtttgaggacattttcttgttatgccggggagaattattgtgtgtgtggaattggtgtgaagagaagaagatgcaggatgatgtgaaggaaagagaggttgctgttgttggtgtggagagagagagggaaagtgaagccattgttgtttcaagttctctcatactcagaattttgctcttttttttaggtcttttcttttcttttcctgtaaattaa

SEQ ID NO: 89468 - DNA, 1029 bp, Glycine max
  Peptide Sequence Number=SeqID_181153
atggcgaagcgtttgattccactgttcaatcgggttttggtggagaaaatcgtgcctccatcgaagatcaccactggcattttgttacccgagaaatccaccaagatctcattcttggagaatttatggctaacaatatatgaaatgcttcagcttcttacaagtattccagactatgtaaagatagtggaagttggtgcaagggatggattgcaaaatgagaaggccattattcctactaatgtaaaagttgagttaataaaactgctagtttcttctgggttgtcagttgttgaggcgacaagttttgtctcaccaaaatgggtaccccagttggcagatgcaaaggatgtactggcagcaattcaaaatgttgaaggtgctaggtttcctgtcttgactccaaaccttaaaggctttgaggcagctgttgctgctggagctaaagaagtggctgtttttcctgcagcttctgaatcattctcaaaagcaaatctgaattctagcattgaggataatcttgctcgttgccacgatattgcttcagctgctagaagcctctcgatcccagttcgtgggtataactttcagttcatacttgtccatctctacagaaatattgctccagcaaaagttgcatatgtggcaaaatcgctttatgagatgggttgctcagagatttcactgggggatacaatcggtgttggcacacctggtactgtcatttcaatgcttgaagctgttcttgatgttgttccaactgacatgcttgctgtccactttcatgatacttatgtggattcatctgtttctggtcttggaggttgtccatatgccaagggtgcaactgggaatgtagccactgaggatgtcgtttacatgctgaatggacttggagtgaaaacaaatgtggaccttggaaagcttatgcttgctggggatttcatctgcaagcatttaggacgtgcatctggttcaaaagcagctactgctttgagtaaagttacaagtcatgcctccaaactataa

SEQ ID NO: 89469 - DNA, 348 bp, Glycine max
  Peptide Sequence Number=SeqID_181154
atgcagtcctctccagaaccttcgagaaggtggcggaggattgctactacgtcgtggaaaggatctagaagcttctcgcgggggctgaagaatcaactctcggtgaaatcttccaacggtgaaacgacttcgttctgcttcaagtcaaaggagttgattgaactgacgaagatgtgcagagatctgaggcacaaggtgctggagatattggaggtggaggtggatccgaagagaggaccaaggattcaagaggcagcaatgaagctctacatttcaaaaagtgcgttcgagaaggttcacttgttacagacaatgcattttagaattttctctctagacaaaatttag

SEQ ID NO: 89470 - DNA, 258 bp, Glycine max
  Peptide Sequence Number=SeqID_181155
atgaaggttgaaggcataggaagtgtgaggatgaagctccatgatggtgttattcgaactttctcatatgtgagatttgtaccttttgttgttgtcaatatgatttctatgggggagatgacatcacaagggtacaagtatgttgccttgaagaggaaccatgataacaaagtgaagaagaaagcgaggttttctaatgttgtggaagtgttgggagatatttccgttggaggtgaagtttgttcactttcaaattga

SEQ ID NO: 89471 - DNA, 300 bp, Glycine max
  Peptide Sequence Number=SeqID_181156
atgattggatggctaaaaaagggaaatgaagaatggctagagaaggaaggttcccctattagagatgctcaggctttggatatattcaatagaaagctccgagactcagtatgtctttcctttcaacttcttactccttttataggcctaaggcttagcgcggaatttgcgctaagcacacctttgggctttttggtgggccttcttcacactaagcgtgagttggctgctaagcaaggaagcacgctgggtcggtcttgtacgctaagcgagctgtccaaatcttcaacttttctataa

SEQ ID NO: 89472 - DNA, 558 bp, Glycine max
  Peptide Sequence Number=SeqID_181157
atggagtctatctttggaggggtgaagttcccagctcttaaaacattgtatgttgttgactgtcatagtctgaagtctttgccactggatgttacaaattttcctgaattagaaactctggttgttcaagattgtgttaatctggacttagatctgtggaaggaacaccatgaagaacaaaaccccaagttaaggttaaaatttgttgcattcgtgggtttaccacagctggtggccttacctcaatggcttcaagaaactgccaactccttacagtccttggctattaaaaactgcgacaatcttgaaatgcttccggagtggctgtcaactctgactaatctgaaagtacttcatatattagcttgtccagagcttatatctctcccggataacatccatcacctcaccgcacttgaaaggttgagaattgcctattgtcctgaactacgtagaaaataccagccccatgtcggtgagttttggtccaaaatatcacatatcaaagaagtcttaattgaagaaccagaaaagctggaggaagaagaagacgaatag

SEQ ID NO: 89473 - DNA, 1029 bp, Glycine max
  Peptide Sequence Number=SeqID_181158
atggaaggagatgggtattgtgggagtttctttcagaggtgcaagccttacatagccatggtttctctgcaattcggatttgcgggtatgaacataatcactaaggtttccctcaaccgtgggatgagccactatgtgcttgtggtttatagacacgcctttgctactgcagctattgctccttttgctattgttctagagaggaaagtgaggcccaagatgacatttctcatgttcatgcaaatatttgtgttgggtctacttgggcctgtgattgatcagaacttatactatgccgggctgaaatttacttccccgacctactcatgtgcgattagcaacattcttcctgcaatgacatttgtgatggctgctatttttaggatggagaagttggacatgagaaaagtaagatgccaagcaaaggtgattggaactattgtaacagttgctggggccatgttgatgacattgtataaagggcaagcagtgacattaaggaaataccctgctcagctctccctcacagcacttgtgtgtgccttgggtacactgcagtcaattgcagttacctttgtcatggagcacaaaccctctgtttggaccattggctgggacatgaaccttcttgctgcagcctatgctggaataatatcatcaggtatcacctactatgttcaagggattgtcatgcagaaaaaaggtcctgttttcgtaactgctttcagccctttgatgatgattatcgtagccatcatgggtgctttcatccttgcagaaaaaatatatctcggaggggtcgttggtgctattctcatagtaatgggactttactccgttctatggggcaaacacaaggagaacaaagagaaagaggcagagacaaccatggaggtgatgaagtgttgttcagaaaatgggaggttggagactgtggtagaagatgctgaaacaaacaacgacattgagatgcaaaagggtgaagcctcgagagagttaagggtagtcattagtgctccaaaagcttaa

SEQ ID NO: 89474 - DNA, 255 bp, Glycine max
  Peptide Sequence Number=SeqID_181159
atggcatataatgaaatcttcagagaaattagaaagcagatgtttcctcaaaagatctgcatctcacctcattcagttgttcctctgcttctcgctttgacaaagattgttacaagatgcaatgaaatcagtcatgcggtggtgagtgcaacgacagtcactgctgaatggcggcgctgtgaagtgcgacagaggcttgggaaactcatccgagaatggtgtgacagtgatggagctcgttatatgacagcgtga

SEQ ID NO: 89475 - DNA, 2124 bp, Glycine max
  Peptide Sequence Number=SeqID_181160
atgcagcatgcagatgcagtccgcactggcaccctcgaaaccagcctatcttctccttcttcctctttgtttctggaggtgctgaccctcaaagttcagcaacaagccgctgcacgtaacacaggcaaaaaggcaaaaaggaaaaatgaaaaacttaagatttcactctcagtctttgcattgcatccattgtacctgagagtacaggcactttctaagaacatacccgaggagatcaagaaagagattgaaaaggcaaaacagcaattggatgggaaggatgttgattatgaggctacaatggctactaaactctcaattgctaagaaagttttcgctcaagagaaagatttgatacttaattcaagttcctttaaggagttcttttctgagaatgagggttggttgaaaccttatgctgctttctgtttcctgcgggacttctttgaaacatcagatcgcactcaatggggttgttttgctcattactcagaggataagctagagaaacttgtatccaaggacagcctgcattatgagataatttgcttccactactatgttcaataccatttacatttacaattatcagaagctgcagaatatgcaagaaagaagggagtgatactaaagggagatcttcctattggagttgacagaaacagtgtggatacctgggtttatccaaatttgtttcgaatgaacacttctactggggcacctccagattattttgataaaaatggccagaattggggtttccctacttataattgggaagaaatgtcaaaggacaactatggttggtggagagctcgattgacacagatggcaaaatattttacagcttacaggattgatcacattttgggattcttccgaatttgggaacttccggatcatgctgcgacaggtcttgttggaaaattccgaccatctattcctcttagtcaggaagaacttgaacgagaaggaatatgggactttaatcgcctaagttacccatatattaagcgggaactattacaggaaaaatttggtgatgcttggacttttgttgcaacaacttttctaaaggaaattgacaagaacttctatgaggaaaaggacaaggatcctatcaagtggggtttgggaatggtagatttcaaggaggattgcaacacagagaaaaaaattgcttccaaactgaaaacttgtgcagaaagttctctcttgttggagagtgtagacaaattgcagcgtaatctctttgatctttcacagaatatagttctaatccgagatccagaggatccaagaaaattttatcctcgtttcaaccttgaagataccataagtttccaggatttggatgatcatagcaagaatgttctcaaacgattataccatgactactatttctgtcgtcaagagaatctttggaggcaaaatgcattgaagaccctgcctgtacttctaaattcatcagacatgctggcctgtggggaagatttgggtctcattccatcttgtgtccatcctgttatgcaagaactgggattagttgggttgcgcattcagcgcatgcccaatgaacctgatctggaatttggtattccttctaagtacagctacatgacggtatgtgccccttcatgtcatgactgttccaccttgcgtgcttggtgggaagaagatgaagaaagaagactccggtttttcaagaatgtgatggagtccgatgggttgccgcccgatcaatgtgttccagaagttgcacattttgttataaggcagcattttgaagccccatcaatgtgggcaatcttccctcttcaggacttgctagcattaaaagaagaatatacaacacgccctgcaacagaggagacaatcaatgaccctacgaatccgaagcactattggagattccgtgtgcatgtgactttggaatcattgatcaaggataatgacctccaaaccaccatcaaagatctcgtcagttggagtggaagatcactccctaaggaagacgactcagaaatagaagcgagcccagtgtcggtgttgtcagcagcagaagctctttctgagaagcagaagtttgccagtaccacggaaaagcctgttcttgtcaaataa

SEQ ID NO: 89476 - DNA, 672 bp, Glycine max
  Peptide Sequence Number=SeqID_181161
atgatcctagttcgcccgctagcctctagctcgcctaggttagcctctagctcgcctgggcccctaaatgactttaaggtgaaggaatcagctcgtctgggcgagccagttacttcaggagtaagtcttagctcacttggacgagttgccattgtcccaagtgcctttttttctataaataggcgtgaaggggaggttgagagggggttccaaggctcagaagtggagagaattgagaaaagagagaaagaagagaaaacgaagccgaggcgttaccgaatcacgactttgaccaatccctacatcgtttcttgttcagtattcttcgtgcgaccatcgcattcatcacggcctttgcctggtgatccagagtatgcaagatttatctcagtagcggacgatcatgagcatggaggacttcttggcacagttggccttggcccagagtccagccttcctttttggggggaggccgctgaagacactccagaggctggggaggctgaggataccccagaggaagaggcaggggctaaggatgcaccagtggaggctgttgaggtgggagtttcaggcgcaacagaggcagacattgacattgactacgtagcagatgtcattgcggcacaagggacttgggatccatggcccactccagatcaggatgattga

SEQ ID NO: 89477 - DNA, 378 bp, Glycine max
  Peptide Sequence Number=SeqID_181162
atgggaatcaggacgaacatcctagtggagtgcctcgtccatatggtggtggacgaggacgtggtcgtggccgaggactctggttatgggggcagatggggttctaataatacaaaggattctgatgatggtttaagcaattttccaggggccaaggttcagaattctcctggaagagaagcttttcctggtggttggggtggtggtggaagcggtggaggtggagctagtaacagtgacaatggtggctgggaacaagcaagtggtggtgctggtccaagtgatggtgaacaaggaagctctggctggggatctgccacaaagaaagcagcatctgggaacggatgggggtctggaaattctggcggtggttggtga

SEQ ID NO: 89478 - DNA, 2157 bp, Glycine max
  Peptide Sequence Number=SeqID_181163
atggcgtattgttctctcaaggttttgtttggtgttgtgctctatgcctttgcgttccaacattgctacgctgatgcaaactcaacactgattgtaaatgctgcttccaataatgcaactgcaaggcaaattcctaacacttttcttggagtattcgttgaggagattaatcatgctggcgcagggggactgtgggctgaacttgttatcaatagaggctttgaagctggaggcccaaacaatgccttaaatgtttataattggtctattattggagatgaatcatccatttcggtatcaattagccgtacctcttgctttgagcgcaataaagctgcattgcaaatggaggtgtattgtggtgctcacaaaccttgcccatatggtgttggtatctctaaccctggttattggggcatgcaagggaagaggtataaggtggtctatcatgttaaatcagaaagaaagtttgattttcaactgtcattcacgggtgttgatgttataaaagtggcatctagtagaagacatgtttatggagatggaaaatggaaaagggtggagacaatagtggaagcaaaaactactaatcactattcaagtcttcaaataaccacaacaagagaagggagttacttgttagaccaagtgtcagttatgccattggacacttacatgggtcatggcttccgaaatgacctttttcaaatggtggcagatttgaaaccaaaatttctcagatttccaggaaattatctgagaaaccgatttcaatggaaagatactattggaccatgggaggagagacctgggcaccttggtgatgtttggaactattggagtgatgatggaattggtttttttgagtatctcctgctagcagaggaccttggggcattgccgatatgggtgtttaacgctggtttcggccttaatgatgaaattgatacatcatccatagaatcctatgtgcaagacgccctcgatggcattgaatttgcaagaggctctcctacatcacaatggggttctgttagagctgcaatgggacatcctaccccatttgacttgagatatgttgctgttggaaatgaaaattgttggcaaacttattttaattatcaaggaaactaccttaagttctatgaggctataaaagctgcctacccagatattcaaattatctcaaattgtgatgcttccagaaaaccattaaatcacccggctgatttgttcgattttcatacatatccaagctccaatgacatgttttctctgtttactaagttcgacaacacatcacgatctggtccaaaggcttttgttagtgaatacgctgtgaaaagtgatgctgcaaacggaaatctcttggctgctgtggctgaagccgcatttcttattggactagaaaagaacagtgatattgtggagatggtttcttatgcaccacttttcttaaatataaatgacaagagatggattcccgatgcaattgtgttcgactcttatcaggtttatggaactcctagctattgggtgcagaaactttttattgaatccagtggagcaacatttattgactcgacactcagtacaacttcatctaataaacttgctgcatctgtaattatttggcaagattcttcagataagaaaaattacctaagaataaaggcagtaaactttggagcagccgctgagagtcttgacattgatttaagtgggttggactcaaatgtgcaacaatatggttctacaataacagtgcttacatcaaccaacgtaatggatgaaaattcattcttggagccgaagaagagacctgggcactttggtgatgtttggagctattggacagatgaaggatttggttattttgagggtcttcaactagcagaggacattggtgcaaggccattgtgggtatttaacaacggtactttcacatttgttgctatatgccatgaagcccttgatggtattgagtttgccagagatgaggctacttctagatggggttcccttagagcatctatggggcacccaaagccttttgacctaaaaaatgttgctattggaaatgaagattgtggaaagacaaactaccaaggcatgctctctcgttttcttttatccttttttaagtatttacactga

SEQ ID NO: 89479 - DNA, 1326 bp, Glycine max
  Peptide Sequence Number=SeqID_181164
atggcagcgtgttcatcttgctttgataagtgcttgctgaactatgctaaattgaattcaatgaagacaaagattagacctccgtgccttgagtcttctaatcttattgttggtgttgattttaccaagagtaatgagtggacaggcaagaattcattcaataggcgaagcttgcatcacattgggagaggtctgaacccttatgagcaagcaatatcaattattgggaaaagcttggcagcattcgatgaggataacttgatcccctgctttggatttggagatgatatggctaaaaggatttctatgatatcatggcagcatcaacacacgatcaagatgtcttcagtttctatccgagtgaaagattttgctgatggatttgaagatgtgttgagtcggtatagggaaattgttcctcatcttcgacttgcaggtcctacttcatttgcgccaataattgaaatggccatgagcattgttgagcagagtggaggccagtaccatgtgttggtgataatcgcagatggccaggtaacaaaaaatgttgacactaaacatgggagactaagtccacaagaacagaagactgtggataccatagttgctgttagtaaatttcctctttcaatcatattggttggcgttggagatggactgtgggacatgatgaaggaatttgatgacaatatcccagctcgggcctttgataattttcagtttgtgaatttcacagagattatgtcaaaaagcatccctccttcacgaaaagaggcagcatttgcacttgctgcattgatggaaattccttctcagtacatggcagcaatagagcttaatctactgggtagtcggcaagccaatgctcctcaaagacatgctcttccacctcccacatatagttctcgtgctgcaaggtttgagccaagtatccctcctcaacatggcaacagccacccatttgccacagctccttctgccccaagttcaacttatgacaatcaaagagatattcatggcaccagttgcctgaaaaatctactatcaaatgaagcaagcatgcttgttgatgtgagtgataaaacagaatgtgttaatctagagtgtcatttgttgcataattttggtgtctcttccgtgcgtcataagctttgtcccatttgtctaagcaatgcgaaagatatggccttcggatgcgggcatcagcaacaaagtggtgatagtgactatgtcagtgatgatcacgatagtagtgaagggatggtactagcaatgatgggtgatagtattgtccaagctaaatgcaagcctgggtggttatcctag

SEQ ID NO: 89480 - DNA, 231 bp, Glycine max
  Peptide Sequence Number=SeqID_181165
atggatcaattacgtaataatgtgaatgctaggtcgttgcccggaagcaacgcgctgtatagctcgagtacagtgtcaaaagagcaagggccgctgcatcgccgcccggatgtagtgaaaagcacacttactggaaaatctatggaaatagtggatgttatggtgaggaggaagatcaattttatgtgcctacaagaaactaagtggataggtgaaaagcgaaagaattag

SEQ ID NO: 89481 - DNA, 150 bp, Glycine max
  Peptide Sequence Number=SeqID_181166
atggcatggaaaggtttcactttctcaggcttagccatatttgctttcagtggtttttgtgtggtggtggtgaaagctcgtgtcgtggcaactaagaaaacaagaattcttgcacccttgaagatttatgtgtatatgtgcaagttttaa

SEQ ID NO: 89482 - DNA, 168 bp, Glycine max
  Peptide Sequence Number=SeqID_181167
atggggttaaggaggaaaagaatgaaaaatggaggaacattgagtgagctgcgctgcaggatggctttcgataagggtgggggaaggggaaggggatacgggaaaattatgggagggtgcaagagcagaaatgagggtgagaatgagaatagcagcatccgtatttga

SEQ ID NO: 89483 - DNA, 1152 bp, Glycine max
  Peptide Sequence Number=SeqID_181168
atggcgtcccaaatccgtgagtggtctggaatcaatacattcgcacctgctacccagactaagttgcttgaactcttgggaaatcttaaacaagagaatgtgaactccttgactatacttgtgatgggaaaaggaggtgttggaaaatcttcaactgtgaactccatcattggggaaagagtggtttcgattagtcctttccagtcggaagggccaagacctgtgatggtgtcacgatcaagggctggttttacattgaacattattgacactcctggtctcattgaagggggtttccttctgaacaagaccatagatgtgctgctttacgtggatcgcttggatgtgtacagagtggacaacttggataagttagtcgccaaagctataacagatagttttggcaaaggaatatggaacaaggccattgtaacactcacacatgcccagttctctccaccagatggattgccctatgatgaattcttttcacaaagatctgagtctctcttgaaggttcttaggtcaggtgccaggataaagaaagaagcctttcagggaccagctgcaatgcaacactacattgtgaaagtgctgctattgataaccctgactgggaatagtgtgaagcagccagaggctgctaatctggactccattggagagttttgtgtcgctggagtctcagctgcaaatagcattcactcccaaaatttgtggtcattgctaccgctactaataaagatgagacttaacagcagccctggtgaagagcacctccgtttccagcaaacccacagctccattgctgcttcaattcctgttgttttggtcgagaacagtgggagatgcaacaaaaatgacagtgatgaaaaggttcttccaaatgggactgcttggattcctaatctagtccagacaatcacagaaatcgcattgaacaaaagtgagtctattcatgttgacaagaatttgattgaagggccaaatccgaatcagagaggaaaattatggattcctctcgtgttcgctctccaatacttccttatcatgaagccaataaaaggactgatcgagaaggacattgcaaatgagagaaagccaacatgggagagacgcgatgctgcttttcggaagagagatttatattag

SEQ ID NO: 89484 - DNA, 249 bp, Glycine max
  Peptide Sequence Number=SeqID_181169
atgggggtatcaataaaggaatccgaggctcaggcacctgtcaacacgctagggcacatcgatctcctctttcgcaattatggatttggtggtgtatgttggacacccggacatgataagggactaagtctgagtggtctagtagtggatctggggagtctgaagagtctaagcggcaatgtaagttatctccagaagttcgaggggttagagattcttcttcagagaaaaagtggcaagttcttttga

SEQ ID NO: 89485 - DNA, 340 bp, Glycine max
  Peptide Sequence Number=SeqID_181170
cacaaagctgataatcaagtttcttccactgctcacgtttgtcttctgaaatcttttctgaggattactctagatgttcatgataaccttggccaagaaaccaaagttcaacagaggctgaccatgtctgaagccatttcagcacttgtcaaagagttttctaatcgaagaactgatcacctaggaaggaagaggagaggccggcgatttttggtgagggtgaccaaggcggccttggatagtggggacaaagatgggactttaggttttgctgaccagatgcagaaacctttaaagaacaaacaaggtggctctagataccatattgaagagactagag

SEQ ID NO: 89486 - DNA, 117 bp, Glycine max
  Peptide Sequence Number=SeqID_181171
atggacctatccgaagagaatcttgacttacccattgcttttaggaaatctttggagcataatggtacttgggagctggttcctcttcccctaggcaagaaacctattggttgttga

SEQ ID NO: 89487 - DNA, 2238 bp, Glycine max
  Peptide Sequence Number=SeqID_181172
atggagagagaaacagagaacgagagggagagagagatcgagagagacacagagacagagagagagtcaaagagaaagggagtgaaagaagaagagagggagtctgtgcgagagagaggccgttcgagtgccagagacctgaaaaggaaccaatatggaagggttcgatacagattgagtaaggagagtagggggagaagatgtcaagtcatggttgaaagaaatttcaccagagaagatgacaatcacagagtcattgataataaacaccaggaggatccttggattgaagtgggaggtaggaggaaggcttggcgacagacaaaaactgaacaaggagctggttcacgtagacagagagaaatttatgtatacccgacaagcggaaaacacagaccccaatcatggaggagtaaaaaggacataacttccttttatttctctcatttcccagattccgaatgggaaaatgtatgggaggttttcgtacctaagtcaaagaacaaacaaggccacaaatacggctttgttcgttttaaaggcgtagaggaagaaggtagattggagagacaactcgacaataacatatacatagaaggtatgaagatgtttgttaacaaaccaaagttccaaagaggaggaaaaagagacatccagaacccggcgggagacggtaacggagttaggaagaaactcatgatccccatggaacccaatcaaccgagacccaacagtatgccatccaccagcctgaaatcctacgcggaagttgttaagtgcaatccggcgatgaaagagaaggagattgtggtgcctttgttggggaagaatagtttagaacctcctgctgcatctgtaactcttcacacttcaaaggagaacaataaatggctggaccaagcttgggtgggtcgtataaaaaacagaggtatgtttgagagggtggtggaagaggttcaggaggtggtcggagaggaggtcaaggtatcctactggggggacgacatgattatcctttatgacatggatgaagtcaaagcaggaaagatcaatctcagagaacaaactaatggagagacacccttatactcaatccagaaatggatgccggcgatgaagcccgaattccgcttaatatggattcacatatggggtgttcccttggaggtatgggatgcggaacaatttgcgattttgttatcgacatatggagaacttatcgagctcgatgaggagacggcagatcgttcgagactcgacgtcgcgcgggtactgttgcgtacgaaggagaagccattcttctccaaatcgatggtggttacggtgaatggtacagagcatcagctggttttgaaggaggacatgcctcgtcttaaaggaaaatggcaacggcgaccggaaacggagattcttccgccatcgccgttcacaacggcggtggaggactccgacgacgtcatgacagcttctactcccgacggagcttcgtccaactgcttcagggacagacgccgtcgacggtggaccagggccatcaacctttggcgcacggagtctgaagctcactctgaagatgacgtgtcgcttcatcgttcggaggtgccttctgctgtgggtctgttgcctctccccgcgcgacacgtggactacaacagtcccctccatagccctttgcatggacatggaatgctggaacgtagggactcctcccttggccaacagcagatgctacttgaggaaaaagcgggtgaaggtcccaatgaagttgactctggtaaaggggctgacctttgggtcttacagcatgatccaaaggatattaacccagtgtcataccctctggtcaaaccaaattcaaatctctcaaataaagagacatttgaattaaacaaccccgttcagaaaaaggaaaataatgaggtgttgcaggaattgggcctgattactaatggcccaacatcaaaaggagaggaaactgtcctcaacttaaaagtctattctagaagaaaggatggtgtaggaagaaattttttggcccatataaacagcaactctgtttcaaaggccaaaagggacgacaacaagccatattccctggatcttgcagaaaatgacacgattaataagaatgatgacatggcagggggtgtacaggtagctgaggtggatccaattcagcaccagcactgtcagccttattctctccagcagtttcaacaaagttcttttagaaaatga

SEQ ID NO: 89488 - DNA, 849 bp, Glycine max
  Peptide Sequence Number=SeqID_181173
atgaaagtcttcaaatgccctaaaaatcaggcttccacaaccggtggtgagacgattccagcaaccagaactccaacttcagtcacctctgtaccgatgaatcaagatgtttcttctacgtcacttcctatgacgaatttctcaaaacaaatcaccaaaaagctcaacgataaaataattttgatgtggaaacagcaaattcagcccacgatcactatgcttggattcaacaattttgtcactagtcctcaaatccctccgcgatatctttttgacgctgatcacgatctagatcacctcaatcctcaattctcgctatgctcaatgcttactcgagttcttggatcgctgcactcgtatcaagtttgggacaaaatccatgcctattttcatcatcagactcagacgaaggcgaggcaacttcaatctgaacttcgtcatacctatctcgaaaatcaattagtgttggaatatctcggcaagatcaagatgattgttgatgtcttgtttcagttggtgatgctgcaacctattgtgagcacatggacaccattcttgaagaactgtgtcttcaaaaaacatgtgaatcttaatcatggaaactcttcgcaatccataactgatgatgattctggctctaattcttcctctaataccaatatgacatatgcaaaccagtattcctctgattctagggtttctggtggtcgtaataatcaaggtggaggtggctacaagcgtggtggtggtcgtagtggtggtcgtagtggtggccgcggtggtcgaagctcggtccaatgtcaagtgtgttttaagtacaatcacaatgctctcacatgttacaactga

SEQ ID NO: 89489 - DNA, 402 bp, Glycine max
  Peptide Sequence Number=SeqID_181174
atggagaaagcaaatttggtattaggatctggatctattcttgggcgtcttttatcttttccttctgctgcactaaatatgcaaaacaataggatgtttcctccatctctaagccctctgcaggaagaaagactaagaaatctacgacaacggcttgaagttccctttgatggttctaaagcagagcaccaagacgcacttaaacaattgtggaaattggcttacccggacagggagcttccttcacttaaatcagacctttggaaggaaatgggatggcaaggttctgacccttcaacagattttaggggtggaggatttatttcattagagaatctcatcttctttgcgatgaagtatcctaaattaccagattgctatataatattccattgtgattaa

SEQ ID NO: 89490 - DNA, 270 bp, Glycine max
  Peptide Sequence Number=SeqID_181175
atgtccaatgtgagaataaatgtgaaaaggaaaagagtaattagggctagaatgaagattaccaatgacgacctcagtgtgggcacgacagcaagtgcacggcggcatctgggatggcggtgcaatgatgtgggtgagaggacgcgcgctcgcgtgggggtgcagggggacagggaagtgccattggcactggcgggttgcaggaaagaactcgccaccagtgaagtttttgatcctgtttgccctacactgcttggttgcttttcttag

SEQ ID NO: 89491 - DNA, 1869 bp, Glycine max
  Peptide Sequence Number=SeqID_181176
atggttctgctatcagaatcaattccagcaccacctactcctgtgtcgagtgactccgccaaggaccatgtcactatgaaccccgtcaacaccaccttcgatgttaagtgtttaagtggaaggagatttttttacgcctctattcagaattatttgcaactatggccatctaaggatatccctagtcctcctgacaaacctatgattatggtcaactacaagggtgaggacaagcagttcgccgctaaggaaatgtcttcgatggttctcacgaagatgcgtaaaaccaatattctggacgctttggctggtattagtttgccacttgaccaaggcattttcactagggtgcccttggttatgaggctccaaaatcaccctcttcctaccccagagcttgtgttggagttcaatggcacgaccagttcaacagatgctattgagaaggccaactctggtcaccctggtctcccaatggggtgtgctacaatggatcacattctctacgatgaggtcatgaactactattccaataatcccacttgtttcaaccatttcattctttctactagacatgtctgcatgcttcaattcattctccttcaccttgcaagctgtgataatgttctggaagaagacctgaaggaattccgacaatggggaactagggttcctgggcatcctatgaactttgagccatttagaattgaagtgactacaggtcctcctggtcagggcattgccaatgttgttgggttagcactagctttatatgatgacaaccacatctccattggtggtgaccctgagattatattcactgcgaatgttgatcaatgttttgaggcacttaggtggcatgtaattcgggtgaagaatgaaaatactggatatgttgaaattcatgcaaccattaaggaagcaaaggttattaaacacaaatccactttgatcaaggtaaccactaccgttggatttagttcccctagcaaggctaactcctatagtgttcaagcaagtgcattagagttgaaggttattattactggtaaatttccaagtggttgggcaaaagcacttccgacatacactccagaaaaccctactgatgttacaagaaatttgtctaaggaaaatctaaatgcccttcttaaggttcttcctggtctacttggtggcagtgcaaatcttgcctcttccctcatgaccttgttgaaatcatatggagatttccaaaagaataatatcaaagagcgcaatgttagatttggtgttagagaacatggaatgggagcaatctatcatggtattgctcttcatagcaccagattcattccatactatgcaactttctttatcgtgattgactacatgagagctgccataaggatttatgcattgtgtgaagctaaagttatttatgtgttgactcatgattcgattagacttggagaggatggaccactttgtcagccaatagagcacttggcaagcttcatggcaatgtcaaacactttgatgctttgtccagttgatggtaatgaaactgttggatcatataaagttgtcgtggttaacaggaagacaccctcaattcttgcactttttagtcaaaagttgacccaacttctaggaacttctaacgaggaagttgaaaagaggggccacattatttcagataactcattagttaatggtgatcgattttgtgctctattacctagaggagctagagtgaaatatctcttaaatgtcggttattttatcaatggaaatgatgttttgggagaacaacacattgcacaatacttcagtcaagttgttgccacacatggagtagaacaacactacatgggaaagtgggactag

SEQ ID NO: 89492 - DNA, 1080 bp, Glycine max
  Peptide Sequence Number=SeqID_181177
atggcaagtgcgttgtcaacactttgtggacaagcatacggtgcaaaagaatatgacatgatgggagtgtatcttcaaagatcatggatagttttattcttaactgcaatctgtcttcttcccctgttgatcttcacaagcccaattttgactatcttaggccaagatgagagcataggacaagtggcaggaaccatttctctttggtcaattcctatcttatttgcttatattgtctcaaacaactgccagacattccttcaatctcaaagcaagaatgtcattatttcatttttggcagctttatcaataatcattcatgtgtccctctcttggctattcacaatgcaattcaagtatgggattcctggggcaatgatttcaacaattttggcatactggattccgaatattggtcaactaatatttattacatgtggttggtgccctgaaacatggaaaggtttctctgttttagcattcaaagatctttggcctgttgccaagctttccatttcatctggtgccatgttatgtcttgagttctggtacagcacaatattgattcttttgactggtaacatgaaaaacgccgaggttcaaattgatgctctatctatatgtattaacatcaatggatgggaaatgatgatagcatttggtttcatggctgcagcaagagaaaaagtagcttatctctttacttccaacgaagacgtggctactgctgtgggggatttgtcacctctgttagctgtttctttgttactaaatagtattcaacctgtactctcaggagtggctgttggagcaggctggcagagcactgtagcatatgtgaacataggatgttattacctcataggtatcccggttggaatagtgcttggtaacattattcatttgcaagtcaagggtatttggattggaatgttgtttgggacactaattcaaactatagtcctaactataatcacctacaaaactaattgggatgagcaggtaattatagcccgtagtcgtattaataagtggtctaaagtggaatctgatcatgaaacaactacatcagataattag

SEQ ID NO: 89493 - DNA, 807 bp, Glycine max
  Peptide Sequence Number=SeqID_181178
atggaggaagcacaaatttgggctaaaaaggtggagctgccagcgttcatggggacaaacccaattggttggattgctagggttgaaaaattctttgagaatttagtgaagcaaaggctaactcttgggaaagaaaggtggaactacctagctttgatagaggtggaactacctagctttgatagaagcatagaagggggaactaatttgaagggtagcaattttgagtgtgacagtgacccattgcagttcttgaaatcagaaaacaaaagtaaagaaggtttagtaatcaagaaccacaccctttgtgatggagaagaaaccaaaaatgatgaaacaaagttaggaagagaaaaaaaaaagattgaaaaggttatgggggaagaagttgatccatcgataaagagggagaagcacagggaaaatggagtggcgaatgtgggttacgaagacaattttcttgataacccaattacagatttaatcaagaaggaagttgaagctggtgattcaaccaaaccacattgttttcaagattcagatttccataaaaagattgttatggtgaaacaaaaaccattcataaaggtggttggaacaacaatggtgttggaatcttggaatgtcaacttgttgggtaagcctttagcattaaattttgttgcatctatgactgacaacttagccatggagctaaggcagaatgaatgtactgagccaatcaacctgattaagttatatggagtccacccttgtcattcccaccaccgaagccaccaaacctcagtttgcatgcaggggcaataa

SEQ ID NO: 89494 - DNA, 1878 bp, Glycine max
  Peptide Sequence Number=SeqID_181179
atgggacattacttgtatgaagaacctttgccttctggaggggttgttactgggataggtcctgtgcatgggagactgtgtatgtttgtggcgaatgatcccactgttaagggaggtacttattatcccattactgttaagaagcacctcagggcacaggagattgctgctcagtgcaaattgccctgcatatatcttgtcgacagtggaggagcttttcttcccaagcaagccgaagtgtttccggacagagagaactttggcagaatattctacaatcaggctgtaatgtctgctcaaggaattcctcaaattgcattggtgttggggtcttgcactgctggtggcgcttatattcctgctatggctgatgaaagtgtgatggtcaagggaaatggtaccatttttttagcagggccacctcttgttaaggctgccactggagaagaagtctcagcagaagatttgggaggtgcgactgtgcactgcaagacatcaggggtttctgattattttgctcaagatgaactccatgcacttgcgcttgggaggaatataattaagaatttgcatatggctgggaaagatgtcttggcaaatggattgcaaaatataaattatgaatataaagagccattgtatgatgtcaatgaacttcgttctattgcccccactgatcttaagcaacagtttgatattcgatcagttattgatcgcattgttgatggaagtgaatttgatgaattcaagaaattgtatggcactgtgaggacttatccactttacttttttatctgtttaaccattatcttgatatcaatgggttgctatggaatgaccttttttctctcggcacctacacttgtgacaggatttgctagaatttttggacagcctgttggaattattggaaacaatgggattttattcaatgaatctgcactgaaaggggcccatttcattgaattatgcactcaacgtaacattcccttggtcttccttcagaacatcactggattcatgaaatataacaatgtagagttcaggaaatacagggggattggtgatactgttgtgaagggaccgtctattctcaaacctgtggccattgatggtattgcaataagcaaaccattagaccagtcctgtttggtcttaaacattcttgttgatggacatcatgtatttttaactgtggtactattctttatcaaatggtgtatgtctgtaggcatccaggttggctcaagatctgaggcaaatggcatagcaaagtctggtgcaaaaatggtgatggctgtttcttgtgcaaaggtacctaaagtcactataatggttggaggaagctttggtgcaggaaactatgcaatgtgcggtcgtgcctatagtcccaatttcttgttcctttggcctaatgctagaatttctgtgatgggtggtgctcaggctgctggtgtgctggcccaaatagagaaaggcaacaagaaaaggcaaggaattcagtggagcaaggaagaagaggataagtttaaagggaaagtagtggaggcttatgagagagaagcaagtccttattactcaacagctaggctttgggatgatggaatcattgatccagcggatacaagaaaagtcattggtctatccatctctgcctccttgaaccgtgacattcaaaacacaaaatatgcaatggtgttctcaagatggtctcaacatcctccacttcaaaaattttctcaaggagcatgtagttccaacacaaaccctctttatccatcagaactcccacttccaaatccttcaagccatttacaagtggtgttcaaatcaatgtatgacccgtgtgccttaaccatggttctccccaaacattaa

SEQ ID NO: 89495 - DNA, 129 bp, Glycine max
  Peptide Sequence Number=SeqID_181180
atggaaattaataaaaacatcctgggggcacagatatggataagaagaggaaaaacaatggcgaaaaacgaaaatggaaccacagtaatcacggaacgtggaccaatagtgagtgagttgaatccttga

SEQ ID NO: 89496 - DNA, 402 bp, Glycine max
  Peptide Sequence Number=SeqID_181181
atgtctttgtgtactaggaggggatataacattgtaatgacaaccagtctatcatctgatgttcctgttggatatttttcatgggctgagtatgatatcatggcaccagtgcagccaaaaactgaagctgctcttgcagctgcattcatttccaattgtggtgctcgaaatatgcggttgcaggctcttgaagcccttgaaaaatcaaacatcaagatcgactcttatggtggttgtcataggaaccgtgatggaagagtggacaaagtggaagccttgaagcactacaaatttagcttagcatttgaaaattctaacgaggaagattatgtaactgaaaaattcttccaatcccttgttgctgatgttcgtgggcttcaagaacacttgcatcccatctga

SEQ ID NO: 89497 - DNA, 272 bp, Glycine max
  Peptide Sequence Number=SeqID_181182
atgacattgctacttagcaacattctgcccagcgaccgcaatgccaatctccccctgcggaagtatcagttaggtctgtgtcgtcccgacatggggatcgcacccacaaagacacccagtgaacctgaagaagtccaacagggccctggggtttccagctctggttacgggcctctatcagtcctacagggtgctcggatcgcgcctgcaagacacccagtggacccgaagaagtccaacagggtcttggagttgtcaagctctaatcacgg

SEQ ID NO: 89498 - DNA, 619 bp, Glycine max
  Peptide Sequence Number=SeqID_181183
cattccattactggtgaatctgtgcattctgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgccccatatgttcttaaaactggactgattcatttgcttccaaagtttcatggccttgcagggagtggcaaaggactggttgtattaccttctccaaggtccatcacgagctgggatgaccttaagagagtattcttagaaaaatttttccctgcttccaggaccacagccatcaggaaggatatctcaggactcagtaatatggagagaagtatgatagatgctgctagtggtggagcccttggagacatgactcctgctgaagccaaaaatttaattgagaagatggctccatctgcatcatctgaaactaagaagcttgaaggcaaactggatgcattggttaacttggtaacccagctggccttgaatcagaaatctgtacctgtcgcaagggtttgtg

SEQ ID NO: 89499 - DNA, 330 bp, Glycine max
  Peptide Sequence Number=SeqID_181184
atggctccgaagaagctctccacaaagaggtccaggagggacgcccatggggaaagctccagcgcctccttggagttcgacagtcaccgacttccaggagaagatagcacgcaggcattggacacctctagtgactcccatggccaatggattccctttggcacagatgccctcagccaattcctgggccacccactgatcttggaggaggaccagcggtgcgaattcagccagaggagggaccaggcctccggctttgacgaggaggccatcgcccagctattgtgcataccggggcaagactttgcttggaccgctgcggggaggcag

SEQ ID NO: 89500 - DNA, 483 bp, Glycine max
  Peptide Sequence Number=SeqID_181185
atgcaaagaagatcaactgcaggtgatttgatccccatcgatttggagattaacgctacttgcaggaggcgtaacgtagagagaattagaaaatttttgcaggacttagaagcagcaacaactccagaagaagaacctcaatcctctgaggcgtcttctagctttcttattctagggcaatctcatacagatttaattgaagacccaatcatggctgaagagccaagaagagtaaccctggaggattattcatgttctactgtgccacaatttttcaccagtatcgcacagccagaagttcaagctcaaacaatcacatatcctccctctttgatacagctgattcaaaaaaatctttttcatggtctacccaatgaagacccttatgctcacttggccacctacatagagatatgcaatactatcaggctggcagctggagaagctaagagatggcttcattcttttaaagaaacagtctga

SEQ ID NO: 89501 - DNA, 741 bp, Glycine max
  Peptide Sequence Number=SeqID_181186
atggttgaatcagaaaagctttcttacatcagaaacaaccaaaaaaaatttcgagttgacaagttttgcagcttacaacactcattggatgatggaagcacgaaaggcctaaataaaggtaaaagagtcattttgccttcaacatttgttgacagtccatgctatatggatcaactttatttttatggtatggccatatgcagccatgtgggcttcccaaatctgtttattactttaacctgcaatccaagctggcctgaaatccatagattgttgaatcccttgaatctgaaagcgacagatagaccagacataatatgcaaagtcttcaaactaaagtatggacaaatgctaatggaccagacaaagaatcagatgctagggaaatttattgcatatatgtatacaatagaatttcaaaaacgagggctgcctcatgtccatttgttgctttttttacatcccgataacaaatatccatcctcggatgaaattgatcgaattatatcaatagagataccttcacagcaagatgatccagaaatgcattcattagtaaaaaaccatatggttcatggcccatgtggaatttcgagaactgaatctccatgcatgaaagaaggcaagtgcagtcatttctatcctaaaatgttccagccgcatactattttagatgcagatggttatccagtctatcgtagaagaaacaatggtcacacaattgagaaaatggtgttataa

SEQ ID NO: 89502 - DNA, 156 bp, Glycine max
  Peptide Sequence Number=SeqID_181187
atgggaagggctacttatgctgccaggtctctccaccgttctgagtgcgatcgggagtgtcgcaacctacccttcggcgggagggcgacgcgtgactcgcaggatgcgtgttccacgaaaggaatacgcgcggagtcaccaccaacgtttatttga

SEQ ID NO: 89503 - DNA, 345 bp, Glycine max
  Peptide Sequence Number=SeqID_181188
atgtgctcatgggtgaagaaggacgctcctgcacaggcagcagaggaccgctctccatcaccacctcctcaaagagatgactcttcatcccttatgcaaatcgttcttgacagactggatggactatacatcttcgttggtgagcgttttgactccttggacagccgcattgatgccattgatgcacggattgtcatcatcaaaaagggggagattgtggaagcaatgtcttccaagattattttgatgatgacaaagaatcatgagttaagaaaattcgaaagattcaagaatcaagatttaagattcaagaatcaagtttcaggaatcaatattcaagaataa

SEQ ID NO: 89504 - DNA, 222 bp, Glycine max
  Peptide Sequence Number=SeqID_181189
atgtcgctaaccgagttctatgcaaacctatatagctctgagggtctttcagcaaagcaagccagggtcagaggccatctagtgaagatcgatgctaacagcctcaacacattcctagagacacctgggtgttggcagagggtgagactttgcccacatactccagatactgcaggctgccttcagatcctagggagattaaggctgccctatgcatactag

SEQ ID NO: 89505 - DNA, 264 bp, Glycine max
  Peptide Sequence Number=SeqID_181190
atgcctcacctcttggcgaaaaaggtgagaaaagcgtcgatcgctaccaggtccaccaacccatccacattcggaaagaggactcctccgaaaatcaacagtgcgagattatctatgaacggggcccactcgcttttacctgccaagattcttgcttttgcctccaaatattttctcggtattccaaccaccccattttctacttgcttcctgtggtctaattcttgcgccgatgatgtgccatcattttcttctattttctaa

SEQ ID NO: 89506 - DNA, 669 bp, Glycine max
  Peptide Sequence Number=SeqID_181191
atggaagacgcgcccgtgagccccgcgtcgccctcccgccgaagggtaggttgcgaaaaggccattgcctccctcgtccaatattatgaccagtctttgaggtgcttcacctttagggacttccagttaacacccacggtggaagagtttgaagagatcctgggatgccctctgggaggaaggaaaccatatctcttcttgggattctatccctccttagctagaatttctaaaatagtcaaaatctcgacacaagaattggaccgcgggaagcaagtcgaaaatggggtggttggggtaccaaggaaatgtttggaagcaaaggcgagagtcttggcaagtcaaggcgaatgggccccgttcatggacatcttggcacttttgatcttcggggtggtcctctttccaaatgtggattggttggtggaccgggcagcgattgatgcttttctcgccttttatgactacaaggaaagcccggttgtcgctatcttagccgatctatatgacacatttgaccgaagatgtgagaagaacagtgcaaggatcgtttgctgtacgccggctctctacgtatggttggtttcacacttctttcgccaagagatgagacacgtttgtccgttagaaggccaccgctcatgcactgagaaaaaaaaggaaaactag

SEQ ID NO: 89507 - DNA, 645 bp, Glycine max
  Peptide Sequence Number=SeqID_181192
atggagacacttcagatggtccgcaaggcatgggagatagtgcgagagaaggacaaagaactcaggggcggtaacaatgggcccatctgtggcttccgtaagtggttgagagcccacgtgcaaggtttggattggctcccaagtatgagaaccactaaaagggaggaagttgaggcaccggaggaagacgaagaggtgcaggcccttaggacagaactcgagcaagcccaaacagtcaaagaaaggttcaaatcggcagctcttaaaatccgaaaggagaatgccgaactgagagatataaatacagctaccaccaaagccttggaacaagaaaccaagagagctcatagggaagagcacggccggaacaagttccgaagggctctgtggggcagtaacaacgagcttaaactccggagagaggaaagggaccaatcacgagtagacaatttcatcttgaaggatgagttgaaggcttgctcgaggtccaagagaagtttgtctcagcggttatgcgagacagagaccaacatgttagccatcatcaacaagtaccaagaagaactaaatctagccacggcccacgagcatagagtggcagacgagtatgcccaagtgtacgtggaaaaggaggctagaggaagg

SEQ ID NO: 89508 - DNA, 285 bp, Glycine max
  Peptide Sequence Number=SeqID_181193
atgaatgctttgggtggtgcaacactcttttgtaaaatcactcgtgcacccaacatcttcatgatttgtgtacatagggactcgttaggtaggaataatcaacatgaaaatacagaaaaaggggttcccatgaaccctaagagaataaaggtcattcctgagtggcccgctccaccaagtgtgttgaggaaaaaagtccagtttcaagaacctcgggatttgaggtcaaatccttttcaagggggagggaatgatacaatcctaccccgcaagggcattggatag

SEQ ID NO: 89509 - DNA, 292 bp, Glycine max
  Peptide Sequence Number=SeqID_181194
tttgatcttgaaggatgagttgaggatttgcctaaggtccaagagaagcttgtctcagcaattgtgcaagaccaacaccaacatgttagccatcatcagcaagtaccaagaagaattaaatctagccatagcccacgagcacaaagtggcggacgagtatgcccgagtgtacgcggaaaagggggctagaggaaggaacttccccgattgctggccaaggccaaagcaatggcggacacctactccgcccccgaggagatccacagatttcttagctattgtcagcatatga

SEQ ID NO: 89510 - DNA, 252 bp, Glycine max
  Peptide Sequence Number=SeqID_181195
atggataaccactcgggtatttctggccgtcagcgtgactcaaaagtcagtatgacagatcttgtgagcgcggaagatgatgtaaatctccgcgtgtcaacgggcttgtccgccgcgattgacgaaaggcgcaaaatgaccataatttgtctctgcgtgccatcggacacaactgtgtctgaatggcaaaaaggtgtgcggaatgaccataatttgtctccgcatgtcatcgggcccgccgcctctggatga

SEQ ID NO: 89511 - DNA, 541 bp, Glycine max
  Peptide Sequence Number=SeqID_181196
gaaacgatcctgagaagggtgactctgacaggtgcgacttgtacatagaagcagatcctacctgcctggttgccatggggagagtttatgagggatccactattgttcataacactcctttgttgcctggccaagtaaagatgcagattctccagttccttagtggggcaggcacttcacaccttccttgcttggccgacacactggtcaagtctttatcagaccaggtagttgtgtcttcggcaaaaccacctccgaagcccgatccggaggtcgatgattcgctttatttgatgacattgaccatcccagagcttttcttgaggccttatcaggttagatgggatgccaccgtgttcggggtctttaatccaaatttccccctctacataaagcacgaagacctctccgaaatcgcacacggtggtcaatgtctcagcatatcagtgttacagttgtggattctgcatctcactgaaacatgtatgcgagtggggaattctgatatctatggattcctcaagccacagttcattcagag

SEQ ID NO: 89512 - DNA, 363 bp, Glycine max
  Peptide Sequence Number=SeqID_181197
atgggtgacctagaggaagtacaggaacagatgaaagccgacatgtcggttttgaaagaacaaatggcttccatgatggatgtcatgctgggaatgaaacaacttatggagagtaacgcgaccaccgccgccgctgttagttcggctgccgaggcaaacccgactctcccgactgctgcacaccaccctattccaaatgtggtgggaagagagagaagcacgccggggcacgtcagtaacccccatccgggatacaaccgaggaacttacccttacggtttaccacctaattacacaccaccagccgtgcatgacgacgtgggtcacattcctcccctcatcctcgaaggggagcctccttga

SEQ ID NO: 89513 - DNA, 390 bp, Glycine max
  Peptide Sequence Number=SeqID_181198
atgaagagagaatctcctctatccctgcattacaaactgtttgaggggacacatgtcccagacattgtctcgacatcagggaaagctgctgcttcaggtgctgtgtccaaggatgctttgattgctgaactcaaggacacatgcaaagtgctggaagcaaccatcaaagccaccacagagaagaaaatggagctggaacgactgatcaaaagactctcagaaagtggcattgatgatggagaagcagctgaagaagaagcagctgaggaagaagaagaagcagctgaggaagaagtagaagcagccaaggaagaagaagaagctgctgaggaagaggaagatgcagcagaggatactgaatcagatgatgattctgaagccaccccatga

SEQ ID NO: 89514 - DNA, 453 bp, Glycine max
  Peptide Sequence Number=SeqID_181199
atgtcacgaaaccttacagattacgcaattatcccttctttggctttcggaatgtcacggaactttatggattgcacattaacacttcttttcaactcccgacatgtcgcagaacttcacggattgcctaacaatgggtgtcaagtacctcgaagtggtcaaatgcttcattccatgctccagagcttacacagggggcatgccattatcatgcagagccttcagggcttgggtctgccatccatcatgagcatagatgagtttgacgtgcaggaggaggagatttccatagaccagattccagagccatctccagtacccatacgtgatgattccatgccatttgcaacagcatctgagctagagcagcctattcctcaggattcaccagctgctcaggtgttggatctcaatgagcatgcacgggagcaatcacaggagcaggacatttaa

SEQ ID NO: 89515 - DNA, 322 bp, Glycine max
  Peptide Sequence Number=SeqID_181200
gcccatgactactccacctgcctcgcctcctcttcctcatcttcctcctcctcctcctcctgctatagtagcatcagagtttccatctaccttgaagcgaacacgcaaagccacacgactacgatccttggccactagaccacctggggcagagagatcggtggtccacatcgatcctgcgaccgggaaggacgatagtccgcacaagaagaaattaagaatatatttggggattatcgctcatgataaggtcgacgtgacatacaacacttggaaggaagtccctgctactcagaaggatttgatatgggaggatatttag

SEQ ID NO: 89516 - DNA, 699 bp, Glycine max
  Peptide Sequence Number=SeqID_181201
atgcagaatgccctcagccaattcctgggtgacccgctggtgttagaagaaggccaagagtgcgagtttagtcagagaaggaatagggccgacgggtttgacgaagaggccattgcccagctattatgtataccgggtcaggattttgcccggaccgctgcagggaggcgggtgcggatcatgcgcaccagtatgccacccaccaggcaccctctagacttggataagtctaacagggccttggggtttccagcgttgatcacgggcctctgccagtcattcggggttcccgtcacacctagtaaggtgatccggccgccgatcacccgagccttcattgagaagtattgcatgcctaggcaagcgcagggtgatgcgccacaggccgcaaacgcaccgccaccacctcatcaggctgatcccgctgggtcattaggcatggagcggtatctacagcacttggtgcagatacatgagtgtctctaccagctcagcctcagtcagcaaggccagggtttcgctccttttgcgtgccctactccagatcagtttagggttgaggtcgcatggcccggagattggccgaaggccctgacagaggaggcacctgcaggagctcccgacgatgcagaggaggcccgcattgatgaggtgatgacagacttgttcggcttcttgggaggaagcggagccacgtga

SEQ ID NO: 89517 - DNA, 609 bp, Glycine max
  Peptide Sequence Number=SeqID_181202
atgaggaagttttctcggatattcccctatgtgataaacaggttacagatgctgctcgtatgttgtgttcagagtactatactgttggttgtgtcacattacattcttgacaaagacaaccttctgaagctcagcaaactcaagttaattgggtggctccacctgatgaatggctcaagtgcaatttctctgaatggatcaaatgcttcacgtggagggttgctgagaaattgggcagtcgtaatcgtcgctgtactggcggcggtgagcctttgtggtggcggtagcggcggtgttctctttcctcttgccatctccggcggaggccgccgcggtcctctctctgtgtggcggcgcggtgtcctcggaaatggatcccagggcgggcctccagtgggacttgttgcggcggagagtctgcgaaggcggcggaacgaggggcttcgtggagccggtggggtcgccggcgccgccgaagcaagaaacgaagaacctcatcaagcgaagaagaagaaggtttgggtatggaacaagtttgttgtaattatcaatgttagagaatgggttgcaacaatttccaatttgcgtgttatacaaaaatggttatga

SEQ ID NO: 89518 - DNA, 228 bp, Glycine max
  Peptide Sequence Number=SeqID_181203
atgagtggtcatgcgtgcggtggagggcatggatctggagtgaagtggtcgcggaagggtcgtgtaatcttggcttgcaatggttccgaggtgagtgttggtggttggcgccactcatggaggtggtgggagaaaggaagaagaataaaaggggaacatttgaatattacgagttacaccaagcaaaaatggagtgcattaaagaattttcagctctcgaacgtttag

SEQ ID NO: 89519 - DNA, 558 bp, Glycine max
  Peptide Sequence Number=SeqID_181204
atgccaatctccccctgcagatgtatcgagatcgcgcccacaagacgcccggtgggcccgaagaagtccaacagggccctggggtttccagctctggttacgggcctctttcagtcctatagggttcctgttcccccagcgaggaatcgcacccacaaagacacccagtggacccggagaagtccaacagggccctggggtttccagctctggttacgggcctctgtagtcctacagggtgcccgttccccccggcaaggtcatgtcatcataggtaaggatcgcgcctgcaagacacccagtggactcgaagaagttcaacagggtcttggagttgtcaaagctctaattacgggtctctgtcagttctacggagtacctgtcacctccagcaagggcatcaggccccctactaatcgagctttcatcaagaagtactgcgcctccaggcaggcgcagggcgaaacaccacaacatcctggggatggccgacaccgggcaacagacacaccgccatcacctctagagttcacctcagctcatccacaaaaaggttag

SEQ ID NO: 89520 - DNA, 449 bp, Glycine max
  Peptide Sequence Number=SeqID_181205
tcaaggttggtgttgaggaagttagagatgcagatgcttccattcctgtactcactcaacaggttcagttagtgggacagacacttaacacctttgttacttggccgacacatcttgtgaagcgtttatcagaacagggagctatgggatcggacaaacctacagataggccggatcatgatgtcaatgatcctctatatcttatgacattgaccatcccacaactttttctaaatccattgcaggttatgtggaatgctaccgtgtttgggctgtttaatgacgacttccccttgtacataaagcatggagatttgtctaaaataacacacaatagtcaatgtctcaacatctctattatacaattgtggattctgcatatgactaagacaagtatgcgagcggggaattccgatgtttatggattccttgagccaaagtcgatatag

SEQ ID NO: 89521 - DNA, 111 bp, Glycine max
  Peptide Sequence Number=SeqID_181206
gagaaagggagctcagcggctagaggattgtaacatgagagaagcaaggaggtcaacctttgtcaaatataccacatgggttctggcaatgctatgtggttggactctcat

SEQ ID NO: 89522 - DNA, 303 bp, Glycine max
  Peptide Sequence Number=SeqID_181207
atgttttccaagaaggaggaaatgatgagaatcatgaaattggccaaatacaggctaaaggcccaagtggagaaggacgaaggcccaagtggagaaggacaaagcccccgagtggagaaggatgaaggcccagaggcagagacactatcaagacttttaattgttactgaaggtaatcctcgtggcgtctaccctgacttatcttccttcaccggaagtggcgtctatcctgacttatcttccttcactggaagtggcgtcatccaaatctctgtaacctgtatcaagcgatccgccccataa

SEQ ID NO: 89523 - DNA, 195 bp, Glycine max
  Peptide Sequence Number=SeqID_181208
atgcccttctatgccaaatttttgaaggatatgctaacaaagaagaactggtacatccatagtgacagaattgctgtggaagatatagaagaggatgttgacattcctctcattcttggccacctattcatgtctactacaagctgcatggtggacatgggaaagaagatactgcagatgggcatagaagactag

SEQ ID NO: 89524 - DNA, 351 bp, Glycine max
  Peptide Sequence Number=SeqID_181209
atggctccaaaaaagctttccgcgaagaaatctaggagggatgccgcggctgaagggactagtgttgcccccgagtttgatagccatcgtttcaggagcgccgagcaccagcagcgcttcgaggaggagatagctcgccgacattggacgtcgctggagactcccatggctaagtttgaccctgatatagtcatggagtttgatgctaatgcttggcacacagaggagggagtgcgagatatgcggtcatgggtgaggggtcagtggattccctttgacgtagatgccctcagccagttcctgggagacccgttagtgttggaggaaggccaagagtgcgaatttagttag

SEQ ID NO: 89525 - DNA, 501 bp, Glycine max
  Peptide Sequence Number=SeqID_181210
atgtctgcttttgtggaacgttggcataaggaaactagcagtttccatttgcccatcgaagaggtgactatcaccttggatgacgtcgtgtcgttgctacatctatctgttgtaggggcgtgccacagcttcaagctacttcatgtcgatgacgctatcgaaatgttggtggaattactcgagttcagtgctgtagagtgttggatctacgagcatttcgcgtccgttggttccgctgttcctgccgaggattatgatgagaggagaccgagtgcatgccgatggacctctggcaaggcactgcccatttccacgtattggaggcgtccggataaactgatccttgacgcgatgtgctggattccgtacagtgaccaccgtttatttagagaatttgatgtcatctcattattttccggccacatcctgttgcgtcttcattctctgttgaagaaattgatgatagatggatgcagtttggtgaatacattgaacctgtag

SEQ ID NO: 89526 - DNA, 237 bp, Glycine max
  Peptide Sequence Number=SeqID_181211
atgtcattgcctagcgctattcatgtgtcctccaccttcgtgtctggagccccgcgaatgtcattgcctagccctgttcgccaattctccattctccacttttattcggagccccatgaatgtcattgcctagcgctgttcatgtgtcctccaccttcgagtctggagccccgcgaatgtcatgtcttagcgttgttcgccaattttccattctccacttttttcggagccccatga

SEQ ID NO: 89527 - DNA, 363 bp, Glycine max
  Peptide Sequence Number=SeqID_181212
atgctatccagtttggaattggagatcaactgtgaaaagactaggagtctttggtgggagacaatgagatgggttaatagagtgggttcctattccatagatccaaagaatcattttttacaattcacccagtggaatagcaaagatagtaccaacaaaagatgggaatttatgtggctagccctgtccttctccatttggtaccatagaaatgccaagatattcaagaaccagccgttcactcctgaaaaggtcatggatgatgccttgttccacacctggtcctggataaaatgtgtggagaaggacttccaaatgcactttaatttctggtcaaccaatctaaaggatgttctttcttag

SEQ ID NO: 89528 - DNA, 222 bp, Glycine max
  Peptide Sequence Number=SeqID_181213
atgatgacaaaggtgatgaacaaaaagctcaaaagatcaaagaacaactcaagtgaatcaagaacaagtcaagagttcaagaatcaagaagaattcaagactcaagaagaaggcctacaatcaagaatcaagattcaagattcaagatctcaagaatcaaaatcaagattcaagactcaagattcaagaatgaagaaaagactcaatcaagataagtattaa

SEQ ID NO: 89529 - DNA, 705 bp, Glycine max
  Peptide Sequence Number=SeqID_181214
atgccggcctggccggcgccgaactggagcgtcattgccccatggacccgtccgcccaggcgctgttgttgcaggcgatgcggcgattggcgggatccgggcgggcgctgcatcgcgccctgcgggtggcgcggaccatcgccgaccttgacggggcggatacgctgcaggccagccatgtggcccaggcggtgcagtatcgacggccgggggtatgatggcggatcgtctgccccggggctggggcgtccgcctcggtgcgtggttctgtttcccctggtccgtccctggttgtgctgccatgttgtccggcgccgtgtcccggctcgacaaaaccagggaaatcaccatataatcaaaggctttcccggatccaggctacttttttgccggcggtgcggggaaggccgggccaaatgccctggcggcagccgaatggcgcaagccgggattcatggccctgggggtattcgagtaatacctccgaagtacttcagtagtaccccagcagtacccccaagaagtggcaagagcgccgcaaagcgctttcaggttcgcggcagcggatccatcaagcgtggtcaggcgttcaagcgtcacatcctgaccaagaagaccaccaagaacaagcgccagctgcgcggttcggcggcggttcacgagaccaacgtggcttccgtgaaagccatgatgcctttcgcttga

SEQ ID NO: 89530 - DNA, 508 bp, Glycine max
  Peptide Sequence Number=SeqID_181215
gaaacttgcctcaaagagatccaggaaggataagacggccgaaggaactagttccgctcccgagtatgatagtcaccgctttaggagcgttgtacaccagcagcgcttcgaggccatcaagggatggtcatttctccgggagccacgcgtccagctcagggacgatgagtataccgatttccaggaagaaataggtcgccggcggtgggcatcgttggttacccccatggccaagttcgatccagaaatagccctcgaattttatgccaatgcttggccaacagaggagggcattcgtgatatgaggtcctgggtgaggggtcagtggatcccgtttgatgcagatgctatcggccagctcctgggatatcctttagtgctggaagagggccaggagtgcgagtatggccagaggaggaaccggtccgatgggttcgatgcggaggccatcgcccagttgctgtgtatatcggggcaagattttgcccggactactgccgggagacgg

SEQ ID NO: 89531 - DNA, 336 bp, Glycine max
  Peptide Sequence Number=SeqID_181216
atgaaggagacaggagaagagtggaagactgaggtagacagagacaacaaccacagcggcacgagcgaccacgtcttcagtgcataccacccatggcgagtgatatgtatgcaatgtatgcaagagtacggtgctcaaaacccaagtcggaaaattccctggtcaatcctccaaagggcttgtgaaacccaaggtcctcctttggtgagtcccactgatagacacaaccgtgtctccagtacctgccactttgtaagaggcgtgtatgtaagagcacaatacttgcactgcacgcaagactcatcaaacccaaccttcgcgcttgctgatccataa

SEQ ID NO: 89532 - DNA, 395 bp, Glycine max
  Peptide Sequence Number=SeqID_181217
atgcataaggcattacgggccaatgcacctctgccttatccctaccttgttactctttttcttcattatttcaatgttcctttggatgatgaaccatatgttaaggttaaaaggtcgttttccattggtgccgatgcagttacctcctttggttaccgaaaggatgttgatggtcagtgggttcgcaaacaagacttgccaccgcctattcctgatgaacgtaccccatctcctccaccacaaaaagatgattccacttctcttctgactgaagtactcatagagctccgtgacctccaagcttttatggacttgcttggtttattctatggattgaatcagtttatggatgcattatgctatgattttgatgttgccttagttcctttctccag

SEQ ID NO: 89533 - DNA, 836 bp, Glycine max
  Peptide Sequence Number=SeqID_181218
tacacgtcgtcgccatcagaggactgcacaccctcacattcagagggctacacgtcctcctcttcagaggactacaggtcctcacctttagagggctacacgccctcgcctttagaggactacacgtcctcgccttcagaggactacacgtcctccccttcagaggagtacatgtgctcacctttagaggactacacgtccttggtattagaggactacatgtcctcagctttagaggagtacacgtcctcaccttcagagggccacacacccttgcctttagaggactacacgtcctcacctttagaggactacacgtcctcgccttcagagggctacacgccctcaccttcagaggactacacgtcctcgccttcagagggctgcacgccctcaccttcagagggctacacgcccttgcctttagaggactacacgtcctcgccttcagaggattacacgtcctccccttcagaggactacatgtcctcagctttagtggactacacgtcctcggcttcagaggactacatgccttcaccttcagaggactacacgtcctcggctttagagggctaaacgttcttatcttcagagggccacacgccctcgcctttagaggactacacgtcctcaccttcagaggactacatgtcctcgcctttagaggactacacgtcctcacctttagagggcaacacgccctcgccttcaaaaggctacacgccctcacctttagaggactatacgtcctcaacctcaagaggactacatgtcctcacacttcagaggactacacgtcgtcgccatcagaggctgcacactcacttcagagg

SEQ ID NO: 89534 - DNA, 468 bp, Glycine max
  Peptide Sequence Number=SeqID_181219
atggctgaagatcttttgaggaaaccaagaaaaggtgggactttagaagaggttggtcaggagtattttgatgatttggttttgagatcatttttccaacgttcaaatagaagtagttggtctcatgggaaatggtttgtgatgcatgacctcatgcatgatctagcgacatcactcagtggagatttttattttagatcagaagaacttgggaaagaaacaaagatcaataccaagactcgtcatttgtcatttgccaaattcaattcttcattcctggacaaccctgatgttgttggtagagtaaaatttctgagaactttcttgtccattatcaaatttgaagctgctccattcaacaatgaggaggcacaatgtatcataatctccaaacttatgtacttgagagttttatcatttggtgacttccaaagtttggattctttgcctgattcaatagaaaactga

SEQ ID NO: 89535 - DNA, 498 bp, Glycine max
  Peptide Sequence Number=SeqID_181220
atgaaagataagagggatgaggaagaaaaactagaaaaacaaaagaaaaaaaaggatagtaaggccttgtcttcaaaggccaaggggaaggaaaaggaggaaaaggattcctttaagaagattgttaagaaggaaaatcattttgcaacaaaaggtgatattaaaagagcactccttattaaacaatctttctaccttctcctatcaagggaaacatcccctagcatcgccatacctcttgagcttgaggttattcctcaagtaaaggagttgttggatgagggtttggttcacaagagcttaaatccttgtgctttgttaatgcctaaaatagggcttcccatggaccctaagagaataaaggtcattcttgagtggcctactccaccaagtgtcgaggaaagaattaatgagtttcaagaacctctggatttgaggtcaaatccttttcaagggggagggaatgatgcaatcctaccccccaagggcattggatag

SEQ ID NO: 89536 - DNA, 495 bp, Glycine max
  Peptide Sequence Number=SeqID_181221
atggttttctgcttcatcgtgttcgtttgtcacgcgcttcagcgtccttatgggtctcgagcttcagcaagggtaccttctttgtgggtgcatggtcgacatggaggctccactggtgacatcgtggaccgaggatattccagggaggttacaggtaggaaatggtgtaattattttgagtggcatgatccagttgccaacattcgtcagaagaagatcattgtagcattgatgaagaaggttgatgaattgaagttaagggaaaaggatttgcaaagcaggatcagtgacatgaagatgaaggaaaaaattatagggattgtattggttgtttcttgggtctgtgtttgcttgttagtgtgtttattatgtagcaaaggactgcaatttgataatgtagtagggaatgtaatttggcaatgtcataggggaatgttattggttgttggtggtttatttgctgggcctatgcaaatggtttttggttctttgtaa

SEQ ID NO: 89537 - DNA, 132 bp, Glycine max
  Peptide Sequence Number=SeqID_181222
atggcttcctatggcgaagcaaaggactccattgatgaagaagattcaaggcctacaagctctacatggagctacattagctttggcggggttactggccattttcagaaggtgaaggaggttggaaggtag

SEQ ID NO: 89538 - DNA, 248 bp, Glycine max
  Peptide Sequence Number=SeqID_181223
atgaccatctctacaacattgacagtagagtacatattcccttccatgatttggttttcttctgagcttttgatgcaatcctcccaaggaggggacccatcaccagagccatggctaggagactctaggaagattgggccaggtgtcgcaacctacctttcagtgggagggcgacgcgagacttacgggagcatcttccaaggaaggaaaacgcgcggagtcaccaccaacgtttatttgaggaaaat

SEQ ID NO: 89539 - DNA, 525 bp, Glycine max
  Peptide Sequence Number=SeqID_181224
atgagaggagaagagcaatctgtagtcaatgagcaacttgaagcttatgttgcaaacatttataatagaccccctcagcagcaaaaccaacaacaacagaataattatgatctttcaagcaaaaaatacaatccaggttggaggaatcatccaaatctgagatggacaagtcctccacaacaacaacagcctgtccctcccttccagaatgctgctggtccaagcaagccatatgttcctcctccaatgcagcaacaacaaagacaacaagcaactgaggctcctcctcaaacttccttagaagagttaaatccaaaaaatgtgagtgctatcaccttgaggtttggcaaccaaattcaagtgcctccaccagtagcaacacctgcacctgaacctgtcaagcttcattctacacctgaaaaagaggatgagctagctgcacaaaagagaaagcttcctgatcatgagggagctaacacaaattttcatgcaggtggaccttctttgagtagttctgacttgtag

SEQ ID NO: 89540 - DNA, 366 bp, Glycine max
  Peptide Sequence Number=SeqID_181225
atgatagttaatcaacaagtaaaggtggccaaagatcaactagctatgaaagataagaggaatgaggaagaaaaactagaaaaacaaaagaaaaagaaggatagtaaggccttgtctccaaaggccaaggggaaggaaaaagaggaaaaggattcctccaagaagattgttaagaaggaaaatcattttgcaacaaaatgtgatattaaaagagcactcattcttaaacaatctttctaccttctcctatcgagggaaatatcccttagcactgccatacctcttgagcttgaggttattcctcaagtaaaggagttgttggatgagggtttgagaattacacttcaaagttcaaacctcatttga

SEQ ID NO: 89541 - DNA, 498 bp, Glycine max
  Peptide Sequence Number=SeqID_181226
atggaaggcataacagagggagtgaacaacatcatgaatcccctcttccaagacgatgagaaggcctctgcttgtccttttgtgtctgagcggtccaaattggcttattctaaggatgagaacagatatttgaaacgcggagtgaatgaaaagggtagagtagctaatgatgttgagacagaacagcaactggttaattcttgggttgactggcatcttctattgtccagtgacatcaaatgtgaggctagatggattttcgcattattcctacacccaaggaaaaagaaatcgaggaagtataggacggaccaggggctatacgcggagctgagcgaggcgatggagtgtttggagcacatatgctatgatgggtgtacccacgttgaaccgtacgatgctgcggaggtgaagagggagaggactccgtgtggaagaatcgccacgtgccaggctcttcaggttctgatccgccactttgccacgtgcgagaagaag

SEQ ID NO: 89542 - DNA, 912 bp, Glycine max
  Peptide Sequence Number=SeqID_181227
atgcatatcttcaaggatcttgtagaaaaccccattctctatgctggagatcttggctccccctttagtggaagatttgttgaggatcaagatccttgctcaagatttgttgttaaagatgcatggcacccgtgtggggctggggcggatagtactcccccgctccccgtccccgaaccttaccctgctccctgtccccgtctctgctccccgtggtgggggtgcaacgaaggcttccatgggttcacggctgaaacaaacagtgaagaaggaacggtgaaacgaacagtgaagaagcggataagtgaagagggtgaagacagtgtgaaacggggctgtctggtggttttcgcagtggtctcagcgttgggcgtgtgtggccctgctctttactggcgattcaagaacgccatcactctccgcaacaacaacaacaaactctcttgcccttcctgcctctgtgactgccctccccctctctcgctcttccaacttgctcctgggctggcgaatctctctgtctcagatgagatcagtgagggtggtaactcttgtattctcaattgcaaagagctgactattaggagcgtgaataagttagatcagctacattgtggaagtaatgacccggatctaaaggaggagatggagaagcagtttgtggaccttctcagcgaggagttgaagttgcaagagtctgttactgaagcaaacactcggcacatgaacataactttggctgaagcaaaaagagtggcgtctcagtaccagagagaggcagataaatgcataactgcaactgaaacatgcgagcaggcaagagaacgtgctcaggccatactcacaaaggagaaaaagatgacttcggtgtgggagaaacgagctcgtcaaatgggttgggaaggagaataa

SEQ ID NO: 89543 - DNA, 204 bp, Glycine max
  Peptide Sequence Number=SeqID_181228
atggtggagaagattcctctcttcttcaaaagattttggacaggttcgatggtcttcaaacctttgtttgtgaaaggtttgatactttggagttacaagtggacatgcgattcaatgagatggagtcaaggatcaccaagggttgtcatcatcaaaaagggggagattgtagaagcaagcttcatgatgttgaatccagattga

SEQ ID NO: 89544 - DNA, 399 bp, Glycine max
  Peptide Sequence Number=SeqID_181229
atgagtgatggattttgcggtactcatttgcagatcatgattaggaccaaaggattaggtcgtgccttaggtcaggtcactcgcaaaggtgtgggcagaggagatcatgatgattccgatgatgctccacaccgtcgacgacctactgcatccgcacggaggcagcgagtcgctgtgactgcggatcacgtcgatgacccagttatccctaacccagatgttcaagatgacccaatggaggcactagctgttgtggaggacattcctgcggacattcctgcggacgtaggcgcagaggcggctgaggatcagcctcagggatttccgagtggtctgagcgacccatctgtgctgacagcgtatgcggatcacgttgcttgcaacgtatggacgggagag

SEQ ID NO: 89545 - DNA, 522 bp, Glycine max
  Peptide Sequence Number=SeqID_181230
gccgccttggagtttgatagtcaccggttccggagtgccgagcaccagcagcgcttcgaggccatcaagggatggtcatttcatagggagaggcgtctccagctcagggaggacgagtaccctgacttccagggtgagatagctcgtaggcattgggcacaactagtgacccctatggctaaattcgacccggagatagtcatagaattctatgccaacgcttggcccactgaggagggggagaaccagcagtgtgaatttagccagaggaggaaccaggcagacggtttcgataaggaagccatcacccagctgctgtgcataccggggcaggatttcgcccggagcgctgctgggaggcgggtgtgtatcatgcgcaccaacatgactaccctgacccagatatggatggcactgctgttcagcaatgtcttgcctagcgaccataacttcgacctccctctgcctaagtgccagttggtctatgccatccagacacggaagagcgttcacgtggccaag

SEQ ID NO: 89546 - DNA, 399 bp, Glycine max
  Peptide Sequence Number=SeqID_181231
atggctatccaaaagcgttgcgaaagtactctgtacaaactgcgacctctcgccgtcctgtcacgacagcacggtagtagcttcagcagtttaagggggctgcgaggcgacgttgccgtcctaaaatcgatgtggattttccaagagacacctgaagtttccggtttttctttgtctttgccgcttcgccttgatagagatgttcagccgaagcaatatcccatattgcaccgccttggaaatttcttggagcgtgccccgccagttggttacaatacgggctgttccgggggctttgctcaacgatggggtggagatgtcgaacaagaagaaaccgctggtcgttcttacgcgaaaattgccggacccagtggaaacccgaatgcgggaactgtttga

SEQ ID NO: 89547 - DNA, 1850 bp, Glycine max
  Peptide Sequence Number=SeqID_181232
gatttcgacccgcaggtgcaggaatcgatcaaccgcatacagggttgtgcagcagacgctggacatcctgcgcgcctgccgcgacagcggcatgcgttcggtcaacgtcgacctgatctatggcctgccggggcagagcctggaaggattcggccgcaccctcgaacgggtgctggcgcttcgcccggatcgcctggcggtgtatggctacgcgcatctgccgcatctgttccgcgcgcagaagcagatcgacgaaggccgcttgccttcgccggaagacaagctggcgctgctgggcctggcggtggagaagctctccgcggctggctaccagtacatcggcatggatcacttcgcactgccggaagaggatctgtcgcgcgcacagcgcgccggccagctgcatcgcaacttcatgggctataccacccacaccgatactgatctgcttggcctgggcgtgagtgcgatcagccacatcggtgccacctacagccagaatccgcgcgatctgccgtcgtgggaggatacggtggaccaaggccagctgccggtctggcgcggcgtggcgttgagtgccgacgaccagctgcgtgcggaactgatccagcagctgatgtgccagggcgaggtggatggcgtgctgctggggcagcgtcacggtgtggatttcgagcagtacttcgccgaggacctgcgttcggtgcagcggctgcaggaagacggcctggccgaataccgcgatggcgtggtgcgtgccagcgaacctgggcggccattgctgcggttgctggcgatgtgcttcgacccgtacctgcgtgccgcgcacatgagcaaccgcgttattcgcgggcgatctgaaggtagcgtgtgctgcgctcgcgtgcgcggcgccgattgtagcccacctgcggtgccgcgaccggattgcatcacggcggcggcgtgcttaactgtcgatcgcattcatgtcatagtctttgccatcgttcccaggggggggagccacctgatgtcgctgcacgcgattgcctatgccagtgaggcccgcgccgatctgcagacaaccgatcttgaccgcctgctggccgacgccacggcattcaatcgtgtagccggtgtcaccggtgtcctgatgttcgacggagcacgcttcctgcagtatctcgagggcccggaggacggcatcgattcggtgttccagcgcattctcaacgcgcgcagccacgtgcagctgaaagtgctgtgccgtgcacccgtggtgcagcgcgcatttccgcgctggtcgatgggcacgcggcggatcgagccggagctgctggcgcagattgtggatgccgcgtggcccggcttcctgcttggcagtggtggattcgagcgcctgctgcaggcctggaccggcgccgacggtgaactggaaccggccgcggtggcgttgggtggtgcagcagatgagtgtgttggccgaagccatggcagcgtatgtgcgatcgcatccgttgcacgggatgtgccgatgagtgcgccggttgcggcggccagcgccccccggtttgccgtgatcggcctgggttatgtcggcctgcctttggcggtggcgtttggccggcagtggccgacgttgggcttcgatatcgatgccggtcgcatcgccgaactgcgcagcggccaggaccacacgctggaaatggaagccgacgagctggccagtgcgcagctgctgcagttcggcagtgatccggcattgcttgatgcctgcaatgtctacatcgtcaccgtgccgaccccgatcgatgcatacgagcagcccgacctggagcccctgcgttcggcgacacgactgattgcca

SEQ ID NO: 89548 - DNA, 519 bp, Glycine max
  Peptide Sequence Number=SeqID_181233
atggagttggatgcgatcaagagtgaattatcccaaattcatacgcaacagtcagctcccccaagaccgtctaaccctgacgtatttgttgcacgtgttagcacgaaagagagttgtgctgaagctgctaataatgttgttggtaacgagcggtctacatttgatacatgtagtatgggcttctacattgtttgtggtgacagtacacagctggtggcagggggaaaggtctttggagtaggtggcttgatacacacagttgcttatggagatgatgtagtaagggtgtgtgttgacactgtatacgatggtgaagccattgtcccgttacccacttcagagattcaatatgtcagggacgccgtgaactcattcattggatggcccagacatctagtgaaacctttatcttatgattctgaccttaatgtgcggaagccagttgaacatagtagtgatgcaaagcttgcagaatccagtggaagtgccgtgggaggcgaaccaatttggacttcctga

SEQ ID NO: 89549 - DNA, 191 bp, Glycine max
  Peptide Sequence Number=SeqID_181234
attgcttctacacttctttcccttcctctagtggaagtgaagaggaagtaaggggtgaagagtctagtaaggaagtctaccctcgtgaagaaggtgacctcttaatggttagaaggctccttggaggccaatcttgtgatctatcccaatctcaaagagataacatctttcatcaagatgaaattttttag

SEQ ID NO: 89550 - DNA, 432 bp, Glycine max
  Peptide Sequence Number=SeqID_181235
atggcagcgcagttaatccatgattgcgtggtgatggagtgcctagagggagtttgggagaccctcgaaggcaatgagaggtgccaattccgtggcacgattcgactcacttctacttcattggtacatccagaggaacccgcacacacgcttcagcagcctgtggagtggatactacctacacctactccatatcgactagtggagccagttcaagtgatagaggtgtcatcctctgaagaagatcctgaagaggacccagaggagttacctcttgagcctgctgtagatgctcttgactttccagaggatgatgaggacccactccctgacgtggattctctagaggatatcatgtcagcatctaaggtagactctacagaggagagtggccctggagggacaacgaatagtgaagactcttcatcatag

SEQ ID NO: 89551 - DNA, 837 bp, Glycine max
  Peptide Sequence Number=SeqID_181236
gtcgactctagaggatcccctgaacaaccgatagaccaatcgcagcacactttccgtttgattcttaaagccttgagcgaaccgggccaccgggtgacgctgccgaacggcccggcctgggcgccgctgaacgccgccagcaccgccgcgctgctgacgctggccgatcaggaaacgccgctgcagctgtgcgcggcgcttaaaactgcaggccgccgatctgcaggcgttaccgcacggcacggaaatctcgccggagttcggtgccacggtcatcgtgcagctcggcgaactggagaacggcgccgcgctgcgcctgaccggccccggcatcgagaatcatcgcctgatagcgccgcgcctgccgccggcgctgctggattacctggtcaaccgcccgcagcgcttcccgctggggctggatattttgctgacctgcggcgatcgcctgctggcgatcccgcggaccacccgcgtggaggtgtgctgatgtacgtagcggtaaaagggggcgaaaaagccattgaggccgcccatcagctgcaggaacagctgcggcgcggcgacgacgcgctgccggcgctcggcgcggaacaaatcgaacagcagctggggctggcggtggatcgggtgatgaccgaaggcggcatctacgatcgcgagctggcggcgctggccatcaaacaggccagcggcgatctggtggaggcgatcttcctgctgcgcgcctatcgcaccaccctgccgcgcctggcggtcagcgagccgctggccagccaaaacatgcggctggagcggcgcatttcggcggtttacaaggacttgcccggcgggcag

SEQ ID NO: 89552 - DNA, 372 bp, Glycine max
  Peptide Sequence Number=SeqID_181237
atggaagctactcagaaaggacttgaccacattagctcagacgtggagtgtcctatcttactccaacctagctcccacatcccacacctcagatttaaacatggagagctaggtcaaatctcttctattgctcagagtaactcctctaggctcggatttccagccttgattattgctctctacaaagctaggggggttacttctaatagcttgacctatgagagcctgagcccggccattaatttggcctacattaaaaagaattgttggaatttgggttatctaacagttaacttcagagggacaaggaaagtaagggctcgaccagctgatgtttcctcttcttctactccaccagcgcgagtattataa

SEQ ID NO: 89553 - DNA, 195 bp, Glycine max
  Peptide Sequence Number=SeqID_181238
atggaaaaatccgacaagatgaatttcaaagagaagaaagaaaagaaaggatatatcacttgggaagataatataaatgaatatgtgatttatgaagacagcaagcgaaggccacatttctccccaagaaaagtgaatatgcgatatatggagacaacaaacaaaggcctcttgatcaacaaccccaacaagtaa

SEQ ID NO: 89554 - DNA, 378 bp, Glycine max
  Peptide Sequence Number=SeqID_181239
atggcatcttcgtcgtcatgctcatcaaatatacaaactaggtctggtccaattgatggtgacgttttgtggatgcaacccaagcatgtttcaaaacatgtttggaatgggaaaccagacagaaaattacacatcagacgagcagtccccacgtatcaaggtgaagaacaaatatcagaggaaattgttcctctgcttcagcaatctgggttttactggataatgaagatgggatacctaaagataaatgcggcattaattagtcttcgtactgacggggcaccattaattggttcaacaaatcttgattgggccaatttatgtgaagaattattaggagtcagaccacatgaaggcgacttgaaggcagtgtggtaa

SEQ ID NO: 89555 - DNA, 255 bp, Glycine max
  Peptide Sequence Number=SeqID_181240
atgaggacgcgtagccctctaaaggcgaggacgtgcagtcctctgaaggtgagggcgtgcagccctctgatggtgagggcgtgcaaccctttgatggcgaggacgtgcaaccctctgaaggcgagggcttgtagccctctaaagattgactgcccttttgaaagaggtgatagtccattcaaccttatcctatcttttgcaaatctctccgggaactccctcaaagtgtgtgttctgtttgatttagtcacttga

SEQ ID NO: 89556 - DNA, 234 bp, Glycine max
  Peptide Sequence Number=SeqID_181241
atggatatcggcattctaatgaactacccaggtgaaaatgaagcatgttcgaaggttcagagtttagaagatattatgggtactatcattgagaacaatgaagaggatgacggcgaagatgatacggtgtctttggagtctgttacgcgaatggaagcacttatgacgtcgaacactcttcacaactttatgatacaatacaaaatacaacacctgagatattggatacaataa

SEQ ID NO: 89557 - DNA, 258 bp, Glycine max
  Peptide Sequence Number=SeqID_181242
atgaaccaaaccctcatccaacaactcctttacctgaggaataacctcaagcccaagaggtatgacagtgctaacaagtgtcttttaagaaaggagaggatgtggaggttgtctaagagggagacacttacctccttacacttctccttaaccattaaaggtcgtccttcttcttggggtcagatttcttcactagattcttccccgtttgcttcttcactttcactagaggaaggtgaagtagtagccttatcttag

SEQ ID NO: 89558 - DNA, 435 bp, Glycine max
  Peptide Sequence Number=SeqID_181243
atgaacgaaaacgcaattgatggggctccgaaaaagggtgagaatggagaattgcactatgaaatcactacgcatggctccaaactcgaaggtggaggacacatgaacgaaaacgcaattcatggggctccgaaaaagggtgagaatggagaattgcactatgcaatcactacgcatagctcgaaactcgaaggtggaggacacatgaacgaaaacgcaattcgtcgggctccgaaaagattgagaatggagaattgcactaagtggaggacacaagaacgaaaacgcaattcgtcgggctccgaaaagattgagaatggtgaattgcactatgcaatcactacgcatggctccgaactcgaaggtggaggactaatgatcgaaaacgcaattcatggggctccgaaaaagggtgagaatggagaattgcactaa

SEQ ID NO: 89559 - DNA, 495 bp, Glycine max
  Peptide Sequence Number=SeqID_181244
atgggctggttaagcctgaaaacaggccgctggcaactggctgcgctttgcccgctggccctggcgctgctggtcgggttggctatcccacaaaaggtacgtgatagcaaacagccgcagagcttcgtgagtgccgttcggccacagctggcgcagagccgctatctggtggtgaacaattccggcatcgcttctgcggtcgcatgggaattgcgccgcagcgatatcactttcttcgatgaaaaaggtgagctggaggacggctggtctactacggctacaacgcgacaccatgaatctgctgctgatcctgctggtaagcctgctcagttgtgccgcccagctgtgccagaaacaggcggcccactgcggcgggcaccgcctgttcggctggctggtgctcagcctgctgctgctggggacggcgatgctgctgtggctggtggtgctgcgcacgtgccggtcagcggggcttaccccgatgctgagccctga

SEQ ID NO: 89560 - DNA, 297 bp, Glycine max
  Peptide Sequence Number=SeqID_181245
atgtcgtcttttgtaccctttgtcaaccagaggcaagcaagcccgttgacacgtggagatttacgttgtcttccacgcagactacctctgtcaagcactaacccacgcaagcgagcccgttcacacgcggagatttacgtcgtcttcggtgcagactacctctgtcaaccactaacccgtgagcatgcaaagactaacgtcgtcttctgcaccctttttcaaccagaggccatcgagtccgttgacacgcggagatttacgtcgtcttcagcgcagactacctctgtcaaccactaa

SEQ ID NO: 89561 - DNA, 178 bp, Glycine max
  Peptide Sequence Number=SeqID_181246
cacgttggccgcttaaaagtgaacgactcttctttcttgggagatcccactgttccttcttccgagggcaaggatggaaattctcatcctgggtcaagttccgggataaaggaatgtcgcacactttttccattacacacatgcaacaatgatgatttggaaattttatggaaaactg

SEQ ID NO: 89562 - DNA, 131 bp, Glycine max
  Peptide Sequence Number=SeqID_181247
atggcggaaccatcacagaagcgaaaggacacttcgagtcggagtcaacggcattctgggtcacaggaaccgccgattccttcctccattccctctagatcattgttttcatctgaggaacaacggatacg

SEQ ID NO: 89563 - DNA, 188 bp, Glycine max
  Peptide Sequence Number=SeqID_181248
atggatgctcatccgcgtcaggatggcgtacaccagctgacacttcggccgggggaggtcggaattatggtcgatgtgcaggatgttgctgagcagcaaagtcatccatatctgagtcagggtggtcatgttggtgcgcataattcgcactcgcctccctgcagcagtccaggcaaaatcccgccccg

SEQ ID NO: 89564 - DNA, 168 bp, Glycine max
  Peptide Sequence Number=SeqID_181249
atgaaaaacgggaaaaagaggcaggtggttgccgcccagctcgcccaagtgagctcagcttgcctaggcaagctggggttgcttccaccagaaggcaccgccttctgttggaaccccctggaaggcccaagtgggcctggttgctatttgcacacccctttttactaa

SEQ ID NO: 89565 - DNA, 1419 bp, Glycine max
  Peptide Sequence Number=SeqID_181250
atggtggtgcctgagtctcagatgaattcccaaaacgaggtagaatcgccgctacaattggaggagcagcaacaacaacaaaacaacaacaacaacaagaaccacccattctcatcactaggaagacaatcttcttcaatatactcgctcaccctcgacgagttccaacacactctatgggagaatggcaagaattttgggtccatgaacatggacgagttcctcagcagcatatggagtgcagaagagaatcaagttttgaacaattccgtctctaaccacaacaacttgtctttagaagcttcaacagagaaaggtgtgataaggaaggaaccaagccttcctcggcaaggttctctaacacttcctgcacctttgtgtaggaaaacagtggacgaggtttggtctgagatacacaaaggacaacaatctcaacaacaacagcaacagaacaataacactaacaacaattgtggcagtaataataataataatgtacagaataccgaatctgcccctcgccaacctacgtttggagagatgactttggaggatttcttggttaaagctggggtagttagggaacagggtggaatggctgcaatgcctgttcaagcttcagcacatcagcatgtgcaacaatatggcatgtatccaaataacaaccctacaatgggggcttcttttgtcggtaggccggtgatggggatggccggtggcgtccgtgttggcagtggtggtagaaatgtggttgcaccgccttaccaggcggtgcctcagggtggtgttggtgttggtgttggtggtgcaattgcggagtcttcagggtatgctggaaatggaaagagggatgttgggtatccaccgggggcgccgggggtttgctttggagggagggtggtgaatggtggcggtggctatgcggcagtgagtaatatgggagtggtggcgccggttagcccggtttcgccggaggggataggaaccggcgaaaactctggtgggcagtttgggatggacatgagtatgttgagagggagaaagagggtgttggatggtcctgtggagaaggtggtggagagaaggcagaggaggatgatcaagaacagagaatcagcagccagatctagagcaagaaaacagagatactgtgcaatgtgcattgcttcttgtgaatacatgccatacatatattcatcctttacaatatttattcttgcatacactgttgaactggaagcagaattgaaccaattgaaagaagagaacggccaacttaaactagctctggccgatcttgagaggagaagaaagcaacagcatttagatcaggaagtgaatggaagagttcaaaccaacgcccagaaggccaaaaagaaattgagatcattgagaaagaccctaagttgccctttatga

SEQ ID NO: 89566 - DNA, 585 bp, Glycine max
  Peptide Sequence Number=SeqID_181251
atggatagcgatgaatctggtggtcatgtaatcgtgtcgggggtaaggttgtgggtggttggaaaattggttggtaagtgtctaggagcttttggagggccatgggtaaaggaatatctggagaagggggaagagaaggactctcgtgaagctgaaggtgaaagaaggccgcgacccagtctgtttggagcaagcgccggatctgggcatgggtggcctctactgggctgggtgaaggaaacgagctatgtgatcctgaataaaattgtgcttactcccgccgtcgacaaggatgacgactttgtgaccctggacggaacctgtgacgcgcagggtggacgatacggaatgtctggccatgacatgcagaatgggttcatctgggaggggttcgtcaggagcgacgagaaggaagaatttggctctacacctgtggtttgtggtggcgccaaaagtagaggtggagggggtggtaccaaagtaatgggaggggcgacgaaggaggaattggggtgtcaaggacacgatggccatttggcgtcgttgattttgtcttcttgtagcttcgctagtgccgcagcctga

SEQ ID NO: 89567 - DNA, 231 bp, Glycine max
  Peptide Sequence Number=SeqID_181252
atgaaccgccacgagcagaagaagctcatcgtcaagaacgagaacgatatgcgcgaccaaatccgcaagaaagacgacatcgaggagaagcccgagaaggctgacgcccagcgccgcaaggtggcctccgctgaactatacaacaccttcaacatacgcatcgaccgacattggagtgagaagaagctcgaggagatgacagaaagggattgccctaagggtcgagcttga

SEQ ID NO: 89568 - DNA, 117 bp, Glycine max
  Peptide Sequence Number=SeqID_181253
atggcgggactgcccacgttggcatgtcccgccaatacgaatggcgacacgaggtatatcgctgatggcaatggcgatacatgcttgccgccagtaggaatggcggaatcaacgtaa

SEQ ID NO: 89569 - DNA, 228 bp, Glycine max
  Peptide Sequence Number=SeqID_181254
atgcaaaagaaggacatgaaggacgtgaacgaacgtgaggtgcctgggtctcgctggtgctactggcggaatgcccagtcccagtcagcacctatatcgctggtgctactggcgataccagcttcttgcccagtcagctttggttccgcttttgccaatggcggtacacatgtactaacttgtcatcatgatgtatgtggcatgctcgagggtccagacaaatcctaa

SEQ ID NO: 89570 - DNA, 986 bp, Glycine max
  Peptide Sequence Number=SeqID_181255
gaatcagaccacagaaagcaagtcaaaaatggggtggttggagtaccgaggaaatgtttggaagcaaaagcaagagtcttggcaggtaaaggcgaatgggccccgttcatggacatcctcgcacttttgatcttcggaggggtcctctttccaaatatggatgggttggtggaccagacagcgattgacgcttttcttgcctttcatgaccgcaaggaaagcctggttgtcactatcttagccaatctatatgacaccttcgaccgaagatgtgaaaagaacagtacaaggattgtttgctgtactccgaccctctacgtatggttggtttcacaccttttccgccaagaggtgagacatgcttgcccgctagaaggccaccggtcatgcatagagaaaaaagaggcaagttgggaccgactcttagcaagcaaagaaggagcatttgtcaacttgttcccccgatggaaagaaggaagaaccgggattcttatttcgtgcagaggatttccaaatgttcccttgatggggacaaggggttgcattaattacaatcccatcctcgccataagacaactgggctaccctatgagaggggcaccattagaggaagacctcacacctattatttcacgaggtttcaatacaaccaacgtggaggcacttcagaaggtccgcaaggcattggagatggtgcaaaagaaggacaaggaactcagaggcagtagcaacgggcctatcggtggctaccataggtggttgaaagcctacacaagggcccgtagggaagaacatggccggaacaaattccgaggggctctgtggggcagtaacagcgagcttaagctccggagagaggaaagggaccaatcacgagtagacaatttgctcttgaaggatgacttgaggatttgcctaaggtccaagagaagcttgtctcagcggttatgcgagaccgagaccaacatgttagccatcatcagcaa

SEQ ID NO: 89571 - DNA, 480 bp, Glycine max
  Peptide Sequence Number=SeqID_181256
atggaagagaagaaagtccttattattacttattactggcctcccgcaggaggtcctggtgttcagaggtggttgaagttcgcaaaatatttacctgattttgggtggaaacctattatttacactccggaaaatccgagttacccgttattggatgaaagcttgctgaaagaagttccaagagacctgaaaattgtaaaaacaacaatctgggaaccttaccagcttgctgaaaaactaaataaaagtaataagaagtttaaggccggccaatttgatgtaggcaaaaaccaaagctggaaatctaagctttccatttggatttcagggatccatggacagaaatctcctattataagcatctcaaacttaccaaaagatctgatcagaaacacagaaaactggaaagtgaagttttcagaaatgcagacattactcttgcaaccagttatacagatgctgaaaatttccgaaaaaagg

SEQ ID NO: 89572 - DNA, 189 bp, Glycine max
  Peptide Sequence Number=SeqID_181257
atggcttcctatggtgatgatgacaaaaagcccaagagaatgatttcaagattgagtcaagaacaattcaagaatcaagagaaatttgatttcaagattcaagaaaagatgaattcaagattcaagagaagaaatcaagaagacctcacaagggaagtattgaaaagatttttcaaaaaacaaacatag

SEQ ID NO: 89573 - DNA, 915 bp, Glycine max
  Peptide Sequence Number=SeqID_181258
atgggccgcgctgcgctggtcccaggcgttgaagccggcagtagcaccgagcagcagcccaagcaccatgcccagcacggccacgcggtcgcgcagcagcaggcgccattcctcgcgtgcaatggtccaggccgtgctcatgccgcggccccctgcacgcctgcgtctgcgtctgcgtttgcgtttgcactcgcactcgcactcgcacccgaacctcctgccgcccgcgatgaagcccatgcggtcggccacatcggccgcccccagcaggtcgtgcgtgaccatgagaatggccacgccctggccgcgcagctgcgtgatcagccggctgaattcggccgtggcctgcgggtccaggcccgaagtgggttcgtccagcagcagcgccggcaccttgcgtgccagcgccagcgcaatggccaccttctgccgcattcccttggaaaagcccgagacgcgccggtcatgcgcggccgcatccagccctgcagcggacaaggcctggccgatggcatccctgctggcgggctggcccgccaggtccagcagataggccacgttctcgcgcgcgctcaggtgctcgtacagcgccacgttctcggggatataggcgatcaggccgcgcgcctgcgcggcagccgtcaccgggtccacgccctgcacgcgcacctggccgctgcgcggccgcacaaagcccaggaacaggctcagcgtggtggtcttgcccgcgccgttggcgcccagcagcgcatagatctcgccggcatgcacggccaggtccaggccctggaggatggtgcgctcgccatagtccaccacggcgcccagtgcttggagcacgggcgaggaggcagaagtggggttggaagaaacaggaagggatggatgcatggcggggctcagaacttggcttga

SEQ ID NO: 89574 - DNA, 307 bp, Glycine max
  Peptide Sequence Number=SeqID_181259
atggagaaatctgaaaagaaaaatcttagtgaaaagaaactgaagaaagcatacatcacatgggatgaaaatgatatggaatcttctgaagattcagaaaatgaagagataaatctctgccttatggctaaaagttacgaaagtgatgaagaggtgtctttgaggaagaagtggtacatagatagcggatgctcaaaacatatgactggagatgcatcaaattttacacatatctctccaaagaaaagtgggcacgtaacatatggtgacaacaacaaaggtagaatccttggagttggtgaaatag

SEQ ID NO: 89575 - DNA, 531 bp, Glycine max
  Peptide Sequence Number=SeqID_181260
atgggattgagccaggcgccttcgcttaaaaagaggttctatcaagtcaagatcaagagcctaagagtcaccagtctgaaagagttaagacagttgatgggtcagctccagcgacaagccttttgcaaaacttatggtaagatttgggacctaaccatggcagaggtctccacggaggccattgcctccctcgcccaatattatgaccagcctttgaggtgcttcacctttggggacttccagttaacacccacggtggaagagtttgaagagatccttggatgccctctgggaggaaggaaaccatatctcttctcgggattctatccctccttagctagaatttctaaaatagtcaaaatctcgacacaggaattggaccgcgggaagcaagaaatgtttggaagtaaaggcgagagtcttggaaagtcaagacgaatgggccccgttcatggacatcctgacacttttgatcttcggggtggtcctctttccaaatgtggatgggttggtggaccgagcagcgattga

SEQ ID NO: 89576 - DNA, 96 bp, Glycine max
  Peptide Sequence Number=SeqID_181261
atgtctggcctgtctgttggtttaagattcaaaggtgaaactgagccgctcttattcaaccatggtataagcttcaacaatgagttgttgaaatag

SEQ ID NO: 89577 - DNA, 298 bp, Glycine max
  Peptide Sequence Number=SeqID_181262
aacttgtaaagggattttgcaagatagtggaactctcaagcgggtttcttggggactggacgtaggcacaggggtgtggctgaaccagcactggtggtatgagcataagaggattcatcaaacactgtttaattctcttaaatgctacctgacaattgtcttcccacttaacagactaattcttacgcaacaacttgaaaagaggctctcagagatattttttccttttggaagatacaagagcggaacaatcaacctattgatattagaagactcatatgattcttccaatgtataa

SEQ ID NO: 89578 - DNA, 180 bp, Glycine max
  Peptide Sequence Number=SeqID_181263
ctgctccaggtcttcaggagccatggacgaagaactccaggaggtccttggagctggtccaaagtattatttgatcgtgacatcggctctagcagcacgcacatgaccagggtgttctggttatccaatggcagcagtcagtacatcctgacgtccatgggcgataaaggaatcctgtaa

SEQ ID NO: 89579 - DNA, 456 bp, Glycine max
  Peptide Sequence Number=SeqID_181264
atggcgctgcgccaggctgattgcggtgcgctgcagatgttcagcgcgctggctgtcctgccagccgagcgacacatcttccagctggcacacctgttcatgctcaatcagatagcgcagttcggtggcgctgtaaccggcatgatgctgcagcggctgttcgccgtgctgctgaatctgctgcagcagcggcagggcccggctgccgtagcgtttcgccagttgcgtcacgcgtgccagcggaaggtcatagtgctgcgccagcgcactgagccaggcgggctgggcggacggcgccggaaaatcccggccgccgccaatcggcaggtcgctgctggagacgcgacgcttttctcccagcaggcgcaacacgcggtcggcggcctcctccccgaagcggcggaaggtagtccatttaccgccgaccagacacagcgtgctccaggcacgcgcgtg

SEQ ID NO: 89580 - DNA, 276 bp, Glycine max
  Peptide Sequence Number=SeqID_181265
atggatgatatattcaaggacttatggaagctaaagatcccagctaaagcatcaatttttgctgggaggttaattagagatagattaccgactaagtctaatatgcgagaaaggaaaattgatataaatgacagcctgtgtcctttctgcacaaaacacaacattttggtgggaatccctatcatggataggcacctcgggggcctatcctataaatccaaggctccactttctgcagcacaacaatgggatgaaaggtgggaagaaatacaatag

SEQ ID NO: 89581 - DNA, 114 bp, Glycine max
  Peptide Sequence Number=SeqID_181266
atggagatgtccaaaatcgcatcaaaactcaagtcacttaagttagagcttggtgaagacctgctcatacacttgattttgatctcacttcctgcacactttgggcaattccaa

SEQ ID NO: 89582 - DNA, 998 bp, Glycine max
  Peptide Sequence Number=SeqID_181267
atggggacaaatcaaactggcaaaaggttttatcaagtcaagattaagagcctagatatcaccagcattaaggagttagggctgttgatgggacctctccaaatgcaagccttccgcaaggtgtacggagagatcttagatttgaccatagcagagatatccacagaagccattgcatcactcacccaatactatgaccatcccttgaggtgcttcacgtttggagacttgcaattagtaccaaccgttgaagaatttgaggagattctaggatgtcctcttgggggaaggaaaccgtatcttttctccgggtttcttccctccttgagcaaaattgcaattgtggtcagggattcggcgagaggattggactgcgtaaagcaaactcgaaatggcatagtgggcctaccacgaaagtacttagaaggcaaggtgagggatatggcaaatcaagaggagtgggttccatttatggatgtattagcattgctaatctttggggttgtccttttttcaaacgtggatggtttggtggacctagccacaattgatgctttccttgcatatcaccatagcaaagagagcccggtggaaggaagggagggagtcctcttctcatgtggggactacccaaacatttcattgatagggacgaggggttgtattaactacaatcccgcactttctataagacagttagggtaccccatgaggggagcacccacggaagagagcctctcgcctttccttgtgagagatttcggcacgaaagataaagaacttaggggtatccgtaatggcatcatcggtgattatcatgaattgctgaaagttcatacacgagggttagattggctctccaaattgaaaattatcaacgaggagaacttcgaagctccggaagaggatgaagaagtccgagctctaaaaatagagctaggaaaggcaagacttgccaaagaaaaattcaagttagtcgctacagacgtccggaaaga

SEQ ID NO: 89583 - DNA, 492 bp, Glycine max
  Peptide Sequence Number=SeqID_181268
atggcttgcacccacattccgagacacctaacaacagccttcaaaattgccccatgtgtggcatctcttgtcaatgtcaggatttacacacgattctcctcaaatttcagccagcataaattagacctcgcaccttacgcttcagagccctacaatgctcaatgggacgccccgaggcttctccgtgacaagcacacattgcgttcgagtcgtattctcagagaaatgaaggttgatgaaccttggttggggttatggctaccattgaattatcaagtagatatgggagcaagtttagcatatgacaacggaatttggggtggtcttcgtcattggaaatgtgtcgactttgtggttgatttagggatggcctttgtggataactgggtggtgggtaaggagaaggaatggctgtcacagcatgggcttctcccttactctcaccctcttcatttgccccagttttctcattcgtctaagcaggatgactaa

SEQ ID NO: 89584 - DNA, 447 bp, Glycine max
  Peptide Sequence Number=SeqID_181269
atgactacaccacccagctctccttctctttctcctcttactgatgcagcatcacattccccttctaccttgaagtggacaagaaaagtcacacacctaagatcattggtgactagaccagttggggcagagagacccctgttccatgtggatcctgcaatagggaaagccgacggttcccacagaaagaagttaagaacatattcagtgatcgtggctcgcgataaggctgaatttgatatccctgaagcatctgatccaaggacaaaaaagaaaatacttcagactgtggggaagtggcggagacagtttaagtttgattttacttcgaaaggggcacttgcagcctacaaggacaatgtcaatgacactgtttgtgaaaagtacgacattagcaggggaaagtggacccaattttgtcagagccgcagagacccttcgtgggag

SEQ ID NO: 89585 - DNA, 159 bp, Glycine max
  Peptide Sequence Number=SeqID_181270
gtcgactctagaggatcccacgtattgaacagtgctttgaaaggacttgacgatactccacaaagtaaatccaaggcagctgctaggtggattattgttaaatatttcaatgatgctagatcattagaatcagagagattgaaggcgcttcacatctag

SEQ ID NO: 89586 - DNA, 1317 bp, Glycine max
  Peptide Sequence Number=SeqID_181271
atggattcaggtttctgcttggtgtcatcgccgaaccaccaagaagtagtccaaagccgtttcttcgacccctcatggctacaaatgcagccccacgtgcccatgagctttgtttggcccaaagagtgcttagtgaacgcgaatgaggagttccacgcgccaatggtggaccttggagggttcctaaggggtgatgatgatgacgccacaaaccgtgccgttaggctcgtacgcaaggcgtgctcgagccacgggttcttccaagtgatcaaccacggcgttgatcctctcctcattggggaagcgtatgatcaaatggacgctttctttaagcttcccattcgtaggaaagtgagtgttaaaaagactctgggttccgtgtggggatattctggtgcccatgctgataggttctcctccaaattgccctggaaagagaccctctctttcccctttcatgacaacaatgagttagagccgccggttgtcactagtttctttaacgacaccttagggggagactttgaacaagctggagtggtattccagaagtactgcgaaaccatgaagcagttggggataaagctattggagcttttggcaattagcttgggagtggataagttgcattataactacttgtttgaagaaggttgttccgtcatgagatgtaactattacccatcatgtcagcagccaagtcttgcactagggactggaccacattgtgacccaacgtctctcaccattcttcaccaagaccaagttggagggcttgatgtgttcgcagacaacacgtggcagaccgttccacctcgtcctgacgcccttgtaattaacatcggcgatactttcatggtgtttgaaaagcagcactaccaaactacacctatcagtcatggagtcaatggcgaaaatttgaggcttttcacaacaatcttcatactcaagtatagacgtcagtatctttcctccagtatttttgttcctggaaacaagtggtgggcagaacaagaaacagtcaagaagaagttgcagttgcaggcattatcaaacgggagatacaagagttgcctacatagggcagtggttaacaagtacaaagagaggaggtccttggcattctttctgtgcccgaaagaggacaaggtggtgagcgccccagaggatattgtgcgtagggatgggacaaaacagtatccagatttcacatggtcgaggttgcttgaattcacacaaaagtactacagagccgacgaagctacactgcaaaacttcaccaagtggttgctatcctccaaacaacaaacactttag

SEQ ID NO: 89587 - DNA, 159 bp, Glycine max
  Peptide Sequence Number=SeqID_181272
atggtgaacgacattttcatactatctaggcacaaggaaaacatggcaaaaataccattgaggcatttcaccgagcacttggtgggcgcacttttgggtaccaacaacaagggaatgggggcaatgtggcttgccccatcatctcagaacacaacctag

SEQ ID NO: 89588 - DNA, 267 bp, Glycine max
  Peptide Sequence Number=SeqID_181273
atgaagcccccggatgtccaagaagatcatatctttctaaaggcttttcctcattctctggagggagtgacaaaagattggctatactaccttgctcccagttgccctcaccaccagatttctgagcaacttcttcttcaatatttctatgagggacttagcaacatggagaggagtatgactgatgttgccagtggtggagctcttggtgatatgacccctactaaggctaggaatttgattgagaagatggcttccaactcctaa

SEQ ID NO: 89589 - DNA, 366 bp, Glycine max
  Peptide Sequence Number=SeqID_181274
atgtgcctgtttaatacatctagttactataacatacaaggcttcattgaaatacatgaatgtcctcccaaatcaaatccttttgagatgcaggaacctatttttgttaatatagataacatcaaatttgtctcgggtgattgttgggcaaatggcctcagttatttgacgaagggagttccgttgctggtaatcgattacaagttcaaaattcagattcaaaacctgtcgcaacatgcccttttgcgggcgggcgaaggcgaggctcacgggtgcgctttccaaaggaggaaagatgcgcggagtcgccaccaacgtttatttgtgaaaaacgtcggaaaaactgaaggaaaccggtcaaagtga

SEQ ID NO: 89590 - DNA, 648 bp, Glycine max
  Peptide Sequence Number=SeqID_181275
atgcatctaggtgaagccaccttctctgagctggcgcacgatgcggaagcagttctcgttgatccaaacatcacctccgccgttcacggagtcgtaaagtgcgttcaacccaaactccgagctgacgcggattttgaaattgtgagtagtgaaggagcgtgtacgaatgagaaagcgaaaaggctagacattggtgacaactgcggagtccttatgtgtgcacaagaggagccacttgtaggatcgaatgtagaggaacaaaaccagatcatggacgtcgacgctgacataattgattttgccaagcttggcgatgacgagagctttggagccgaagataactcgagaagcttctgcttcaacaaaattagggtttgcgcgggattggcaagaggtcatgctcaaagggctcgtgccttgggtgaaccacagtggttgggtccctcagggatgaagatgacatggatggctctattggttcgaacaagtagatggagaaaaaagagatgcgggtgtgttttggtggagtttattgagagaacaatgagcgaggcgagggccagtgaaactaagtatgcgatggcgacatgcacaatggtggtgatgacgagatttgaggacttgacaaagctttggacacaaagagag

SEQ ID NO: 89591 - DNA, 252 bp, Glycine max
  Peptide Sequence Number=SeqID_181276
atgcatggggtagcttttgcccttaccaccaagaagccaaagtctgtagcacctaccaaagagcttgatcattggaatcaagcaaataaggaagcaaaggagatatgggagtcccttgttttgaagtacactattgaaagtgtgttacgacaattcttcatcatcgacaactattatcattggacaatgatcgaggacaaggacatcaaggtgctaatcaacaagtaccacaagttgctagaagacctatag

SEQ ID NO: 89592 - DNA, 174 bp, Glycine max
  Peptide Sequence Number=SeqID_181277
atggttaacgaatcaaggatgaggactttactgagtgctgagaggaacgaggagaagggctacgtatgtgtacgtgagctcaatttaaaggtgggcaactggggatggtgtgcttatgcctgggcttgtggaaatgggatatttgttttgggccatcgcccgatcgccacctag

SEQ ID NO: 89593 - DNA, 411 bp, Glycine max
  Peptide Sequence Number=SeqID_181278
atgccagcctccccttcagagaaccgaaccagatggaggaagcgcaagagagattcgcaaatcagccgacaccaccagaagcacgaggaggaggaggacgacgacaaaaaccccaatgcggaggaagacctcgtcaaacgcgactacgattcggaggaccaaacgcaccagaaccaccctaattcgcaacctcacgtggaggcggaggtcctcttcgaccacgacgtttggatttcgcagttcccggtggtgataaagcgcttcgtgaactgccctcactcctccgtcaccgcaattgttgctctggagcgtgccctcgagtccggagagaacaaggctccaagcgcaataggattggaaggagttagattggttatctttaggtgttgtgaatggtacgtgtggaactag

SEQ ID NO: 89594 - DNA, 480 bp, Glycine max
  Peptide Sequence Number=SeqID_181279
atggcaataggtggtgaaaaaagtctcagtgatccactttccttcacaaatgtgcaacacttttgggttcgattagagaccatgagaatgtctaaactcatactaggaaatacaccaagttctgatcatgtactagctaagttgtcaactttgcttgacatggatgatagagaagaagaatttaaaacagttttcatattttcatatggactcaaactaagaaggtgggatgacaacatttttttaaaggaagaggtagaagcctcttgtataagcaagaaagaagcaactcttaagagggaaaaaccagaagcaaaacttaccaagacaatagacacagcagacacgacaagaggagcaaaaagtgctttggtgccaatggctgcaaggaaagcaacatcagcagacacagtagacacaatagacatgagttttgtcaaaaccgatgttgacatcaactacgtaacatcggttttttga

SEQ ID NO: 89595 - DNA, 186 bp, Glycine max
  Peptide Sequence Number=SeqID_181280
atgataattaagaaggacttcatggttgggcaaaaagtgttattgtataattctaggcttggactcatgagtgtcgagatcaaaagtgactccacaaaaaagaggttcaaggtcaacggacatcgacttaagccattcctcacaaacccttctttagtggacgtagtggaggatgatacttcctga

SEQ ID NO: 89596 - DNA, 636 bp, Glycine max
  Peptide Sequence Number=SeqID_181281
atgaaaagatatagcacacttttgtttgcagtgaaagaacaaggtttggaaaccagaaaacttagaaagcttttggcaaaggaagaagaagaagaagaagttcaaagagatgttcaaaagttaattggaaaaggtttttttgaaatgcaagtcaaggaaactggtaatcgattaccagagagtaaaaaactctgtgtctcctccaagaggttagctaagaaggaatgtcattttgcaataaagacaaacattaaagaaacttcccttcttagacaacctctacatcttctcatttgtaaaaagacacttgttagcactcccacacctcttgggtttgaggttattcctcaagtaaaggagttattggttgagggtttagttcttaagagcttaaatccttgtgctttgttggtgcctaaaatagatattattaggcaccaaatccctaaaataggtgatatgatgaatgtgttgagtggtgcaaccctcttttgtaaaatcactcatgcacccaacatcttcatgatttgtgtacataaagactcattaggtagtgatgaaggggttcccacggaccctaagagaataaaggtcattcttgagtggcccactccaccaagtataagggaaatctga

SEQ ID NO: 89597 - DNA, 201 bp, Glycine max
  Peptide Sequence Number=SeqID_181282
atggccccgaaaaagattttcgcgaagagatctaggagggacgccacggctgaagggaccagtgccgccctcgagtttgatagccaccgtttcaggagcgccaagcaccagcagcgcttcaaggccatcaaaggatggtcgttccacagagagagactcgtccaactcagggacgatgagtacacgaattttcaggaatag

SEQ ID NO: 89598 - DNA, 597 bp, Glycine max
  Peptide Sequence Number=SeqID_181283
atgaccggacgtcttcttgccgggtcattggcttttgaaagccgcatccttcactatttaattgtgcatattctgcttccactgtcttccaaccttgcccaggtttctgaggaagatctaattatcatgtgggcctttcatatagggcgtcaacttgactgggcacacttagtcagatatcgcaagcataaggcattgcgattaaatgctccactaccatatccacagcttgttactctctttcttcgtcattttggaattcctcttgattccgaatcttatattccaatcaagagatcctttttaattggtgctgctgtgattgcttcttttggttaccgcaaagagagtgatggctcttgggtcaaaaagggcgttccacccgctgatgatgaaggccacctaccagttgaagataattccactcttcttcaaaggcttatggacaagtattgtcatcatcaaaaagggggagattgtagacaaaggatcaagctgaatgttttgatgatgccaaaggattacatgaatcatatgcttctcaaagatttattcaagacaaagatattcaagatgaatgatcaagacagtctctag

SEQ ID NO: 89599 - DNA, 981 bp, Glycine max
  Peptide Sequence Number=SeqID_181284
atggccaatatgatcttccagcagcttaagcgcattgctgacggagggaggcgtaatttccagttttcttgcggctgccgaaatattgccctcacgtgcaatgctctgaaagatccgtatctggagactatgatgcgaattttatgtctggatatccccgcacctggagcatcgctggaaaaatatgctccacacctgaacgctgaagcgctgcacgcttggggattgtataaatccggcttcatccgcgacatctacttccgtcaggacagacctggcgtcgctatttttcttgaatgtgactctgtcgatgaagcgatgaacgtaatggccgaattcccgctggcaaaagctggcttattaagctttgaccatccgattaaaggcgcatccggtgtaccaaccggttttttcctggccgagctgacccatccgctgaaagtactggaagatgccggactaaaaacgatgatcgccagcattcgcgggggacagccgccggtggatggatttaacctcagtgatcctgtcaacgcctggtactggaacgaaaccgattttcagcagcgcctggcaacaacaccagcgttatccgagctaaacggtaccgattacagcgccgttttctttgcaggcggccatggaaccatgtgggatttccgcgacagccaggatgcccagcgtattatccgcgaagtatatgaaagtgatggcattgtctcagccgtctgccacggacctgcggcactggttgacgcaaagctcagtagcggcgaatacctggtgaaaggcaaaaacgtggcggcctttaccaacaaggaagaggaagaagttcacactaccgatgtggttcccttcctgcttgagactgcacttcgcgagcatggcgcgcttcatcatgaagccccgaactggtctgaaaatgtggttactgacggtcgccttatcacgggcagaatcccgcttcagcgcacggtgtcg

SEQ ID NO: 89600 - DNA, 701 bp, Glycine max
  Peptide Sequence Number=SeqID_181285
ctgggggtaagatcaaaatgaaaacccctgaagaagcaatggacttaattgaaagcatggctactagtgacatagccattttgagagaccaagcccacattcctaccaagaagagtttattggagctaacctcacaggatgctctattggcacaaaacaagttgcatgatgtacaatttgtggcgaagctcatgaatctggatgttgtatccctaatgaagagcaaattgcacatgaagtcaattatatggggaatcaacccagaggcaatctcaatacaagtggattttcaggatttcagaacaaccagcagtatctacggcagagacagtggtaaaatcaccctgatgccaagtctctatgaccgaaccataaagctggaagagactctagctcaattcatgcaagtatcaatgtctaaccaaaagagcactgagtctgcaattaagaatctggaagtccagaaaaatcctaaaaaagaatgcaaagccgtgatgactaggagcaaaatggcgattcaagcggaggaaagtaaagctgatcagaaggtggagggatttaaacaacagctggctaatgaactggcgttggaaccggttgatgatttagttgaacttgaagaaattgtggaggaagtagaaggtgttgaagaaggagagacaccaataagagactgtgaagagaaaatggggatcctctag

SEQ ID NO: 89601 - DNA, 162 bp, Glycine max
  Peptide Sequence Number=SeqID_181286
atgacaaccaaaaaacatgaaatggaacttatgagactccatcaacatgaagagaaatatataaagagaaaaggaatagcactcagagcctcatcatcttctattcaagaagaaagtgacaaagaggacttgactgaaatagaagaaaacgatgatttctga

SEQ ID NO: 89602 - DNA, 561 bp, Glycine max
  Peptide Sequence Number=SeqID_181287
atggaggtcatgaaagagcaaatgaccataatgatggaagccatgatgagtatgagaaaaatgatggaggtcaacacggctacagtcgttaccgcaagtaccaccactgaggtggacccgactcatctgtctggcctcaatcaagtaaatcgttcagtctcagatatagtaggtcagggaggcgaagcgttgggaaatacgggcagcccccatgttgtgcaggtccagagcaagcattccttcccaccatatggcttgcctcctaactttacaccacccaatgttgcacactctcccgatgagaatgtagataacttcgctcccatacccattgagagccaacaaacccaatttggtcatgcacaggtctctcaacccatgagaaagacacatgaagtaccctgggaccatactctagctgactttaagcttcatctcggatatgccactgaggagcaagcatttggtggcgtatccctgccaaacactttggggggccctcaatatcacccacaaccccaacccttacattttgcgatgaaaggagggtttcctgctatg

SEQ ID NO: 89603 - DNA, 264 bp, Glycine max
  Peptide Sequence Number=SeqID_181288
atgcgtagatctcccacaggcaatttagttcctctagacttagaaattaaagctacgttgagaaggaatagggccgagaggagaaggaaacttctgcaagacagaacagttgcatccattcttgaggaagaaactcatttttctaattcattatcacctgattcaccatcatcaagggaatccgctgctcaatttcctgaagccactatcatggcagacgagcaacatctgaggatcacccttgaggattattcaagcagctaa

SEQ ID NO: 89604 - DNA, 454 bp, Glycine max
  Peptide Sequence Number=SeqID_181289
gactctgccagtcgtttcagcgtccccgtcacacctagcaaggtgattcggtcgcccatcacccgagcttatattgagaagtactgcacgcagagacaggtccagggtgatgcaccacaggtcgcggacgcgtcgccacctcatcaggctggtccagccggattgtttgatacagagcagtatttgcggcatttggttcgccagcaggcggccaaccaccgggcacatgtacagactcatgattgtctttatcagatgagtctcagcctacagagccagggctttacttcttttccgtgccctactctggaccagttcagggcagaggtcgcatggcctagagattggcctgaggcccaggcaggagaggcaccagcagaggctcccgacgaggcagatgaggcccgcgaggacgaagagatgaccgatttacttgatttcttgggagggagcg

SEQ ID NO: 89605 - DNA, 483 bp, Glycine max
  Peptide Sequence Number=SeqID_181290
atgtgggcttttcataaaggtctacaaattgattgggcacatcttgttagatatcgcatgcataaggcattgcgattgaatgctccattgccatatccacacctagtcactctcttccttcaacacttcaacatccctcttgattctaaaccctatgttccaatcaagagatcctttctaataggcgcttctgtcattgcatcctttggttatcaaaaagagcatgatggatcttgggtgaaaaagggtgctcgacatgctgatgaagaaggacatggtggagaagattcatctcttcttcaaaagattttggaaaggttcaatggtcttcaaacctttgttggtgaaaggtttgatactttggaattacaagtggacatgcgcttcaatgagatggagtcaagaatcaccaaggtcgaagaagatgtttcttatagtcgttcaagctttaatctaccaccaccaccaccaccatcatcttag

SEQ ID NO: 89606 - DNA, 396 bp, Glycine max
  Peptide Sequence Number=SeqID_181291
atggacattgatgatctcgtgccttatgtggagaagataatgattttatctgaagagcaagagagaatcactgagcctgtggcacatggtccagcatcagagcgtcgatttccagcacaagagtttcacattcttcagtcaagtgttgaaactcggggttttggtagacaaagggaggctgttgaagtggaagaaatatcccaacaaatggaggagcgtgaccatggaatgtattacacgccaccaacattttctcaatatctttcacaaatgtatcagtatcctttcgaaggtcatcacactgatatgtctgcaagcaaacattcgttcggtggtgttgtggaaaccatatcctcatttttcatggccgactatgaccccttcatagcaacatga

SEQ ID NO: 89607 - DNA, 350 bp, Glycine max
  Peptide Sequence Number=SeqID_181292
gatcaatgacatcttcgtcgtcatgctcatcaaatatacaaattaggtccggtccaattgatggtgatgttttgtggatgcaacctaaacatgtttcagaacatgtttggaatgaggaacacagaaaattacacatcagacgagcagtcccgacgtatcaaggtgaagaacaaataccagaggagattgttcctctacttcgacaatttgggttttattggataatgaagatgagatacctaaaaataaatgcggctttaattagtgcgttgattgaaagatggaagcctgaaacacacacgtttcacttgagatgcggagaggctaccattactcttcaagatgtgtga

SEQ ID NO: 89608 - DNA, 336 bp, Glycine max
  Peptide Sequence Number=SeqID_181293
atgacaacattcggagtcaaatacccctgtcaaaacatcaagggattgagggattttctccaacgaatctttgaggaggatgctgtggattccactctgaataaaagtgttcctcttggtgtgggggttcaacgacggcttgcggtggccaccagtggtcttgagtggtggaaaaatgaggttttagggtttgggtggcgttttgaagaagaggagagtgaaaaatcttgtttttcacgccgagaacgtatttataacctgcaaatcgcacttagcgagctcatcgcgctaagccgaagtccacttttcattcttagtgcgagaattcacacttag

SEQ ID NO: 89609 - DNA, 1581 bp, Glycine max
  Peptide Sequence Number=SeqID_181294
acgcgtgagcatttacagctgctgagcctcgccggacagccgccgctgagcgtggcactgaccaaagccgaccgcgtcgatgccgcacgcatcgcggaggtgcagcagcaggtcgcgcagctcacgcagcagctcggctggccagcggcagcgcagtttgttaccagcagccatacgctgcagggcattgaaacgctgcgccagcacctcagcagcctgaacgcaccggcgtttgagcctggccgccgtttccgactcgccatcgaccgcgctttcacgctgaaaggcaccgggctggtggtcaccggcaccgcgctgagcggtgaagtcagggtgggcgacacgctgtggctcagcagcctgaacctgccgctgcgcgtgcgggcgctgcatgcgcagaaccagccagtgacgcgcgcgcaggcgggcgagcgcatcgcgctgaatatcgtcggtgacgtagagaaagcacagattacgcgcggcgactggctgctggcacagccgcgtcccgccggcacgcagcggctgatcgtcgcactgcgcctgctgcaaccgctgaaaacggcctcacagccggtgcatctgcatcacgcggccagccacgtcaccggacgcttaacccagctcacggacgatgtggctgaactggtgctcagccagccgctgtggctggcggaaaacgatcggataattatccgcgacagcaatgcgcagaacacgctgggcggcggacgcgtactgctgtgcgacagcaaaaagcgcggtaaacgccagccggactacctgcagtggctgcaacagctggccgcggcgcgggatgacagcgccagcctgcaggcgcatctggcgtatcaaccggccgcgtatgacgagctcggctgggcgcgccagctcactgcgtcggcgctggacgcgctgctgctgccgctgaatccggtgcggctggggaccagcctgatgagcgacaccatggccagcgcctggcagcagcgtttacgggaagcgctgagcgccttccaccagcagcatccggagctgccgggcatcggccacgatcgcctgcgccgtgtggcgctgccgcatgcgccggcaccgctggtgccgggattaatcgaccagatgctggcacaaggcgagctgcggcagaaacagggctggatgcaccttcccgacttcgcgccgcgctttaatccgcaggaagccacgctgtggcagcaggtcgagccgctgttcagcgaccagccgctgtgggtgcgcgacattgccgatacgctgcagcaggatgaagagcagattcgcggtttattgctcaccgcggcgcgtctcggtcatatcacagcgatcgtgcgcgatcgctactaccgcagcgcgcagatccagatcttcgccgatctgattcgtcagcgcgctgccgccggaggcagcaccagcgccgccgacttccgcaaccagctgggtaccggccgcaaagtcgcagtgcagattctggaattctttgaccgcagcggctttacccgccgtcgcggtaacgatcacctgctgcgcgacgcgcgcctgttcacctcttctgccgcctga

SEQ ID NO: 89610 - DNA, 360 bp, Glycine max
  Peptide Sequence Number=SeqID_181295
atgtacatgattggcggtgctttaattcctgataaatctggaaatagagttcatttaatgtatttgaacctattacgtgatttgaacaacacaaaaaaatatatttggggttcggcttgtttagcaaacctgtatagagaactatatcgagcatcatcagaggttggtaaagttatgggtggttgtgccatactattgcagtcatgggctggtaccgcatgccttttattgcacaaagagtcccacgacccgaaacaacttttccacgggctaaaagatggagtggtggtagataagaatatagggccgaaccatgagtcacacctcatggtgacttggtcagatatagatctcgtatag

SEQ ID NO: 89611 - DNA, 234 bp, Glycine max
  Peptide Sequence Number=SeqID_181296
atggaggagtttgatgctcaggtggcctggccaggagaccagtcctcttcctctagaaggggtggggcctctgtatcccaagagcctatgactgaggagccaccagcaccagcaccatcaccagcagcagttgaggaggaaaccactccagatcagaccccacagccatctccatcctttgcacctgctcttgaggagactcatccatcagcactggatcttaatgaagactag

SEQ ID NO: 89612 - DNA, 183 bp, Glycine max
  Peptide Sequence Number=SeqID_181297
atggttcgctcagtggatggctcactaagccagcagattagcttagcagaattctcagattgtgtcgttttgaattctttgacaagggagaagggagacacaaaagaattcaggcgaaaaccagaaaactttagaaagcttttggaaaaggaagaagaagaagaaattcaagaagatgcttaa

SEQ ID NO: 89613 - DNA, 392 bp, Glycine max
  Peptide Sequence Number=SeqID_181298
caacattctgccccagcgaccgtaatgccgatctcccctgtcggaagggtcacgcctacaagactcccagtggacccgaagaagtccaacagggccctggggtttccagctctggttacgggcctctatcagtcctacagggtgcccataccccccggcaaggtcatgccatcgcgacatagggatcgcgcccacaggacacccagtggacccaaagaagtccaacagggtcctggggtttccagctctggttacgggcctctgttagttctacggagtgcctgtcacccccagcaagagggcgagacaccacaacagcctggggatggccagcaacaggcaacaaatgcaccaccgccacctccagagcccctcagctcatccacaaaaag

SEQ ID NO: 89614 - DNA, 354 bp, Glycine max
  Peptide Sequence Number=SeqID_181299
atggtgacgattttaggaatggatggcttaaaggcagaggcttcactatcgcttcacttggttgaaagtttaaggctttttgagttgagcaattgtgcacaacaactagcaagtgagatagtagatagtgcaattgtgccttactttttgcatatccaagtgactaggttaccaccaatgaagtggaagagagagaggagacgccacttcaaggagaagatgagtctagaagaagctcacaaccataggaggccatggataagagcttggaggaagaaggagatgaatgaagggagagggagagaagagcacggaattttgtgctctaagagagctttgaaatctgaagtttaa

SEQ ID NO: 89615 - DNA, 321 bp, Glycine max
  Peptide Sequence Number=SeqID_181300
atggtgcccttcctggaccgcttcacggggagcttcttcgtagccaattctaggttgcctcctagtagtgcttctgtgaactctggaggtggtggcggtgcgtctgttgcctgttactgtgatgcctcgccctgcgcctgcttgggggcacaatacttctcgatgaaagccttgttaataggggttgatgaccctgctaggggcgacgagcactccgtagaactgacggaggctcgtaatcagagctggaaatcccaggaccctgttggacttctccgagtccactgggtgtcttgcgggcgtgatccctgcaaacaatag

SEQ ID NO: 89616 - DNA, 636 bp, Glycine max
  Peptide Sequence Number=SeqID_181301
atggacgaagatcagtggatatatgacaacataatgtctgaagaagttaatatgaatgaagacaatggagaggaacttgatgtgtttgaaaatattgattattctgatgccttcaatacttctcaggtgtttgctacccgtgatgacattttgcattgggctcgctctgttgcgtatgatattggttttatggcggtgataatgagaaaatgtgggtgtccctttaagctacaagtgttgaaaggtgacggatggatggtgaagttaatatgtgggagtcataatcatgcattggctaagtcattagttggacatccatatactggtcgactgactaaggttgataagactattggtgatatgacaaagtcagtggtccaactgtcatacattaatttcatccagggacaattgtttgtcaacatgtggacctttgctgaccaaattgagattcttaacactcatcgccgtccctgggcccatctggaatattctggagggaggttacttcaggtggaagctaccaagcttgcctgggcgagctgggcggcaaccacctccctcatttttgctataaaatggtgtgaggggctgaggaaaaaaggttcaacatctttggcactcaggattcactaa

SEQ ID NO: 89617 - DNA, 231 bp, Glycine max
  Peptide Sequence Number=SeqID_181302
atgcaatgcatgaatatgataaatgcaggaatgatatgcccattacaatgccataaagagatgcatgatgcaatcaaggaacatgccagaggactattagtgacaatgcatcaccaaaagaggaaaactctagatgaggcttcactgttatcaagcgagtcagagacccaacatgaccacagatcgacctccactccttatggctcacataggcccgggtatagggcctaa

SEQ ID NO: 89618 - DNA, 465 bp, Glycine max
  Peptide Sequence Number=SeqID_181303
atgcaaaatctttatgagactgtgaagaaggcacaaatggttgtccaagttgaagcagtgcgggtgcagaaagaactcgcagcagcagagtttgatggttattgtgagggtgagttagtaaaggtaacgctgtcggggaaccagcaacctgtaagaacggaaattactgaggcagctatggaattgggacctgaattcgaaattccgttttcgaactcgcaactcttccctcacaccgatgatcctctacttcaagaaacactgtctgagctcgcggagtgtcgatcagggtctaggtcatgccttgcgccgttgattgaatgctgtggtcggaaactttctcttttaatcactgaggcatacaaggatgcacaccaaaagagtgtccaggccatgaaggaaaggatgaatgatcttgcacagagcttaggaatgccaccagggcttagtgaaggattgaagtga

SEQ ID NO: 89619 - DNA, 477 bp, Glycine max
  Peptide Sequence Number=SeqID_181304
atggttagaacacgaggtttaggtcatgctttagctagggttataggcagagcccgtaggcgacgagtacatattgcggttgatgagggtgtttctcaagtgactgaggatgttcctcatatggcggaggatgttcctcagatgactgaggatgtccctcatatggctgacgatgttcagatgactggggacgtaggtgcgactgttgtagaggacttaggtcgtgatggtgttgaaaggtcgtatgttgatgagggattccctggtgggccccgtgacccatcagttctgacttcatttgcggagcatgagcgtcctgagctgaagttggtgtcgcacgggaggaaggtggcattaattgggaggccagtgcctgagattgaagggctagttgtcgccataggattaagtccattgatcgggtgttcagttgtaaccggcgatcttggacttatatccgcatatgtggagaggtga

SEQ ID NO: 89620 - DNA, 545 bp, Glycine max
  Peptide Sequence Number=SeqID_181305
acacttcggtgagtctattgactcaggctccccctggtagactatcgcaatctaccgaggctggcgctggtttcagtaaggtttattcttttgacttgaagtctgccaccgataggtggcccctcagtctgaagactcaccttattagaactttatttggtaagtctgttggagattgtttagatgcaatcttcagcagatctatgaagtaccctttcttcgctcagttcgaggtgtacccaggacagcgctttactaggtatgccattcttggagacgatgtttgtatcgccgacgagaatgtggcctctctttatcgccagacagtagcttgcttccaagccggcccggccgcgaggaagagatctttgccggtgctgacttggatctcgggtgacggaataaggcgcccagaagctacgagcagtcgcggtcgaagcttggctctaggcgataggctagcagtaagcttggctacagcgaagcgcttaccaagcgcgaaggattcgttcctctcccagcaagaggatgcgcgccttaactaa

SEQ ID NO: 89621 - DNA, 396 bp, Glycine max
  Peptide Sequence Number=SeqID_181306
atgactcaagagctggtagcccgtggagacaccttacggttatccgcacctcgtcattcagtgaccccaagtgtgattgatgagcagaggccaatatggtcatctgcgccctttccggagatgtcagcattttccgatggagacttttcaagtctcacaagagcaagagccttggttttgcccgcaccctatttgtcatccatgagcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggtag

SEQ ID NO: 89622 - DNA, 168 bp, Glycine max
  Peptide Sequence Number=SeqID_181307
atggatgtggccagtaatggcagaaacttcaagaccatcgtaaagaagacagagaatgttgtcattgtcgaagaacagagagtggagaagttgagggaaatgagtccactttatgaatttgtcaaggaaggtatcaacatcaaggacattcaatgggcacaacactga

SEQ ID NO: 89623 - DNA, 300 bp, Glycine max
  Peptide Sequence Number=SeqID_181308
atggacttcgataaaaacgctcaggcgcaaaactcctataaggatccaagcttaaaggattttagcattgataccccatccgccctggacaacttcactcaggctatccagtcgcagattttaggcgggttattgaccaacattaataccggtaaacccggccggatggtgaccaacgattttatcgttgatatcgccaacactgatggacagcttcagctgaacgtgaccgatcgtaaaaccggaagaatatccaccattcaggtttccggtcttcaaagtaattcaactgacttttaa

SEQ ID NO: 89624 - DNA, 284 bp, Glycine max
  Peptide Sequence Number=SeqID_181309
cccaggcacctcaacaacatgagccagaactagaaaatgatcactcatctgaagccaccatctctggagctgttgattgtaaaaaaagaagattagagatgagatccaatgaggctgctcatcatggaccaatgccagcgtcagctaatgcaccatttccaggaatggatccatctccacctcagcacgcaatagactcttccattcctgtcttagagatacatgagggccagaccataccagttttgcctttggacacttctcctccagctactccagtatga

SEQ ID NO: 89625 - DNA, 734 bp, Glycine max
  Peptide Sequence Number=SeqID_181310
agaggacacatgtcctcaccttcagagggctacacgccctcgccatcagaggactgcgtgtcctcaccatcagagggctacacgccctcgccatcagaggactgcatgtcctctccttcgtacggctgcacgccctcaccttgaagaggactacacgtcctcgccaacagagtgctgcacgccctcaccttgagaggactacacgtcctcgccaacagagggctgcacgccctcactttgagaggactacacgtcctcgccaacagagggctgcatgccctcaccttgaagaggactacacagggctacacgccctcacctttagaggactacacgtcctcgccaacagagggctgcacgccctcaccttgagaggactacaagtcctcgccaacagagggctgcacgccctcaccttcagaggactgcacgtcctcgccaacagagggctgcacgccctcaccttgagaggactacacgtcctcgccaacagagggctgcacgccctcacctttaagaggactacacgtcctcgccaacagagggctgcacgccctcaccttgagaggactacacgtcctcgccaacagagggctgcacgccctcaccttgagaggactacacttcctctccaacagacggctgcacgccctcaccttgaagaggactacacgtcctcgccaacagagggcttcacgccctcacctctagaggactacacatcctcgccttga

SEQ ID NO: 89626 - DNA, 556 bp, Glycine max
  Peptide Sequence Number=SeqID_181311
aaaagaacatgctttacgccgcccttaccgaactcgtgctagagctagagtaatgggggaagcagaggaggtgcaagagaaaatgaaggccgacatggaggccatgaaagagcaaatggccacaatggtggaggccatgatgagcatgaagaagataatggaagccaatgcggttacagttgccgctaccagcactgttgctaaggtgaacctgatgcccccatctgacctcaaccaaatgaatcatccaacctcagatatggtaggcaaagatttgggaagtacggacggccccatgatgtgcaaattcaaaacgagcacgccttcccgccatatggcttgcctcccaactatacaccacccaatgtggcgtacactcccaacacatgaaattccccaccacaatctagtcgacttcgagccttgcctcggatatgccactgaagggcaagcagttggtggtatacccttgaaaaaaactttggagggccctcagtatcacccgaaaggctcagggacattaaaagaggcgaagattatgcctttgcaaacctag

SEQ ID NO: 89627 - DNA, 342 bp, Glycine max
  Peptide Sequence Number=SeqID_181312
atggctactccacctgcctcgcctcctccttctcctcctcctcctgcagacgcatcagcgtctccgtctaccttcaagcgaacacgcaaagccactagaccacctggggcagagagaccagtggcccacgtcaatcttgcaatcggcaaggctgacggtccccacaagaagaaattaagaacgtatttggggattatcgttcgtgataaggtcgatgtgacatacgagaactggaaggaagtccctgctgctcagaaggatttgatatgggaggatattcaggcggaatttgaaatccctgaagcttctgacaataggacaaagaagaaagttcttcagacg

SEQ ID NO: 89628 - DNA, 384 bp, Glycine max
  Peptide Sequence Number=SeqID_181313
atggcatcttctttgtcatgttcatcaaatatacaaattaagtctggttcaattgatggtgacatgttatggatgcaagccaaacatgtttcagaacatatttggaatgaggaagaagacaaaaaatcacacatcagacgagttgtccccacatatcaaggtcaagaagaaataccagaggaaattattcctctacttcggcaatctggtctccgtgtgaatggggcaccattaattggttcaacaaatcttgattggttaaataaccatgatggcaacgtacaacaactagaaaggtttacccatgcatggatccttagattcataggaggtgtcctatttgttaacaaaagcagtagcaaagtttccctaagatacctgtag

SEQ ID NO: 89629 - DNA, 102 bp, Glycine max
  Peptide Sequence Number=SeqID_181314
gcacttgtctaacagcaaaggactccattgatgaagaagatccaaggcctacaagctccacatggagctacatcatgtggtatcaagagcatcttcatctag

SEQ ID NO: 89630 - DNA, 395 bp, Glycine max
  Peptide Sequence Number=SeqID_181315
tttgtgtgggagccttacacaacaactgttatatcattgttgcctcccatttgtggggcgggaaatctagcgtgtcgagcgcgggggccactaaggctgaaattgcggagacattacaatacatggtgtctcctcaatggaggaatacatggacagttgatgatctcgtgccttatgtggagaaaattacgattttatccaaagagcaagagagaatcattgagcctgtgccacatggtcctgcatcagagtgtcaattttcagcaccagagtttcacattcttcagtcaagtgttgaaactcagggcataggcagacgaagggaggctgttgaagcggaagaatattcccaacaaatggcggagcgtggccatgaaatgtattatacgccataa

SEQ ID NO: 89631 - DNA, 183 bp, Glycine max
  Peptide Sequence Number=SeqID_181316
atgaagtgcttaaataaggaatgctctcgggaacggaagcttcgagcacactccagacatcttctcaaagatcccaacggtgaatctaaagagaagcagcatatccctcttccattccctcgaagagcaatttccaacaaaaaaaatggaagaggcaaagaaggagatcttggaaacatttag

SEQ ID NO: 89632 - DNA, 315 bp, Glycine max
  Peptide Sequence Number=SeqID_181317
atgactttgagcttagctcatcagtgggctaagcgcgcatccaccgctaagcgcagcttcagcgcgcttagcatgacagaagaatctagcaaggcatcaatatcaaggctgcacgctaagcgcgagatcagtgttctaagcacagcagttgtcttcagccaagctcaacgcatgactggtgggcccagggcacagaattccacagcacaccatggtgcctatttcgagaaagaagctctggaggcagcaagaggaacagcttttgcagagatacctaggttttgtaagctaattattgttagggtttcgttgtaa

SEQ ID NO: 89633 - DNA, 678 bp, Glycine max
  Peptide Sequence Number=SeqID_181318
atggccccaaggaagcttgcctcgaagagatccaggaaggataaagcggctgaaggaaccagttccactcccgaatatgacagccaccgttttaggagcgctgagcaccagcagcgcttcgaggccatcaagggatggtcatttctccgggagcgacgcgtccagctcagggacgacgagtataccgacttccaggaggagatagttcgccggcggtgggcatcactggttacccccatggccaagttcgacccagacatagtcctcgagttttatgccaatgcttggcctacagaggagggcgtgcgagatatgcgatcctgggtgaggggtcagtggatcccgttcgatgcggatgctctcagtcagttcctgggatatcctttagtgctggaggagggccaggaatgcgagtatggccagaggaggaaccgggccgatgggtttgatgaggaggccatcgcccaattgctgtgtataccggggaagaattttgcccggactgctgctggaagacgggtgaggatcatgcgcaccaacatgaccaccctgactcagatctggatgactttgctgctcagcaacatccagcctagcgatcataattccgacctccccctgccgaagtgtcagctagtgtacgccatcctgacacggatgagcattcacctggcttag

SEQ ID NO: 89634 - DNA, 249 bp, Glycine max
  Peptide Sequence Number=SeqID_181319
atggctactcagttgaaccaagctcagtcacaaaattcttacaaatttccttcacaaactgtgcagaatccgaaaaatgtgagtgccatcaccttgaggtatggaaaccaaattcaagtgcctccaccagtagcagcacctacacctgaacctcctcctatccctattccattcccacctagagcaatgccaaacaaaaaaatggaagaagtggaaaaggagatcttggagaccttcagaaaagtagag

SEQ ID NO: 89635 - DNA, 466 bp, Glycine max
  Peptide Sequence Number=SeqID_181320
aggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaggctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 89636 - DNA, 270 bp, Glycine max
  Peptide Sequence Number=SeqID_181321
atggattttgaaatctgccaaatcgtgcagcaaaaagctatcaaatttgtgcagcagaattttccaaatgtgcagaaaaatgtttgtgcattgctggttatgggaaagcttagaggggttgatggggacccgatgccgagaggaatgagaataagggctacatgggggtacgtgagcttagttgaaggtgggcaactggggatggtgggttcatgtttgatttgtggatgtgggagagttgatttgcaccatcgcccgatctccacctag

SEQ ID NO: 89637 - DNA, 693 bp, Glycine max
  Peptide Sequence Number=SeqID_181322
atggttctgttggatgattttggtgacatcgtgctgaaaacacaggatctctgtgcctctcaggacgagtgcatacgtctcaaaaatgcgctggtcaacctggggaacagtaaagactgggactcgctggtgaagcgtgccgaagcgggacgcctggatggcgttaacgtgctgctgcgcccggttagcgctgaatcgctggataacctggtcgccacctcgacatcaccgttcatgatgcgcgaaaccacccgtgcggcgcaggcgctgaacagcccggctcccggcgggtttgtgattgtcagcgatgaaggcagcgacctggtcgatcagccttacccgcaggtcgcgctttatgactacccggcgcaggaacagtggagccagttccagcgcctggcgcagatgctgatgcagacgccgttcagcgccgaaggcatcgtcacgagtatttataccgatgccaatggcacccgccatgtcggcctgcaccggatgccggatagcgcagggttgtggcgttacatcggcacctcactgctgatgatcgcgatgcttgccgccattttctggaacggtgttatggccctgcgccgctaccagcgctcgcgaacccggcttgccgagatccagcaatattacgaaaactgcctcaatcctaagctgatcccctcttctgagagcctgatctga

SEQ ID NO: 89638 - DNA, 627 bp, Glycine max
  Peptide Sequence Number=SeqID_181323
atgggattgaatcaagcaccctcttttaagaaaagtttctatcatgtcaaaatcaaaagcctagaagtttccagtttgcaagagttagggcaacggatggatcaactccaacgtcaagctttcctcaagacatatggcaagatctgggatttgactatgatagaagtgtctgttgaagccatcacatccctcattcaatattatgaccagccgctaagttgcttcacatttggggactttcagttagtatcaaccgtagaagaatttgaaaggatcttgggatgcccactaggaggaaggaagttgtatctgtttttcggattatacccctccatggcaaggatagccaaaatgcatttggaagagaaagcaaaagccttggcagatcaaggagaatgggcctcattcattaattttttagcgttattggtgttcggagtcgtcctctttccaaacgtggatgggctagtagatctagcagcgattgatgtttttcttccttatcacaacagcaaggaaagtccagtcgttgctatgttggtagatgcctatgacacatttgaccagagatgcgagaagagaggagcaaggattgtctgttgcacacccgctctttatgtatggctg

SEQ ID NO: 89639 - DNA, 561 bp, Glycine max
  Peptide Sequence Number=SeqID_181324
atggaggagaagaaaaagaaaaaactggaggaagctactcaatccagaagcactgacaccatcattgatcaaccatctcccatcagacgacacgtgaaatggaagatggtccgcacaaagaaaactggccaaatgacgtctcagcctgcaaaggaaattgctaacaagattgtaagattcattggaggagcaggcctcatagggttcctttgtcgcccatggaccaacactttggactgggccaaggacctcccgcacgtcttcctccgtggctcccgaagacctggtgcagctgacacaacaaatcagggaccaactggaggaggattcccactgcctcctgagcttgagattggtccttcagttgctcgtgtcagcacaaaggagagttgtattgatccctcatggaacgatccagacatgggtgactcagacaaatgcgggttgtacatcgaagaaaatcctccccgcctagttgccataagaagactttatgagggatccacaaccattcacaacattcctttgctgcatgatcatgtcaaggttggtgttgaggag

SEQ ID NO: 89640 - DNA, 1302 bp, Glycine max
  Peptide Sequence Number=SeqID_181325
atgtgccaaaatcactggctatatgagagactctcacaatcgttgaggctaagtggggaatatcatttcagtgataagcagaagaagcataaaagaagtactgtggggcttcttggtaaggttttctccttaagaagagtttccactcctcacggagagcctaataaggtggctgagacagtggtaaagaaggagaagaaacactcctcttggcagataatttgcaaacaaaaaaaagcatcgatattccacataaaagctgcaggggcacgcacatataagaaaggaggaactgaatttattttagaaaaagaaatacatgaaagaccggtacatgggattcgaagtaaggttgttgctagaaaagctccgcacaaggatcttcctaattatgctcagcataccgtgccaattttctgtttgccacaagagtggctatggtgtgaatcatggtgtggtaatgctacaaaatacaaggcaaaaaccattgatctctgcaacaatcccatgacaaaagaacccaaactgcagcagatgaggtgccagaaaatgcttatagagtctagacaaactcatcctagagaattgcttataaatcaaataagaactggatggacaaggcttgagaacctaaatctagcaagaactctaacaagagaggcaagtttgagtgtaccacttgcaacaaaattttccactcataccaagcttggaggccatagatctagccacaagaagatcaaaggatgctttgcctcaaggaatgagagcagtgagagcaatgagtgtgtggtggaacatcaacatggtgctagttttcataatgaggtggaaacagttaatgagtccaagaagagcaaggggcatgagtgcccaatttgcctcaaggtttttccatgtggccaagccttgggtggccataagagatcccatatggttggtgggtttgagagtagaagctttcaaacaattgtgcttcaggaaccagtggcagaaattagggacttccttgatcttaatcttcctgctgctactaaggaagaaagcaatagccatgctgactctaacagtaacataccctggtggatagtagaagaaaaccacaaacaggaggcactgagtgcaaaagcagtgtggacagcaaggtcaatgtctggggctaacaagaagatgattgaggcactagctgctaggaagaaggaacagtatctaaagaaggaagagtacctgcaacaatttaagatgaactgccataagttccattttcaaagctttcatccaatatatgcatgttttcaataa

SEQ ID NO: 89641 - DNA, 69 bp, Glycine max
  Peptide Sequence Number=SeqID_181326
atgtcccttgatgtgtttgctttagaggcattgcctggagatggaactttcatgaggagaatggaataa

SEQ ID NO: 89642 - DNA, 342 bp, Glycine max
  Peptide Sequence Number=SeqID_181327
gttggtgctgacaaggactacaaggaggtacccccacctcctttgtttaaacctgcagggggacacatcaaccaagctgtgaccttcaacagatcttattacaagaacacgtttatctcaacgacggtgttgttacgtgactatagtagtattaacaccgtctcttacgacggtcgtccgcaacaaaacaccgttgtagtgataggacccttctacgacggttcgccgtgtttgaattgtggacctttctacgacggtcctttggaaacaaccgtcgtagaacaagattatgtctacgacggtgctgtccttatggccgtcgtagtctctagtaagttctaa

SEQ ID NO: 89643 - DNA, 702 bp, Glycine max
  Peptide Sequence Number=SeqID_181328
atgtcattttgggatggtgatggtgaaccagatctgaagaaggatggagatagtggctgcgagttgcaatgcaagcacgacctccctctgctcctcgatgcgggcaatggtggaggacttgcacttcgggatggaggtcttgcaacagtggagggattcgagggtttctttggagagggaatcaagatattgggatttctcgacaacggagtgttggagggaggagaagtgggtggagagggtggtgaagagttcatcaaagaattgctagaccctcgtcgccattggagagtgctaagactcctttctcaaactgaaatcgaaaatcgtgctcgcagagctcctccataccacacctccgtcggaccccgacctatccgccacgctcaaatccatgtggaggaagatggacgtagcgatgttgctatggttcatggtgtcaaagcggagggagtcagcattgctgtgagaagagatagcggcggcgatggaggaggcagtggacccagcctagctggtggtagaggcaatggagagagaaagagagaaacaaacgaaaaaaggaataaaaaacaacatcgtttctgctttttaaaaattaaaaagaaaaatttatgtgtaatctcactcagccaacgggtatacatggtaacacatgtcacaatgccaatgtgtctgattaatggtcacgtaagcagttaa

SEQ ID NO: 89644 - DNA, 258 bp, Glycine max
  Peptide Sequence Number=SeqID_181329
atgctttgtgtaatcgattacatggttatgggtacatcctttgtggtacaagtaaagggtacatctacttgggttgttgtaactgagaacaagagagggtacatctcttgtggatcaattcaagtggagggtacatccacttggttgttcaaagagaacaagggagggtacatcccttgtggatctttgcttgtaaaggcttttacaaggttgaaaagaaatctcaaggaccgcaggtcgcttggggactggatgtag

SEQ ID NO: 89645 - DNA, 882 bp, Glycine max
  Peptide Sequence Number=SeqID_181330
atgtgcactggcatgaccaccctcacacagatttggatgacgttgctgctcaacaacattctccctagcgaccataatttcgacctccccctaccaaagtgccagctggtctacgccatcctaactcaggtgagtatccatgtggctcagttgatcttagacgctatatatcagtttgcagggatcacgcctcctagacacctagtggacccggagaagtccaacagggcactagggtttcctgctttgatcatgggcctttgccaattttatggagtgccgcaaagccttcatagagaaatattgtatgccaaggcaggcaccacagtagggtcaggcacaacaacaacaagaggagggccactagcagccagccgcagatgcaccgtcgtcgcctctataggagacaccatccctagagtccatctccgctcacttgtggaggatagagctccagatgcacacatacatgcagcatgggtcaagtgtagcttaatgagaccttctactggtacactatgcaccaacagagccaggacatcagtcctttcccatggcctacccccgagtagttcggggccacagttgcatggcctggagatgagcccaattttgagacaagggcaaggcccgcaggggcccctagggacgatgatggagcttaagaggataatgatatggctgatgtgcttgatttcttcacttgaggaggcagagttgcacgaccatttttgttatctcattgttattaacttgaccacttctagcgtattgtcgtactattgcattgctatgatcaaaacgccaaaaaggtttttgcaaaaaagaaatgtgtgcctaaagggtgaatgcgatgaaagattttcccgaatgctgaaatga

SEQ ID NO: 89646 - DNA, 285 bp, Glycine max
  Peptide Sequence Number=SeqID_181331
atgacacgcaaaccaaggcaggattttagcgtttcaaaggtcagcccaaaagaaattttagaagctctccctctctctcacgcagccttcttcttcttttcttcctccaccattgttgcccaacaaagcttcaacctttggtgctcatttctgctccaaatcgcgaaaggagggcattttcggagtcgtgaagtgcgtgtctacgagtgggacttcgaaatttcaggtttgggtggacttctttctctcttgatttttgtgggtatggggtattgggagatatga

SEQ ID NO: 89647 - DNA, 255 bp, Glycine max
  Peptide Sequence Number=SeqID_181332
atgacaagcagagaccaagtttggtcattctgcacccttgtatcatccagaggcggcgggcccgatgatacgcggaaatacccgagtggttatccgtataaacattcttttgctatctcacccaggcccatttgggccctccagaagattcctccagaaggcggttgcttctggaggaagcaaccctgctcgcctgggcgagctgagctcgcctgggcgagctgggcggcaaccacctcccctattttgctataa

SEQ ID NO: 89648 - DNA, 330 bp, Glycine max
  Peptide Sequence Number=SeqID_181333
atgaattttgcagtgaaaaagcctgtagaattcaccccaattccagtgtcctatgctaacttgatcccatatctacttgataattcaatggtagccataaccccagccaaggttcatcaacctccatttctccgagaatacgattcgaacgcaacgtgtgcttgtcatggagaagccccggggcgttccattgagcattgtagggctctgaagagtaaggtgcaagccattggtctgtttgctcaagccacctatgctcttgagtttggacttccaagaccgttcaatcagagattactcgtcaagcacgttggtgtgggggtgccataa

SEQ ID NO: 89649 - DNA, 456 bp, Glycine max
  Peptide Sequence Number=SeqID_181334
ggtgagaatgtcaatccttaccctcggaagaaaaaaagtgggagaaagcaaaaaagaaaagaaggaaagttcccaatcaaagagttggagaaagcgaaaaataaaagaaggaaaattcccaaatcaaagagtgggagaaagaaaaaggaaggaaagaaaattcctgatcaaggatcgaaagaaaatagaggaaatgtgcagaaaggtcattggaccagacgatatctgaacaatacaaaattgtcaccaaataaaaaaaaaagaaggaaaggaaaccacgacctaaagtggtcttctccctttgattgccaaccaaaatcctgtgcgtcggtgacttgttcacctcgcgtaaaacaaaaacagaaaagaaaaaggccagaaaactcaaagccaaatttcccaccaaaagaacccattcccaagaaaagtcctattgatccacgatcgcgcatgtaa

SEQ ID NO: 89650 - DNA, 409 bp, Glycine max
  Peptide Sequence Number=SeqID_181335
gtccaacgccttaaacggtcctctttgcttttatcggttaaaatggaccgttcaaaagcataaaatcaacccatcactttactgccgtttgaaagaactacgtaggtctgatttcctcttcgatggagggctgttgtcctttgggacaaacgtgagaggtgctaataccttcctcaaacataaatacaactcccgaatctggaatattcttcatgactggtttccttcggtttttctgacgttttccacaaataacgttggtggcgactccgcgcattttcctccttcggaagacgcacccgtgagcctcgcctcgctcgctcgcaaaagggggccctatacccgggttcatggaaatctaaggagtggaggtggatctatggtaatgctaggtctccgacttgtttga

SEQ ID NO: 89651 - DNA, 375 bp, Glycine max
  Peptide Sequence Number=SeqID_181336
gctattcgggcaactcaggctatttgggcatttataggccaaaagggcataatttctacaactcattctccgattctagctatcctaacgaattctctcgacagcaccggttcaagggttgctgatacatatgaaaggagattaggacccctcttcaagaatagaagtttgtcggctactattactgaagggtgccgggtttacattaaatggaaagcaagcgaagcggttgtctaccgagcggaagctgaacaaagtgaaggttcacctttctgtatgcttaactacgacccagcgaaaacggaaggtttggatctttcaatcttcaagaaggcaatttcgctgaatacaaagggactacttgttccagttcag

SEQ ID NO: 89652 - DNA, 327 bp, Glycine max
  Peptide Sequence Number=SeqID_181337
atgacggtgaaaacctctgacacatgcagctcccggagacggtcacagcttgtctgtaagcggatgccgggagcagacaagcccgtcagggcgcgtcagcgggtgttggccgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 89653 - DNA, 561 bp, Glycine max
  Peptide Sequence Number=SeqID_181338
atgcttaacacattatttaagagccctgttattgtggaagaaggggaatcactctgtgcttattctagatttgcactcctgaggcctaatcctcaggagttagctgctaagctttgtataccagggagcggattcgagcttaatgctgatgggcaacctctgaagattttgaggaagaacatgaccacgcttgctcagacatggagtgctctttccttcactaacctgatccctacctcacatacttctgatgtcaccctggacagagccaaactcatttatggcatcattatgaagatggacatgaatgtgggaggacccaggaaggtcagagggaagagatttgaggccccttccacatcagcatcagaggcaccaacaccttattcttctacacttcctccctcttcctccacagagatcccagtgattcctcctgcacccacacagataccacttccaactcctctctttgcaggtccagcagattttattttcactcctcagatgcttcactccatgctccagagcatccatagggggcaatccattatcatgtag

SEQ ID NO: 89654 - DNA, 909 bp, Glycine max
  Peptide Sequence Number=SeqID_181339
atgcctcaaaacttgttggggcgctttttgttggagtttaatgtggcacatattgttcctttggcgctcgttgcaggtgccgcattcctaacgagtagttcgctcgctttctccgccgatgtacagcaaaccgatatttatgcggcggaaaccgttcagcccgctcgcaagtatttctggtccggcgattggtatctcaaggtcggcgcggcaggtctcgtcgctccaaagttcgaaggctcgaacaaatatcgcttttctgcccagccgctgatctcgcttggccgacaggggcaggcgacgcgcttctcatcgcgaaatgacaacgtgtccttcgcattgatcgacaatgaccgcttccgtgtgggtctcgctggcaaacttctttttgagcgggatgacgacattcatggcctgaaagacacaaagtttggcggtgaagcgggcgcttttgtcgacgtctaccccaccgactggatgcgtgtgcgtggcgaagtgcgtcacggtatccgtgcgcataatggcgtcgtagccgatattgctgccgatgcattctatgatgttacgccgactgttcgtgtgtcgggtggtccgcgtgcgactttcgcctcaaaggattacttcaaaacctatttcggcgtcgatgccgaggaagcggttacgtcgggactttcagaatatagtccgggcggtggcttcaagtcagctggtgttggtggcgcaattacctggaaggcaaccgacaagatcgatacgagcctgtttggtgagtacagtcgtctgcaagtgttcggcaaaggattcaagcatcgtgaaggaacgcggctccccggaccagttcatggtcggcgtttctgcgacttaccgtttcgatttctcgctggactgacctcaacggtatcaatgtga

SEQ ID NO: 89655 - DNA, 418 bp, Glycine max
  Peptide Sequence Number=SeqID_181340
gataggacatctggccttagcgacgagagaattccgtcatctgaatcttcttcatcatttcccactgaactaagagaaatcgaagttggtgcatctgaagcaaacatagtggcagaagatcaaccaccaagggtgactcttgaagactattctagaaacaacttgaagacttgggaagaggtggttgagaagtttttgaagaagtattttcatgaatcgaagatagctgagggaaaggcagagatttcctcattccatcagttccatgatgaatccttgagtgaagccttggagcgcattcgtgctaggggaaagataaaattaaagactcctaaggaagctatggaattgattgagaacatggtagccagcgatcatgctatattgcgtgatatgactcacattcctacaaagagaa

SEQ ID NO: 89656 - DNA, 387 bp, Glycine max
  Peptide Sequence Number=SeqID_181341
atgggcagaaatgtctccgcattgattggtaaatctgttccccaaatccttgaaaaatgtaaagatccagaggagggatgttgtaagggatcagttcccatcattctaggcagaccttttatgaaaactactagaactaagatagatgtatatgcaggcacagtatctatggagtttggtgatataattattcattttaatattcttaatgctatgaaacacccatctgaagatctttctgtatttcatgttgaaataattgaccatattgttgatgaatacatgactgatcttcattctaatctgcatgcttgtcactcttcatgcattgaatctgaatttgtacttgatcatatgtctgaatttgatgctgaaatgaatctatag

SEQ ID NO: 89657 - DNA, 228 bp, Glycine max
  Peptide Sequence Number=SeqID_181342
atggctaaggcattaagtttttctggaaaaacaaaattaagtgaccatgttctacatggagataaaagaacattgaaaaagaaaacaaaaattatcataagtggtggcttcattgatctaatatctatcatgccagctcctacatcaactaccatagcggatggaactgagcaccatgttgatgatactcaggttgatcgtcctcatgacatgtcaaaggaccattga

SEQ ID NO: 89658 - DNA, 1146 bp, Glycine max
  Peptide Sequence Number=SeqID_181343
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattgcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccagttcaagaactctgtagcaccgtctacatacctcgctctgctaatcctgttaccagtggctgctgccagtggcgataa

SEQ ID NO: 89659 - DNA, 826 bp, Glycine max
  Peptide Sequence Number=SeqID_181344
gatcgccagcatcgcctcgtccggatactcgttgatcctgcgcttgtaccgagaacgtggagatgcgcgagttcaggccgagcatgaaggcggtgatgctggtcggggtcaggtccaggtggcgcgcctgctcggcgctgacgctctggctgcgcagctgcacgcccgatcgccagtcaacatggatcgcctcgatggccggcagcgagaccagcagcgacgaatccaccggcgtgccggtgcgctgcaggatgccggcaacgcggaacggcttgtcggcatgcgtggccagcgtgaccgcgccggtgccgtgcgccagcacgatctcgtcgccgaggccgaccttctgcgcgcgagccacctccgcgccgatcaccgcgtcatacagatcatcgaagggccgcccctgtgcaaaggccagcgcgtggccggaaccataacgatagtgttcaaagtagccgccagtggtacccactacccggtagccgcgccaggaatcgcccagcgacaacggcaccgaccacttcacctgcggccatgcggacagctcctggtaggactgccaggacacgttgttggtcgggtcgccgatatggaacaccgaatacagcagcaggttcaccggtcccgaacgcgcaccgacgatcagatcagtgcccgatacggtgctggcaaacccctcgtgcgcctgcgtgcgtacacgctcgacgcccagcagcagcaccacgctgagggtgatgaccagcacggtcaggcccacgctcaacgcgcggctgcgcaggctggcccaggcaagctcaagcatggccggcacctgcctggttga

SEQ ID NO: 89660 - DNA, 381 bp, Glycine max
  Peptide Sequence Number=SeqID_181345
atgaaatggatgaatagattcgctctcactctgaatgagagtcaagtgcttccaaggttgttagccagagccaaggcagtggctgacatgtactcaactcccgacgaagttcatggtcttttcgattactgccaacacatgatgttgcattactcattccattctgtttttagcagtcattatcatcatcaaaaagtaaccatagtaacaaaaaagaacgaatgcgctttacggcactgtcgcaacctacctttcggcgggagggcaatgcgagggctcacgggtgcatcttccaagaaaggaaaatgcgcggagtctccaccaacgtttattgaaggaaaacgtcggaaaaaccagaaaggtgtggtctacgaactttaa

SEQ ID NO: 89661 - DNA, 1050 bp, Glycine max
  Peptide Sequence Number=SeqID_181346
atggaattcttttctgctgaaacttttgattgcattcaagcctttcagaacctaggtcttatacctttcatgtcattacaattgcctgtttatcctgaattggttaaagccttttattgtaatcttgaaattcaggacaacactttaatttctgaggtttttgggataaaaatggtcattgaccaatcctttttccatgacttaacccaattgtccagtgacggtgtaccatttgaaggtacactgaatgacgattggaagtttgatttttctgcacatgatgcccgccaattggtttgcaccaacaatgcggatatgaccggacgccttcttgccggttcattggcttttgaaagccgcatcctacattatctgattgtgcggattttgcttccacgatcttccaatcttgcccaagtttctgaggaagatcttgttatcatgtgggcctttcataccgaccgtcaacttgactgggcacatcttgtaagatatcgcatgcataaggcattgcgattaaatgcacctttgccatatccacatcttgtcactctctttttccgccattttcaaattcctcttgattctgaaccttatgttccaatcaagagatcttttttaattggtgctgctgtgattgcttcttttggttactgcaaagaacatgatggctcttgggtcaaaaagggcgctcaacccctgatgaagaaggcaacctaccagttgaagataattccactcttcttcgaaggcttatggacaagtttaatgccatggaactgcaagtcgacatgcggttcgatgccatggaatcaaggatcaccaaagttgaagaagatgtctccttcattcgtacttgctttgatccaccaccaccgcctccatcatcatcttagcttaacttgtcttgatttcagggattgtcatcatcaaaaagggggagattgtagacaaaggatcaagctgaatgttttgatgattccaaagttttcacatgcgtctcaaagctttattcaagacaaaggaattaaagatattcaagatagatga

SEQ ID NO: 89662 - DNA, 525 bp, Glycine max
  Peptide Sequence Number=SeqID_181347
atggaattgaagagattgaatcaacatgaggagaatgataagaagaagaagggaatttctcttaaagcttcatcttcaatccaagaagaaagtgataaggaggattcaattgaaatagacaaagatgatgatcttagtctttttgcaaaaaaggcctacattacatgggatgacaatgatatggactcatttgaagattcagaaaacaaaattgtaaaccagagtctaatggccaagagttatgaaagcaatgaagaggtatccttgaagaagagttggtacatatatagcggatgctctaaacatattacgggagatgcatcaaagttcactcatatctctcccaagaaaagcggacatgtgacttatgacaacaacaataaaggtagaattcttggagttggaaaaatagatgatgtttcagaatcattagaagaaatgcatattcatgaagaagatcacaaaggcaaaggagatggaaataatgaagattttcaaacaaatgcttatcttccaagagaatag

SEQ ID NO: 89663 - DNA, 420 bp, Glycine max
  Peptide Sequence Number=SeqID_181348
ggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgcccccagcggggatggagcgaaagaagttttga

SEQ ID NO: 89664 - DNA, 712 bp, Glycine max
  Peptide Sequence Number=SeqID_181349
agtagatgttgaggaaggatgcctagagaccctggttcagttctatgacccgctctaccattgcttcacatttcccgattaccagcttgtccccacacttgaagagtactcctacctagtaggtttacctgtgccagacaagatacctttccatggttttgagcctacccctaaaccctccgacatcgcagccgccctccatcttaaaacctccatcatccaagcaaaccttacctctaaaggaggcctccaaggtctccccacccacttcctctaccaacaagcctccatatttgctgaagcagctagtatacttgccttccattctatcctagccctccttatatatggccttttattcttcccaaatgttgacaacttcatcgatatcaatgccattaaaatctttcttacaaagaaccccgtacccactctactcgccgatacctaccattctatccatgaccgtacccaggctggccggggaaccatttcttgttgtgcacctttactctatcaatggtttaccttccacttacctcaatcccgtgccttcaagaccaatgatgacaagctttcctggcctcgccgaatcatgactcttgacccatctgacattgtttggtaccaagcagctagtgatgttggagagattattgtgagttgtggtgatatcccaacgtacctcttttgggtatgcgtggcggattag

SEQ ID NO: 89665 - DNA, 795 bp, Glycine max
  Peptide Sequence Number=SeqID_181350
atggccatcaacccctctagagctcataagtataccaaattctccaaaaggaagcaaggagagtgctctcaagtagctctcaataggctagatacgtggttcatagatgaaaacaagaagactaatttcaagatgatttacactatgaagaatgtgagaatacccaatgctaacatggaaggtaatttgtactctattgtcaatggtgtagagatgatcattgatgctgcagtttggaaagcagttgcaggattgaatatagttggagtttgcacgttcaaagaatctacgaatggccacagtaagatgcagacatacaaagcctctagattcattgattacttcaatatcaatgtttataatgagatagttgatttcaccaaagcctctaatgagacaaccgaaaggcatctcaagaagcttgggatgagatatgttgttcatgaatggattatggttggagagcaaccagcagcaataaacatggaccggatggaagaagaaaaagaagaagaatctgaacaagagcttgcacaccgatggaacccttttgagtctcttatgattcagaagatggatgctattcttcaccttcatcaagagcaccaagccaaagttcacactctatgtagagcttgtaggccttggatcttcttcatcaatggagtcctttgcttcttgaatatcaatggcaacggaatggggaaggagaaagatgattggagatgccacttcaaggagaagatgagtcaagaagaagctcaccaccataggaagccacaaataagagcttga

SEQ ID NO: 89666 - DNA, 204 bp, Glycine max
  Peptide Sequence Number=SeqID_181351
atggcgaagggtgcgaatgaccataatttgtctctgcatgccaacgaacgcacttgtatcaggaaggcaaagggtgcggatgaccataatttgtctctgcgtgctgacggactcgcttgtctctggaaggcaaaaaatgtgcagatgaccataaattgtctccgcatgctgacagactcggttgtctatggaaggaaaaggtga

SEQ ID NO: 89667 - DNA, 288 bp, Glycine max
  Peptide Sequence Number=SeqID_181352
atggcaactcaagtagcacccccaatgatagagaaggagatgataacaatgatagtagacacactaccagtgttctactttgaaaagatggtgggttacacaccttcaagctttgcgaatttggttttcaccggcaaaaggatcgaagtgggtttgaaaagaggcaaatttgatcatcctaccttggtgaatgggaagcctggggccaatagagaggatgacaagcagggaggatcccatgttgtgactgtcgttcctacatggccaaatttcccaccaactccataa

SEQ ID NO: 89668 - DNA, 479 bp, Glycine max
  Peptide Sequence Number=SeqID_181353
atgggtgaagtagacgaggtgcaacagtggataaaggccaacatagaggccttgaaagagcaaatagccacaatgatggaggccatgatgagcatgaagaagatgatggaggtcaatgcgactgcagttgccgctactagtgtcgttgctaaggtggaccctattctctcgtctggccttacccaaataattcatccaacctcagatatggtaggtcaggcaggcaaggagttgggaagtatgggcggcctccattttttgcaagttcaaaacaagcatcccttcctatcatatggcttgcctcccaattatacaccacccaatttggcgcacactcccgatgagaatgtcaataaccccactctcatactcattgatagccaacgacctcaatctgatcatgcacatatccttcaacccatagaggagacacatgaaataccccaccacaatctagtcaacttcgagccttgcctcag

SEQ ID NO: 89669 - DNA, 72 bp, Glycine max
  Peptide Sequence Number=SeqID_181354
atgtcggtgtcggtgctggttcctggactggggcaagttcgggttgtgacgttgagtgctagtgaggcttaa

SEQ ID NO: 89670 - DNA, 426 bp, Glycine max
  Peptide Sequence Number=SeqID_181355
atgtcgaactcagacaacagagcctaccaccgagcgatccgtccgatgagagcgggtttctcgaaaatgtacttgactgggtccatcttggataccaaccaagtggtgtggcttagcatgtactgccttagacggtgggctgcccacaacaaggcacaacacattctttcaagcagagaaatatgtccattgaatttaatgatgaaatatgtgcaatttaagttaagcttagctcatcagtgggctaagctcgtatccaccgctaagttcgctaaagctgcgcttagcgcgacaaaagaatatggcagggcatcaatatcaaggccgcgcgctaagcgggagattaatgtgctaagcgcaacaattgtctttagccaggctcagcgcatgactgacgctaagctcaaatccacttactcgcattga

SEQ ID NO: 89671 - DNA, 171 bp, Glycine max
  Peptide Sequence Number=SeqID_181356
atggacctgacaaagctccccgcgaagaggtacagcaaggacaccaccgaagagggctccagcactgccccgcaagctgacatggacttcgacaggcaccgagaaagacgagtccagctgagggacgatgagtttcctaactttcagggagagatagcccgcaggcgctag

SEQ ID NO: 89672 - DNA, 353 bp, Glycine max
  Peptide Sequence Number=SeqID_181357
atggcttcttctctcataatttccccaagaaagcttcgctctgatttgtactcctactcctaccaagaggatcattacagcaccccattggtgatcaatgttctggcttcactgattgagaggagcatggccagaacagaaaggatcgtgaagaatggttcgaggtctttgtccaaggccattagcacaaacatctttgactgcagagagatccttgacatgacaatccagtcttatttagagagaattttcaggttttgccagaacaatccaggattcagaatcaatgctagaaatgtgcataggcttctcatcacaaccatcatgcttgcttccaagtatgttgaagacat

SEQ ID NO: 89673 - DNA, 126 bp, Glycine max
  Peptide Sequence Number=SeqID_181358
atggatgggtgggcaaatccctcgatcaattatgatctttgcaagccttaccaaggattagttcgagtctccctaaatcatcaaggtgtgactatgttaagagatatgcttgagttaatcgcttag

SEQ ID NO: 89674 - DNA, 318 bp, Glycine max
  Peptide Sequence Number=SeqID_181359
atgactggtttaatggtgtcataccctaatttcatccggggaccattgtttgatggcatgcaacctttgtttgaccgctttgagcaaccagacccacttggaccttccagattgttcctccagaaggcggttgcttcaggaggaagcaacctggctcgcctggacgagctgcgtggcaaactcctcccctattttcctataaatagagggaggagtgaggaaggaaggggttccgccttcttggcatttcgtaatcacttgaaattcgtgaggaaaattgtttccgtgaagaaaatcgaagccgaggcacttccgtaa

SEQ ID NO: 89675 - DNA, 330 bp, Glycine max
  Peptide Sequence Number=SeqID_181360
atgaagatgctcttgataccacatgatgtagctccatatggagcttgtaggccttggatattcttcataaatggagtcctttgcttcttgaatatcaatggcagcagaatggagaaggagaaagatgattggagatgccacttcaaggagaagatgactccatgtggagcttgtaggccttggatattcttcataaatggagtcctttgcttcttgaatatcaatggcagcaaaatggagaaggagaaagatgattggagatgccacttcaaggagaagatgagtcaagaagaagctcaccaccataggaagccatggataagagcttga

SEQ ID NO: 89676 - DNA, 291 bp, Glycine max
  Peptide Sequence Number=SeqID_181361
atgttgattgatgttggaaatgctttggcatgtgcatgttgtgtatgttcgtggggggcgaagtgcactgaccttccagggtctttggcacttgctttgggtcatgttcatacgttggatgttgtgtatgttcgtggggggcgaagtgcactgatcttccatggtctttggcacttgctttgggccacgttcatacatcggaactccttttggccccaagctgatcacctatggggagggcagttatgtgcgcaaccgggtggtctcgacgaactatgcatggtttcctaa

SEQ ID NO: 89677 - DNA, 1599 bp, Glycine max
  Peptide Sequence Number=SeqID_181362
ggacgtgtcatttatgaaacgcacgtcgccaccggaccgttccgtatccaggacattaacgatgcggtcaacggtacgctggatgtgcgcgttgaggagcaggacggcacggtacagaaatttaccgtcaatacggcgtcggtgccgtacttaacccgcccgggacgcgtgcgctacaaattagccaccggcagaccgtcggatttccgccatcacattaacggcccaacctttgctgccggtgagtattcgtgggggatcaataacggctggtcgctgtacggcggcggtatcgccagtgcgcgctacggcgcggtttccgtggggctggggcgtgacctgctgttcctcggcgcgctgtcgtttgacgccacccagtcgcaggcaaagctgccgcacactggtacccagagcggtcgctcctaccgcctgagctactccaagcggtttgaagagtatgacagccaggtgacgtttgccggctaccgcttctcacagcgcaactttatgaccatgggcgattatctcaatgcgcagcgtgatgcgcgccgtaacgggcgcaacaaagagatgtacaccgtgacgctgaacaaatcgtttcgtgatttgggtgttaccgcttacctcagttacacccatcagagttactggaaccgtccggcgagcgataacttcagcctgtcgatgtcgcgctactttgacattggccgcctgaaaaacgtcagcgtttcgctggcggcctatcgcaacaaatttaataaagtcaccgatgatggcgcttatatttcgctgtcgttcccgttcggcaacagcagcaatatcagctacagcgctgatgtgaagcgcgatgacaccagtcacgacgtcagttattacgatcgcgtcaacgaaaacagcagttatcagctgcgcgcaggccacagccggcgcggtaacagcatgggcggttacgtgtcgcatcacggcgatatcgctgataccaccgccagcatcaactatcaggaagggcagtacagcagcctgagtgtgtctgcccagggcggcgcggtgctgacccctgaaggcggcgcgctgcaccgcaacatgatgctgggcggaacccgactgttagtggataccagcggcgtgcctgacgtgccggtgcgcggctttggtgcaccggtatacaccaaccgctttggtaaagcggtgatcagcgatgtcaacagctattaccgcagcagcgcccgcattgactttggcaaactggatgacaacgccgaagccacccgttcggtggtgcaaaccaccctgactgaaggcgccataggctaccgtcgctttaacgtaattgccggtgctaaagcgatggcgatcattcgcctggcagacggctcggtgccgccgttcggtgccagcgtgatgaacagtaaaaagcaggaaaccggcatcatttacgatcagggcaacatctatttgagcggtgtccatccggcggaacggatggacgtgagctggaatggccaggtgcagtgttccgtcacgctgcctgccacgctgcctgatgacctgtacagcggattacttttaccgtgcctgcgggaagacgaaaaaatttaa

SEQ ID NO: 89678 - DNA, 1300 bp, Glycine max
  Peptide Sequence Number=SeqID_181363
cccgctggtgattggccgcggcgtgggcgaaaactttatcgcttccgatcagctggcgctgctgccggtgacccgccgctttatctacctcgaagaaggggatattgccgaaattacccgccgcgaagtgacgattattgatcgccacggtaaccaggcacagcgcgcggagatcgaatccaatgcgcagtacgatgccggcgataaaggcgtttaccgccattacatgcagaaagagatctacgaacagccgaacgccatcaaaaacacgctggccggccgcttccatgacggcattgttgatctcagcgagctgggcgctaatgcggaaacgctgctgagccaggtggaacatatccagatcatcgcctgcggcacctcttacaactccggcatggtgtcgcgttactggtttgagtcgctggccaacatcccgtgtgacgtggaaatcgcctccgaattccgctatcgcaaatcggcggtgcgtaaaaacagcctgctgatcaccctgtcgcaatccggtgaaaccgccgatacgctggcagcgctgcgcctgtccaaagagctgggctatctcggttcgctggccatctgcaacgtggcgggttcgtcactggtgcgtgagtcagatctggcgctcatgaccaaagccggcaccgaaatcggcgtagcctcgaccaaagcgttcaccacccagctgacggtactgctgatgctggtggcgaagctgggccgtctgcacggcatgcgcgctgacaccgagcatgagattgtccatgcgctgcaggcgttgccgagccgcattgaacagatgctggcgcaggataaagtgatcgagaatctcgccgaaggcttctctgacaagcatcacgcgctgttcctcggccgtggcgatcagtatccgattgccatggaaggggcgctgaagctgaaagagatctcctatatccacgccgaagcttatgcggcgggcgagctgaagcacggtccgctggcgctgattgatgccgatatgccggtgattgtggtggcaccgaacaacgaactgctggagaagctgaaatccaacatcgaagaggtgcgcgcgcgcggcggtctgctgtatgtgtttgccgaccaggatgccggtttcagcgacagcgaaggcatgaaaatcatcccgctgccgcacgttgaagaggtaattgccccaatcttctacaccgtgccgctgcagttgctctcctaccacgtggcgctgatcaaaggcaccgacgtcgaccagccgcgtaacctggcgaaatcggtcacggtggaataa

SEQ ID NO: 89679 - DNA, 178 bp, Glycine max
  Peptide Sequence Number=SeqID_181364
atggctatactcgtggatgataaaagacttctgctagagggggaggctaccatgtggaagagactcacacttgagggggagatgtgttgggttacaagtgtgaggtctccttatgtggtggctcgtggtccacaagtgtacccctcgaatctccccaacatcgccctcctgccaaagg

SEQ ID NO: 89680 - DNA, 574 bp, Glycine max
  Peptide Sequence Number=SeqID_181365
ggcagtagcgtccattcttgaggaaggaactcatttttctaattcgtcatcacctgattcaccatcatcaagggaatctgcagcccacttgccagaagtcgcttctatggcggatgaacaccaacagagagttacccttgaggactattcaagcagttcaatgtcgcaattctttaccagcattgcacgtcctaaagagaagccaagaggtggctccactcatttaaggttccctaacgagtccttgagtgaagcgttggaaaggtttagagggttattgagaaagactcccacccatgggttctctgagccaattcaattgaatatgtttatagatggactaagaccacaaaccaagaaattgctagatgcttcagcagggggaaaaataaagctgaagacccttgaggaggcaactgagctaattaagaatatgtcagccagcgatcatgttgtaccatttatggtgaggctcatgaaacaggccaatgtatccccattgaagaaaacactcaagaagttcattatatgggaaatcaatagagacaaggatatactcaaagaggatttttag

SEQ ID NO: 89681 - DNA, 678 bp, Glycine max
  Peptide Sequence Number=SeqID_181366
atgtcctgctatatgaacatcgatcccgcggcctcatcgattcactacaaaggccgcaagctgccgcattttgatgcggtgatcccccgcatcggctcccagatcacctattatggcaccgccgcgctgcgccagttcgagatgctgggcagctacccgctcaacgaatctgtcgccatttcccgcgcccgggataagctgcgctcgctgcagctgctcgcccgccaggggatcgatcttccggtgaccggtatcgctcactccccggacgacaccagcgatctcatcgacatggtgggcggcgcgccgctggtcatcaagctggtagaaggcacccagggcattggcgtggtgctggcggagacgcgtcaggcggcggagagcgtgattgacgctttccggggcctcaatgcccacatcctggtgcaggagtatattgaagaagctaaaggacgtgacatccgctgcttcgtggtagggaatgaggtggtggcggccatcgaacgccaggccaaagagggcgattttcgctccaatctccatcgcggaggcattgcgcgggtggcgacgatcagcgatcgtgagcgtgagatagcggtgaaagccgcgcaaacgctggggctggatgtcgcgggcgtcgatcttctgcgggcgacgcgcgggccgctggtgatggag

SEQ ID NO: 89682 - DNA, 252 bp, Glycine max
  Peptide Sequence Number=SeqID_181367
atggcacgcagcgtggtccgcttcgtgcccctattcaagggacctatatgggagagagctaaaagggtttttagtgataatccccaagtccccagtggagtcgccaactgtcgcaacctacccttcgacgggagggcgacgcgtgactcgcaggtgcgtgttccaagaaaggaatatgcgcggagtcgccaccaacgtttatttgaggaaaacgtcggaaaaaccagaaaagacgtgatctacgaattctaa

SEQ ID NO: 89683 - DNA, 311 bp, Glycine max
  Peptide Sequence Number=SeqID_181368
gtttggcgcctaccaggcaccctctggacccggataagtccaacagggccctgggatttcccgctttgatcacgagactctaccagtcgttcagagtccccgtcgcacctagcaagttgagcctcagcctgcagagccagggttttacttcttttctgtgccctactccggatcagttcagggcagaggtcacatggcccggagattggccggaggcaccagcagaggctcccgacgaggcagatgaggcccgcgaggacgaggagatgaccgatttacttgatttcttaggagggagcagggccacatga

SEQ ID NO: 89684 - DNA, 1071 bp, Glycine max
  Peptide Sequence Number=SeqID_181369
atggacttcgtgctgtggaagatgtccaagccgggcgagccgagctggcagtcgccgtgggggccgggccgtccgggctggcacatcgaatgctccgccatgaactgcaaacagctgggcacccacttcgacattcacggcggcggttccgatctgatgttcccgcaccacgagaacgagatcgcgcagtcgagctgcgcccacgacggcccgtacgtcaattactggatgcactccggcatggtgatgatcgacaaagagaagatgtccaaatcgctggataacttcttcaccatccgcgacgtgctcggccattacgatgcggagacggtgcgttacttcctgatgtccggccactatcgcagccagctgaactacagcgaagagaacctcaaacaggcgcgcaccgcgctggagcgcctctataccgcgctgcgcggcaccgacgccgacgccgcgccggccggcggcgaagcgttcgaagcccgcttccgcgaagcgatggacgacgacttcaacaccccggaagcctactcggcgctgttcgatctggcgcgcgaggttaaccgcctcaagggtgaagacatggcggcggccaacggcatggcggcggaactgcgcaagctggcgaaggtgctcggcctgctgcagcaggcgccggagcagttcctgcaagggggcgctcaggttgacgacggcgaagtggcggagatcgaagcgctgatcaaacagcgtaacgaagcgcgcgccgcgaaggattgggcgctggcggatgccgcccgcgatcggttgaacgagatgaacatcgtgctggaagacggcccgcagggcaccacctggcgccggtttaaccatgaccttgccaccgttgaactccaccacctgatcggcgacgatcttgcagcgcttgcgggtttcgaccttgccgtcgactttcacctgcccttcagcgatgacttctttggcggcgccgccgctttcacaccagccctggaacttcagcagatcgcacagttcgacgtggggatgattgtccagattgaaaatttccatactgccttacttatttag

SEQ ID NO: 89685 - DNA, 321 bp, Glycine max
  Peptide Sequence Number=SeqID_181370
atggtggaaccatcaaagaagcacaaaggttcttcgagtagaagccaacgttattccaaggttcaggatactccaattccttcctccattccctcctcctcattgttctcatcggaagaacaacatatacggtacacaaaccttttctcctctcgttctatcatagaccctaagttcatagatatggatttcttttctaatgagagtttcgaatgcattcaagcatttcaaaactcaaatctcattccctttatgtctctaaaatttcctgtgtattttgaattggtaaaagctttttattctaatcttgaaattcaataa

SEQ ID NO: 89686 - DNA, 570 bp, Glycine max
  Peptide Sequence Number=SeqID_181371
gtgactatcaccttagatgatgtggcgtcattgttgcatttgccgataataggggcgttccataacttcgagcaactttatgtcgaccatgttgtcaatatgttggtgaaattactcgagacgaaaatcgatgcatgtcactggatcgtagtagcacgagcgtatttgttgcatctgcttggatgcacactctttgctaacaagagtgtcatacatgtgcatgtgatattcttagatgcactacatgacttgacgcagagtgggacttatgcttggggcattattgcacttgtgcatatgtatgataatttaaataaggcgtcaaagagcatgacgaggcagcttgcaggatatatcactctgttacaatgttggatctacaagtatttttcgtctattggttctgccatagctgccaaggattatgacgagcggagaccgcgtgcatgtcgatggacctttggcaaggcattacctgtgttgacgtatcgtaggcatctggacagattgacccctgatgttgtgtgctggattccatatgatgatcaccgctcatttagagaatttaag

SEQ ID NO: 89687 - DNA, 897 bp, Glycine max
  Peptide Sequence Number=SeqID_181372
atgggttttacttgtctattgattgaactagtcaaatttaaatatggatgcaagggttttacgctgacttcatcagaactttttttgtttgttagaaacagagattcatatgaatacgagtttattgggagtattgttgaggagatctctaggaagtttagtcgtgcttctttacatgttgcggattatccagttggtctagagtcagaagtgacagaggtaatgaagcttttggatgttggatcccatgatgttgtccatatcatagggatccatggaatgggcgggttaggaaaaacaacacttgctctggcagttcataatttcattgctctccatttcgatgaatcctgttttcttcaaaatgtgagagaagaatcaaataaacatgggttaaaacaccttcaaagcatccttctttcaaaattacttggggagaaggacatcaccttaacaagttggcaagaaggagcttcaatgatacaacataggctccaacgaaagaaggttctcttgattttagatgatgttgataagcgccagcaattaaaggctattgttggaagacctgattggtttggtcccggtagcagagtcatcattaccactcgggacaaacatctgctaaaatatcatgaggttgaaagaacctatgaggtgaaggttttaaatcagagtgctgctcttcaattgcttacgtggaatgcttttaaaagagaaaaaattgatccaagttatgaggatgtcttgaatcgtgtagtaacttatgcttctggccttccattggctttggaagttataggttccaacttgtttgaaaaaactgtagcagaatgggaatctgctatggaacattataaaagaattcccagtgatgaaatccaagagattctaaaa

SEQ ID NO: 89688 - DNA, 192 bp, Glycine max
  Peptide Sequence Number=SeqID_181373
atgcggggtaagcttatggttacccgcaccattcgtcaaccaggggcaaacgagcccgttgacgcgcagagacttacatcttcttctgcaccttttgtcgtcctttcccgtgaagtcaggggacaaacgaacccagttgagcgcaaggagactaacatcgtcttcttcacctttcgtcgtcctaacccgtga

SEQ ID NO: 89689 - DNA, 336 bp, Glycine max
  Peptide Sequence Number=SeqID_181374
atgtcacattttataattgagagagaagagttttcatgccctccttggtttccagtgggagcaaaaatgttgatacatagaattttggacccaaatcctaaaactgcttctagtgcatatatattttggccaaatggatcccctctaaatatcatttcaagatcagactttcaacatcggttattaaccgatgttgaaagtaccgatattgaaagtaatatcgttaacattagttttctgaaactaataagcaaagactttgatgttttgatgatgccaaagggtcatgcgcttctcaagtttaattcaagaggatcatacgcttctcaagtttaa

SEQ ID NO: 89690 - DNA, 366 bp, Glycine max
  Peptide Sequence Number=SeqID_181375
atgttggtgcttgaaagctccaaacctgctgattcagttctagagttcttgggttcgatgctcttgtcattctacaagaaacactctccactcaaggaacttaccagcgagaggaagaaaagccacggagagggagtggtaactcatgacgctgctgagagggaaagagagagagcttgtgatggtgtgctgagagggagagatagctcgtctgtagtgtgcgatgagatagagggagagcacgtgaaattttacgaaagcattacggaagccacggaaaccatttttcaacaacgtggaggagcttgccacctagttgcttcctccttaaacaacccaacttccaaaatgtgttggacgggctag

SEQ ID NO: 89691 - DNA, 177 bp, Glycine max
  Peptide Sequence Number=SeqID_181376
atgttggagtggataattgttgggaagaagtttggtgacattggtgaaagtgatgcaagcaaggagtttggatggctcatgggggttgggaatgaaggagttgttgtcggccatgggaggcaagggtggggaacgacgtccttaattgaagaaatagggaatgggtggatcgtttag

SEQ ID NO: 89692 - DNA, 211 bp, Glycine max
  Peptide Sequence Number=SeqID_181377
atgggagatcgcttagaggatataatttatgatcttggacaagagtcttttcagcaagcacatgcccggtatacaaagaatctacaccgtctagaagcatctattgtggaaaggtacattccagaagaagctattgaattttgttcagagtacattgaaagggcaaaacctgttgggcttcccgagtctcgccatgaggaaagagtgagag

SEQ ID NO: 89693 - DNA, 330 bp, Glycine max
  Peptide Sequence Number=SeqID_181378
atgggaggaaaatgcgcggagttgccaccaacgtttattcgaggaaaacgtcggaaaaaccggaaaaggtgtagtctacgaactttaagtgtgaaaggttcgggagttgcatttccgcacggggaaggcgttggaccatttaaacgatcttttgattcttttgaaaggagagaaacattaaggtattggacgattaacgatctcttggtttttgaaagtaaagaaatgttaaggcgttggaccattaacgatctcttggggtggtcgacaaaagtgaggcttttgctcctatgtatcctcaattgcgatgaggaaatcagacctacgtag

SEQ ID NO: 89694 - DNA, 231 bp, Glycine max
  Peptide Sequence Number=SeqID_181379
atggcagcggaatggagaaggaagagagagaggagacgccacttcaaggagaagatgagtctagaagaagctcaccaccataggaggccatggataagagcttggaggaagaaggagatgaatgaagggagagggagagaagagcacaaaattttgtgctcaaaaagagctctgaaatctgaacccactaatccaagatcaattccaagattctccactaagtgtgcttag

SEQ ID NO: 89695 - DNA, 210 bp, Glycine max
  Peptide Sequence Number=SeqID_181380
atggctgatgacattgtctataattataaaaaatcatcaacaagtccagcattacagcttgatgataggactcttcaaaatatggtcttgcttgaaattgaacaactattgcaagcaaatcaaagattgcttagagtctatccttcaatgccatatcaagaagatgtgaattgcccaaccaatctagaaaatagccttatattagcttaa

SEQ ID NO: 89696 - DNA, 1116 bp, Glycine max
  Peptide Sequence Number=SeqID_181381
atggcatctaagaaaaggaaggctccttctacaccttcccaagtcagatatgatcggtctaggttcacctctcaagaagcttgggagaggtatactgatataatagtgcctaagaaactactaccagagagaaatgtagtagtatactacactaagtttgatgagttcaaggaggaactcgagagaagacactggggtgaggagttgactgattttgcttacagcagcatagatgttgccattgtgaaggaattttatgctaacctctacgactcagaagacaagtcacctaagcatgtgagggttagaggtcatttgataaaatttgatgaagatactttgaacaccttcctaaagacccctgtaattctggaagagggggaaaatctttgtacttattccaggtttgcactcttgaggcctgatcctcaggagttggctgctaagctttgtatcctagggaggggattcgagctaaacattgatggtcagcctttgaagatattaaggaagaacatgaccactttagctcagacatggagcgttctgtccttctctaacttgattcctacctcccacacatctgatgtcacattagacaaagccaagttaatctatggcatcattatgaagatggatatgaatgtgggacttggattcccagccttgatcacagctcttcgcaaggctagaggagtccaatcagattctagatccctggagagcctgatccctgccattaacttggcatacattaagaagaactgttggaatctagatgatccaacaatgacatttagagggccaagaaaggccatgggtaagagatcagaggtccccaccacttcagcagcaccagagatagcaactcctttttcttcaacagctccagcactttccatttcaactccagcacagactccaggcattcctactccatctactcagataccacttccatctcctttatcttttggaccctcatattttttatttacaccacaaatgcttcattccatgctccagagcttacacagggggcaaaccattatcatgcagagccttcaaggcttgggcctaccatccatcatgagcatggatgagtttgacacatag

SEQ ID NO: 89697 - DNA, 327 bp, Glycine max
  Peptide Sequence Number=SeqID_181382
atggctcaggaggaggagacttccacagaccagatgccagagccatctcctgcatctgttcctgaggagacccagccatctgcaccagtcatggagccagagcaacctattcaggattcatcagcagctctaacactggatcttaatgaagatcaatcacaggatgagcatgatgcattcctcggcggcagccttctcatggtggagcttatccttgatgttgcggttaaggtcctcaacggcatcgtcctcattgtggatgaagtgcagaagagaggtggaggtggggaacgactttgtatatcagagaatggaaaggaagtgtga

SEQ ID NO: 89698 - DNA, 1113 bp, Glycine max
  Peptide Sequence Number=SeqID_181383
atgccgaccgtggcctggcccgcgatcacgtcgggatcgtcgaaggggtgcacgaaggtcagtttttcctttttttccagcgtctgcgcgtgggacgaaggcatcggagaagctctcgcttggcgcccgaggcttcgccaccagccggcgcacccctcgcgctcgattcttgaccggactggtggtgggcatgacgccagcgcgcccgccggctccagcgccacgctgcgcgtgttccaggaaaacgtccttgatcgccgcgatcagaccgcgttgcgggtccacgccaggagcgtgttcgccatcgccgacaacagccccacgcttcggccggcgattcgaccgcgacgtcgtagacctggatcgatgcgtttccatggctggacatggacgtctgccgatcacctgaggcggaaccttcagcagagacgggccgcggcaggcccgccgccgatggcaggcgattattcagggaaagccgcgcgccgacggttttcaggcgctttcgccacgcaccggacggccgcggccgcacgcggctacactcgctggcatcatggaagaaagcctcctctccgccgtccactggttgctcggcctgctggccttgccctcggtcggcctgcccgcgatcttcgcggtgtcgttgatttccgccacgctgctgccgctgggatccgagccggcggtgttcggttatctgaaactgtcgccggacatgttctggcccgccatcctggtggcgaccgccggcaacaccattggcggggccatcagctatgccatgggcctgggcgcggagaaggcggtcgagcgctggaaagagcgccacccgcacgcgccggccgaacgacgcatgcgcggccgttggcacgagcgcgcccacgactggatccaccgcatgggaccgccggcgctgctgctgtcctggctgccggcggtgggcgatccgctgtgcgccgtggccggatggctgcggctgccgttctggccttgcgtggcctatatggccatcggcaaattcctgcgctatctggccatgacggccagcctgctgtggctgtttcccgggcaggtctagcgctgacgtcccgcttaattggggacatataa

SEQ ID NO: 89699 - DNA, 151 bp, Glycine max
  Peptide Sequence Number=SeqID_181384
gaaagaaaaatactacaatgcgaggggtatttcacttatctcagatgtgatatcaaaattcccaacggaaaaagagagggttttgggagagcaagagagaaaaaacgaaattggtagacagaggaggctgagaagtcagtctgaaaactga

SEQ ID NO: 89700 - DNA, 189 bp, Glycine max
  Peptide Sequence Number=SeqID_181385
atggtgaaagttggaacctcttacgtgccgatcaacgtctcattttcgccaaaagttggcccagggcttcccggtatcaacagggacaccaggatttatttattctgcgaagtgatcttccgtcacaggtgctccaagtggcttctgtttctatcaagctgtccctcctgttcagctactgacggggtg

SEQ ID NO: 89701 - DNA, 321 bp, Glycine max
  Peptide Sequence Number=SeqID_181386
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggctccaagtaactcacagggaaattttccccaaagtcacgaccacataagcaccctaaccttgaaccctcatgaagctccactcattcattacaaaggcttcaaacttgttatcaaggaaccaacaatccaaagccctaaatggtttgggtccccaattcacattagaactcttcatgactaa

SEQ ID NO: 89702 - DNA, 719 bp, Glycine max
  Peptide Sequence Number=SeqID_181387
atggttctatttcttattcttaatgttttcgatctcggttccgtagagaaagaagtgaggaatcctcttttcgactctgactctcccactccagtcgttgcttttctttctgttacttcgaaagtagctgcttcagcttcagccactcgaattttcgatatccctttttatttctcatcaaacgaatggcatcttcttctggaaatcctagctattcttagcatgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatttcttagtttcaataggactccttacgagtgttgtttctatctactattatttaaaaataatcaagttattaatgactggacgaaaccaagaaataactcctcacgtgcgaaattatcgaaggcccatcaagcttatcgataccgtcgacctcgagggggggcccg

SEQ ID NO: 89703 - DNA, 429 bp, Glycine max
  Peptide Sequence Number=SeqID_181388
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaagcgggcagtga

SEQ ID NO: 89704 - DNA, 913 bp, Glycine max
  Peptide Sequence Number=SeqID_181389
atggctatcgagcagcttgccgaacgcgtgcctggcgtcctgctgctgaccgcaacgccggaacagctgggtctcgaaagccacttcgcccgtctgcgcctgctcgatcccaaccgtttccacgattttgagcagtttgtggaagaacaaaataactaccgtccggtggcggatgccgtcgccctgctgctggcgggcaagcgtctttctaatgacgaactcaacaccctgagcgatctgatcggcgagcaggatatcgagccgcttttgcaggccgcgaacagcgagagcgacaacgcggaatccgcgcgtaaagagctgatcgacatgttgatggatcgccacggcaccagccgcgtgctgttccgtaacacccgtaacggcgtgaaagggttcccgaaacgcgaactgcacaccattaaactgccgctgccgacgcagtatcagacggcgattaaagtctccggcattatgggcgcgcgcaaaacgcaggaagagcgcgcccgcgacatgctttatccggagcaaatctaccaggagttcgaaggcgataccggcacctggtggaacttcgatccgcgcgtggagtggctgatgggctacctgactgcacaccgctcccagaaagtgctggtgatctgcgccaaggctgctaccgcgctgcagctggagcaggtcctgcgcgagcgtgaaggtattcgcgccgccgtgttccacgaaggcatgtccatcgttgaacgcgaccgtgccgcggcgtggtttagcgaagaggacagcggcgcgcaggttctgctgtgctcggaaatcggctccgaaggccgtaacttccagttcgccagcaacctggtgatgttcgatctgccgttcaacccggatctgctcgagcagcgtatcggccgtctggaccgtatcg

SEQ ID NO: 89705 - DNA, 219 bp, Glycine max
  Peptide Sequence Number=SeqID_181390
atgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaagaatgaccaaacttggtctctgcttgtcatcgggcccgccgcctctggatga

SEQ ID NO: 89706 - DNA, 67 bp, Glycine max
  Peptide Sequence Number=SeqID_181391
gggtagagggtgtcacacaagagaatagagaacaattaaacaagataaattcatcaaacttagaaag

SEQ ID NO: 89707 - DNA, 372 bp, Glycine max
  Peptide Sequence Number=SeqID_181392
atgatgtgtgaagacaagaagcctaatcctgatcaagcatcatccgcagattcctcttgttggactaaactcaaccatgaccgtattaaaacaaacatactacaactaggttaccgtaccccgattcctcgtgaaaatacgataaactatccccgtcctatcaagttcgaagaatcagaccagtttccactgttgaatgatcctaaggacacatgcatctacatgatcaagattcttcctcacgctcaaccgaagagtgttgcgcttagcagatggctcgctaagtcagtagattggcttagcgaaaaggtccatgggaacataggaagtggagatgaatctgtggtcatgctaagtctccgacttgcttga

SEQ ID NO: 89708 - DNA, 544 bp, Glycine max
  Peptide Sequence Number=SeqID_181393
cgtgagctatgagaaagcgccacgcttccccgaagggagaaagccggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacagcggataacaatttcacacaggaaacagctatgaccatgattacgaattcgagctcggtatccaaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 89709 - DNA, 531 bp, Glycine max
  Peptide Sequence Number=SeqID_181394
atgacgttgctatttagtaacattctgcccggcgaccacaatgccaatctccccctgcagatgtatcgattgggatcgcgcccacaagactcccagtgggcccgaagaagtccaatagggccctggggttttcagctctggttacgggcctctgtcagtcctacagggtgcccgttcccccaacgaggtcatgccatcgtgataagtatacagatggaatcgcacctacaaagacatccagtggacccggagaagtccaacagggccctggggtttccagctctggttacgggcctctgtagtcctatagggtgcccattccccccggcaaggtcatgtcatcatagagtgcatgccacctccagcaagggcattaagccccctactaatcgagctttcatcaagaagtactgcgcccccaggcaggcacagggcgaaacaccacagcagcctggggatggccagcagcgggcaacagacgcacggccatcacctctagagttcacctcagctcatccacaaaaaggttag

SEQ ID NO: 89710 - DNA, 360 bp, Glycine max
  Peptide Sequence Number=SeqID_181395
gtaactttgtttgctgtgcactgtgctggatgcttcaactatctgattgcagataggtaccctgatgcaaaatcaacatggattggttctgtgtacccaaatttcaaagaaatgagtctttgggacagatatgtcactgccatgtattggtccattgtcacacttaccaccactggctatggggacttgcatgctgaaaacacaagagagatgctgtttgacatattctacatgttgttcaacttgggattaacctcatacatcattggaaacatgacaaacctggtggtccactggactagccgcaccagaaattttgtatgtgctctcaaacttgtgcttcttttactacttaattaa

SEQ ID NO: 89711 - DNA, 756 bp, Glycine max
  Peptide Sequence Number=SeqID_181396
gcattggagagattcagagacttactgagaagaactcctacccatggattctccgagccaatccaactgaatatgttcatagatgggctgagaccacaaaccaagcaattactagatgcttctgctgggggaaaataaagctgaaaaccccagaagaagcaactgagcttatagagaacatgtcagccagtgatcaagccattctgagggacagaacccatcaacccacaaagaagagcctgttggaactaacatcacacgacgccttgttggcacagaacaagttgctatctaagcaacttgagatcctaacggaaacacttgttaagctgccaactaaattgtcgattggacaacctacccattcttctgttttgcaagtcacagggtacactcaaggagggttttcaggcttccagcaaggtccttataatcaacaaggacagtggaggacacaccctggcaaccagttcaataaagaccaaggtggatcctcaaacaggccaattcaacaagggcctaacatctttcagaggacaaccaagttggaagagacctttattcagtttatgcagatagttgacaagtcatcaaacaactttggagcaaatacggaaaataatcctaaggaggaatgcaaggctgtgatgaccaggagtaaaaggtttgtggaagctgaggatgaagaaaatgtggtagacaaggaacaactgagtgaaaagacaggtgccgaggttaagaaaaatgatgtgaagg

SEQ ID NO: 89712 - DNA, 285 bp, Glycine max
  Peptide Sequence Number=SeqID_181397
atgaagattgttatctctattccactaataaattatgattttgctggaggagagcatcaccaggacagttgttacttttattctataaataactttgactggaggcaggaacccgccatgtacaactattatgagaaaggaagagctcctgatcttgaaagtgtattggcagacttcatgacataccaagctagctctaaaggtgactgttattccatgcaacaacagggaattcaatttaaaagggactattcttttgtacattatcaatgggagtcagaatga

SEQ ID NO: 89713 - DNA, 339 bp, Glycine max
  Peptide Sequence Number=SeqID_181398
atgcttagcggctccaacaaaagacttccctccaagtcacctactactgctcatctgctcccacgaacgaaagttcaagatcatcacaggcaccaatcgcacggtacaaaaattgcaaagggatatccaatatggtcaccacacccccaatgtaaatacacaacatacatcatcaaaatcaagatcatctcatctcagcatcatcatcaacatcacaagcaatcacattccacatacatacttataaattcatgcccgggattcacattccccaggccttcaggcaacataaacctcatacaacaacaatctataataccacaatactcatatttttaa

SEQ ID NO: 89714 - DNA, 1333 bp, Glycine max
  Peptide Sequence Number=SeqID_181399
atgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggattaatttggaaaagtagtagggacatacaagaacaaactatttttgttggaaacattcctttaatgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgtgtgagtaggaaacagaaaatatctattctagttttatcatcagctatgggttcgaatttaagcgaaattctagagaatgtttgttatcctgaaattttcgtttctttcctaaatgataaggataaaaaaaaaatagggtcaaaagaaaatgccattttggagttttatcgacaatttgcttgtgttggtggagatccagtattttctgaatctttatgtaaagaattacaaaaaaaattttttcaacaaagatgtgaattaggaaggattggtcgacgaaatatgaaccaaaagcttaatcttgatatacctcagaacaatacatttttgttaccacgagatatattgacagctgcggatcatttgattggaatgaaatttggaatgggtatacttgacgatataaatcatttgaaaaataaacgtattcgttcggtagcagatctattacaagatcaatttggattggccctggttcgtttagaaaatatggttagaggaactatatgtggagcaattagacataaattgataccgactcctcagaatttggtgacttcaactccattaacaactacttatgaatctttttttggattacatccattatctcaagttttggatcaaactaatccattgacccaaatagttcatgggagaaaattgagttatttgggccctggaggattgacggggcgaactgctagttttcggatacgagatatccaccctagtcactatggacgcatttgtccaattgacacgtcggaaggaatcaatgttggacttattggatctctagcaattcatgcgaggattg

SEQ ID NO: 89715 - DNA, 858 bp, Glycine max
  Peptide Sequence Number=SeqID_181400
caaaagctcctggctgagaagacaaagaagaagctagaggaagcttcacagccaggaagcgttgatggcatcatcgacccttcatccccggtcaaacgccatgtgaagtggaagatggccccccagaagaagacaggggagatgacgactgaggccgcaaaggaaattgctgagaagattgattcgtttgaggagcaggccacacggggatcgttcgtcccttatggacgtcaggatgttcttgccgctgctattggttgtccagagcaccctggacgtgtccgtgctgctggagccagtgtcaccatcaagcaatactttggatcggctccacggacgtcccgcaacgcttcctccctgcctcctgacgaattacagcagctgacccaacagattagggaccagcaagaggagtccatcatagagaaagtgacgaggcaggtgagcgtggaggaggttatagatgcagatgctccagttcctgtacccactgatgaggtttccttagtggggcaggcacttcacaccttccttgcttggccgacacatctggtcaagtctttatcacagcaggtagctgtgtctccagcaaaaccacctccgaagcccgatccggaggtcgatgatccgctttatcttatggcattgaccatcccagagcttttcttaaggtcttatcaggttagatgggatggcaccgtgttcggggtcgttaatccagatttccccctctacataaagcatgaagacctctccgaaatcgcacacggtggtcaatgtctcagcatatcagtgttacagttgtggattctgcatctcactgaaacatgtatgcgagtgaggaattctgatatctaa

SEQ ID NO: 89716 - DNA, 489 bp, Glycine max
  Peptide Sequence Number=SeqID_181401
atgatagaagtgtccgttgaagccatcgcatctctcactcaatactacgtccaatcactcagatgtttcgcttttggggactttcagttagcaccaactatagaagagttcgaagggatcttaggatgcccgctagagggaaggaagccatacctttttttcggattctatccttctttggcaagaatagcaaaagtggtcaagatctcggaacaagagctagaccgagtgaagcaaactaggaatgaggtggcagggataccaaggaaacgcttggaggagaaggtggaagctttggccagccaaggagagtggacaacattcatcgacatattagctctgctagtgtttgggacggtactattcccgaatgtagacgggttggtggatctagcggtaatcgacgcctttcttgcttatcaccacaacaaggaaagcccagtcatcgctgttttggcagatgcatatgatacatttgactttagatga

SEQ ID NO: 89717 - DNA, 663 bp, Glycine max
  Peptide Sequence Number=SeqID_181402
atgaaatcttggcagcagattcttcaggatgtggcttcaagatttgacatggcgaattatgataatcccatatcagaattatctaaactacaccaagaagaaaaatcagtctgtattcataaccctaggtcgctacaagatgcaatgcaattagctagattgcaagatgaggggaaattaagtgccatatttgctgctcagggtgaggcatcagaagaatctaaagaggaggaagaacaagagaacattatagccttaggaaaagaactgttagccactgatgcagttcaaatttcactaaatgcccttaaagggatagctagtggccagaccttacagttgaaaggaattattaacaatacagagttaccattcttaatggacattggaagtacacataatttttggctgaaaacacttggagaaataacgtggaactacaaatctcttactatggaatttgaacatgctgggaaaacagtgaagctcgtgggagaacaacaatgtcgacagcaccaaggagcgtctatagctatgaattgcattttcccagaagctatgttgttatctatttcgattctcgagacccaacaggagacttcacatcaggaaacaatgctaacagaacaacaacaacaagacttaactgaaatattattgtaa

SEQ ID NO: 89718 - DNA, 750 bp, Glycine max
  Peptide Sequence Number=SeqID_181403
atggccacacttgctcaaacttggagtgttctttcttactccaacttcgtccctacctcccacacttctgacatcacatttgatcgggccaagttgatctatggtattatcatgaagatggacatgaatctgggctacctcatctcccatcagatttctattattgcccagcaggattcttctaggcttgtatttccagccttaatcacaactttgtgtaaagctagaggggtcacattagattccagatccttagagagccttagctctgccattaacttggcatatataaagaagaactattggaatctagaagatccaacaatgacattcagagggccaaggaaggccaggggtaagagatctgaggctccccctacttcagcagcaatagatagcctccacaaatggcaggtcattatcatgcagagtctccagagctcaggcctgccatctattatgagcacagatgagtacctgactcaggtggcttggctaggagtccagccttctccttctagagggggtgggacctccgcagcccaagagcctaagcaggcaacagaggagccagttttagcagaggatgagctcattcctcttgagccctcttcagttgttgcagatacatctatggctcaggaggaggtatctttaccagatcccatgccagagccatcccttgcacctatatctgaggacactatgccattagtaccagccatggagccagagcaacccattctttag

SEQ ID NO: 89719 - DNA, 168 bp, Glycine max
  Peptide Sequence Number=SeqID_181404
atgccaatctccccctgcaaaagtatcagctgggatcgcacccaagagacacccagtggacccggaaaagtccaacagggccctggggtttccagctctggttacgggcctctatcagtcctacagggtgctcgtaccctcccgccaagctcacatcatcataggtaa

SEQ ID NO: 89720 - DNA, 366 bp, Glycine max
  Peptide Sequence Number=SeqID_181405
cagacaagcccgtcagggcgcgtcaacgggtgttgccgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatgagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcagaggcg

SEQ ID NO: 89721 - DNA, 897 bp, Glycine max
  Peptide Sequence Number=SeqID_181406
agaggaatacacctccacgtcctcaccttggagaggactacacgtcctcgccttgagaggactacacgtcctcgccttgagaggactacatgtcctcaccatcagagggttgcacgccctcacctccagaggactacacgtcctcgccttgagaggactacatgtcctcaccatcagagggttgcacgccctcacctccagaggactacacgtcctcgccttgagagggctacccgccctcgccttggaggactacacatcctcgccttcagaggactgcacgtcctcaccttgagaggactaaacgtcctcgccttgagaggactacatgtcctcaccatcagagggctgcacgccctcacctctagaggactacacgtcctcgccttgagaggactacatgtcctcaccatcagagggctgcacgccctcacctctagaggactacacgttctcgccttgagagggctactcgccctcgccttggggctacacgccctcacctttagaggaccacacgtcctcaccttcagagggctacacgtcctcgccaatagagggctacacgccctcacctttagaggactacatgtcctcgccaacagagggctgcacgccctcaccttgagaggactacacgccctcacctccagaggactatacatcctcgccttgagagggttgcacgccctcacctttagagggctacgtgtcctcattttcaggaccagtagtttccttttaacggttcctgggccaccccctgatattggaggacggccaactgtgcgagcacaaccagagagggaggctatcacacagctactatgcataccggggcaagattcacccgtgccgctgcaaagagacgagtgcggatcatgcgcaccaacatga

SEQ ID NO: 89722 - DNA, 85 bp, Glycine max
  Peptide Sequence Number=SeqID_181407
atggtggtccgggggagatggcgatcagtggaggctcttcatcctagtggacagctctttggattcgtttggtatacttttgagg

SEQ ID NO: 89723 - DNA, 99 bp, Glycine max
  Peptide Sequence Number=SeqID_181408
atgttaaatgatatgaatgacagtggaatggagaaggaagagaaagaggagatgccacttcaaggagaagatgagtctagaaaaagctcaccaccatag

SEQ ID NO: 89724 - DNA, 162 bp, Glycine max
  Peptide Sequence Number=SeqID_181409
atgcctccaaaggcaactgctcctccttcaactgcctttaggtcaaggaatatagacctttcactcaccatatgtcgtgagcatccactatccaggttttcaacattcgaagcagatgatctcattgctttcgagaagcttctatggaggctggatctttag

SEQ ID NO: 89725 - DNA, 897 bp, Glycine max
  Peptide Sequence Number=SeqID_181410
atgaaggaaggcataggtcacatcttagacctcactcccataggagagaaaatgaaagaaagcctcaagaggaagtctacttcaaaatcttatggctctcactcttatccaaagaatgaccaaggtcaaggaatcttagggtgctttaaatgtcttggaagaggacacattacttctcaatgccccaccaagaaaaccatgattatgaggggccaagacatttatagtagccaagatgaggctactacttcaccttcctctagtaaaagtgaagaagcaaaagaggaagaatctagtgaagagatctacccccaagaagaaggacaacctttaatggttaaggaggagtgtaaggagacacttgttagcattgccacatctcttaggcttgagtttattcctcaagtaaaggagttgttggatgagggtttggttcgcaagagattaaatccttgtgctttgttggtgcccaaaataggtattattaggcaccaaatccctaaaataggtggtgtgatgaatgctttgggtggtgcaacactcttttgtaaaatcacttgtgcacccaacatcttcatgatttgtgtacatagggactcattaggggttcctatgaaccctaagagaataaaggtcattcctgagtggcctgctccaccaacaccactcattgagttggtgaggaaccatgttccttcatgggaagatgcccaggaaatgagttttcagaccttaccttacttcaacatactaaacaccactaatacatatgtttttgttctttttacaggtgttgaggaaaaaagcccagagtttcaagaacctcgggatttgaggtcaaatcctttccaagggggagggaatgatgcaatcctaccccgcaagggcattggatag

SEQ ID NO: 89726 - DNA, 213 bp, Glycine max
  Peptide Sequence Number=SeqID_181411
atgaggggggttgtcgcaacctacccttcggcgggagggctcgcggggctcgcgggtgcatcttccgtgggaggaaaatgcacggagtcgccaccaacgtttattcgaggaaaacgtcggaaaaaccagaaagggtgtttccctcgctcctacgtatcctcaattgcgatgaggaaatcagacctacgtagttctttgcaagatatattttga

SEQ ID NO: 89727 - DNA, 486 bp, Glycine max
  Peptide Sequence Number=SeqID_181412
atgatagaaagtgcggaagacgatgtaaatctccgcgtgtcaacagacaatcacttgtgtatctccgcacgtcatctgacttcacgggtcacgataacaaaaggtggggcggtcaacaaaagcgaggcttttgctcctacgtatcctcaatttgtgatgaggaactcagacctacgtagttatttcttttgtgcgagactaaaaaatagtctctaccgggagatgctgacattttcggaaagggtgcaaatgaccacattggcctctgcttgtcaatcaaacttggggtctctgaatgacgaggtacggataaccggaaggtgtctctgcatgctaccggactcttgggtcatgatagcaaaaggtggggtggtcgacaaaagcgaggctcttgctcctacgtatcctccatttgtgatgaggaactcagacctacatagttctttcaaaagcgagactaaaatagtcttgatgttccttcactaa

SEQ ID NO: 89728 - DNA, 762 bp, Glycine max
  Peptide Sequence Number=SeqID_181413
atggaaccaaaatactgggataagaatcctttcaaggccaccgccaaaaaattttctgcaccttttgaccctgcaggatataattattgggattacattgacgcctggaccaatgtattctggcatcaaaatagtaaattcaagcattcatggctgatttacttcaaaaataacaccgtgtacaattttccaaattggttcctccaatggtggaactacttcggaccaataccacagatatttccagaagaagtccaacagggattccaacagttcaacaaactcttcaatagcaaagaatcaagaattccagcagatttgaagtacttttccagctttgctttgtcatggattttttcatggcaatacaaatatggaaaaactgaaaattgcaagcagtatccgccattacaaagacatgcctttgtaaaatggtggtcacaattcgatacctcaaaggctgctccagatcaggtcaagaattggtttcagagcaaccctgagtttctcaaacctgctgatccagagacatccttatttctgaatcagaagtctcaacttgcagcattcttggcaagctcaaaatctaaagagagtcttgcccagaatctcaaggaagttctccaactacttcaacaagaagaagatgaagaacccccaaaaaaggaggccgaatcatcagaaaataatgatgaccaagatgatgatccattctaccagaatgaggacgactgttttggtatatcattagatgatgattag

SEQ ID NO: 89729 - DNA, 717 bp, Glycine max
  Peptide Sequence Number=SeqID_181414
atgggtgaagcagagaaggtgcaagagaagatgaaggccgacatggaggccattaaagagaaaatggccacaatgatggaggccatgatgagcgtgaagaagataatggaagccaatgcggttgcaattgccgctaccagcgttgttgctaaggcaaagatttgggaagtacgggcagcccccataatgtacaaattcaaaacgagcacgccttctcgccatatggcttgcctctcaactatacgccacccaaagtggcgtacactcccaataagaatgtcaataactccactcctatacccattgagagccaacaaccccaaactgatcatgcacatgtctcttaaaccgtggggggggacacatgaaattccccaccacaatctagccgacttcgagccttgcctcggatatcccacggaagggcaagcagttggtggtataccctttgaaaacactttggagggccctcagtttcgcccacaaccacaaccattgcattttgcggtgggaagagcccctcctgctatggccgaaaagggaaaggcggatcatctagaggaaaggctcagggccattgaaggaggtgaagattattcctttgctaacctagaagagttgttcctagtacccaatatcatcacccctcccaagttcaaggtgctggactttgacaagtacaaggggactacttgtccccaagaaccatctaaagat

SEQ ID NO: 89730 - DNA, 321 bp, Glycine max
  Peptide Sequence Number=SeqID_181415
atgacagaaactgtttgtacggataaccgcttgggtatctccatacgtcacctgacttcatgggtcagcatgacagaaaccgtttgtacggataaccgcctgggtatctccgaacatcacctgacttcacgggtcaggatgatagaaagcacggaagacgatgtaaatctctgcatgtcaacaggtgcggataaccgtaaggtgtccccgcatgctaccggactcttgggtcatgatagcaaaaggtggggtggtcaacaaaaccgaggctcttgctcctacgcatcctccattcgtgatgaggaacttagacctacatag

SEQ ID NO: 89731 - DNA, 237 bp, Glycine max
  Peptide Sequence Number=SeqID_181416
ggaactgtgctgagtttgtcgagaccacccggttgtgcacgtaacagcccccctcctataggtgatcagcctgggagcccaaaggtgttccctaccagtgcctcccacgatcatacacaacatccaacgtatgaacgtggccaaaaagctagtgccaaagaccctgaaagcatgcaacagggacaggcagatatcctcatagctaggttccctgaccctaactatggtgttaaaacg

SEQ ID NO: 89732 - DNA, 783 bp, Glycine max
  Peptide Sequence Number=SeqID_181417
atgggtgaaatagatgaggtgcaagaacggatgaaggctgacatggaggccatgaaagagcaaatggccacaatgatggaagctatgacgagcttgaagaagataatagaggtcaatgcggctggagttgccgctaccagcgctattgtagaggtgaacccaactcccccatctggcctcaaccaaataaattatcccgtctcggataaggtagggcagagaggcaaagaattgagaagtacgggcgacccccattttgtgcaagttcaaaacaagcatgccttcctgccatatggcttgcctcccaactatacaccacccaatgtggggcacactcctgatgagaatgtcaataactccactcccacacccattgagagccaacaaccccaagctgatcatgcacatgtctctcaacccatggggaagacatatgaaataccccaccacaatctagccgacttcgaggctcgtctcggatacgcccttgaggggcaagtagttggtggtgtacccctgccaaacactttggaaggccctcagtttcgcccacaaccacaacccttgcatgttgcagcgggaagaatccctcctgctatggcagagaatggaaagtttgatcatatagaggaaaggctcaaggccgttgaaggaggcagagattatgctttcactgacatggcagaattatgcctagtgcctgacatcgtcattcttccgaagttcaaggtgtcggacttcgataaatacaaggggacaactggccccaagaatcacctaaag

SEQ ID NO: 89733 - DNA, 99 bp, Glycine max
  Peptide Sequence Number=SeqID_181418
atgtttgcattcaagagtgctttgaaaggacttgacgatactccacaacctaaatccaaggctggtgctaggtggattattgttaaaactaatttgtag

SEQ ID NO: 89734 - DNA, 408 bp, Glycine max
  Peptide Sequence Number=SeqID_181419
atggatatctgtgaagataatgacattcctataatattgggaaggctattcctgctaactgcgagttgcatagttgatatgaggagaaagaagctggagctgggctttgaagataagaaaattgattttgatttatttgtcgaagacaagcctactccagaacaaaatgtttgcttacaagtaatggaagtgggtaaggagattctggaactaagaaccaaaattcctttcgctaagcgcaagcctcgcgctaagcgcatcttttgtcatgcgctaagcggagagtctctagcgcttagcgctcaaccattgtatctcaagctgatttggtccgctaagctggccaaggctaagctaagcccatttctattcgatctgaatttggctaagcgatggccttcttgctaa

SEQ ID NO: 89735 - DNA, 594 bp, Glycine max
  Peptide Sequence Number=SeqID_181420
atgcctacgacacgtttgactgaagatgcgagaaaagtagtgcaaggattgtttgctgcacacccgccttttatgtgtggctggtctcgcacctctttcgccatgaaagtagacccgtctatccccttcaaggtcatcgcatgtgcgccgagaaagggaaggcaatttgggaacatctcttggctagtatggtgggggcatccattaattggttcccccaatggaaggaaggaagagttagggttctgtccttgtgcatggagcacggtgcaaagaaaggataaggaacttaggggaagcaacaatgggatcatcgttggatatcacaagtggttgaaggctcgaacgcaagagcttgattggctcttgaagctaaaggcctcaagtgaggaagaggctaaaaccccagaggagaatgaggaggtgcaagccttaaaggcggaacttgaaaaggcgcaagcagtcaaggaaaggttcaagatgacggccatcaaggtccggaaagaatgtgacgaactgagagacgtcaatgtggccacaaccgaggcattggaattggaaacaaagagggcccgaaaggaagaatggggttga

SEQ ID NO: 89736 - DNA, 219 bp, Glycine max
  Peptide Sequence Number=SeqID_181421
gtgttctcttgcctgcccgtggattcagcagcagttcgaaaggttgacctatatcgggaattccccggatctacgcttatgttcaactccccgaagcatttcgtcgcttactacgcccttcctcgtctctgggtgcctagttcacgagttggagataagcggactcgaaccgctgacatccgccacagggtaaaccaccgcctctcaggccccgactga

SEQ ID NO: 89737 - DNA, 389 bp, Glycine max
  Peptide Sequence Number=SeqID_181422
actctgaagaaacgatcaagaagattaaggtgaaagttaggggagtcaatagcttacctagggagttacgcatcattgtgaattttgatgaccaaggccaaacaattggtgaagcacaagccttgcttgcaggatttcttggaacactagcagctgattgcaaattatttcctatggattatgatagatggtctggaccttcaggcgtacctaaagcttattttgattattgctttgaaacaattttaaagcctcgattttattttaagattaatgaagctggtgcaaaacagtattgcaaattgagtatgggaagaaaatgggttgaaataggcaaagcttatggaatgaattcaacgatccaaccaaaacaagagatgaaatcataa

SEQ ID NO: 89738 - DNA, 1080 bp, Glycine max
  Peptide Sequence Number=SeqID_181423
atggatgccgtacgtcaggcggcggatgcggttgccgagattcgcgatggagagatagtacagtatggcaccgtcagtgcgctgctggcacagccggacagcgcgctcggccagcggctgctgccgctgacggcacaagtcagtgatgccggactggtgctgcagcttagctaccgtaccgatgtcgcggtggccagcgactggatttcgcgcatcagccagcagttcgctttaaaggtggatctgctgggccggacggttgcaggtgggcattcattttcagcaggagcaggtgccgctggcacggttgctgacgcagctggaacagtatggcctggcggccagcgttgctgtcagcgtgccgccgttacgggaggcggtatgagcgtatccgtgataagccaggacacgccctggcctgaaattccggcactgatgttgccggcgctgggtgaaaccgcgttgatggtcggcatcgtgatgctgtttgtggtgagcctcggtggcgtggttggcgtggtgctgtttaacacctcgccgcgcggactgtttccgcagcgcggtgtgcatcgggtgctgagctggatcgtcaatatggggcgctcgttaccgtttctggtgctgatggcggccatcattccgtttaccttctggctcaccggcaccaccatcggcattccggcggcggtggtaccgatgatcgccgccgggattcctttctttggccgtctggtcgacaacgcattacgcgagctgcccggagaagttaccgccgtggggctggtgtgcggcggttcgcgctggcagatcatccgctccgcccagctgagtgaagcgctgccggcgattgttgcagccatcacgctcaacctgatctccatgattgagtactcggccatcgccggcaccattggcgctggcggcattggctacctggcggtggtgtatggctatcagcggttcgataaccacatcatgatcgccaccatcgtggtgttgattgcactgattcagaccattcaatttttcggcgaccggctggttgcggccttgcgccatcctcaggggacatcgttatga

SEQ ID NO: 89739 - DNA, 222 bp, Glycine max
  Peptide Sequence Number=SeqID_181424
atgactcgcgtgaggggaccaaagcttttgatgctccgccagccactccgtaaggacgacgacctattggtagtgaccctagcctctttttgtgtccgtccccaagtatctgaaagtaggaaacaacgaggtgtggcaaatctcgaccgcgtcgtctgtcttaccttgattggtttctactgctttaactttgtctccaccccagaaggtagctcgagatga

SEQ ID NO: 89740 - DNA, 717 bp, Glycine max
  Peptide Sequence Number=SeqID_181425
gaattacatggcgaccgcgcctattcggatgatccggcgagtgttggcgggattgcgcgtttcaagggcattccagtcatggttatgggccaccagaaaggccgtgacatcaaggagcgtcaataccgtaatttcggcatgccacgtccagagggctatcgcaaagccttgcgcctgttccgcctggctgaaaaatttcatatgcccatcattacctttatcgatacgcctggagcttatccaggtatcggtgcggaagagcgtggccagtcagaggccattgcgcgtaacttgtatgtgatggctgagctgaaaaccccgattatcggcgtggtaatcggtgagggtggttcaggtggtgcattggcattgggtgtcgttgatcacttgaatatgctgcagtattcgacgtattctgtcatttctccagaaggctgtgcctctattttatggaagagcgccagcaaggccccggatgctgcagagacactaggcatcacggcggatcgcctgaagtctttagggttggtggataccattgtcagtgagccattgggcggtgcgcatcgcaattatgaagaagtgatggagcgcattggccaggcgattggccagcaactcaaaacattacaagccaagaagttgccgcaactgcttgaatcacgctaccagcgactgatgagttacggtaagttcaaagcaagcagtgaaaaataa

SEQ ID NO: 89741 - DNA, 411 bp, Glycine max
  misc_feature (11)..(11): n is a, c, g, or t
  Peptide Sequence Number=SeqID_181426
atggcacctcnctctgacctcgttctcctttgtctttcactgcatctccatggtggaaaatcaccattaaaggacctcattgaagctcaaatatccagcctccatagaagccccacaagaaagcttccaccaattcttgaggaagacactcatttttctgattcttcatcacctgattcaccatcatcaagggaatctgtgacctatttgcttgaagtcatttccatggcagatgagcaccaacaaagggttacccttgaggactattcaagcagttcaatacaacaattctttactagcattgcacgtcctgaagtgtaccagatgaagccattagactcagtctattttcattttccttggcaagagaagccaaaaggtggctccactcatttaagggtaacagtctga

SEQ ID NO: 89742 - DNA, 546 bp, Glycine max
  Peptide Sequence Number=SeqID_181427
atgtatttgaacctattacgtgatttgaacaacacaaaaaaatgtagttggggttcggcttgtttagcaaacctgtatagagaactatgtcgagcatcatcggagtcatgggcttggtaccacatgccttttattgcactaagagtcccacgacccgaaacaactttttcactggctaaaagatggagtggtggtagattagaatatagggccacacctcatggtgacttggtcggatataagtctcataaagatcatatggagagccatgaggaaaacactactttgttcttgtatgttgcacaacaactacatgatccacgcacaacaattacccataatgttgcagggtcaggtgttgaacaaacacattttgaaattccacatcctcagtcaaagtattctactccttcagctgttcatcaaacttttggccacactggtgagtcagtcaccgcaaccacccaagaatggatgaccgatttatttggcgtcgatttcaatacaccaaattcactggcatcatatttagctactttacaatag

SEQ ID NO: 89743 - DNA, 498 bp, Glycine max
  Peptide Sequence Number=SeqID_181428
atgaggaaatgggcccttgcagctgatcaggacgatgtggaggacactgtctgtgagaaatacggcattagcaaggaaaaatgggcccagttttgccagactcgcagagacccttcttgggaggatgtgcgcaaaaagtcacaggccatccagaagcagaacactgccccccaagttttatctcgtgggggttatgactatttggagcagaagctcctagctgagaagaccaagaagaagctggaggaagctgcacagtcaggaagtgttgatggcgtcattgaccctccatccccagattcctttgaggatcaggcaacacagggatccttagtcccccatggacgtcaggatgttctcgctgctgctattcgacgtccagagcaccctggacgtgtccgtgctgctggagctggcgtgaccattaagaaatactttggatcggctccacggacgtcccacggctcttcctccctgcctcctgaagaattgcagtag

SEQ ID NO: 89744 - DNA, 177 bp, Glycine max
  Peptide Sequence Number=SeqID_181429
atggagtcgccaactttcgcaacctacccttcggcgagagggcgatgcggggctcacaggtgcgtcttccaagaaaggaaaatgcgcgaagtcgccaccaacgtttatttgaggaaaacgtcagaaaaaccggaaaagggtgtttccctcgctcctacgtatcctcaattgcgatga

SEQ ID NO: 89745 - DNA, 564 bp, Glycine max
  Peptide Sequence Number=SeqID_181430
atgaacccgtcacgcgctaatcatcaatatcaacgcggagctatcggacttgttggagtaatgctgttattaagcgcagtgcttttaactgctttggtgctagacagcggtcgtctttggatgcagaaaaaacagctgcagtccattgccgatctagctgctatcagcgcctctcgtcatctgggatgtagcgccgatctttcaaacgtgacccaaatggcgcaactggctgctgccaataatggcttcgacggacaactttctgaaagccctaacctagtcttgctggggcgactacaaacggtacaaggcatacggcaatttactgcagatggcagtcatggcgctgtgtttgtaagggcgaccagagaggtaccaagtagcctggcggctggcggtttatttggcggaaccatcattttgcgcgctgaagccgtctcagcatccgacccaccactcgcggcattcagtgcagggagctttacggccagcctcagcagcgaacaatccacattattaaatggtctgttaagtggcatgctgggcgcaccactcaacctggat

SEQ ID NO: 89746 - DNA, 624 bp, Glycine max
  Peptide Sequence Number=SeqID_181431
atgctggaaagttttaaacaagaccaaatgtcagttctggaattgtacatagaaaaggatgtggctggtggttcaatgtttcattctgccaattcgcttacatcatgtggaaattatttatctaatgatgagacacaaccggcaacaaatatgagcaatttacatattgacgaagacgatgatgatgatgatgatgatgatgattatcttgtgtctaactcatacattgaagagtctttagacgaagatgacagtgttgacggtatatctgatacagacgatgaagtcaccaacattcctcaaccagtaagaattgttcacccagcaaaaggtgcacaacgaattgaaaatccattttggaataatgccttacattataacaatatcaactggagttatcctgatgaggaggacatttgcggtttggagatgccgtcgacctttaatgttggccaagaattatatgttggcatggaatttgatagtaaagatgcggtcaaaaatgcagtcaaacaatatgttatgaaggtgcatcaaagtttcaaagttgttgaaagcaaaacgaacaagtatgtggtttgttgcttgaataaaaatgcagagtgtcctgcccactctatatga

SEQ ID NO: 89747 - DNA, 975 bp, Glycine max
  Peptide Sequence Number=SeqID_181432
atggatgtactccaggccatgaatactggacatgacggatgcatgagtacggtacatgcaaatagcccggaagatgccatgctgcgctttgaaatgttggcaggattagccaagtttcagggcacagaaagtacgttacgcaaaatgattgctgcagccattgagcttgtcgtacaaattgcccgtacaactaacggtcaacgcaaagtcgtttcgattactgagattgtcggcatacgcgacggtcactttgtgctgaatgaactctatgcctatgacacaaatacaggctacttctcccaccctggcgaggtcgctatgagtgtcttagctgtgtccttcattgtgggagctatcgcattattgctgctggctatctggatgctgaaacatagcaaagaggcccgcttccgtgagcgcatgatgcataatttccgggaggtattgccttatggcacgacggtttcgggaatggcgccaggtacaccgccacctttttggcatgtgttgaaaattcgcgcctctatctatgccggatttgagttacgaaagaaacatgctgttgtcatcccgttggcctttatttctgtgggactgctcggatggcttacatatggtttactaggggccgcactgacattttttataacggtttttgtgttcggctttttgctgccctacaaccgtttgcgccgccgccaggcacaaatcattgcccagattcctctttttattgatcaggtactacgtagcctgagtaccggacgtagcctggaaagcgctatccgctttggtgcaggcgaagcgcctccgccactgcgctatgtactggatcgtgtgattcgcgcagctgatctaggcgcagatatggtagagagcctggcggaagcggcaaagctacatgacttgcgtgaactaaacctgattgccttgtccatgcgtatcagcaataactatggtagcagccccgcgtga

SEQ ID NO: 89748 - DNA, 2871 bp, Glycine max
  Peptide Sequence Number=SeqID_181433
atggctagaaagcagaacaatgaaaacgccttgactatcacttgctgccatctgctggtgcagcagttggaattcgtattggccgagcagcaaatgataagtgctgttgcttcttcctctagctcttcttctatgttgtctcctaaaaaatatgacgtttttctaagctttcgaggtgaagacacacgcaggaacttcactagccatctctatgaagctttgaagcaaaagaaagttgaaacctatatagatgaacatcttgaaaagggagatgaaatctcaccagcactcattaaagccattgaagattctcatgtatctattgtggtcttctcaaagaactacgcttcctcaaagtggtgcttggttgaactcatcaagattctggattgcaagaaagaccgaggacagattgtaatacctgtgttttacgagatagatccatcagatgtgagaaagcaaactgggagctacgaacaagcctttgcaaaacatgagggggaacccagctgcaacaaatggaaaactgctctcactgaagcagccaacttggctgggtgggactctcgaacttataggactgatcctgaattacttaaggacattgttgcagatgttttgcaaaaattgcctcctagataccaaaatcaacgtaaaggactagttggaattgaggaacattgtaaacatattgaatcattacttaaaattgggccgacagaagttagaacccttggtatatggggtatgggtgggataggcagttccttcctctcaaacgtaaatgaaaaatcagacaagcttgaaaatcactgttttggtaattctgatatgagtacgcttcgaggtaaaaaagctctcattgtcttggacgatgtggctacctcggaacatctagaaaaattaaaagtagattatgatttcttggaaccaggaagtagagtcattgttacaactagaaatagggaaatacttggccccaatgacgaaatttatcaagtcaaggaattgagttctcatcactctgttcagcttttttgtttgactgtttttggagaaaaacaacctaaagaggggtatgaagacctatcagaaagagtactttcctattgcaaaggtattcctttggctttaaaagttatgggtgcaagtcttcgtcgaaaaagtaaagaggcatgggagagtgaattgagaaaactccaaaagatttcgagtatggaaattcatacagtattaaaattaagttatgatggcttagatcattctcagaaggacatatttttggacattgcatgcttctttaaaggacgagaaagagattgggtaacaagagtattggatgcttttgatttctttgcagcatctgggatagaagtccttttagataaagctcttataactatttcagaaggcaatcacatagaaatgcatgacttgatacaggaaatgggttgggaaattgttcgtcaagaatgtatcaaagaccctggaagacaaagccgattgtggagacaagaggaagtgcaaaatatattgaaatataacagggcaagtggaaaatgcaatttcttttatttgataaagggaactgatgttgttgaaggcataattttatctttgcggaaattaactgaagctctacgtttgagctttgatttccttgcaaagatgactaacctgagatttcttcaattctatgatggttgggatgattatggttctaaagtgcccgttcctactggttttgagtcattgcctgataaattgaggtaccttcattgggaaggattctgccttgagtctttgccacttaacttttgtgctgaacagcttgtggagctttacatgccttttagcaagcttaaaaagctttgggatggggttcagaatcttgtgaatttaaagataattggccttcagggctccaaagacttgattgaggtcccagacttatccaaggcagaaaaactggaaattgttaatctttctttttgtgtaagcttgcttcagctccatgtttattcaaaatctctccaaggacttaatgccaaaaactgttcatctctcaaggaattctcagtgacatcagaggaaataacagaattgaacttagctgacacagctatatgtgaattgccgccatcaatttggcaaaagaagaaactcgcttttcttgtcctaaacggctgtaaaaatcttaagttttttgggaacgaaattgttcacttactgtcttcaaaaaggttagacctatctcaaactaatattgagaggttgtctgcacttccaccatccctaaaatatttgatggccgagggctgcacttctctggaaacaaacttcactcaacatttagtgttacaccacatgatacaaagccgcataccctacttacacaaacatcctagtaaccccgggtattataataaccatgaatgcttcttcttcccgggggaccgcatcaccaaagcgtgtgggttttgcacaggagatagttcaataactattccttatcttccaaaatctgacttgcacggtttcatttattgcatcattttttctgagggaatttacggaaagagaagcagcgtactttcatgttctatcaatcaagacggtatacagattacatggggcataaaagagtgtggggtcttcccagtatatgccagggcatcagggtttaaggtggttggtagtaatagcaaggaaacttttgaatgtgaatccattactcaaatctctaataatgagtcacagcccagacccagagcgatcagagttgaagctggagttagaggctctaataatgaaaatgaagaagacaggagcaacttcctgcagcaaaagagcatgaggacttcaccataa

SEQ ID NO: 89749 - DNA, 285 bp, Glycine max
  Peptide Sequence Number=SeqID_181434
atgagtgatgctggtggtgaggtggcaaatcaactagtacatatgcctttgattttgcctaaagttcctggccggttctactattattttggaaaaccattggaaacagaagggaggaaacaagaactgggagacgacagaccgaaatcaaagttatatttacaagtgaaatctgaggttgagagatgtattgcatatttaaaggtgaaaagaggtatagggcctcgactattataccaggctacacatggttttgagtctgaagttccaacatttgaaatttga

SEQ ID NO: 89750 - DNA, 453 bp, Glycine max
  Peptide Sequence Number=SeqID_181435
atgaaactagcacaagaaatccagaaaacactcaaggagcttactttcgtagatggtccgaatccggagctggcgcttgatggcagaaatcaaggggggacgctggaaggtggcgccggtgagggtttcgagggcatgggctaccttggagacatcagggacgatgacgaggtgtcacagtggcgagctgtcacggtggctgcaaagggaaatagagtcacgaagacgaagcttagacagagaagaagagagattttgaatagacatggcaagaaaacctgtacccatgggtacccgcccgaatccgtcccgactttgacgggtaatatccgagttgaccgggtatgggtacgggttcgggttttccccgataaccaaaagtcgggtacgggtacgggtatgggattactagactcgtctcgaccccgaacccgaacccgccccgccacttaa

SEQ ID NO: 89751 - DNA, 537 bp, Glycine max
  Peptide Sequence Number=SeqID_181436
atgtcatgtaatgcaagagatgagcttcgatttgtgtttaccattttcgaaaatgcaggaagagcagtgagcataagtgacttcaaagatatatttgatgtagatcatttcattacctccttgagagacgaggttcgaataataaagatactgccacctaaggtcaagaaaagagttgaactaggattattatactcaatgccacccattagctggtctaatatctcatactatgaaaatcaggtccttcctctattgctgaaacacaaggtcatacagctaaatagaacagatgctagacttgcaaataatggattacctggtgagattcaaaagctacgatgccgagtaaacttcaatgctctgaggtttactactcagatagaagaacttggcagaatgatagtcaaggttttgagggaaaagcggcctttccttgcacttcatcttagatatgagatggacatgttggccttctctggctgtgctcatgattgttacagcaaagaggaggaggaactcacaagaatgaggtaa

SEQ ID NO: 89752 - DNA, 417 bp, Glycine max
  Peptide Sequence Number=SeqID_181437
atgggttgggtagccatcgattatctgaacaagcttctcctaatcggcgactcttccgttggaaaatcctgcttgcttctcagatttgttgaaatcagaaccgtggacatggaagggaaaaccgtcaagctgcagattgtgagtattctcaggaagtccgagattccgtccatgtctcacttgagactctcaatgaacgaaagtagcaagccttcatttaaatggcgaagggttttgctcaaagttagcggagaagcacttgctggaaaccactctcagaacattgaccctaagtgggatggagctggacaggagcgattcaggactataacaagcagttattatagaggaggggatgccaaagataccagtagatcatcaaagaaaaattcaattgaagaagagattgaaacttaa

SEQ ID NO: 89753 - DNA, 651 bp, Glycine max
  Peptide Sequence Number=SeqID_181438
atggaatacaaagatctagcaatgattctattagcctttcttcctccctcctatgagaattttgtgggttctcttagtgtaggtaaggactccattataattgaagaagtcaagtccaacatttattctagagagcttcaactaaagaagaagtctagtgttaacattctcataggtgatgatgttccttgtaagtttgtcggtataggttttgtacaaatcaaaatgcatgatgatgtttttagaaccttgagtgaagttcgtctcactctagagcttcagaaaaatcttgtaatatgggtgccaaagattcgaaaggcaattagcataacatgttatcttgtaaatccttcaacatccactgtcatagacttcaagaaccttattgaggtaagcaagagcctagagccaagaaaggattctttatgggctatagatggagtcaaaggatttcaagtttggtttccatttgaaagaaaggtcattctgagtagagatgttgtctttgaaaaactctttatgctacattataaacctgatgaagatttaggcaaggttaaggatgtcactaagcaggtggagtttgagagtttcaaaatcagaaatgttagtgatcagaagcaatttgaagcacctgatgagactggtcgg

SEQ ID NO: 89754 - DNA, 876 bp, Glycine max
  Peptide Sequence Number=SeqID_181439
atgaccagacagttagggagttacattataacgcttgtaatcgattacaatgaaacttcaccaaatggcagaatcatcaaagaggcgcaagggctcattatcctccaccaccaccaccatagtccttccggtgaccttccaacaccacccaatccatatctttcctcaccgcgctttctcactctgttttccactgatgttcagcatgggggagtaatattttctaaagtaaacaaaataccagtttttgttgatcaatcgttgttttactccctaaccaagctaagcagtcaaggcgtgccttttgaaggaactttagttgatgattggaaaccaatttattctagtcttgatgctcgtaaaatgatttgtggttcaaatgttgatatatctggtcgcttacttgttggatcctttatttttgaatgtcgtatcatgcattacattctctatcgtgtgttgcttcctcattctactaaccttgctcaagccactgaggaagacttaattttgatgtgggcattgcaaactggacgccaaattgactgggcacatcttgttcgtaactgtatgcacaaggcattacgtgcaaatgcccctctaccatatccccatctggttactctatttttgaagcacttcaaagtcccttttactaatgaaccatctatcaaggattaccaggcaaatgctctcgatgaacgcactccatctccaccacctagggatccctcctctgctttactgaatgatgttctcaacgagattcgagatcttcatgcttttgttggcgataggtttgattccatggattcttgcatcactcttcttgaggatgagatggaatttatccgccgttgcttgatccccaactaa

SEQ ID NO: 89755 - DNA, 303 bp, Glycine max
  Peptide Sequence Number=SeqID_181440
atggttatccgcacctttcgtcaaccaggggcaaacgagctcgttgacgggaagagactaacgttgtcttctgcaccttttgtcatccagggacagcgagtcaggtggctggcggagataccttatggtcgtctgcacctttcgtcaaccaaggcgaacgagttcgacggtttttactcttgtcgtccagagacattcgagcccgcgacgcacgagattcttctctactgggcggggacgattaagttcgatagagtgtggaaacgtcgtggttatcccattttatcgctttcaagacactga

SEQ ID NO: 89756 - DNA, 711 bp, Glycine max
  Peptide Sequence Number=SeqID_181441
atgaatggaaaacaggcttgcgagtggacaagccttagaacgcatgataaggaaataacgattaatatccaggagaggatgttaagggaagggaagactatggattttaacactatgtttaagaagtgtctggacatggccaaaatttcaattaaatttgcgtcatgggagcctatcaacatagtttttaaggtgaagatcaatgataggatccatgatatttgtgtcgtggaagaggattctgtgccagtgttttatggagaagttgaggctagaaagtcagtatcttcgtcttcgtcgaagatgtcgaagtggcctaagaaagggtggtcagagtggcaagaattttttgatgaggaaaattgtgttttcaatgtgaaaaataatgaagaatcgaggattgaaattcaaaaagatttagatgaaaataaggggtggggcaaaaggagattgagaatggacaaaatgatatcatttgcaaaggagggtgtgtgggtctgggccttggagccttatgaggtggagggcttttgtgtggctaagactagtaatgatgagtctgaggccttcttggaggctttgggtagggactggtattggggtgatggtgttgtaatggagtctaggaggtctaaatttaagggcagttttaaaaatccaatgaatggtgagggtgaagagaatgatatacaagctctagaaacatcataa

SEQ ID NO: 89757 - DNA, 198 bp, Glycine max
  Peptide Sequence Number=SeqID_181442
atggttgagaagacaaagaaaaaactggaggaagctgctcaatcgggaagcactgaggccgtgattgaccctccatctcccatcagacgacatgtgaagtggaagatggaccgcaccaagaaaattggccagatgacgtctgaggcaacaaaggaaattactgagaagattgattcgttggaagagcaggcgtcatag

SEQ ID NO: 89758 - DNA, 231 bp, Glycine max
  Peptide Sequence Number=SeqID_181443
atggacttgctgcaaggaaattcagtagcaaacttttggcatgagagaaaaatgttgaaattggcaaagagaagaaatgacgagttgcaattcagggttaagagaggtgaggaggttccaacagatggtttgcttgcaagagatggcattcttgtgctggctgagcctgaggcaacaaaaagcaaacatgatcctaagaggaacccgtttattataccttatcaaaggtga

SEQ ID NO: 89759 - DNA, 732 bp, Glycine max
  Peptide Sequence Number=SeqID_181444
atgggaaatgccgcagtgactccatgctttcatccaaagaattcctcgtcatcgtcatcgtcgaaacttattttttgggatggcaccatgaggtgtctcaagggtaagcacattgctggtgagatcatgtatgagtttccagacaaggtagtttgccatgcagattctttcttcattggacacccaattcctgctttagctttagaggatgagctcattcaaggtgaagcttattttgttctccccattgatagcttcacatgcaaaaccctttctatttcttcactcttgtccttgggatcagaccctagcaagtccaccatcaaatttggggaatgcccttttgagtacttgaaaggttccaatggaagggtgttgataaaggtcatgcccgagttcatcacaaggctaatcaatagaagtaaaagaccttgttgccccagcagcaacgacaacaacaacttcctatgcagcactcctgagttgagaaaacactaccaaatgctagtgaaatccaaggaccaagtttggtcacctaagcttgaaaccatttcggaaaacaagcaaggtcttgatcaagcgttagaagatgaaaggccagcttctgtaaatgaaatcgagtggactaagatccaaaggagagaagtgagcacgattcggttagcccttgctctcgagataacacaacatgttgaaggagacaacaccgaaagccttgtgggagaagcttga

SEQ ID NO: 89760 - DNA, 360 bp, Glycine max
  Peptide Sequence Number=SeqID_181445
atggaagctttaacggaggcgctagacaccttcgacggcggcacgagtgagagagggcacaaagagaccctgagagggtgcgagctagtgagacaaagtgagacactgagaaagggcgcgagtatacaagccaaaacacttgaccttcaaagactattttcgaaaaccgtctttcaattagagagttcaacaacaattctccaaagaatcgtattctattttaggcttcaaagtcatttttttaaaaatcatcgttgtaattttactaatacttacaaaaataccaccaagttggtaacatcgatggttatggttaacatcggttttctacaaaaatcgatgttaacttccaaacgttaa

SEQ ID NO: 89761 - DNA, 858 bp, Glycine max
  Peptide Sequence Number=SeqID_181446
atggctcgcaccaaaaaaactggtcagatgacgtctgaggcaataaaggaaattgctaagaagattgactcattggaggagcaggcgtcacaggattcgtttgtccctcatggacgtcaggatgtcctaactgctgccattgggcgaccagaacaccccggtcgtgtgcgtgctattggagtcggtgtgaccatcaagcaatactttggattggctccacagactcagatgcagtcccagtttcagtcacagatgcaatcgcagggacttgcattgcctccggagcctgaggttggtccctcagttgctcgtgccagcacaaaggagagttgtgttgatcccttagggaacgatccatacacgggtgatttagacaaatgcgggttgtacatcgaagaaaatcctccccgcctggttgccctagaaagagtttatgagggatccacagccgttcacaacatccttttgttgcatgatcaagtgaaagtgaaggtcggtgttgaggaggttaaagatgcagatgctcctgttcctgtacccactgacgagtttaacttagtggggcagacacttaacaccttccttgcttggccgacacatctcatcaagcgtttatcagaacatggagttgtgggactagcaaaacctgcagataggtcggatcatgaggtcgatgatccccaatatctgatgacattgatcatcccagagctttttttgaagtcgttgcaggttatgtgggatgctaccgtgtttggggtgtttaatcaagactttcccttgtacataaagcatgaagatctgtctgaaataacacacggtggtcaatgtctcagcatctctgttatacagttatga

SEQ ID NO: 89762 - DNA, 234 bp, Glycine max
  Peptide Sequence Number=SeqID_181447
atggtgctcaaatttcatgacgatccaacggtgaacgagtccgagattgtcgtttttctgagacaggttaggtggcctacgggaaaaagaaagggttttggaagaagagaaaagaaacgaaatttttacgagaattgggatgttacactttatggtacaagtagagggtacatctacttgggtttgactgagaacaagagagggtacatctcttgtggatcagttctagtatag

SEQ ID NO: 89763 - DNA, 873 bp, Glycine max
  Peptide Sequence Number=SeqID_181448
atgacgacggggaagtctgatttggtgtcgatccgcgttccctacaagaacctccacgacgattcctccgcccccgaactcgaactcgtcgacgtccaccaccgcggcaaccaccgcaactcgccgccgccgaatcactctccctcgccgccgaacagcaacaacgctccgctgcttcatctcgttctcagttgcaccgtcgccgccggcgtccaattcggctgggccttgcagctctctctcttaacgccctacattcaggtccctctccctctccctctccgactgaataattttgactttttcgatattacggtttcgtcgttgaccagatccttctgtaatcggaaccggatactctacgtgtttatattcaactttccgattaactgtgtgcttagttattgcgttttggtgcagacgttgggaataggacatgcgttttcttcgtttatttggctctgtggccccattacaggtcttgtggttcaaccatgcgttggtatttggagtgataaatgcacttcaaggtttggcagaagacgaccattcattctggcaggatctcttatgatatgtctggctgtgatattaatcggattttctgcagacattggatatgtattaggtgatacacacgagcattgcagaacatttaaagggacccgaacaagggctgctcttgtatttattcttgggttctggatgctggaccttgctaacaacacagtgcaggggccagctcgagcacttttggctgatctgtctggtcctgatcaacgcaatgttgcaaatgctgtattttgctcgtggatggcagttgggaacatcctaggatattcttcaggtgctagtggaaagtggaacaagtga

SEQ ID NO: 89764 - DNA, 318 bp, Glycine max
  Peptide Sequence Number=SeqID_181449
atgtggtggagagaaagccaaatagtatcgtcctttctttcgagcagtgttaaccttgtctctactactggtacaaaaaaggcttgtgtagagtatgttgtgattgtgacttgtcttagaaaacacgatcaaaatttaaatgatgagatgtgtttcaaaaaggcgagtagtggtggcatcatggtggttaatgaagagcttagcatgaaggaccttagcttggtaggaaccatgactagagcaaggtttaggaagctacaagaggagcttaacaagaagatgaactcactctggagaaggaagagcaaggaaggttga

SEQ ID NO: 89765 - DNA, 381 bp, Glycine max
  Peptide Sequence Number=SeqID_181450
atggaggtctggaacacacatctttcacctgccatggggaagtgcaccatcacactcgaagatgttacactgcatctaggcattagggttgatggtcgtgctgtgactagacctagcttcttacattgggatgagttatgcggtgagttactaggcgaagtccctccagataatgcatcttggtaccgcatgccttttattgcaccaagagtccaacggctcgaaaaaacttacccactcgctataagatggagtggtggtaaattagaacataggggcacacctcatggtgacttggtcagttttcttgggtcctatatagaggatttgaagaacacctacaaagacatgcatatagagacagggacatttggtttgcat

SEQ ID NO: 89766 - DNA, 111 bp, Glycine max
  Peptide Sequence Number=SeqID_181451
atggttgtggagatggtagttgtggttgtggacacgatggttgtggagacgatagttgtggttatggagatggtggttgtgcacacctctgagatcgtcattgtcgtgtag

SEQ ID NO: 89767 - DNA, 237 bp, Glycine max
  Peptide Sequence Number=SeqID_181452
atggcaaaaatgcccttcagtattgtaagggatttgctagttgatgcccgcggaacatttcttccgcgagtgtcaacggaagaagaactgcggaagaatcatctttcgtggaactacgcggaagaacttcttctgccaaacattctctgtagaaataacgaacaaggcgtaaggaaaaggcaaggaggtcgccagaaaaggttctgctggcaagcgcaagggcgccttcgacgatga

SEQ ID NO: 89768 - DNA, 339 bp, Glycine max
  Peptide Sequence Number=SeqID_181453
atggttggagagggaacgaaaaacactcccacggtggacctttcttccgcggactccagcgaaagatggcagatatggctcttccgcgagagtccgcggaagaaccatcttccgcgagaagctaatggaacgtctttgacacacacggaagaagcttcttccgcggaaacgatcttccgcccgacctccaacggcacccagacacgcgcggaagaaacgaaccttccgcagaagaaggctcgtcttcaacctcgcgcaaccaaaaccatgaaaaagcaaaccagaccaaacatgtcttctaccctatggccatcaaaagcgattaaaggagaaaaatga

SEQ ID NO: 89769 - DNA, 654 bp, Glycine max
  Peptide Sequence Number=SeqID_181454
atggcgagacagcatgcatggggtatcgctagtttgactggcgatttgggcgtgacgtggaccgggtgtagccattaccactggcaaaatagccagtggtatatgatggatttggttataacaatcttgtatttcaatggaagagtatatgaagagactgatggtgtaatctttgaaggcagtaaaaaagcgattcagattaaacgtggaattagtttcaatgctttgaaaaaaattggagataaggcggaaccgccaagaaatgtaagcaatttacatggtgatgaagattatgatgatgatgatgatgattatcttgtgtctaactcataccttgaagagtctttagacgaagatgatagtgttgatggtatatctaatacagacgatgaagtcaccgacatgattcaaccagtaagaattgttcatccagtagaaggtgtagaacaaattcaaaatccattttggaatgatgttttgcattataacaatatcaactggagtcatcctgatcaggaggacatttgcgggttggagatgccatcgagttttaatgttggacaacaattatatgttggcatggattttgatagtaaagatgcggtacatgtttcgctttcatattatgctacttttgcgttatttgttatttaa

SEQ ID NO: 89770 - DNA, 97 bp, Glycine max
  Peptide Sequence Number=SeqID_181455
gtggtggagtgagagtgatgatggtgaaggtgttccttggtggtcatactggagcgctggtgttagtaacacaatagtgtccagctatgagaattga

SEQ ID NO: 89771 - DNA, 249 bp, Glycine max
  Peptide Sequence Number=SeqID_181456
atgggtggaaataaacgaaatagaaggcgggaaaaatggattaagggtttggcacatgaaagaaggctgagtgacaaagtaggaagtcaccgtccatggacaatcatggattcaaagctagaagtctggaatatgtttgtcgtaaattgcaagtggaaaagtcacaaatacagatggcaagatgttcaattttggttcgggatatgcatgaaaaatgtaagcaaaggcaaggaaaaaatcaccaaatga

SEQ ID NO: 89772 - DNA, 699 bp, Glycine max
  Peptide Sequence Number=SeqID_181457
atggttctctgttttatttttgttttggacctcactttccttgcaaatgatataccttctgctctctacttcacgggtgttggatacactcatcattcattgcctttgttacgggacaggaattttggcagctgcaacaaagtttatgcaaatacttatagcataagagtggcagaatctctagccttaagatggtgtgttgaagtcatattgaggttccagaataggaaggctaggtggaagaccaagcagttggagaaggactatgatcttctcaaaagacaatatgatgctatcaaggcagataatgatgcacttcaagctcagaaccaaaaacttcaaactgagatattggcactgaaaagcagagaaccaactgaatccatcaacctcaacaaagaaactgacggatccagcagcaatagaagtgagaacagctcagagatcaacttggatatctcaagaacaccagctattgacagttctctatccactcagcagagcaacaacaaaaccttctttccatcttctgctagaccaacaggagtggctcaacttttccaaaccacttcaaggccagagattcagtgccaaaagattgatcacatggtcaacgaagagagcttaagcaacatgttttgtggcattgatgatcaatctggcctttggccttggttggagcagcaacatttcaattga

SEQ ID NO: 89773 - DNA, 165 bp, Glycine max
  Peptide Sequence Number=SeqID_181458
atggactgctataaaacgaaagcaattcaagtttattatcaaatgctaccaggggttcccccaaacacttcagagaggagaaacgaagcttcaaatgttgcttatgttcatgggaataatgtgaaggtgcaagaaagtgaacctggacgcaacattggtccatag

SEQ ID NO: 89774 - DNA, 279 bp, Glycine max
  Peptide Sequence Number=SeqID_181459
atgaagacaaaagctcgcagcagaatcattgacaatatagtaagtgaaactgagcaagagactccataccaagatgatgagctagtagggcttcaagaagtgttggaagttgaccctgatgtcattaatgaatctcttgcggatgttgatggaggtggagaagagatagatgtagatttactcaaacaagtaaacttggttgaaccagacaaggatgaatgcatattaagtgataatgacattaagagtgattttgatgatacatatactgctttgtga

SEQ ID NO: 89775 - DNA, 285 bp, Glycine max
  Peptide Sequence Number=SeqID_181460
atggagaatcatgaccaccaaagtcaggatatgcgacaacagatgcaagaacaaaatgagcaaatgcagtgtatactgcaacacttgcatattcagcctatcatgtccgctcctagtccatcgactaccatagctgatggaattgaccaccatgttaatgatgctcaagttgattgtcctcatgacattttgattatggcattgacctgttggatatccctggagatggaaggagatttgtttaaaaatttcatgcgtccttggagaatgaaggggattgcttag

SEQ ID NO: 89776 - DNA, 2433 bp, Glycine max
  Peptide Sequence Number=SeqID_181461
atgggaacaccgctaaggtcccatccttcgcgttcaaatggtcaatcaaaggcgacatctaggaggagtagacagtccacacgtctaagacgactgactttaagagccttggatcagcccagaccaatagttaacatcgattcggcaacgggaagaggatcacacccacataaagataagttccacaattatctaagggtggtagctcgagaaaagattcctattgtacatagcaattggaaagatgttctggaatctctaaaagacctaatatgggatgaaattttgggtattaggaaaagggcacagaaaacacaaggtacctttgttcccaatggtcgtggtgacatactcagcattgccattgggcgattggagcatggaggttgtgtttgtgtagcggtaagtcaatactatggaaaggcatcacgtggctctagcagctcctccacatccatcagccaacaacagttggctgacacaattagaagccttaaggaagagtggaggaatgagattgtaggaaaccttgaggaagaaataaggaatgagatagatgaagaaaacaaacggtgtctagaaagaatgaaacaagagttgaaggaggccatcaaaatagagttttcccaaaggggatcgcagtacacacccctagttgaggcagatatacaagtattaggtgcacgtgtgagcacaaaggggagtaacgctgaaattgcagtcaagccatcagggaaagaagatggtgttcatgtgataccgagtatggggttgtatgtgcaagatgatgcggttagggtcaatgttgaaattttttttgatagtgacgctcaagtcccgttcccaacgtcagaaattcagtatgtcagtcaaaagaaattggctgaagctattgctcctgatgatcccttgcgtggcctgatcaagagcttgtatgatatttacgagaagcctgttgagttgttatgggatgggactaaatttgggattccaaatgttgatgcatcattattcttaacatatgctgatgtaaatgatataatagcaggtttatggatgagtggagttcaagcttgggtcatgactcaatgtatggatttcttgagcctcagtccatacacaatgcaaaggatagacgtgctgaatgtcaacattacattgaaacatgggttaaggaatcctaaagagagagtcatgttcaaagcggaggctatgagtgtggctaagcattggatgtggaacatagtaaccgggggattgaagaatgattggaccatgtggtttggtgatgggacgccattagacatcgagaccatgacaacaattcgcaagaaatggacagcatatttcataaaacttaaaaacatccaatgtcattgtcaagcagaggatttggatagttctaatgatagcccaattcgcatcaaccaacttaagtatgagtttgatttcacaacattggtattcaacaagaactcttcatgggctgtaattttaagacaattatttgagaataaatatacacaaaaaacgaagattattccccctaagcatttcagtgatttcgtacaacagaagcaattacaagagaggcttacttccctctgttctttgaatacacatcagacaattggtgctttcattgatctcaacaaagggctagctttctcaacaaaagagaggtatgcacagtatttgcatggcctgctgcctaccacaatcaacactcaacaacttcaggagaagaaactgatgaacaacatcagcctatatcaggttcccttgcaaaagtacgtggccatggtggaccttcaggtgtttgttgctgaaatgaattggtcatcatttttaggctactgcaatggaatgaacaaaaagcagtcaaattggcttctatacaaaggaggattaggagtaaaaggagataatagttgggagtcttggtgggacttagaacagacgactaggggattgccacctggactggttcctatttcagaaccttactttgatggtgagttgcctgaggtggagcttattgttgtagacacaagcaagtttgatgatgcaacgactccagaacctgaacatactaataaggaagacaagtctgaactttacaagccaaaagtttctacctggggtgtcattcgtagacctggcaatatttcaaaaacatttggtggtggaagagttatatgcccaggagaggttctagagagcaaagaagaaaaagttgttaaagaagcacgcacaaagcagctacttgctgcctacaacaacaaaactggattaaatgttgatccaaagctgaaatctgagtgcgaggagctaagcatatttagtgatattcaaatattacaaccattctttccttcttttattcatgcctttcctttttatgcacattgttgggtgttttttgtatcatag

SEQ ID NO: 89777 - DNA, 531 bp, Glycine max
  Peptide Sequence Number=SeqID_181462
atgaggacatataacatgatgtttgtctttacttctgctggtattaagttcgacaaatcaattaatcattcaagaggacttcctacaataagaattcaaggtcaaccatgtcacagaataggcagcatgttaccaatgcctgggaaagaacctaaatttgcacaagtgtatatctttgacacagaaaatgaagtgcaaaataggattaatgcaataagtccacataatcaaattcaagggcacattgtttcacaacttagtgagatgctggatgaatacgacgtgcatgcaaaaactttcaagatggcaagagatagattgcaagatggtcaagtggataatataaagttgaaattgattactaaccgtgaaaaagatggtcgtacatataatgtacctactgttccagaagttacaacgctaattgtaggcgattttgatgcaaattcaaaaagagatattattattgaaactcaacatggacaattacaaaagatccatgaattacattctagctatctagctttataa

SEQ ID NO: 89778 - DNA, 401 bp, Glycine max
  Peptide Sequence Number=SeqID_181463
ggacccgcaaggccagggctagagaatctgaaggtccatcttctgctgctccccagacatctactacaccagctcctactccttcagcactagtggcttggccaggagtccaaccttcttctcatggaggaggtgaggcctccacagctcaagagcctcagccagatccggagactagacctgttgctcagaaggatgatttagaggccactcccctagagtcatttgtaccagaaactgatccagaggcagatccaatgattgcggaggccagcccacaggcatcaccaatatctaaaccagtgctggagctgagcaccccgcatggatcaccagtaggcacgcctgtgctgcatttgacagatgatgaggccatggatcaagacacaccgcaagactag

SEQ ID NO: 89779 - DNA, 72 bp, Glycine max
  Peptide Sequence Number=SeqID_181464
atggcgacgacggcggctttgtcggcggtgggggtaagaagtcggtttggccaccctgacttccgtgcttga

SEQ ID NO: 89780 - DNA, 207 bp, Glycine max
  Peptide Sequence Number=SeqID_181465
atgtacgcacaaattggttctgacctcattgcttgccttctctgtttgctctcacaatttgatttgacccaactacgcaaagtgttgggtgatatgtgtagaattgatcctgcattgatcactgcattggttgaacgatggaggcctgaaacacacacctttcacctaccatggggagagtgcaccatcacactcgatgatgtttga

SEQ ID NO: 89781 - DNA, 147 bp, Glycine max
  Peptide Sequence Number=SeqID_181466
atgaaaaggtccaagacttgcttaaggccattgatgactagttcatcacttcaggaagaagaaagacttgtaatggagatgagtgagagtgcattgttgacaactgcttgtgggaagaataaagcagctaagtctcaagctaattag

SEQ ID NO: 89782 - DNA, 219 bp, Glycine max
  Peptide Sequence Number=SeqID_181467
atgcatggtcatgcaggcaaaccgccattgccattggcgagttcgctgcgtttggcccacgtggaactcgccacctctgttggcgattctggtgatgctttcctaaatcgccagtttgactggcggttttgctttgcaggtggtgcagtcagtcataggcacgttgatggacagtctttttcagagaaaggggagttgcaactcctcctggcgatttga

SEQ ID NO: 89783 - DNA, 1485 bp, Glycine max
  Peptide Sequence Number=SeqID_181468
atgggagaggttggagaaggaaacgataacttgaaactttcattggcaaagcttgtaaaggattcaactagcgatgaagaaagtgaacttgtttccctttctcttggaatttcatccacaggccaacatgagatgaagaaaaagaagaatagaaatgaaaagatgagagaaaatgaggatttgaaagatatacttgcacttggattagatatcagatttgactcttcagctataaaaaatctaagcactgaaagtagttgtgatggggaaaggaaggatgaggaactttcagagacatggccaccaagtaaagttgtcaagacaattatgagaactagagataaaagtgaagtttctcaacatgctgaactcaagaaggccagggtttgtatcagagcgagatgtgataccctaacgatgaatgatgggtgccaatggagaaaatatggacagaaaatggcaaaagggaatccgtgccctcgagcatactatcgatgcactgtttctccatcttgtcctgtgagaaaacaggttcaaagatgtgctgaagacatgtcaatcttgattaccacctatgaaggaactcacaaccacccacttcctacttcagccactaccatagcctacacaacttctgcagcagcttccatgcttcagtctccttcattgagctcacaactaggaccagccaattcagatacggtccctctcatcaattctagcgttgcttataaccttaatgccctaaacttcacatcatcaagctatgatcagcagttttcaaaatcatcacaacacttgtacttccacaactcatctatttcaacctctaattctcaccccacaatcactcttgacctcacctcacctcaaacttcacctcatgttggaaagttcaccccaggcttgtctttcataccaaaacattcatcaacaaatcttcatttttcctcaagtactttctctcctttgcaatcaagcatgctacagtcaccttggagtccttatggtgattgcttcaactatgagggattgatcacccaaaatagtaaccaaaatggtttccttactaagactggaaaacaaccatttcaggggcatctttatcaacccaattacattagcaaccgtgtcatttctcaacaacctttacctgattctgttgtagctgcaaccaaggcaatcacggctaccccaaaatttcaatctgcaatagcagctgcactcacagcatatgttggtaatggggttagagaaaatcatgttggggctgaaagtgcaggtttggacttaaatctaggtggagatatgccatacacaacgaagaaggcagattacacttctaatgcatcaaggtacaagagaatgtcatcttctgctcctactgctccaaaaagaaatttggtcatatctcaaccattacaagcatctaaaagctcctttggatcgtcgtctcttaaaagtaaccaattcatagaccaatag

SEQ ID NO: 89784 - DNA, 1134 bp, Glycine max
  Peptide Sequence Number=SeqID_181469
atgaagtgggttgcacgaagctacgcgcttagcacgcgacctcgcgctaagcgctcagggaaaccaagggacactcctcttggggcacttaacggccaaatggcctcctgcaaacgtcgagccgtgcccacacctggggaagcgtccaactgggactcttcccgtgtcacatccgagattgcttggcatagatatcaagataacattcagctccggaacatccttccagagaggaatgtagagcttggaccagggatgtttgatgagttccttcaggagctccagaggcgtagatgggaccaggttctgacccgacttccagagaagcggattgatgttgctttggtgaaggagttttattccaacctatatgatccagaggaccacagtccgaagttttgcagggttcaaggacaggtggttagattcaatgctgagacgattaatgatttccttgacaccccggtagtcctgacagatggagaggattacccagcatactctcagtacctccacacgcctccagatcatgacgccatcctctccgctctgtgtactccagggggacgatttgttctgaatgttgatggtgccccctggaagctgctgtggaaggatctgacaacactcgctcagacatggagtgtcctttcttattttaaccttgctccgacttctcacacttctgatattaatgttgacagggcccgactcatatatgcattgatcacaacactgtgtgagattcagggggttgtctctgataccctaatttttgagtcactcagtcctgtgatcaaccttgccttcattaagaagaactattggaaccccgccgatccatctatcacattcccagggacccgccgcactcgcaccagagcttcatcgtcggcatttgagcctcctcttccatcccagcctccttctcagccttcttcccagagaccgcgccctccacctgcatccacctcagcacccctggacatgcatggagaccagccctccactaacaagggggaagaaccttctggagccgccgctactgaggatcctgcagttgatgaagacctcatggctgacttggctggcgctgattggggcccatgggcagacttgggcggaggcagctga

SEQ ID NO: 89785 - DNA, 201 bp, Glycine max
  Peptide Sequence Number=SeqID_181470
gttcttaagttgttacctttaaaggagtgcaatcatctttttgcctctcctgctagggaaaaggagaagaggttaaggcgtatcacatcttctggaactccgacgattttaacggtgttgcatatttctatgtatgaggctaaatgtgcatatggatcttcacttggaagaccatggaagaggttcccttggattaactaa

SEQ ID NO: 89786 - DNA, 228 bp, Glycine max
  Peptide Sequence Number=SeqID_181471
atggtgaatgagtccaagatcgtcatttttctgagacaggtttggtgggctgcgggaaaaagaaagggttttgagaggagaaggagaaaaacgaaaatgagggaaagaaaaggcaccgtcagtgtgaaaaatgacctaacgctatttatagctaggagaaggcaattagctcaacttggttctgcaacaggagtctataaaacgcttatgaagtaccttgcagattaa

SEQ ID NO: 89787 - DNA, 375 bp, Glycine max
  Peptide Sequence Number=SeqID_181472
atggcaaaccagatcatggttaggaccagaggattaggtcgtgccttaggtcaggttactggcagaggtgtgggcagaggagatcgtgatgattccgatgatgctccgcagcgtcgacggcctactgcattcgcacggaggcagcgagtcgttgtgactgcggcgcacgatgagccagtcatccctgtgcaagatgttcaggatgacccgatggaggcaccagctgctgtagaggacattgtggcagacattcatgcggacacaggcgcagaggctactgaggatgagcatgagggatttctgggtggtccgagcgacccatccgtgttgaccctgtatgcggatcacgttgcttgcagcgtatggacgggagag

SEQ ID NO: 89788 - DNA, 669 bp, Glycine max
  Peptide Sequence Number=SeqID_181473
atgccaaactttaatttcgaaccgtgttgtgcccttgaaacccctctagttcacactgtaggtgaagcacctcgcgccgtgaagcaactcttgactgtctccgtcatagtgagctcgtgtcgtgacctgctccgcgaagaactattgttgtcatcaagcagtatctccctgaaacccgtttggctccacgtgttaggtcgtggtacagcccaaatctcgtgtgtttcatattgtccacatcatctattggatacgatttttgttgattgtgggtattcttctccaacccaatgggctatagttcatgatctaaacctctttatttcggagttttctttctttggatctttgtctaatgtgggagcaatggtgggagctatagcgagtggtcagatagctgaatgtatcgggcgcgaagggtcattgatgattgctgcgatccccaatataatagggtggcttgctatttcttttgccaaagattcctcatttttgtatatggggaggttgttggaaggttttggcgttgggattatctcttatgtggtgcttgtttatatagctgagattgcacctcaaaacttgagaggtggccttggatcagtgaaccagctctctattacaattggcattatgttggcttatctgttgggtctttttgtcaactag

SEQ ID NO: 89789 - DNA, 342 bp, Glycine max
  Peptide Sequence Number=SeqID_181474
atggcagaagaccgtccacagagggtaacgctagaggattactctagttctgttacccctcagtacttcaccagcatagctagaccagaagttcaagcgaccaatattacatactcacattctctcatccagctaattcaagggaatcttttccacggcctaccaaatgtagacccatatgcgcaccttgccacatacatcgagatctgcaacacggtaaagatagcgagagttccaaaagatgtcatccacctcaacctattctctttctccttggccggtgaactaaaaagatggcttcactcgttcaaggggaatagcctgcggacatgtgaagtgtaa

SEQ ID NO: 89790 - DNA, 1695 bp, Glycine max
  Peptide Sequence Number=SeqID_181475
atgtcaaagaatttaaaggctcaggatgaaagctctcagttttcaaaggtgcaatctccaaactcagcaaaatcaagtctttcctccaagagtcctgacagaacaaagattgcttcaattgacgatcagtatgcaattatggtgtcttgtcgatgcaattatacggcatcaagattattctttaagcaagcaaccagttggcaaccacgttcatcgagggatattataatctctgttgcatctgagatgtccggagagtctcctggaccttatgaaagaaattctcaacttcctgtgcaggttttaactcttcaagcttcaaatttgacatctgaagatctaacactgacagtgcttgctcctgcctcatttacttcacccccgtcagtggtttctctgagttcacccactagtccaatgagtccttttattggtttcaaagagtttttaggaaggataaatgttgaaagacatgttggtgccatccagggggggagctttacttctcttataaaagacaatgagaagcaaaatgatgatgtcagacctgagtcagtttcaatgaatgatgatgtcattgctagttctggcctaagttgtacacatctttggctgcagagtagagttccactcggatgtatcccgtctcaatccacagccaccattaagcttgagctacttccattgaccgatggcataattacactcgactctttgcaaattgatgtcatggaaaaagtggtaatcaagatgcaaaatgcacattatgttattgcacaggttctcatggatttacattatggtctaaacagagtgaaagcaatgaatcacctctcgattcatggcattaggcagttgcaattcagtgtgtttcaattgatcatcagtggaagcctttgtgccggtcgtaagagtggtggctccagcaagggtcgagatagtggcaaatttgtcaattttcagtgtcaattttgtcttaagtatgatcacactagaaatgtttgtcactttaggtctgacatgagttttcagtctcatggaacacttactttctttgacccagcaacactccaacccattccttactcctctggttctgtcagaacctctagtacttgggttaatcccaaatacaaatttggaactgctgctctagcatcaactcacccaaatgctatgcttaccaattccacttctcatggaaatggacatgctaactccacatggattccagattctggtgctagctttcatgggaccaataaagtctttcttcatggagttgttagtgctaatggtctttactcctttcataatctcacgcttcaagaccattcttctctattgttgtccacttcagcttcacctgttagctcaactacatacaattgcttgtctagtgtagatattgctgccaataaaattcctaatgtagtttctaatcttgtaatttcatctcctagcaatgtaaaactctatttgtttttcaaacctttaagtccatggttgaattacaacttaatactaaaaataaaagtgatgcaagctccattggagcttgtaggcctaggatcttcttcatcaatggattcctttgcttcttggaagataaaaggcagcggaatggagaaggaagagagagaggagacgccacttcaaggagaagatgagtctagaagaagctcaccaccatag

SEQ ID NO: 89791 - DNA, 588 bp, Glycine max
  Peptide Sequence Number=SeqID_181476
atggacttgaaggaaaattgtacttatgtcatgcacaattttaaagtgctaaaaaacaacggtcaatacagagtctgtgatcaccaatttaaattggtgtttattgaagttactgttgtaaggcagtgtgctctagacgacctcccttttagaaaatacaggtttgctgaatttggtgatgttgtggctaggcagtttgaacttggcctattggttgacgttatcggtgttgtggacgaggttgtctttcgtcatgtttcaggaaaaggtagaagggtagtctttaaactaaaggacttgagccagcaattgctatcttgcactttgtgggatgattattgcttgcaatttttaaagttcttagatgatcatgaaggtcatggcccgattacagttttattgacccatggtagaataaaggaagctcagggcttgcagagttgggcattgaggcccggtcagtgtttaaatcccatggttaaggcagttcatagctttcaggttctatccaattatcatcaaaggaatcattctttggaaaggctgaggcaaagactattgttgagattaacaccatccctgaagtaa

SEQ ID NO: 89792 - DNA, 846 bp, Glycine max
  Peptide Sequence Number=SeqID_181477
atggtggaggtttcgaatttcgacgcgcgtgaagaatttgaggcttcggagcgtgtgaattcggggtttagcaagggtttgggagggttattgggtgaatggaagggttcgggcacgagaacggtgatgtcacgcactgatacgatgacgacttcggatcttaatagaactggtcccgtggaaagagacattgagcaggatgaatctattttgatatggttctcagggaaagaagagaagcgccttaaactaactaatgtttctaggattatatctggacaacgcacggagatttcaatctgtttttcccctcctcctccacctatctctgccgcgctcgcgatcaggatgactactccggttactgccggtggtggcggttgtgatcctctgctaaatggtggccatgcgctgccgattcaaccttcatcggctaacacgaacttcaatcacatcattaccaagaagctcgatgctgtgaattatctcttctgggatcgtcttctccaattcattcagaatgtgcagattctggcgatgtctgcgacaattgctgatcgtgatgctggttgcgtaactgaagcttaccatgcctgggagcaacatgatcaattgttgccctcgttgcttcaatccgtcgtttctgcttcgatgctttgcaagcagctgcgtactgatcttcgccaaatctccttgaagaacacagacatcattattgatgagattgaaacagtgcttcttgcacatgaatctcgtaagaaaaatgttgcttctatcaacattgcctccatttctactgctccattgaatttcaattcagattctattcaagctaatcttgtgtaa

SEQ ID NO: 89793 - DNA, 177 bp, Glycine max
  Peptide Sequence Number=SeqID_181478
atgaatgaaggcaatgcagaacaaaaagcagaaatagagcatgacataaatacagagcaagaggcaagtgaagaagaaaaacacagaaggacaaaaagggaaattgtcaagccacgaaataaaacaatttccatttttccttatcttcttctggaggttctaggcctcgaatcctag

SEQ ID NO: 89794 - DNA, 342 bp, Glycine max
  Peptide Sequence Number=SeqID_181479
atgggggtagcagcattgagcgcagcggtgaaggtgaaggtaccggcgtcgagctttgcggtggtcggtggtggcaaacgaggtacgcagatggtgatggacaaagatgagtggatgtatgaaataatgtctgaacgagcggatatggattatgaaaatgcagaatcatgtggtgcgaatgaaccacatgttgattgttcggatgcgttcaagacttctcaagtgtttgagtgccgagatgatgttttgcggtgggctcgatccgtggctcatgaaaacggatttgtggcggtgattttaaggtcggacacaaacacaggtcgtagaggaaggactacgttt

SEQ ID NO: 89795 - DNA, 234 bp, Glycine max
  Peptide Sequence Number=SeqID_181480
atggaaaaactaaaagttagctatgagggtttgaaaggaaatgagaagggaattttccttgacatcacttgtttctttagaggctacgatttgaaagatgttagaacatgggaagagaaattgttaggcagtgatgagaatcctgaaattggccaaatacaggctaaaggcccaagtggagaagggcgaaggcccaagtggagaaggataaagcccccgagtggagaaggatga

SEQ ID NO: 89796 - DNA, 231 bp, Glycine max
  Peptide Sequence Number=SeqID_181481
atggcagcgaaatggagaaggaagagagagaggagacgccacttcaaggagaagatgagtctagaagaagctcaccaccataagaggccatggataagagcttggaggaagaaggagatgaatgaagggagagggagagaagagcacgaaattttgtgctctaaaagagctctgaaatctgaacccactaatcgaagatcaattccaagattctctactaagtgtgcttag

SEQ ID NO: 89797 - DNA, 462 bp, Glycine max
  Peptide Sequence Number=SeqID_181482
atgaaaatctttgatttggaattggaagaaatcacttacataagaactcacataaacatattcttgtgtgacatgtttgaccaaggacaattgcaaactgattttgatgaatcaaagtggtctaatattcccctgattttggataccattgatccccaagagtctggcttacctaacgaagaactcgattcctttattgaggatgaagatgacgttctatgcaatcaaccccaggaagatgatgaggaagaagatgaacttgtttcaccaataaaaaccgccccaccatactacataccaccacacatgcataattttaaagattctgaatacggccatagcttggattacgaagaagttgaacattcggggatcctccttgtggtagttgcacaagatgacaacaacaaaatcattccaatagcctttgtcgttgtcaagagtgaaacaacggaagaatga

SEQ ID NO: 89798 - DNA, 324 bp, Glycine max
  Peptide Sequence Number=SeqID_181483
atgcagtttgtagatcacttactacctgcgggtcagctttgtctaatgcctgggcagagggatgcaccagttgcagaccctaaggactacatacagccgcccagcccccaggttccagtggcatttgacccccctccacatgtggatgattacgagggatatgaggcgattgcacagaggttggagcgtgtgctcaaccttaggatagtcactgcagacatagagttatatgacattatgcaggattgcctgacgatcgcgagagggggacccagtgctgatgggactgtcagggctcatcagagacgccgcacggaccattga

SEQ ID NO: 89799 - DNA, 141 bp, Glycine max
  Peptide Sequence Number=SeqID_181484
atggaggcgaagaacaaagtgaagatcgaggattctacaacggagtctccaacttcggtccttgaagacgagattcttgaatggcttcggactcagaactggtgggattttggtaagatggatttcttcatgggaagctag

SEQ ID NO: 89800 - DNA, 387 bp, Glycine max
  Peptide Sequence Number=SeqID_181485
atgcaaaatttagtccttgaaagtgttaaaagtgcaacaaaaatatcctaccgtcaacttccgcctgtcaccgttaaaaagttgtctgcgtggcacagagggatgaatttgtcagtacaaatgttacctacgtggctgccaacatgggtgtcgcaacttacccttcggcgggagggtgagacgagactcgaggctcacccaggcgagctgttgcttcaacctgaagtaaccttgcttgcccaggcgagctcagtttgctcaagcgagctggttacttcacccctaaattatttgggggcccaggcgagcctttcacagggaagtaaagggcagaagacattgatagtctctgcaagacaaaagactctgatagtctttgaaatgtaa

SEQ ID NO: 89801 - DNA, 771 bp, Glycine max
  Peptide Sequence Number=SeqID_181486
atggcaagagtggctaaagtggtcaaaatctcggcacaagaccaagaagagtgggcatcattcattgacatcttagcactgttggtgtttgggactgtactctttccaaatgttgatgggttagtgaatctagcagcgattgacgcttttcttgcttatcatcacaacaaggaaagcctgatcattgttgtgttggccgacatatatgatacacttgacctgagatgtgagaagagcaacgcgaagattgtctgttgcatgcccgctctttatgtgtggttagtctcccatgttttttgtcatgaaggggcatctgttagttggttccctcgatggaaagaaggaggggtcaaaatgttgtgctcatatgaacggttcccaaatgtccccttgatgggaacaaggggctgtatcaattataatcccatgctttctataagacagttaggatatcctatgagaggtgcgccatcagaggaaactatcgcacctttcatcgcacgagggttcaatgaaggcaatgcaaaaatacttcaaaaaatccgaaaggcatggaatacagtggaacaaaaagataaggagcttaggggaagcaacaacggtgtcgtcggcggctatcataagtggttgaaggctaagacgcaagagataacttggctcccaaagctgaaaggtccaagtggggaagaagctgaagtccctgaggagagcgaggaagtgcaagccttgaaagtagagcttgaaaaacaagagtggttaaagaaagactaa

SEQ ID NO: 89802 - DNA, 588 bp, Glycine max
  Peptide Sequence Number=SeqID_181487
atgggtacaaaagaaaatcagttagcctatgatatagttgatcagttagcctatggttactgcatctatggctactgcataattagaagttccttggagagaacacctcaacctcagtcctcagtcatgtatgtggcagtcactggtctgtggtctaaaaacctgagtttagtccttccatatctaagtaatctcattccggagttggtttgtggaagttgtggtagctcgaaggagttggtttgttgtcattgtcgtgggctgtttggggtgctgactttgcattccgtttggggtgatcactcatgctcgcaaggtgtccttttcagtgaggagtcattgtctcacttgatttgctggtcagtgtgctttgtttttgttgcatttttcacttctaaaagacctagaaggtttatggggttcatgtatggggttgtgggtgtggtttgtcctgttgagccaggagctgcatccaacttggtatcaaattcatatgagatttgttgttgctcttctctgaatgttgtggctttacttaggcctgcaaaagaaaccaaggatgtttcaactcttcagcaggacaaatga

SEQ ID NO: 89803 - DNA, 690 bp, Glycine max
  Peptide Sequence Number=SeqID_181488
atggaggaggagaatgttgggaaatgcttgtgcaatggcttgaagcaaattgagggagaaaaacaaaagaaggtaaagcttgattatatgaagctttcaacatcagggttggggcagcagggacatgaaggagaggagaagaagtgtctgaattctgagctatggcatgcatgcacgggccccctagtgtccctaccaacttcagggactcgtgtggtttacttccctcagggtcatagtgagcaggttgctgccacaactaacagagaaattgatggacacattcccaattaccctagcttgccaccccagttgatttgccaacttcataatgtcacaatgcatgcagatgttgaaacggatgaagtatatgctcaaatgacattgcaaccattgactctggacatttacgatgtcgatgtgttcatgaaaagaatggaagaagtggtcagagtgttaaaggatcttccttctcatcttagagttgcagcaagaacgcatgaccttgttgactcaatggttgaaagacttaggactttaagtcgaaagtcagatggccaatttatagttatggatctgagggttgagatgttggataagaagggttgtcaaggaagggatagtgaaaaagaggagagttgcttcaatgcacaagaggttgcagtgttttttgaggaagattggttttga

SEQ ID NO: 89804 - DNA, 873 bp, Glycine max
  Peptide Sequence Number=SeqID_181489
atgtatggggtagagggtgtcacatggccaaccaaccttagcccaactgctatgaaacaacccccacctatgagagaaagagtagatcttatcaagaaaaaacttgttcgctttgaacatgagggtaggaaccgcttattgcctaagattttcttggacgagttagtgtttaaggacttgtgtaacccttggaaagatgctattaaggttaaacttctgggcaaaaacctaggctataacttgatgaaagagaaattgaagaagctttggaaattgaaatggggatttgacattatagatgtgcataatggattctacatatataagggtctttacattatatgtgttggatgtggctattatggccatttggagagaaactgtgttaagtgtacggcacaacatgaaagccctaacaagaaccgaccttctccatcaagtacaaaagaccctccaatgactagtccctctaagactaatgtgaagggacaagaagatgttaaggttattaatgttggtgataatgtgcatggagattggcttgttcttcctaggaggaaaaagccaaggaacaaaggtgttaatgaaaaggtctatgatcatatcaatccctttaaagtgatggggtcaattcatgctaggagtaaagatatacagaggaaaaatattaccattattgaggggaaagggtcaattcctatgaaatcccaacgtaaccctaatcccattgttgttgtgcaaaaaagaaggagatattgccacaacaacatgtcacgagctagcaaattgccaccaaccaaagttgaggccaaatctagtccccccaaatcacccaatagtcaattaagaaatgggaagggcatgcaatgttag

SEQ ID NO: 89805 - DNA, 852 bp, Glycine max
  Peptide Sequence Number=SeqID_181490
atggctcccggggcaaagttctgcttgcttttgaagataataggtcttcaaaaattggggttaggtttgataaatcaattccagatggcaatgatcttggaggcctttgtgaggatgatcgtaggttcttttgttctgatgaccttgaagcaacttgggcatcttttcccaaacaaagtgacaatacagctgcctcaggacgaggctttactttctgattggaagcaacaattagaacgtgatattgaaactatgaaagttcaatccaatattgtcagcgtttgcacaatagacagagcttcaatgctagatgaggccatagaatatttaaagcagctccagcttcaagtgcaaaatcctatccatctaagagtaattactcaccacaatgctctaatcaaggtcagttttgggcggcaaaatttggaattggatgacgacgatcttggtgttctacatgcgggtgggtacctcagtggtgtagttgactttcttgtaaaaaatgaaacctttcacgagctcggtgtcgtcgagcttcttcacaatcttgacatcgcggagatcaaccatgtcgggcttggtggcatccacgacgaagagagcggtgtcgacgacgaggggagcgaggagcatggagtattggatgatgaccttgctattgagggaagtgctggcagacttcacaagggagtcgcgatcagagagctcgacggggatggtcatggcggtgagaacatcgacaaccttgaaggtagctttgtggagggtgttggagacgatggtgtggtagatgtcgtgggagaggaggaggagacactactcagtggaaaatattctaagatagttttgtaa

SEQ ID NO: 89806 - DNA, 1551 bp, Glycine max
  Peptide Sequence Number=SeqID_181491
atggttactaccatatcatcctcaacaagccgcaacttccatcatcagttgcatactttcaactcagagaacaacatcaacaacaacctctttgatgccactttctctccatatttgaatggcaataatgaagggaccattattgtaggaaagcttggtgaaccaagccaaaagcttaaaccttttaagtcccctcttcaaaagctagaaaagaaagaagagaatggagaaataggtgtatttggtgctgaaaagtacttcaatgtggaagttgagaccccaagatctgtcaactgcataaccactccaaaataccttcaccatagagatgaacaaatggccatagcaactagaaagaacacacttccatatggaactccaagcattcgctctgaatcaacaacttgcaacagccaacatgcactacttcagagtggaatgatgatgaggaactcttcaaggagcaaaaaggagaacaagggtcatcaagccaaaagtgttcttgctggccttggcttcaaatgctcttgttctgataaagattctgttgatgcaggtgaaatcagtttcagcaaacctgccacatatggttcagttcatggaaaaactagaagaaagcttgtggatattgctgctctagatgctagccattcaatcaaaataagcaagcctaatgcagaactcttgaaaatcaacaatgtttacttccaaaagcaagagagtacttttgggaatagccaaaaattactctcattctcacccttgagttctgcctcaggaaaccaaaaccatcttgccaaaatgcaacaacatcaacaactagatgaagtggaagctgagaagccaagaaactcaatagaggtgtttggctccccaatactgaaaaacaagctcaagtcattgagctttgacagaaccaccacaaggtttgtgatggcctcatcaagagatggcactcctagactattggaggaaattgactcaaactacatcaatgatgctgcaagtgatgcaagttcagacttgtttgagattgagagcatcaaaagcaaaaccaatcctttccatgcaaggcaaacatcagatgttgctgcttcaagctgtgtgagccccacaaatggctatgcaccaagtgaggcaagcatagagtggagtgtggccactgccagtgctgcagtgatgtcagattgtgaagaacagatgtctgaggtaaccataagaagtccaataagaacaacaacatttgctaatggaaaagcaaaatccaccaaagaggttcagagaattaggcgccctagcatgctgttgggttgcaagagccacaaatctgttagagttgcaggtgatgcttacataacatatgagaatccaagttccacaccaaaacttcgtaacaggactaatagttcctcgatggtggcaaggtttccttcagagacaaaactgggaaattttggtgcaaaacatggacatcatcatgcttatgccacaccatcaccactgcagaactctcactcatcaccacatgcctcaaaacttctatacatttag

SEQ ID NO: 89807 - DNA, 357 bp, Glycine max
  Peptide Sequence Number=SeqID_181492
atggaactctcaaactctattgatgcaacaatcttcacagagagaggattgtctggtgcaggcttagtaattcgcagggagaatggaatttttatcgcagcaaaaaccatgaaggcacaaggaataatggagccaaaagaaactgaggcttgggcgagagcggaaccggcgacgccggcgccaacgacgatcacgtcagcgacgccggagaaaccaggaggcggatctgccgcggcattgcgacggagagaggttgtcgttcgtagaagtggcggcgatgcgttgggaagggagagtgaagaaactggaagcattgtggaggaacaagaccataacttatgccttgaactgaaatga

SEQ ID NO: 89808 - DNA, 2361 bp, Glycine max
  Peptide Sequence Number=SeqID_181493
aacctggacatgtcagggttgatgtggcgaatgtggggtcccagaccttccacatcggctttgaagggggctgttatagcctttgcagataattctcagcttgtagataatagttgggagcttacagataatgttagagataaacatttgcttatagataaaaggttagagataacttggttgttggggaacccgactgctaagagtcctggacaatacataagccccccaagctttgagctggctcgcgggcaaaagagattgtcaagtatcgaagaaaggttgtcccatgtcaagggagtctgtctgatgtctgaggtcaatgtagcttgtcaagcccctgagcctagacaagttttgtcgggctggttttgtcaagttgtcaatgatggacgtgtctttggcgtgtcaggtaaggggagcattgtggttcaaaattttagggagctacttcagctcctgctagttaccgaagaatctgtctcctctttaaatggagtggatgtactttcttcttccatcatgtcttcatttttgtctgattctaccatcggaatgagtggcaggtactctgggggctcgattgagcagcccataatgaattgggaggtcatcttgataggagattcctcatatgaggatatccgtcaaggtgcctccaacaacgagtcctccttttcagagagggtgagggtctcgcgttgtgctagtggggacacttctcgcccttgcagaagggtgtggccttccacttctaccaggggtgtgaggagaggtagcgactatagagatattagggcatctccctgcgtgcgatgtagccagagtgttgggtcgctgtcatccatcccaattgttgttggctatgagtgggtgagaaaagacattctaaaatacaagtcatgtctcaccttggcggtaagtgttgttgtgcttcaactccaggtgaagttggaaaaccttgaggactcctgtaagatggtcctcggtctcattttacccttgaccgttattcagtgtgctgtgttggagcacttgaatgtggccctttcccaactccacccaaacagttgggcgatggtgctggcctttgaaattttgtgctctttcttcaacatcctgcctagtgtgctagtcttcttgtttttcttccgattgaaactcaatggcaaaattggatgggtctccttgaatagcatgtccaggaagctgtttgcgtttgattcaaacatctttcaccgttttaaggatcatttctttaaggtcctagctcttgatgggggtcaacctgctggtgaggttgacccttttgctgttgttgctaaggtcacccctagtgctcgttcctctgttctggcaaagaggaataggggtgatggtgttgggccgtttggccgcaagaagtcgaaggcctctatgagccttcgtgccctaaggcaagctatagggttgatgcctagtgctggtcgcctttcgactgtgcaagatgtgcctctgaatccaccgcccatcaaggcttctattgttgctgtgactacttctgctccttcacctcctcctactattgttgttcaggaggttacccctactattgctgaagttactatgtcagccactcagtctgactctgctagggcaccgtcatccactagtgctcctacggtgctgcctatttcctcatcggctcagttgtacacctctagtgatgctgactcactgtggggtgcaacttataagccggagcagaagaccttgattggctttgtgtcaactttcgacaagagccttattaggtcagcaagggtgatgaatgctactgactctgccaaagtctttctccaaaggagtttggccattttggaggagaatggactatggtaccatgaggctatgcaaaatgtggtgtccttggaggcagaggtcgccaaatggagggctattactgatactctttggcgagtggagcaccctaaagtgggcaatgccagcattgcttttgttgaggttgtaaggtcgaatcaccaattgtctttcaaagttggtggtgtattggccaatgtggcggctgagagggacgagcttgccaaggtagttgttgatttagaggctcggcttaaggagtcgaagtccaggcttgaggagtccgagctacgagctgccaaggagagggaggccaacaaggagcttgaggatgagttacttctatacaagaagaatgtcgaccttgacttgggtctcttcgatcccttcaaggatgtgaaggatggtgtcctgcttgatgaggaagacattgttgcgaaggaggaggctggtaatgaaagacagggttctgcgaagcaaggcaatgatgcctatgtctag

SEQ ID NO: 89809 - DNA, 93 bp, Glycine max
  Peptide Sequence Number=SeqID_181494
atgatgtgcgagggaggttatacaatgatgcaaagttttgatttgcttgctaagtgcgagtcactcgctaagcgagcactcagtgacgtttaa

SEQ ID NO: 89810 - DNA, 258 bp, Glycine max
  Peptide Sequence Number=SeqID_181495
atgagtgatcaagccacaagcattgttttaaaggctcttggactcttcagcttccgaaggctcgctcagcgagcatgtctcgctgagcgagagcgcgctaagtgcgagaagagacaacatcctcattgggcaggatggctacgtgctgggcatgcagatctctggcttatcctcttccagggtttcccatccgctaagcgagttggatgcctcgctaagcaaatgcatctcgctgagtggatctacctcgctaaatga

SEQ ID NO: 89811 - DNA, 426 bp, Glycine max
  Peptide Sequence Number=SeqID_181496
atgggagagcattttggtgcagtgaaaacacgagcatctgcaacacagttcaactatgagagagaagtgcgcgagaagcttatctacagggagaggatgagaagtgcgccgtttgactttgacaaaggcatccttgaggttatcgaagatggagaagagcgagcggaggccattggtggtggtctcccagctaaggccacggatgaagagcttgcgctgggagacgtcgtggtccgcgacggtacgcacaacagcaaggacgttgaggtggcacaccaccgcatcctaaaggatgtcgaggagctggttgggagtgaagcccttgatgagcttgtaggcttcgaagggggagagcttgagaacgagaaagcttcaataaaaggaaaattaaaacacaacattaaaattcaacatcgatttttgtaa

SEQ ID NO: 89812 - DNA, 856 bp, Glycine max
  Peptide Sequence Number=SeqID_181497
atggtgatcacgtgggagttgctatgtgcacccagcattattgctggggcacccagtgaagtggcgaaactgcccttcagtaattcttctttcggaagaatacccacaaactacttccggaagaacgtcatccagaatgtttccggaagaaccttcttccggaagtttccggaaaaagcttcttccggaatttccattggtggtcccgtgaagtatttgaagatttggtggtcccgtgttccgtatttgaagttttgcatagcaggaggaaggtccgaaatgaccacttccggaagaccttcttccggaagtaacttaggcctattccggaagaagtgcttccggaaaacagatcttccggaagttactaagactcattccggaagaagtgcttccggaagtgtagtaaatttttggatgtggttatatgataatttgaatgtacttgtgtatgatgcatatgtccttaagatggacgaagatcaatggaggtatgactttgcgatgtcacaagaagttcatatggattatgattatgataatcaagaagaatgtggggtgaatgaaccacatgtcgattgttcaaatgcttttaatacatctcaggtattcgctactcgagatgatgttttgcaatgggctcgaatagttgcccatgaaaatggatttgttgcagtgattatgagatctgacacagagaccggtagcagaggaagaagttcatttgtctttattgggtgtgaaaggagtggtacgtacaagtgtagaaataaagaattcgttagaaaagacaccgggagtaggaaatgtggttgtccctttaggcttcgtgggaaaccagtgcatggaggggaag

SEQ ID NO: 89813 - DNA, 690 bp, Glycine max
  Peptide Sequence Number=SeqID_181498
atggtggttgttttagcaaccatagtggtggttgaagtggtggcaccaatggcgacgaatgaggttgtggtcggtttgctaactttcagtgtcaataaccctaattctgggcagcaaaatggtgatactcgtcctgctaatatttggatgaacaataactataagtctacaagcactagcaatcaatctactcctagtgctatgactgcatctggagacgttgtccctatcaacttagaaattgaagctacttgtcggcgtaacaacgctgcaagaagaagaagggaacaagacacagaaggaagcagttacacctcacctcctctttctccacatcacgctgaaatgcatggggaaccggcacgaagagtcaccctagaggacttctccaataccgccactcctcagttcttcacgagtattgcaagaccggaggtacaagccgccaatatttcctacccgcattcccttattcagctaatccaagggaacctcttccatggtcttccaagcgaagatccatatactcaccttgcctcgagagacaaaacgatggttgcactctttcaaaggcaacatcttaagaacctgggaagaagtagtggaaaagttcttaaagaagtacttcccagagtcaaagaccgccgaagggaaaatggagatttcttctttccatcaattccaggatga

SEQ ID NO: 89814 - DNA, 207 bp, Glycine max
  Peptide Sequence Number=SeqID_181499
atgaaatgcaaaactttggagtcttacttgcaggttgttagtaaaattgcaaacactgaaccagacacttatacgaaaaatgaggttacattaagcaaaaagggcaatagaaatgaagagaaagaaggaattctgaagcaggcccagcccaacagtggcgctaagtgtgcgtcaggcgctaagcgagcaaccaaatgcaggcgctaa

SEQ ID NO: 89815 - DNA, 141 bp, Glycine max
  Peptide Sequence Number=SeqID_181500
atgtgtggcttcatgtcagatgtctccttcattgccacaaccaatgctgcctcaaaagcagatcccttcaccaaggcacttggcataaaagagtttgacaagcacaaatgggaattaggaatgaagttcatgaattattag

SEQ ID NO: 89816 - DNA, 168 bp, Glycine max
  Peptide Sequence Number=SeqID_181501
atggaagaagtaaagccatcccccatgtctctatcatcatcaacctcactcaagcttcacgatggaacaccttcaacagatgcaaccaaagcaatcagaggaggagctctagagagcaccagagacgccaccattgctaacagagaacatttaagcgactacctcgag

SEQ ID NO: 89817 - DNA, 204 bp, Glycine max
  Peptide Sequence Number=SeqID_181502
atgaaagacaaacacatgcgttatgcaacaaatactctagactcaagcctacatacaatgtggtaccatttttcagtgaaaaacctcgtcgggcgcctaggagtacatgacaggacatgcctcgcaatgggtaagtcaggtcagtcagggtcacgctattttgcgagaatgctccaaccatgtgggatcggcacagacttataa

SEQ ID NO: 89818 - DNA, 453 bp, Glycine max
  Peptide Sequence Number=SeqID_181503
atgaccaagaaacaaaaaacttggacaggtgtcaagctctcacctatgggtattttgaccaaaaaaccaaaattctggacagctgtcaacctctcaaccatgggtatttcaggtgagaagatcaaagagaaagtaaataatgtagatgagaatgaagttgttaggttgataaaagagcaggaggacaaaaatttggaaatttcagctttgaaggtagaactggaaacaaccaaaagaacatatgaagtacaattctcacagatggaagaagaagctaacagttttaaagcagcattgacacgaaaggtccgagaatatgagcaccaattggaagaattaagaaatgagttggaagaagacgctaaagatgctaaagtagaattgacacagaaggcccaagaatatgagaatcaattggaagcattagggaataagtttgctgcacaaggttaa

SEQ ID NO: 89819 - DNA, 894 bp, Glycine max
  Peptide Sequence Number=SeqID_181504
atggaattgaaatcagcaatctcagtcacattcttgtgcctagtcttgttagcactagcaaatggttcttatgctggaacaattacagtctactggggccagaatggcaacgagggcacgctggccgaggcttgtgccacaggcaactatgattatgtgatcatagcctttttgccaacctttggcaaaggccaaactcccatgattaatcttgctggtcactgtgaccctcatagtaataatgggtgcactggcttaagttcagacatcaaatcttgtcaagccaaaggcatcaaggtattgctctctttgagaggagatgttggaagcccctcaattgatccaagccaagcagccacttatctttggaacaacttccttgggggacactcattgactcgtcctcttggccccgccgttcttgatggcattgactttgacattgaaggtggatcaaacaaacactggggtgaccttgccaggctcctaaaagggtatggcatggccaaacaaagcaagaaagtgtacataactgcagcacctcagtgcccatttccagatgcttggattggaaatgctctcacaacaggcctttttgactttgtttgggtccaattctacaacaaccctccttgccaatacaattctggggcaattagtaaccttgaagatgcatggaagcaatggatcacaagtatccctgccaacaagatattcttggggttaccagcttctccactggcagcaggaagtggcttcattcctgcagctgatcttacatccaaggtgcttccagccattaagggttcttctaaatatggaggtgttatgctgtggtcaaggtattatgatgttcagagtggttacagttcttctattaagagctatgtttga

SEQ ID NO: 89820 - DNA, 1191 bp, Glycine max
  Peptide Sequence Number=SeqID_181505
atggaggagtttgttgtccgtgacaaccattggcctcataaatctctttatccttcttctccttttggaagaattgaaccaatttattgttatgatcaacttggaagggattcctttgaggagcaggtgacacaaggattcttcgtccctcatggacgtcgggatgttctcaccactgctattggacgtctagagcaccctggacatgtccgtgctgctggagtcggtgtcaccatcaagcaatacttcggatcggctccacggatgtcccgcagctcttcctccctgcctcctgaagaattgcagcaactggcccagcaaatcaggaaccagccagaggagtcgatcacaaaaaaagtgactcggcagctcatgggacttgcactgcctccggagcctctggttggtccctcaagtcctcgagtaagcacaaaggagagttgtgttgatccctcaggaaacaatcctgagacggatgactcagataggtgcggcttgtacatcaaagcaaatccttcccgcctggttgccctggggagagtttatgagggatccactgttgttcataacactcctttgttgcccggccaagtaaaggtgggtgtagaggaggttaaagatccagatgctgcagttcctgtacccactaatgaggtcgatgatccactttatctgatgacattgaccatcccagagcttttcttgaggccttaccaggttacatgggatgccaccgtgttcggggtctttaatccagacttcccgctctatataaagcacgaagacctctccgaaatcgcacatggtgtggggaattctgatatctatggattcctcgagccacagtccattcaaaggtctgggcaatcgcagtttgagactgaaagttacataaagagttggatgcagagttcaaaacgtgatgtctaccttggagcctacctgaatggcggacactggcagatggtggtcatcgtgcccaaggaacacctagttgtctggttttgttcattgcataacaggccagacaactaccttaaggggatcattaacaatgctttaaaaggtcttgatgatgctccacaacctaaatcaaaggctcctgctaggtggattgtcatcaagaccattggatctagagagattaaaggtgttgcggatccagtggacacaatattatctccgagttag

SEQ ID NO: 89821 - DNA, 429 bp, Glycine max
  Peptide Sequence Number=SeqID_181506
atgtctcagcatatcagtgttacaattgtggattctccactgtccattcagaggtctgggcaatcacagtttgagtctgaaagcaacataaagagttggatgcagagttcacaatgtgatgtctatcttggagcctacataaatgggttccactgcagcggacactggcagatggtggtcatcctgcccaaggaacacctagttgtctggttttgttcattgtataacaggccagacaactaccttaaggggattattaatagtgctttaaaaggtcttgatgatgctccacagcctaaatcaaaggcttctgctaggtggattgtcgtcaagtgtaatagacaaaaaggaagtactaagtgcggctactatgtgatgcactggatgtccaccatcattttaggaacttttaggaataattgggaagca

SEQ ID NO: 89822 - DNA, 192 bp, Glycine max
  Peptide Sequence Number=SeqID_181507
atggaaactacaactcctagggcagtaaagcaacaaagtgcccaatttaggatttccccaacggatccatttttgaggttgaaattctggaggtcagatagttgcggacaacgtgacgagggagtccacggcggtgaagtgtgtcacatcgatgaaggatgcataggcaatgacaacaacgatggaggctga

SEQ ID NO: 89823 - DNA, 567 bp, Glycine max
  Peptide Sequence Number=SeqID_181508
atggatcatgtaccagaggcaaatccgatggacactcttaatctttcacgatgtcacgttgaacagttaaaacgtgttgaaatttcacaactcgcgcgctcgaaaaccctgctgcactctctcttctctttctcctcccacctaaaatctgccggaaaccgctcggtcgacacccacattgccccacattcatttcaatactgtcggaaaccgctcactggaacccacagaacctcctatcgaagaaaagtcgaagaaaaccctatattggtgttggaactgtgggtcgaagaaaaccctacactgctcttggaacaatcgtgggtgctcaaagctcaaagctttctacgctgccagttaacaaggtatgagctctaccttagtttgttgctcttcttattgattgtgctttacgtggttttcaagcttgatgagagttacacgccgagcaaagtttccatccgtgccggtgatggttttcacaacttgaaggagattaagaccgtggaactcgtgaagccaactgggtgggtttatctatccttgtctggagctaatcctaggtaa

SEQ ID NO: 89824 - DNA, 441 bp, Glycine max
  Peptide Sequence Number=SeqID_181509
atggcagcaaaattaagccaaagagacgtgtcagatttttctccaactgctattgctatggagtttaatgtctttgattggccattaagtatagcattgtgtgggtctgaagctcaaaagcaaaattcaactgttggagaaaaagctgcaacattcatgatagacttgaagagaaggcttgagttaagtccaaacctcctggacccaatgctgaacctcaactgctcttgtgcattgtcattgtttggatttgagtcttggttttggaaagaagttagaatcccaccaaaccagtctcagaaaaacgacgatctcgaacctgttcaccgttggatcgtcgtgaaatttgagtatcatgtccgcaagacaattccgagcattctcaccgttggtaatttcgatatcatgtctgaactaagagaaaaacccttcgcattgtag

SEQ ID NO: 89825 - DNA, 325 bp, Glycine max
  Peptide Sequence Number=SeqID_181510
atgcatggcggtatcactagcgttgtgacacgtggacgatgccgccaggatgaatggcaagacagctgccacttggatgccgccagtcagagtagcgagacacccgtggatgccgccagtcgtagcagcgagacccgtgacgtgaactctgtgtcaccagttccaatggtgagacaggcagcagctatgaggtgcagtggcacaggggagcagctttttcttgttgcagtatctcgctggttgcaatggcaagattcactgcttgtgctgctgggtgtggttgttattgttgtccatcttccattctttcattgtgtcaaaccag

SEQ ID NO: 89826 - DNA, 1131 bp, Glycine max
  Peptide Sequence Number=SeqID_181511
atggaaagggagaaaatagataagaggatcacatgggttgaacttctgccttcgaagtatcttaaaggggattcattgttgtggataaaggagcccatatcacaattggtggattatgttaatattcaagacattagcctttctcttcatgacgtctggcatcatggtgcaaggaatttgagggacatagctaccattgtccctaatcaggtcaaagaaaaactaaacactgacagaagttcccttggaaacccaggtttatctggctatggaggtctgattcgtgactctcttgataggtggatcacaggattctcagttagtcattatagcaagacttccatatcaactggcttgtgttccataatagattgggttaactttttaattggcatgtccttcgtaaggaaactagttcaataccgtgcatacccatggccatgcaaagccatgcaagtgtatcgccagcatgaatggcgaaatacgcaagccgttgaaacgtggactgataccgccagtggagctggcgatttcagtgtagataccgccagtggagctggcgagtttggtgtgaccagttctcgccactctcactggcgacttggcttcaaatttttagtttctggaaaatatgttgctttgcaaatttgtgatgacgaagatgttgaaaccatgcttgaaagttttcaacaacaaaatcaaatgtcagtttttgaattgtacatagaaaaggatgtggctggtgattctatgtttcattctgcaaattctcttacatcatgcggaaataatttatctaataatgaggcgcaaccgccaacaaatgtgagtaacttacgtggtgatgaagatgatgatgattatcttgtgtctaactcatacgttgaagagtctttagatgaagatgatagtgttgacggtatatctaatactgacaatgaagtcaccaacatgattcaaccagtgtacaatgaattgaaaatccattttggaatgatgctttgcattataacaatatcaactggagtcatcctgatgaggaagacatttgtggtttggagatgccatcaacttttaatgttggacaagaattatatgttggcatggattttgatactaaagatacggtaa

SEQ ID NO: 89827 - DNA, 2919 bp, Glycine max
  Peptide Sequence Number=SeqID_181512
atggctgatcatcagaaaaccgctcctggcgagagagacatcgagcaggcaattatatctcttaagaaaggctcatatctgctgaagtacgggcaaagagggaagccaaagttctgtccatttaggctttccaacgatgagtctctactcttatggtactctggcaaggacgagaaacagcttaagctcagtacagtttcaaggatcattcctgggcagcgaactgcaacatttcagcggtatccacggcctgaaaaggaatatcagtcattttctcttatatacaatgataggtccttggatttgatatgcaaggataaagatgacgctgaaatctggtttcctggtcttaaggcaatagttactcgaggtaacaaccgcaagtggagatttgaatcaagaactgacgatagtctgtattctgatagtccaaaatctggcacacgaagatccactccgtccattgcaccattctctgaccctggggatgctggtggaggttttattgacttgcaaaatagatggataaaggctttctctgaaataatttcttactctgcagctagcaagagttccagtcaagctgaatcacttgcaaattcctctttatcctctgggtctgtggataactcaagcaatcgaaattctgcatctgaggcatttcgagttagtttatctagtgctgtaagttcctccagccagggttcttatcatgaagattttgattccctaggtgatgtttttatttggggagaagggatcgccgatggaattcttggtggtggtgtacatagagttggagccttatctagttctgagatggatgcattccttcccaaggcattggaatcaaagttagttctagatgttcatagtattggttgtggctacagacatgctgttctagttaccaagcagggagagatatttagttggggagaggagtcaggaggtaggcttggacatggtgtagaaatggatgtttttcaccctaagctcattgacaccctcggtggcatgaatattgagttagtagcatgtggagaatatcatacttgtgctgttacttattctggggatctttatacatggggtgatggtgctcacaattctggcatgcttgggcatggaaatgaagtcagtcactggattcccaagaaagtaggtggtaacttggagggcttacgtgtattatatgtgtcctgtggaccttggcacacagctattgttacatcagctgggcagttgttcacatttggtgatggaacttttggtgccttaggacatggagatcttagtagcgcaaatattcctcgggaagtagaaaatttgaaagggttgagaacaaccagggttgcctgtggtgtttggcacactgctgcagttgttgaggtggtaaatgaatctgtggaatcttctacacgctcatctagtggaagactgttcacctggggtgatggagataaaagccaacttggacatgctgatagggaacctagactagttcctgagtgtgtaaatgcattgagtactgaaaacatttgccgagtggcttgtggccacagtcttacaattgctttgacaacgtcaggacgtttatatacaatgggaagtacagcgtatggacaacttggctgtcctgcatctgatgggaaagtccctacatgtgttgaagatataatttctgatagttttgtagaagatattgcctgtggttcatatcatgttgcagtcctgacttccaaggcagaggtttacacatggggaaagggtttgaatgggcaattaggtcatggagacagtgatcacaggaataaaccaacacttgttgagttcttaaaagataaacaagtgaaaagtgttttttgtggttcaaactttactgctgttgtatgtcttcataaatggataccaagtgttgatcattctgcttgtgttggatgtcgcaatttatttaatttcagaagaaaacgtcataattgttacaactgtggacttgtattttgcaaatcatgcaccagcaagaaatctataaaagcttcccttgctcccaattccaacaagccgtatagagtctgtgatgattgttatcttaaacttaggaaagctgccattgaatcagtaccctcagtgcaaacacctagcttgagatgcgtaagtttgcaagacaatagaatcactaaaatacagggaacactactaaggcttgcatcttttggttctattattcaaacagaaagtagtcaatcaaagcttccagattcacaagatagccatcttttcccatctttaaatggaaaattgcagatgagggattttgctccttcaaaatcatcaaattctctttctatggattccaagaaacacctttcagtttctgagcccgctgcaagaatatcttgtcaatcaatgtcaccagtttcatcaaagtcaagtccaagacaatcttatgaagatataaatgatgatttaaagtacagaaatgatattttaagtctagaagttataagtttaaggacactggttgaagagcttactcacaagtcaaaaagtttagaggctgaacatgagagaacatcaacgcaattgaaggaaatgactgcagtagctgcagatgaagctggaaagtgtaaatcagcaaaagaggtcataaagccattaactgcacaggttgggtattctatcagcagggtttcctttttctcctattctgcattaaggcctgccatggacacatacaaagaagaccactataagcaccaagaagggggagaggcccgccatggcagcgccataagacacaatggcatgtttatgtggtggaattttggccttccgccatattccaccattgataacagcaaggttgtcaaatggcggtgctatgatggtgtgatggtggactccgcaatccgttag

SEQ ID NO: 89828 - DNA, 318 bp, Glycine max
  Peptide Sequence Number=SeqID_181513
atggagaaagtaccttttcccagttcattgaactctcatgtatcatctggtcaatctttaatgggcttaacttctttgactgaaatgagcaaatccaatttcatttgtgttttgaatcttgatcttgctatattggaagagaagtctgctactattactgatgctagtaacaatgaaaagaaagctcattataaagcttgggaaaaatctaacagactcagcctcacgagaatgactgttacagacaatattaagacaactcaccctaagaccgataatgctaaagagtttatggggttagtgggagaatgctcttaa

SEQ ID NO: 89829 - DNA, 381 bp, Glycine max
  Peptide Sequence Number=SeqID_181514
atggactcctctaagaacaatagcatcgtttcttgcactaaattgttgggagttggaagccatcttctcaatcaaattcctagcttcagcaggggtcatatcaccaagggctccaccactgacagcatcaatcatactcttctccatgttgctaaatccctcatacaaatattgaagaaggagttgcttagaaatctggtggtgagtggtcctagatacagggaagaatttctccaagaacaccctcttaaggtcatcccagctgaaaatggacctaggagcaaggggcttcatggtgtaacaaacaatatggaactccttaagatgcttatgaggatcttcacctgcaagaccatgaaacttgggcagcaaatgtattag

SEQ ID NO: 89830 - DNA, 330 bp, Glycine max
  Peptide Sequence Number=SeqID_181515
atgcatcaatctaaacctgtaagcacacttttgggaaatcacattatgctctcaattactcaagctcttaatactgaagaagaaaaaagaaagttggatactattccatatgctaatggagtaggaagcatcatgtatggtatggtattgaggtatgtgaatggatctctagaatctagtttgaagtacaagaaagcaactcaaggtggagatgctattatcagtttgagaggcagtgtgatcgttgtgagaaatataaaagagaaaacactaggtaagaagagagaaatagagaatgaggtttgggttcttgttgagagttcttcttga

SEQ ID NO: 89831 - DNA, 432 bp, Glycine max
  Peptide Sequence Number=SeqID_181516
atgaattatttggaagcgtacaatgaagctactgccctagcttcaaatgaagaggataagaaaagggctagtgtggatgcagagttggtggaaaaatacaataaagcaaaatggtcaaaaacattggtacagaagtatcaagaagaggttgctagcaaatccaagaaaaagtcgaaggaactgatgcattttgatgataaaccaatgactgtcgatgaggaacttctgtttttgacttcaaactattcacagcagttgcagtcatggatactgatgaggagtgctcaattgttcttgaatcatctgaaagagatcctttctttgacaaaaataagtaagggctttagtcccaaagaacggatatacctcaagtgctcttcaaaacttggctggatgaatactactgtggaggtcttacttcagattgcatga

SEQ ID NO: 89832 - DNA, 291 bp, Glycine max
  Peptide Sequence Number=SeqID_181517
atgtctttatgtactaagggatataacattgtaatgacaaccagtctatcatctcatgttcctgttggatatttttcatgggctgagtatgatatcatggcaccactgcagccaaaaatagaagttgttgttacagttgcattcatttccaattgtgatgctcgaaatatgcggttgcaggctcttgaagcccttgaaaaatctaacatcaagattgacttttatggtggttgtcataggaactgtgatggaggcttgaaacacttgtgcaatgcgcaagatacctactag

SEQ ID NO: 89833 - DNA, 531 bp, Glycine max
  Peptide Sequence Number=SeqID_181518
atgagagaagatccaatcaagaataggcacttcaggaacgatccacttacaaaggaaaaggcaaaggaccatggaaaggaaataagtcatgcaccaatcagaaacaccaagatcaaggatctaatgcaggtagtgaatcctctaaaggaaagaaaagtgatcaatcacagaagcgaaatgatagctccaatggcagcaaggaatggaagtttagcaagagatgtcacaactgtcaaaagcttggtcattatgcacgggattgctggcaaggagagggtgctaagaataagcccaataatcagccaaacttggcacaagatgaaggatcagattctgaggttgaaatgctcatggcaaccacaagcaatgaatcctccaatgacacttcatgggagaaaggaatggttcatcagtttggatgactcattaaagagcaaagttcgttttgcagatgatagcagcctcattgtagaaggcattggcagagtggcttttagagacacaaatggaaaagaaacaatcattgaggag

SEQ ID NO: 89834 - DNA, 213 bp, Glycine max
  Peptide Sequence Number=SeqID_181519
atgagtcttcagcgtgagctagtaccccaaaaaagccaaagagtgtttgcagagaaaaaggaatacccacttattactattccaagattttcgtgggtagatggtgaaatgggaatcatgaccaaagttagtgctaacatgacgccttccgacttgctcgcaagaatcgaacaccggttcagttcggcaatgccatccttactcagccattga

SEQ ID NO: 89835 - DNA, 498 bp, Glycine max
  Peptide Sequence Number=SeqID_181520
atgattatgaggagccaagacatttatagtagccaagataaggctactacttcaccttcctctagtgaaagtgaagaagcaaaaggggaagaatctagtgaagaaatctacccccaagaagaaggaaaacctttaatggttaaggaggagtgtaaggaggtaactgtctcctccaagaggttagctaagaaggaaagacattttgaaataaagacaaatattaaagaaatttcccctcttaaacaacctccacattttctcctttgtaaaaagacacttgttagcattgtctcacctcttaggcttgagtttattcctcaagtaaaggagttgttggatgagggtttggttcgcaagagcttaaatctttgtgctttgttggtgcccgaaataggggttctcatgaaccctaagagaataaaggtcattcctgagtggcccgctccaccaagtgtgttgaggaaaaaagcccagagtttcaagaacctcgggatttga

SEQ ID NO: 89836 - DNA, 348 bp, Glycine max
  Peptide Sequence Number=SeqID_181521
atggctgatccagagacttctgtgtttttgaaccaaaagtctcacctggcagcatttttagcaggatcgacatcaaaggaggtcttagctaaaaatctgaaggaagttctacaaatgttacaacaagaagaagaagtttcatcctcaaagaaggaagaaacaagttctgccgaagaagacgaagaagatcccttttaccaaaacgaagatgattgttttgccattaaagtcccggtcaaaactacttgtcttgtaacaaacagtcaaatagtcccggtcaaaactacttgtcttgtaacaaacagtcaaatagtcccggtcaaaactaccggcaactaccggtcttag

SEQ ID NO: 89837 - DNA, 540 bp, Glycine max
  Peptide Sequence Number=SeqID_181522
atgtggcttgtgcggtggcgcgacaagacgagacgctggacacgcgacaatgtactacgcccttcggccgaggtcactggggtgcaacaatgcaggcaaatagtagaggtcactgcgagggaaagggaagaatcaaaagaattctcagactgtgtcattttgaattctttgagaagggagaagggagacagaaaagaattcaggcggttagtcctttgttcttttggaaaaaggagaagagagacacaaaaagaattcaggcggttagtccttggcgaattctttttggtaaagggagaagagaatgcaaagatgaatagcataagttttcaaggtttagaaaaccagaaaactttgaaaagcttttggtacaaagaagaagaagaagttcaaagagattcaaggcttgtaaaggattgtaagagattgattggaaaagtattcaagactgaatggatgaatgtattgaaaagcaaatcaaagccttgcttttatagactcttcatgtctggtcaagacaaccatttagaagagttataa

SEQ ID NO: 89838 - DNA, 450 bp, Glycine max
  Peptide Sequence Number=SeqID_181523
atgggacttactatagttgaccttcaaaaggagatgtcagctttctcccaacaaatgcctttgatgaatgctaaagatgaggaggatgatgctacgtctaggagaactagacaatccacccggctaagaaggttgactgtcagaagcttggatcagccacgaaaaactacaaacgacaatcctgccattgggagaggatcaaggcctcataaagaaaagttccatagttatctggggattgtagcgcgagaaaaaattccaattgtccactccaattggaatgttgtcccagaatctttaaagaacctaatatgggatgacattttgggtgacaacgccaaaaagaaggtgatgtcaaccgtcgctactagatggaggcaatttaagtcttctctcgcgacaaaatatgtttatgctgacaataagggtcaacaaaaagatgatcctgct

SEQ ID NO: 89839 - DNA, 273 bp, Glycine max
  Peptide Sequence Number=SeqID_181524
atgaagacattaaccactactttggaaggaaagccaaatcaacatgtacctcggtggattgaaccaaagagtcatgttcaaactagaggctataagagtggatattatgtcatgcattggatgtggtgcatagtgagcggcggtttgaagaatgaatggaataagtggttttctaatggaacaacgttagacagtgagaccatgacaacactgtgcaagaaatgggcagcatattttctaaaagttaaaaacatggaatttagacaagtttag

SEQ ID NO: 89840 - DNA, 558 bp, Glycine max
  Peptide Sequence Number=SeqID_181525
atgaggtcctttaatggtgattttccaccatggagatgtaccagaagacaaaggagaagaggtgagaggaggcaccatccactagggaataagccatggaagaaggaacttcaccaccaagatgagccttggataagaagcttggaaggatgcttcaatggaggaaaagaaacagggagagaaagagagaggggggagcacgaaattgaaggaataaaagagggagagaagtggaactttgaagtatgtctcacaagactctcattcatcaaagttacaacaagtgttacacatgcttctatttatagactaggattcacaagcgattctcctcaaattttagctagcctgcatcaattagactttgcaccttatgcttcaaggccctacaatgctcaatggaatgccccggggcttctccatgacaagcacacgttgcgttcgagtcgtatcctcggagaaatggaggttgatgtaccttggctggggttatggctaccattgaattatcaagtagacatgggagcaagtcagcataggacaccggaattggggtga

SEQ ID NO: 89841 - DNA, 924 bp, Glycine max
  Peptide Sequence Number=SeqID_181526
atggagcacggccccggtggcatccgcgacgcccttccctgccttcacgccctcgccgccgcgaacaccgccgccatcctccgcgtccctgaatccaccgccgcctgggccaagaaagccctcgacctcggcccgcagggcctcatgttccccatgatcgaatccccattatccgcccaggacgcagtctcctactgccgctttccccccaccgggctccgcggcgcggcccatcccatcgtccgggcctccaagtacggcctggacgacgagtatctcggtaattacctcgacgagcttcttatcatgtgccaggtggagtccgaggagggagtggcgaacactggcgcgatcgccgccgttgatggcgtagactgcgtgcagatgggccggaacaagaaagtgagggaggttttgaaggatgctgagaacaaggtgttggagagccgaaacgacgacgttgagattggggcttatctcgcaggtttcgccacggtgtatgatggggcgagggatttgaggtcgcgtgggtatcacatggtgagtggcgccgtagacgtggggctgttccggagcgcagcggtggaggatgtgacgcggttcaagatgggcggggatgggtcggagagtgatgagggggaggagaaagagggtgatgagaagtactggaagttggttgccatcagaggtttgggagcgagagataaggtggtggtgcatggtggtatggtcgtgtggtgccatctgtggttctgggggcaaggtggagaagaaaagaaaataaacaagatgtcgctgccaaaaatcacctctgacgacagtgcaaggtggtctgccgcggaggtcacagtgttaatagtgtcaactgggttccttgtgcacagcatgagtgagagtgaaaaatgggtgggggtagcagatgag

SEQ ID NO: 89842 - DNA, 309 bp, Glycine max
  Peptide Sequence Number=SeqID_181527
atgacggctcgtggtggctaccggtggtcgtggtgggtggcggagaagaagcgtgctcgtctcactaagtgggagtccacttttggcgctaagcgtgacaattctcgctcagtgcaattccctcttgggttggaatttgcgttgagcgtgacaattcgcgctgagcgcaattcctcttgcgctaagcgcaataattctcgctcaatgcagttccctctcgagttggaattgcgcttagcgagagttgcgagtagtcgatgggcactcaacctagtgataaaggttttcatggtggctaatatcaaatga

SEQ ID NO: 89843 - DNA, 87 bp, Glycine max
  Peptide Sequence Number=SeqID_181528
atgttgctgaaacacatgttggtaaaactgttattttccatgagtggtggtcctatgataatctatgagtgtgcgagtcttctatga

SEQ ID NO: 89844 - DNA, 873 bp, Glycine max
  Peptide Sequence Number=SeqID_181529
atggcatccaggaagaggaaaagcactgcttccagacctcaagctcagtatgataccaggcggttccattctttggacgcttggaatagatataccgataacattcttggctggaatatccttccggagagaaatgtgcagatttatcatactgagtttgacgagtttaaagtggaattggagaggcgtaatctacacaaaggccttgccaatctccaagatggaagtatagatgtagctgtggtgaaggagttttatgctaatttatacaccacagaggagcaagcacccaagcaagccaaagtacgaggacacttgatcaaaatagatgcagacagcctgaatgagttccttcaaacgccagtgggccagccatggaagcttcttagaaaagatttgatgacactggcccagacatggagtgtcttcttttactccaacctagctcccacatcccacacctcagatctaaatatggatagagctaggttggtctatggcttggtgactaagatggatatgaacatcggagcccttatctcaggtcagatttcttttattgctcagagtaactccactaggctcagatttccagccttgatcactgccttatgcagagttagaggagttacctctgacagtctgacctatgagaacctgagcccgaccattaacttggcctacattaagaaaaactgttggaatgtggatgatctaacagttaacttcagaggggtgaggaaggcaagggtaagaccagctgatgttccttcttctactactctaccagctccttccacttctgctactcctacaccagctcctccaagctcatctactcaggactctcagtgttatgaagccatgctttag

SEQ ID NO: 89845 - DNA, 504 bp, Glycine max
  Peptide Sequence Number=SeqID_181530
atgcaattcaaggatacaattggatctattcaacgagcatttaaaagtgctgaaattcaaattggtaagctagtagaagaagtgactcaagttatgggcagaagaaaagaagaatttgtagggattgaagctcaagagggaagccctgtaaaagagcatgacttagaagaagaaaggcatgaagaccataaagttccaattattctgggacaaccatgtctgtcaattgctagttgtgtattaggcatgggtaaagaatgcctagtcagtaaaaatgaaggagaagagctagcttgtattgaagagctgaatgttccagaagataagtctgcaggtcatgtgatgtttgaaacattagaaaatagtagaccaatggaaaagcccaaagtagaactgaaaacccttccaacacatttgaagtatgtatttttggaggacaacgaggctaaacctgtaataataagtagttccttgcaaaagaaagaagaggatcaattggtttag

SEQ ID NO: 89846 - DNA, 450 bp, Glycine max
  Peptide Sequence Number=SeqID_181531
atgggtgacagcttgtcatttgaagatattggcgataggtggatgtattactccgaccatctagcaataggggaacaaatttgtcttgtgcctggccagtgtgcactagattacatggactggttcttcaggatctctcatccgttcatcacacccacacaggcagctgatccacccagacatccacctgtcccacagcatgacacatatggggagccagatatccctgaggtctcaatggcaccagaagctggaccttcagatgcaccttctgatgtggagcagcctagacatgcagtggatgcgtgccaagcgatcgcagaaaagttggagtggttgctcaagctaaggataatcactacagacacagaggtacatgaggtcatggaagactgcatcaggatcgctacggttgtcacaacagatgggaatgtttatgttggggcgtga

SEQ ID NO: 89847 - DNA, 189 bp, Glycine max
  Peptide Sequence Number=SeqID_181532
atgtttgtggagttcgtctctgccacttatcgattgaggtcgaagaaaactacgaaaggaaagggtgggaagcgattttggaagtccattgtggttggctttaagactcccagggaagccatcgaagtaatggatttgagtcatttgatgttgcgggatgtattcttaaagtccaataagctggtttaa

SEQ ID NO: 89848 - DNA, 366 bp, Glycine max
  Peptide Sequence Number=SeqID_181533
atggcaaacaacatagacattctttgcattcaagaaaccaaaaaggaatctgttgatgcaaaactatgtcagtacctgtggggtgacagcaatgcttcttgggagtgttttccttcctccaacactgctggaggactattatgcatttggaataatggatcattcttggttgatagacgggtgctggggagaggtttcataatgctagaagttgagatcatcctatcaagcaggccttggtgtgtcttgggagattttaactccataaggcatcgagaggagaggctcaattcatctcagacaagggatactccacccagcatatctgagttaaactcctggatttcagatatgactttagaggag

SEQ ID NO: 89849 - DNA, 687 bp, Glycine max
  Peptide Sequence Number=SeqID_181534
gcctgggaccgctacacagataatgtactcggctggaagatccttccggagagaaatgtaaagttgtatgtcactgagtttgatgaatttagaagggaattggagaggagaaattggcataaggagcttacaaacttcgcatatgggagcatagatgtggcaggagtgaaggagttttatgcaaatctctatgacctcgaagacaaattgcccaagcaagaagaggagagcctcccagcttactccagatttaccaggttaaggccagatccgcaagagctggcagctcgcttatgtatccctggaaggagatttgagttgaatgcagacgggttgcctctgaagattctgaggaagaatttgactatgttggcccaaacatggagtgtactttctttttctaacttggcccctacttcccacacttcagatattactttggacacggtcagggtaatatatgggattattcagaagatggacatgaaccttgggtacctcatcttgagtcaggttactcttattgctcagcatgactccttgaggctaggttttcctgcccttatcgctgccttgtgcaaggcccgaggaaaatccagggctaggagatctgaggccccatctacttcagctccccctatctcagctccttctacctctcctctccctccaacaccagcagctcca

SEQ ID NO: 89850 - DNA, 555 bp, Glycine max
  Peptide Sequence Number=SeqID_181535
atgaagactgctgcacttaaattacctcaagtaatggcagagtgtatctataggaacatgcaaaagccttcaatgtcgtcatggaagcgtgacatgccttcttcaaacatttgtgttctctccactgcatacaggctatacaagaaagggagggcattagaaatcgtggacccaacattggcctccacagcggtaacagaacaagcagaaatgtgcattcaactgggtctactctgcacacaaggtgatctaaacctacgtcctacgatggggcgtgtgattgtggtgttgtcaaagaaaccgccaggccacatggaagaaccaacaagaccaggaatacccggttccagatacagaagagtatcacgcagaccctatgcaatgtcttctggggaagttgatgatgactctaatttgcacacttttgattcttcaagaaattgtggcactaacactaccacttctgcaacaacaccaacaacaagctccaatactacagctgaagtagaccggcgagggaaacgaccgatgcaacgtttggtgttgcgtgattag

SEQ ID NO: 89851 - DNA, 465 bp, Glycine max
  Peptide Sequence Number=SeqID_181536
atgcaatcctaccccgcaagggcattggatagaaaactccaagtagattgggccagagatgcaagagaaggccctagggttcttatgagccttaggatttcaaagctcatttggagcataaaatttcgtgctcttctctccctctcccttcattcatctccttcttcgtccaagctcttatccatggcctcctatggtgtggcatctcctctctctcttcctttctccattccgctgtcattcatcttccaagaagcaaaggaatccattgatgaagaagatcctaggcctacaagctccaatggagcttgcatcaataggtttcaactaggtttcaagactagaagcagtactggaactagcactcgacctcaaagggaaaacatcctcaaagaattcggcattcttagctccacgatgatgtcacactcaatcatatcactcttaagaactagaaacctatag

SEQ ID NO: 89852 - DNA, 259 bp, Glycine max
  Peptide Sequence Number=SeqID_181537
gctccgctcttgacgtcgaagaacacattggagaatggaggaatccaatcgggaaaataccaaagatcacatttcccagtcaagaggggtccgctcttggcggtgaagaacacattggagaatggaggaatccaatcgggaaaatgacaaagatcacatttcccagtcaagagggtccgctcttggcggtgaagaacgctttggagaatggaggaatccaatcgggaaaatacgggggatcccatttcccagtcaagag

SEQ ID NO: 89853 - DNA, 1001 bp, Glycine max
  Peptide Sequence Number=SeqID_181538
caacatggagagaagtatgatagatgctgccagtggtggagcccttggagacatgacccctgctgaggccagaaatttaattgagaagatggcttcaaactcccagcaatttagtgccggaagtgatgctattgtcattagaggagtgcatgaagtagccacgaattcatcaggtgagactaagaagcttgaaggtaaactagatgccttggttaacctggtaacccagctggccatgaataaaaaatttgcacctgtcgccagactctgtggtttatgctcctctgccgaccaccacacagacctttgcccttctgtgcaacaatctgaagcaattgaacagcctgaagcttatgctgcaaacatctacaacatacctcctcaacctcaacagcaaaatcagcctcaacagaataactatgacctctccagcaacaggtacaattctagatggaggaatcatcccaaccttagatggtcgaatccttcacaacagcagcaacaacaacaaccttattttcaaaatatgagacagttggctacacagttaaatcaacaacagtcccagaattctgatagattaccttctcaatctgtccagaatcccaaaaatgtgagtgtcattacattgaggtcaggaaagcagtgtcaaggacctcaaccagtagcatcttcctcatccgccaatgaacctgcccaacctcactctactccagaaaaagatgatgacaaaaatttaaagagtaagttacctaacaatttctatgcaggtgaatctaaagagaagcatcatacccctcttccatttcccccaagagcaatttccaacaaaaaaatggaagaggcagagaaggagatcttggaaacatttaggaaagtagaggagctgtgcactaataagcgaatgcttaaaggaagtgaaagaattagtatgggcaaaaatgtctccacattgattggtaaatctgttccccaaatccctgcaaactgtaaagatccag

SEQ ID NO: 89854 - DNA, 252 bp, Glycine max
  Peptide Sequence Number=SeqID_181539
gctggaggggaaaggaagttgcaactaagtgagctagatgagattcgtttagaagcctacgaaaattccaaattctacaaggagaagaccaagaagttccatggcagcttgatagctaagaaggactttgatgcaatcctccctaggaaaggaccagttaccagagccatgagcaagaggctccaagaggattgggctagagttgataaagaaggccttagggttctcatgaaccttagggtagatttttga

SEQ ID NO: 89855 - DNA, 351 bp, Glycine max
  Peptide Sequence Number=SeqID_181540
atgagctacttcttaatgagggggattaggtttggctccatcttaggaaggatagattccctactaagaggaaatccaagcttagtcctagaggtgatggaccttttcatgtcttggagaggatcaataacaatgcctataggttggacctcccagaagaatggtgctcatgctgaagaggaggaaccaacaaatttgaggtcaaatcctcttcaagggagaggggatcatgcaatcctccctaggaagggactagtcaccagagccatgaacaagaggctccaagaggattgggctagagttgctgaagaaggccctagggttctcatgaacctcagggtagatttctaa

SEQ ID NO: 89856 - DNA, 312 bp, Glycine max
  Peptide Sequence Number=SeqID_181541
atggcagctcaagtaacacccccaatgatggagagggaaatgatcataatgatagtagacactttacctgtgttctactacaagaagatggtggaatacatgccctggagttttgcagatctggtatttacaggcgaaaggatcgaagtaggcctaagaaggggcaagtttgattatgctacttcaacgagttttgataataggaggcctggggcaagtggagcaaagaaaaaggaaggagacgcccacgccatgaccacagtacccacatggccaagctctccacaaacccctcacaaccctatgtattag

SEQ ID NO: 89857 - DNA, 983 bp, Glycine max
  Peptide Sequence Number=SeqID_181542
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtagtgaaaacctcagcacaagagttggaccgtgtaaagcaaaacagaaatggagtagtcggagtaccaaggaagtgtttggaggaaaagggcaaaggccttggcaaaatcaaggcgaatgggcttattttattgacatcttggcgctttttgatctttggagttgtcctctttccgaatatggaagggttggtggacctagcagtgatcgacgcttttctcgcctatcataaccacaaagaaagcccggtcgtcgccattttggccatgtatgacacgttcaaccggggatgtaaaaagagtaacgcaagaattgtttgttgtgcactggctctctatgtgtggttagtttcacacctttttctccaagaaggtaggcccgtctacccgctacaaggtcaccgctcgtgcgtcgaaaaaggaaaggcgaattgggaccaactcttggctagcatggaggggcgtctgttaattggatccctcgctagaaggaaggaagaatcaggattgtatcttcatgcgaaggatgacaaagagcttaggggaagcagtaatgggatcatcggcggctatcataagtggctgagagcccgtacacaaggatttgattggctcccaaatctaaagactgtgagagacgatgaggttaaagcttcggaagaaagtgatgaggtacaagccctaaaggcagagcttgaaagagcccgggtagtcgaagaggagttcaa

SEQ ID NO: 89858 - DNA, 425 bp, Glycine max
  Peptide Sequence Number=SeqID_181543
ctcccggagacggtcacagcttgtctgtaagcggatgccgggagcagacaagcccgtcaggggcgcgttcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctaaaagaacaataaataattgcattaaatag

SEQ ID NO: 89859 - DNA, 600 bp, Glycine max
  Peptide Sequence Number=SeqID_181544
atggcagcagcactggtcggtggtgcctttctctctgctttccttgatgtgcttttcgacaggctggcttcacctgactttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaagatgctgtctatgaagccgatgacttactcgaccatgttttcaccaaagctgccacccaaaacaaggtaagagacttgttttctcgcttttccgatagcaagatcgttagtaagttggaagacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagtgatgtgtctgtggttcctattgtgggcatgggtggggttggaaaaactactttggtccaattg

SEQ ID NO: 89860 - DNA, 264 bp, Glycine max
  Peptide Sequence Number=SeqID_181545
atgggagggtacatcccttgtggatctttgcttgtaaaaggatttttacaagatatgacttctacaagtggagatgctattccatcatctccaaaaactgcaaggctcatgacagagatgattaaacttggtgatcaaatgagaagaatgagttatgaaaatgaagaaaggatggagagaatgagaaaggagaattatgagagtttaagaagaatacacaggattagtgaagctttaagtgtgaagattgaccatatagagtga

SEQ ID NO: 89861 - DNA, 366 bp, Glycine max
  Peptide Sequence Number=SeqID_181546
atgctagaggaagaagctcatttttctgattctacatcatctgactcaccatcatcaagggaatccgcgacatatttaccagaagttgttatcatggctgatgaacaccagcaaagggttacccttgaggactactcaagcagtttagtaccacaattctttaccagcatcgcacatccggaagggaacttattccaaagattaccaaatgaggacccctatgaacatttggcaacattcattgaaatctgtaacactgtaaagattgcaggcgtgccagatgaagccattagactcaacctatttcattttccttggcaggagaagccaagaggtggctctattcatttaagggtaccagtctga

SEQ ID NO: 89862 - DNA, 210 bp, Glycine max
  Peptide Sequence Number=SeqID_181547
atgagtccctcgaagcaagaagcgggtcagacggagagtgaggaggatgaggatgtgggacttccctcggagttggagaagatagtcgctcaggaggaccgagagatggggcctcatcaagaagagacggaagtagtggacttaggaaccggcagtgggaaaaaggaagtaaagataggcacgggtatgaccgcacccgtccgtgaataa

SEQ ID NO: 89863 - DNA, 638 bp, Glycine max
  Peptide Sequence Number=SeqID_181548
atggctctgaagaaattctccatgaagaggtctagaagagataccataggagaagggtccagtgccatccccgagtttgatagtcatcgtttccggagcgccaagcaccagcagcgcttcgaggccatcaaaggatggtcgttccacagagagaggcatgtccagctcagggaggatgagtatatggacattcaggaggagatagctcgcagacgttgggcatcgctggtgactcccatggctaagtttggccctgagatagttctggagttctatgctaatgcttggcccatagatgagggagtgcgagacatgcgttcatgggtgaggggtcagtggattccctttgatgcagatgctctcagccagttcctgggtgacccgctagtattggaggaaggccagcaatgtgagttcagccagaggaggaacagggccgacgggttggacgaggaggccattgcccagctattatgcacaccggggcaagatttcgcccggaccgatgcagggaggcgggtgcagatcatgtgcaccagtatgaccactttgacccagacgtggatgacattgctgctcagcaatgtcttgcctagcgatcataactccgatctccctctacctaagtgccagttggt

SEQ ID NO: 89864 - DNA, 202 bp, Glycine max
  Peptide Sequence Number=SeqID_181549
gtggttgtcatcatcaaaaaggggcagaatgtaaatcatgcaggttttgatgatgtcaaaaagaattttttgataatgagcgtcatcatcaaaaagggggagaatgtgaatattgcttcaacaaacgaagccttgtttcaagattcactaaagatcaagccttgcctcacaacaaagggtttcaaagtcatgcaaggctctg

SEQ ID NO: 89865 - DNA, 231 bp, Glycine max
  Peptide Sequence Number=SeqID_181550
ggtgacgcacatcaggccgcaggcacaccgccaccacctcggcaggccgatcctactagacccctgggccctcaccaacagtttggggctgaggtcacattgcctggagactgccccgatgcccaggcaagggaggagcgtgcaggatcccccggtgaggcagatgaatcccatatggatgaagatatgactgacctgcttggttacttgggagggagcggagccatatga

SEQ ID NO: 89866 - DNA, 396 bp, Glycine max
  Peptide Sequence Number=SeqID_181551
caaaataggggaggagcttgccacccagctcgcccaggcgagcaaggttgcttcctcgagaagcaacagacttctagaggaagaatctggaaggcccaactttcgaagaagttacggaaactcacggattgcgcaaaaacacctcttttcgatttccgccacattacggaatttcacggatcgcgcttaactcacaaaaatagtccccagtggagtcaccaactgtcacaacatgccctcttgcgggcgagcgaggcgaggctcacgggtgcgctttccaaaggaggaaagatgcgcggagtcaccaccaacgtttatttgtggaaaacgtcggaaaaaccaaaggaatccggtcaaaaagaatattccaagttcgggagttgtatttacgtttga

SEQ ID NO: 89867 - DNA, 216 bp, Glycine max
  Peptide Sequence Number=SeqID_181552
atggttaagcattgcttcaagattaagacaaggttgcttcaacaaacaagcattgcttcaagattcattcaagatcagtttttgcctcaaaacacattgtttccagcatgtcaaggctctgcaacggaactcttgaaattcaaattgaaaagtcatgacccttcaaaatataactgtgtaatcgattaccagaaacctgtaattgattaccagtga

SEQ ID NO: 89868 - DNA, 396 bp, Glycine max
  Peptide Sequence Number=SeqID_181553
atgctggtgagcttcttcctgactcatcttctccttgaagtggcatctctaatcatcttccttctccattccacggccattcatcttcaagaagcaaagcactccattgatgaagaagatccaaggcctacaagctccacatggagctccatcatgtggtatcaagatcatcttcatattggtgatcttgaggtggtattttaccatttcccttctaattatcttgaggtggtattcacacatctcaattacaagttgtcgcaacgtgcccttttgcgggcgagcgaaggcgaggctcacgggtgcgctttccaaaggaggaaagatgcgcggagtcgccaccaacgtttatttgtggaaaacgtcgggaaaaccgaaggaaatcggtcaaaatga

SEQ ID NO: 89869 - DNA, 411 bp, Glycine max
  Peptide Sequence Number=SeqID_181554
atgcccttggaaaaatatgagtggataggtttgacatatagcgtaaggaatttctttgcaaagcaaaagcaggaaatggctccgaagaaactctccacgaagaggtgtagaagagacgccacaagagatgggtccagtaccaccccagagtttgatagtcatcgtttccggagtgccgagcaccagcagcgcttcgaggccatcaggggatggtcgttccacagggagaggcgtgtccagctcagggaggatgagtatacggactttcaggaggagatagctcgcagacgttggacaccgctggtgactcccatggccaaatttgaccctgagatagtcctagagttctatgctaatgcttggcccatggaggagggagttcgagacatgcgttcgtgggtggggggttag

SEQ ID NO: 89870 - DNA, 516 bp, Glycine max
  Peptide Sequence Number=SeqID_181555
atgcgagcggggaattctgatatctatggattcctcgagccacagtccattcagaggtctgggcaatcgcagtttgagtctgaaagttacataaagagttggatgcagagttcaaaacgcgatgtctatcttggagcctacctaaatggcgcacactggcagatggtggtcatcctgcccaaggaacacctagttgtctggttttgttcattgcacaacaggccaaacaactaccttaaggggattattaaaagtgctttaaaagatcttgatgatgctccacagcctaaatcaaaggctcctgctaggtggattgtcgtcaagtgtaatagacaaaaaggaagtactgagtgcgactactatgtgatgcactggatgcccaccatcattttaggaacttttaggaataattgggaagcatattttaacaatcctagatcattggagtcagagagattaaaggcattgtggatcaagtggacacagttttatctccgagttagagatcagacctag

SEQ ID NO: 89871 - DNA, 306 bp, Glycine max
  Peptide Sequence Number=SeqID_181556
atggcgagaatatccaaagtggtcaaaatctcggcacaagaattggaccgagtaaaagaaaatagaaatagggtggtcggaataccaaggaagcacttggaggagaaagcaaaggctttggcggatcaaggtgaatgggcttcattcattgatgtcctagtgctattggtgttcagagtcgtcctcttcccaaatgtggatgggctagtggacctagtggcgatcgatgccttccttgtttaccaccaaagcaaggaaagtccagtcgtggctgttttggtcgatgcctacgacacatttgactga

SEQ ID NO: 89872 - DNA, 225 bp, Glycine max
  Peptide Sequence Number=SeqID_181557
atgaaagaggtaatgagggagatcgatcttggagagagtgacaacgtggagaggggtgtggttgcgaatcttgtcgcaccaacggtggaagagcaagtactcaatgaagaagaacaaaggagaggaagtatccctctgtcataccctaatttcgtccggggacctttgctcgatgacgtgcgaccattctttggtcctcgtgaggtgcttggcacccatcattag

SEQ ID NO: 89873 - DNA, 216 bp, Glycine max
  Peptide Sequence Number=SeqID_181558
ggatatggtgcctattcatacctattttgggcaccaataaagtgtggaagcaatgccttccaagattattttgatgatgtcaaagaatcaagagtcaagcaagttccaaagaatcaagagtcaagcaagtttcaagaatcaagatcaagattcaagattcatgtaaagaatcaagactcaagattcaagaatcaaaagaagactcaatcaagataa

SEQ ID NO: 89874 - DNA, 698 bp, Glycine max
  Peptide Sequence Number=SeqID_181559
atgtcgcgcaaagcgtgttcatccctgatgataaacataagtgatgagcccactaggaacgctaagcgcgcccggtgcgctaagtctgagtgtcattctgatgagcctgagctaagcgcgccatgctgcgctaagctccaactctctttagttttgaaaattgtagacttaggatggcatctaagaaaaggaaggcttcttctacacctacccaggccagatatgacagatccaggttcatctcaggaagcttgggagagatatacagatattgtggtgcctaggaaactactaccggataggaatgtggtagtttattacactaagtttgatgagttcaaggaggaactcgagagaagacactgggatgagaagttgactgattttgctaacaacaacatggacattgctattgtcaaggaattttacgccaacctctatgaccccaaggataaaccacctaagcaggtgagggtgagaggtcatctagtgaaatttgatgaggataccttgaacacattcctgaagaccgtagtgattctagaagaaggggaaattttgtgttctttttccaggtttgcactcctgaggcctgatcctcaggagttggctgctaagctctatatcttagggaggggattcgagctaaatgctgatgggcagccattgaagatcttgaggaagaacctgaccactgg

SEQ ID NO: 89875 - DNA, 981 bp, Glycine max
  Peptide Sequence Number=SeqID_181560
atgacactactatcatgtgtctatgctaaaactagaaatgttctcaaggttcaaaatctgttgggtcattgttcacaacatcttgataaaggtgaaactcaccaaggtcctgttgtgcttggaattgctatggtagctattgctgaagaattgggacttgagatggaaattcggtcattagaacatcttctacaatatggagagcagaatattcgccgagcaattccttttgcccttggtctactctatatatcaaatccaaagggctgcaagatgccactaacttttgctaacttttctctaaataattacaggtcaatgtgcagacttagccatgatactgattcggaagtagctatggtccgcattgcccaaggtcttgtacatttgggaaagggcttattaacccttaattcatatcattctgatcgcttcctactatcaccgacaacacttgctggattaattaccatgttgcatgcttgccttgacatgaaagctattgtgttgggaaaatatcactatgttttctacttcctcgttttggcaatgcagccaaggatgttgttgactgtgaatgagaacttgaagcctctatcagtgcctgttcgtgttggacaagtaggtcgtccaaaaacaaccactggctttcagacccactccacccctgttctcctggctgctggggacagggctgagctaacaatggaaaaatacattcccctatcaccaattcttgaaggtttcataattttggaggagaatccaaattacagggaagaatacctcccaggaccagatgatatgctagttttggacattgcatattcaatttataaaaaaattgaagaatatctaaatgcactcgaaattgcattgttcatggataatgcgcagatggtcactgagatgggggctatggatagcagtgtagagcaacgacgcttactggtgcggaacggcggagctaacaagttttag

SEQ ID NO: 89876 - DNA, 642 bp, Glycine max
  Peptide Sequence Number=SeqID_181561
atggaaaaatccttgaagaagagaaagggatcctcctccaccaccactgctgtaggacaacgccgccccaacacattcggtgacccaccagcaccaaatcctccttccttttcatctcccagtgtcgcatcatgctctatgtgctttgtcgaattttgcttcctaggtccaccaatcttgttatggactcttcaaatcggtcgtcaaattgactcgacgcatcttgtttggtaccgaatggataaggcattacgagccaatgcaactcttctatatcctcatcttgttaccttatttcttcatcatttcaatattcctttagaagatgaaccttttgtcaaggttaaaagatcttttgctattggtgttggtgctgttacttcttttggataccagaaagataaggatggccaatgggtgcgtaagcaagacctgtcacctcccattcctgatgaacgtacaccgtctccaccaccgcaacgagatacctcttcctccttattgattgaagtcctcactgagctacgggatcttacaactttcgtaggcgatcactttgatgtaatggacttttgtatcacgtgtcttgaagacgacatgagcttcatccaacgttgctttgatccatctgccaattcttag

SEQ ID NO: 89877 - DNA, 291 bp, Glycine max
  Peptide Sequence Number=SeqID_181562
atgttggtaaatgataagttaacattcaagaaggaggaaggatcttcattcaaatctcatgaaaaaggtgctgcccttggtaaaaataattttaaccctactcccacttcttcaaaggaaagttctattaaatgttttaagtgtttgggaaagggtaatattgcctcccaatgtcctaacaaaaggactatggttgtgttgggtaatggggatatcactagtgcatcttcttctagctcttctagttcttttagtgagagtgaaggtgaatgtcacaagaagggggattga

SEQ ID NO: 89878 - DNA, 288 bp, Glycine max
  Peptide Sequence Number=SeqID_181563
atgaaggacattgtgaaggaggctccaaaatcgatgatccatagtgatgcaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaggggagcgggagagaagagcacgaaattttgtgctctaaataa

SEQ ID NO: 89879 - DNA, 486 bp, Glycine max
  Peptide Sequence Number=SeqID_181564
gtctgagttcctcattggaggatacgtaggagcaaaagcctcgcttttgtcgaccacaccgctttctgttaccgaacaccaagaactagtagcccgcggagacaccttacagttatccgcacctcgtcattcagtgaccccaagtgtgattgatgagcagaggccaatgtggtcatttgcgcccttcccggagatgatacgtaggagcaagagccttgcttttgtcgaccgccccataatctttgtcatactgaccctgagtcgtgtccgatggcacgcagagacaaaatttggtcattctgcaccctttttgtcatccagaggcggcgggcctgatgacatgcggagacaaaatttggtcattccgcacccctttgccattcagacacagtcgtgtccgatggcacgcagagacaaaatttggtcattctacacccttttgtcatcaagaggcggcggtcccgatgacaagcagaggccaatgtg

SEQ ID NO: 89880 - DNA, 312 bp, Glycine max
  Peptide Sequence Number=SeqID_181565
atgctgttttgtgagaatgctctaaccatatgggatcaacataggcttaaaggagcactcacaccaggtgtatttacccccaaggcctacactccgaagagtccatcatggtctctccttcctgatttagggtccccacagtggttcccatcacaatactcgtcgcccttaaagggtcttagcattaactcgtcgcccttaaagggtcttagcattaactcgttgcccttaaagggtcttagcattaactcgtcgcccttaaaaggtcttaacattaactcgtcgcccttgaagggtcttataatcatgtga

SEQ ID NO: 89881 - DNA, 195 bp, Glycine max
  Peptide Sequence Number=SeqID_181566
atggcaatcaacggctttctaaagctcaaggagttgcttgttggctgggaagcgaagaaagaacgtcagaaagaatcaaatgtccctagtatcaggaaagagggtgcacatcataggccaatctgttttcttgcccgttcccaggaaaggtatgaaagacgcctattcttcaggcaaggagcgcttcctatatag

SEQ ID NO: 89882 - DNA, 535 bp, Glycine max
  Peptide Sequence Number=SeqID_181567
atttcctacatctactgtccaatcttttgaatttggggtgatcgaccctctcgatgagtcaatctcttgctttctcataagggtggacccttgggtactagtacctatcgccttcagagggctgcacgccctcgactttagaggactacacgtcctcaccttcagagaactacatgtcctcgacttcagagggctacacaccctcgccttcagagggctacatgcccttgacatcagaggactacacgtcctcgactccagagggctacacaccctcaccttcagaggatcgcacgtccccaccttcagagggttgcacgcccttgactttagaggactacacgtcctcaactttagagggcttcacgtccttgcattcagagggctacatgtcctcgccttcagaggactacacctcctcgactttagagagctacacgtcctcgcctttagagggctacacaccctcgcctttagaggactacacgtcctcgacgtcagagggatgtacatcctcttcttcagagggctgcac

SEQ ID NO: 89883 - DNA, 276 bp, Glycine max
  Peptide Sequence Number=SeqID_181568
atgaggagaaacacaacaatcggagaagtactcacaagtagaaattcaacaagaaagtatctccaagtgaatacctctcctcatcaattgatcatcaaggaagaaagacatggaaaacatgagaaagccttaagtatcattccttccttgatcaccaacacttctcttgctacaatatggaaggtgtatccggcatacatgagtttcatggcgtctctagctaagaggcgaaaatgcaaggaagatgtgttctacgtgaccttcatgccaccttga

SEQ ID NO: 89884 - DNA, 327 bp, Glycine max
  Peptide Sequence Number=SeqID_181569
atgcaggaccctggaacccccagaatttgtatgcaagatgagcctacaggagtgccaatcaaccgagccaccaggtttgagaataaggtgggatccctggatctagtggccggtgaatcactgatcaaaaagaagattttggagagattcttcatcgatctagtggccggcgaatcactgatcaaagagcgagcagccgccaggtttaatgatttggtgggatccacagatgtagtggctggtgaaccgcttcttcttcttccacgaagattcagacaaaacctagcttggatggaactgaacaagatttggcgaacgaatacaaag

SEQ ID NO: 89885 - DNA, 330 bp, Glycine max
  Peptide Sequence Number=SeqID_181570
atggcttttcactattccttattcctttccagagaaggctcgaaaatctctctttcgcctctcctccctgtctccattctggttgattcgcttcttccttcgcgcaagcgcttgctatcactgctggaagcccctgcggttgttcggctgcgtactccccgttcgcgtatctcacactccccatctttttttttcatatttcatctttctaccggtcggcttcgtgcagatagatgtttgccgggggagattggtgctcctgaggtatgcccttccggtgggttgttatattctctgtctatttcatccagtgtccgcactgcgtcataa

SEQ ID NO: 89886 - DNA, 332 bp, Glycine max
  Peptide Sequence Number=SeqID_181571
gtggctcaggttcaaatcagccttatggctggaaactacaaaactctggtcccactaacacttcttttgtaggtccttctaacaactcttctggaggtttttcaaatagaggtccacaacaacatcaagctcaactagatagaatgtcaaagatggaagatactttaacacagtttatgcaggataataatgagaaaaagaataaagaaggaattgaaaaagaaaatgagataaatgatgaagtggtgactagtgaaaaagtggaagaggatgaagacatggcagagcttgttgattatttcattggaggagactgggctcctcaaccatga

SEQ ID NO: 89887 - DNA, 382 bp, Glycine max
  Peptide Sequence Number=SeqID_181572
atgactagaggcaatccatctgacttacaaccctttgatcctgagatagataggacatttcatagattagttaggcatcattttataccttttgatcatcctgagcattccattactagtgaatctgtgcattctgttattgatcattttgaacatcctgattttgagcattataattttgagcattctgattctgagcattctgattttgaacattttgagaacatggcacaacctccaccctgtgataggactctaagggaaatggctacacctgatttcacctacaaaagcttgtgcatccaataccctgatgaggatgtcccatatgttcttaaaactggattgattcatttgcttccaaagtttcatggccttgccg

SEQ ID NO: 89888 - DNA, 324 bp, Glycine max
  Peptide Sequence Number=SeqID_181573
atgggtaccaagcacctcacgaggaccaaagaatggtcgcacgtcatcgagcaaagccttgtaatcgattacccacccttggtaatcgattaccagaggccatattcaaaatattactcaagatccatagctggccagccaccacacaagcctgcttgctttgtggtctttgtttttttatcggttgactgccaggagctcgcctgtttaggttgggtcgggattggtcaaacttgtgtgaatgtatgtatacatgattttgatgatgtcaaagaagaatctaacaaggctgcttcaaatgataagcatttgcttcaagaataa

SEQ ID NO: 89889 - DNA, 519 bp, Glycine max
  Peptide Sequence Number=SeqID_181574
atggaccttgagcatgaccaggccgtgctgctgcaggagcccgcgagcgcgctggtggagcgtttggccgatgccttcgaacgcctgcagctggatgcgctcacgccggctcgcctgcaggccctggccggtgagcggccgcgccagccgctgcggccgctgctatggcaatgggcgcaacgcagtcgccactggcaggcactggacgaacgcctgcgtggcgcctcggtgaagctgctgcgctggccggatttccgcgtgctgggtcacgaccacgatggcttccgcctgtgttcgctgctgctcaagcgcgcgtgcacggttgaagaatgcgcgatgctgctcgagttgccggctgcggcggtgcgcgatttcatccatgccgcctatctctgcggttacgcgcagttgcagagcgccccggcggcaccgatgacggcgctacgcggcaatggcaccgaccacggcctgcttgcccgcctgtggcgccacctgcgtgggagcgagcgcaatgcgtga

SEQ ID NO: 89890 - DNA, 348 bp, Glycine max
  Peptide Sequence Number=SeqID_181575
cccgcggacgcgccgccacctcatcaggctggcccagccggattgtttgatacagagcagtatttgtggcacttggttcgccagcaggcggccaaccaccgggcacatgtacagactcatgattgtctgtatcagatgagtctcagcctgcagagtcaaggctttacttctttttcgtgccctaccccggaccagtttagggcagaggtcgcgtggcctggggattggcctcaggcccaggcagcagaggcaccagcaggggcaccagcagaggctcccgatgaggcccgcaaggacgaagagatgatagatttacttgatttcttaggagggagcggagccgcatga

SEQ ID NO: 89891 - DNA, 240 bp, Glycine max
  Peptide Sequence Number=SeqID_181576
atggcaaatgagaaagagtgcatgtgcccaaaaatgaatgagagagaggcaaatataacggcgaatgcacaaaatataacggagatagcgaatgccatacctattatcactaatagcactaaggcatcagacaaaggcaacgatggccaagaaatgggcactgttagtacagcaactgtatgggtagaatctgatttcttctgcgcaactgctcttacaattgaggtaattgaggactaa

SEQ ID NO: 89892 - DNA, 241 bp, Glycine max
  Peptide Sequence Number=SeqID_181577
ggattgcgcctgcaagacacccagtggacccgaagaagtccaacagggtcttggagttgtcaaattacgggtctctgtcagttctacggagtgtctgtcacctccagcaagggcatcaggccccctactaatcgagttttcatcaagaagtactgcgcccccaggcaggcacagggcgaaacaccacagcagcctggggatggccagcagcgggcaacagacgcactgccaccacctctag

SEQ ID NO: 89893 - DNA, 409 bp, Glycine max
  Peptide Sequence Number=SeqID_181578
tgaccatggaatgtattacacaccaccaacattttctcagtatccgacacagatgtatcagtatccattcgaatctcatcaaagtgatacttctgcatgcgaacattcattaggtggtgttgtggagacatatgcgaatttttcatggcctactgtgatcccttcacagcaacatgatgttctaattgaaacacctaatgccccattaggtactcaatggaatatacccggagcaatacctaatatggatgaattattaggtgttgatttgcgtcaccaattttctcttgaggctaaccagcacgaagagaggggtcatcgtggcaaaagaaatcctgatagacaggcacgaagatgggatcgtccatgcggcacatcatcacgtcatcaccgacatcaagacgattga

SEQ ID NO: 89894 - DNA, 156 bp, Glycine max
  Peptide Sequence Number=SeqID_181579
atgactctaagacaacatggattaagcctaggatcttcttcatcaatggattcctttgcttcttggaagatgaatggcagaggaatggagaaagaagagagagaggagacgccacttcaaggagaagatgagtctagaagaagctcaccaccatag

SEQ ID NO: 89895 - DNA, 309 bp, Glycine max
  Peptide Sequence Number=SeqID_181580
atggagaaggcgagagcttcctacgtggctatctcgccaatgcagaaggcgagaccttctcgtgtctcctgtctcgccaatggagaaggcgagagcttctcctacgtggccctgtgtcgccagtgcagaaggcgagaccttcttgtcgcctgtctcgccaatggagaaggcgagaccttctcctacgtggcccgtgtcgccaatgacaatgacggtacgtcctgtaacgccaatgccagtggcgggttaagctttctcgccagtggctatggcggattccatgcaaaaacaaaccctctccgtgaatag

SEQ ID NO: 89896 - DNA, 2472 bp, Glycine max
  Peptide Sequence Number=SeqID_181581
atggattggcaagaagatgatcgtagtttcgagtcttcagaatcgtcagacaaatacctgttgggcttcatcatgtccaacatcgtgggcctgcagcaccactccggcaccctccacggcgagcgtcctctggtgggcctggcccgcgagccccacaacccgcacgaccctcacgccatcgtagtcctcaacacccacagcctctccgtcggctacatcgaacgctccgtcgccgccgccctctcccccctcatcgaccaaaacctcgtcaaagtcgaagccatcgtccccaccgcccgcaatgcccaccgcatcccctgccagattcacgtcttcgcccgcgtttccgacttcagcgccgtcgaaaacgccgtcgaggacgccgggctcaagatcatcaccgggtccgacgcctccttcaccctctccgactccgtcgccgtcaaggagacccgcgcgcagaagaagtcgtcctccgtcgacgccattttcaagaaagtcaaccgaagctacaccggcaagaaccctgctatccaaatcctggagcctccgaggaccatcatcagaacagagcttctccagcaccagaaggagggtctcgcatggctcgtccatcgcgaaaattccgatgatctccccccgttctgggaagaaaatgaaggcaaattcgtgaatatcttgacagattatcaatcggataaccggcctgaccctttacgaggtggtatcttcgccgacgaaatggggttgggaaagaccctaactttgctttctttgattgcttttgataaaaagagccaaatgggtgtctcgaagaagtggagaactgacagaaaggttgttactttggagaaaagaagaatgcgtgaaagtgagaatgaaagtgagagcagttcccctgagaagggatttagaacaaatgcaaccttggtggtgtgtcctccttctgttatgtcgacgtggatcacacaattggaggaacacactgtgcctggtgcattgaagacttacatgtattatggagaaaggaggacggatgatccttttgatctcaataggtatgatctggtgttgaccacatatggtattttggctggcgaacactgtatgcccaagatgccggctaagaatatgtattggcggagaattgtgctggatgaggcacacaccatcaagaatttcaatgctctgcagagtttggcggttagcaagttgaatgctcagtgcagatgggctgtcacagggacgccaattcagagtggttgcattgatttgttttctataatggtctttttgcggtttcaacccttttcagtgagacaacaatggagagagttggtgcaacgatctcttaataagggcaaagacaaagggcttgtacgtttgcagattttgatggaggcaattgctttgcgaagaacaaaagatatgacattggtggggctgccacccaaaaccattgagatttgttatgtcgagctttcttttgatgaacgtcaaatgtatgatcagttgaaacaggatacaaagatatttttgagtaggtatgcccatgatgacagtctagtgccccattattctgctgtactaagtaggattctaagacttcgccaaatctgtactgattcaaaactgtggaatgttcagtcgctactccttacaaatattgaagatgcctccaataatcctgaactgctgcaagcattacttgggcaggtgcaagatggtgaagattttgactgtccaatttgtttgtctcccccgatagagattgtgatcacacgttgtgctcacatcttctgccgaatctgtattctgagagctctacaaaataaaaacccatgttgtcctctttgccggcgccgcctcaaagaatctgacttgttctcagcccctcccgagtcttccaaggtagatagtgctggagagtgctcatcatcacaaacagtgttaccctccaaagtgtctacattgataaaacttcttacagaatcgagggaccaacatccagctgcaaagtctgttgtattttcacaatttcgaaagctgctattgttaatggaagagcctttgaatgcagctggattcaagaccctgcgtcttgatgggacaatgaatgctaaacacagggccaatgttattgagcagtttcaatcccaaggaatagatgggccaacagttctgcttgcaagcctcagggcttcaagtgcaggtataaatctgacatctgcctctagactgtacttcatggagccatggtggaaccatgcagttgaggaacaggcgatggatcgtgtccaccgcattggtcagaaagaggctgtgaagattgttcgattgattgctcaaaacagcattgaagaacaaatattggtgttacaggagaagaagaaacaactgcctagggaaccatctgggacaggattaaagggcatgggcataaatgatatacatttccttttagatcactag

SEQ ID NO: 89897 - DNA, 291 bp, Glycine max
  Peptide Sequence Number=SeqID_181582
atgcctgacgtacgtgcatgtatttacaagttatatgatgagagcaacgatgacatctataacatgatcttgatggagtccgtgaccgtgagagaagttgaaacggttccacttcttgcatcaagcacggccattgaatctctcgagaaagtcaagttagaagatgatgctgggataaaaaaaaagaagaagaaaaagtgcagtatttgtttacatgagtttaaagataacgtggaggtctcatcaatgtcatttaatcatgtgtatcaccaagaatgcatcattacatga

SEQ ID NO: 89898 - DNA, 492 bp, Glycine max
  Peptide Sequence Number=SeqID_181583
atggcggcgcggctaatccgtgatcgagtagagatggagtgcctagagggagcttgggagaccctcgaaggcaacacgaggtgccgatttcggggcaccattcgattcacggctacttctttggtgcatccagatgaacccgcacggacgcttcagcgcacggtggagtggatactacccacacctacaccatatcgtctagtggagcccgtccaagtgattggggtaacgtcatccgaggaagaccctgaggaggatctggaggagctacctcctgagcctgctgtgggtgcccttgactttctagagggtgatgaggatccacttcttgaggtggattctcccgaggaagtcatgtcggcatctgaggcagactctacggaggatagtggcccgggggagatggcgatcagcggaggctcttcatcctacctgtgtgatacactctcacatcaggatttcttgggtgctaatagtttccctacaggatag

SEQ ID NO: 89899 - DNA, 516 bp, Glycine max
  Peptide Sequence Number=SeqID_181584
atgatgctatctactgccaaaggtgcacagtcttacaatgacattagaatagtcaatggggtggtatatcctacatttagggaaacatgttttgcaaaaggctttctaggtagtgatcaagaatttattagtgctttacaggaagctaataattggggtactgcacactacctaagaaaattatttgtcaagcttttatttatgaacaccatggacagaccagaatatgtttggcaacagacatggcaatggatagcaaatgatatcatattcaatcatagaaaacaaggtattcgccttactcaaaaggaaacaattcatttatgcttaactgagattgagaatatgctacaagccaacagaaggagcttgcgagattttccatccatgccatacccaataggatatgcacgaaaccaagggtgccaagtattgtgcaacaaagggtgccaagtatctcgaagcggccagtcaaaggttgtatatcatcaaataataatccccggacgaaattag

SEQ ID NO: 89900 - DNA, 420 bp, Glycine max
  Peptide Sequence Number=SeqID_181585
atggcggcgcagctaatccatgatcgagtggagatggagtgcctagagggagcttgggagaccctcgaaggcaacacgaggtgccgatttcggggcaccattcgattcacggctacttctttggtgcatccagatgaacctgcacggacgcttcagcgcatggtggagtggatactacccacgcctacaccatatcatctagtggagcccatccaagtgatcgaggtaacgtcatccgaggaagaccctgaggatgctcttgactttctagagggtgatgaggacccacttcctgaggtggattctcccgaggaagtcatgtcggcatctgaggcagactctacggaggatagtggcccgggggggggggatggcgatcagcggaggctcttcatcatagtgggcagttccatggactag

SEQ ID NO: 89901 - DNA, 331 bp, Glycine max
  Peptide Sequence Number=SeqID_181586
gtctgtttcagaatcatcgtctgattctgaggccatttctgcccaggtttttttggccaattttggtactctggtgaggcctatgtcttctaaggccaggagagtttttgatgactcaggtttaatggtagttatatgggtcaatgacccttcaagctttcctttctgggttgatgacccagtctgggtaggtgacccagaagatgacgcagttgccttcttggttattggctctggtagagccaatagaacatcttttcctttagtactggatcttcctcctctgccgaaggagctagacaccttaggaggcatcgggaatcttctgtaa

SEQ ID NO: 89902 - DNA, 197 bp, Glycine max
  Peptide Sequence Number=SeqID_181587
acttatcaaggtagtccttgtggagtctgtccagacttatcttccttcaccggaagtggcgtctaccctgacttatcttccttcactagaagtggcgtctacccagacttatcttccttcaccggaagtggtgtctaccctgacttatcttccttcactggaagtggcgtcatccaaatcttcatagcctgtatcaa

SEQ ID NO: 89903 - DNA, 414 bp, Glycine max
  Peptide Sequence Number=SeqID_181588
atggcccgagttatgttggggaacggttacgaacccggaatgggtttaggcaaagacaacggcggcataactagcctgataaatgccaaaggaaatcgtgggaagtatgggttaggctatgggcccactcaggcagatgtaaagagaagcatcgcgggaaggaagagcggtagtcaaagctcgcggttgagacaagaaggtgaaggaagcccgccctgccacataagtagaagctttataagcgcgggtctgggggacgaaggtcaagtggtcgcgatatacgtgtcgcaaccttcccttcggcgggagggcgacgcgagactcgcgggatgcgtgttccacgaaaggaatacgcgcggagtcgccaccaacgtttatttgaggaaaacgtcggaaaaaccggaaaagacgtga

SEQ ID NO: 89904 - DNA, 138 bp, Glycine max
  Peptide Sequence Number=SeqID_181589
atggatgaaacttctattgtgctcatgcaacaacctcatcatgttcattttagggttaatatgggaaacatgttctttgtgagcatacataaagatgagcttgtgacagttgctggtgatccatggttacaacattga

SEQ ID NO: 89905 - DNA, 351 bp, Glycine max
  Peptide Sequence Number=SeqID_181590
atgaagaacgatgaagaatttccactgaatcgcttacccccctcccctatttatagggaaaaagagaggtgcttgccgcctagaggcttcttgaggaagatttttaagcgcaccacaattactaagttcaccccccttttcgtactttacggaaaagttacggaagccttatggaagtgtttcggatttgattttcatctttttttatcttccctttcagcaatattaagtgaaatatgcttacccaaggttttcgaaaattttacggaagcattagggaagccacagaagccccggaaaccatttttcaacaacgtggaggagcttgccgcccagttgcttcctccttaa

SEQ ID NO: 89906 - DNA, 207 bp, Glycine max
  Peptide Sequence Number=SeqID_181591
atggcagttaccagtataaggggttgtgggtccccaagtgcagctcaaacacgttttctctttatcccgtcacaagagaaaaaattcagagaggaaaagaagggctctctacaattgggaggtcataaaaccaatattctgatcaacctttcatcatcatcatcatggctaatccaggggttaaaaatggagagaagacttatgtaa

SEQ ID NO: 89907 - DNA, 388 bp, Glycine max
  Peptide Sequence Number=SeqID_181592
aagtgctaaagttgatgtcttgctaagcgagctcaatgcacgtaacaagagtcatccattaagcgaggcatcaacgcgcttagcggataggaggaatctggaagggaatctgtcacgcaggcatgcgctcagggcgtcatcagctcgctcagcgagtcgtttgtcaccttccaagcttagcacgagtttggcgctgagcgaaaattcacttactcgcactaagtgcgagaatggcgctaagcgcaactactttagtattgtatgcttgtggcttgatcacccatatgtgtgtactgttaggggctttagcattgaaagatgtattgtctccttagagcttgatagagcaggattaggttactgtatgtttggacacggagtatggtaa

SEQ ID NO: 89908 - DNA, 1209 bp, Glycine max
  Peptide Sequence Number=SeqID_181593
atgctttcaaaaggcgacaatgaccttcatctacatttcaaagacgacaatatcttcagtcgttgcatgctttcaaaaggcgaaaatgaccctcatttacatttcgaagacgacaatgtcttcagtcattgcatgctttcaaaaggtgacaatgaccctcatttacatgtcgaagacgacaatgtcttcagtcattgcatgctttcgaaaggaaataatgacctttatcttcaatttgaagacaacaatgtcttcagtcattgcatgctttcaaaaggcaacaatgaccctcatttacatgtcgaagaccacaatgtcttcagtcattgcatgcttttgaaaggcgacaatggccttcatccatatgtcgaagaccacaatgcctttagtcattgcatgctttcaaaaggtgacaatgacccttatttacatttcgaacacgacaatgtcttcagtcattgcatgctttcaaaaggcgacaatgatcttcatttacatttcgaagatgaccatgtcttcagtcattgcatgctttcaaaaggcgacaatggccctcatttatatttcaaagacgacattgtcttcagtcattgcatgctttcaaaaggcgacaatgaccttcatctacatttcaatgacgacaatatcttcagtcgttgcatgctttcaaaaggcgataatgacccttatttacatgtcaaagacgacaatgtcttcagtcattgcatgctttcaaaaggcgacaatgatctttatttatatttcgaagatgaccatgtcttcagtcattgtatgctttcaaaaggcgacaatgaccctcatttacatgtcgaagacgacaatgtcttcagtcattgcatgctttcgaaaggcgacagtgaccttcatctacattttgaagacaacaatgtctttagtcattgcatgctttcaaaaggcaacaatgaccctcatttacatgtagaagaccacaatgtcttcagtcattgcatgcttttgaaaggcgacaatgaccttcatcgatatgtcgaagaccacaatgtctttagtcattgcatgctttcaaaaggtgacaatgacccttatttacatttcgaacacgacaatgtcttcagtcattgcatgctttcaaaaggcgacgatgaccttcatttacgctttcgaagacaacgatgtcttcatctcaagacttcaatgtcatttgtcctt

SEQ ID NO: 89909 - DNA, 201 bp, Glycine max
  Peptide Sequence Number=SeqID_181594
atgaccactgaagagaaaacatctgaagtctccagtactccagaatattcctgtccagccactgctggctatgttggaggaacaaagaaaggtagattggaactcaatgtggaggatcaaaatgtctcttttgacctctttgaggccatcaaacactcaaatatgggtgatgcttgttctgaggaggaagaggtggaatag

SEQ ID NO: 89910 - DNA, 156 bp, Glycine max
  Peptide Sequence Number=SeqID_181595
atgggggggggggggggaaaactgccaggaaaccacattacaagcgaaacctcaaagagagttggacttcgtcctcaaaaggaaacaacaccagaaaatctagccttccatggattcaaacagaaaacgcaaatgaaacatgaagcagaaacgtaa

SEQ ID NO: 89911 - DNA, 640 bp, Glycine max
  Peptide Sequence Number=SeqID_181596
cgcagtcaaaacggatctcaacggaaaagtcattagtaatgacgatgataaagagattcctgacgctgtcaataccttaatttttacaatagctcaacattttattggagacccatccttatggaaagataggtctgcagaattattatcaaaccttaagtgtagaaccttagcagattttaggtggtacagagatactttcctaactagggtttacacaagagaagatagtcaacaaccattctggaaagaaaaatttctagctagtcttcccagatcattagaagacaaggttattgataaaattcatagtcaatctgccaatggagacattccatatgaaaacttaagctatggccaattaatttcctatgtccaaaaggtagccttaaaaatctgccaggatgacaaaattcagaggcaattagccaaagaaaaagctcaaacaaagaaggatttaggttccttctgtgaacaatttggcttaccagcctgcccaaaacaaaagaagaaacaaacctctaggaaagaaatccaggatcataaaccagccaatagaataagattttcaaaaagaagatactctaaaaaacccttaactagtaaggaaatagaaaatcctaagcaaaaaataaaataa

SEQ ID NO: 89912 - DNA, 492 bp, Glycine max
  Peptide Sequence Number=SeqID_181597
atgggtgacctagacgaagtacaggaacagatgaaagccgacatgtcggctttgaaagaacaaatggattccatgatggatgccatgctgggaatgaaacaactaatggagagtaacgcggccaccaccaccgttgttagttcggctgccgaagcagacccgactctcccaactgtcgcgcaccaccctattccaaacatggtgggaggggagggaagcacaccggggcatatcaacaacccttatccgaggtaccaccgaggtacttatccctatggtttaccacccaattacacaccacagccatacatgaagacatgggtcacgttcctcccctcatcctcaaaggggaacctcctctacatcctgacggggtccacgagaatcatagagagcatgctcagggagacgtcgactcctactccccgttacccgctgaggggccagcgcccaacgcactacctcaacccaaaatcacggaagagcctctaa

SEQ ID NO: 89913 - DNA, 246 bp, Glycine max
  Peptide Sequence Number=SeqID_181598
atggaaacaaatatgattccaatagctcttactctcttcatcattctgatcatcctggaatgggcaatggagcttcttaatcagttgctcccaagacaaataatgtcaatttttcttcagaatgtacttagggtaccatcttgtaaggtggatttgatgtctgatttgatggcagggatgacgattggtttgggtgaacaacgagatggactctattacttggtttcaatgaataagacacacaaa

SEQ ID NO: 89914 - DNA, 48 bp, Glycine max
  Peptide Sequence Number=SeqID_181599
catccagactgcacaaaacatccaacaaattaatgcaaaatccacaag

SEQ ID NO: 89915 - DNA, 405 bp, Glycine max
  Peptide Sequence Number=SeqID_181600
atgagtcattttgttgaacattatgctggcaaaaacccttcccgttgtagatgtgtcatgagaactactcacggtctttcatatgcatatgagctatctagatatgttgttggtaccataccacttgagacaatccatatgttttggcagaggctaagtttttcaaaccaagggttatttgagcccgaggttaacataacagaagagatgaaaatcatatccaagtggtttcaagaacttgatgtttgtagcaaagttactctaaagagtaaactccagaaaattgcctaccttgatctaaaatttatgtgtcatcctttagaaaaggtcaacaccaaagtatttcttcagtcaaacatagtgcatcatcatcaggccaagcaattccaagaaggattatgttga

SEQ ID NO: 89916 - DNA, 315 bp, Glycine max
  Peptide Sequence Number=SeqID_181601
atgcgagcagatgcgctaagcgcaggggcttttaaaactcaatcatcatatggaaacgctaagcgcagttgtgcactaagcgcaccatacgaaactgctaaaaattataaggccattcgttgcatctgcccttaccttgcttcatctccctacattcctgcacctttgctattcattgcattcatctacacaatccaaatgaaagcgctacgcgcagctatcgcgctaagcgcgttcatcttctctattgagttttctattgaactcgctaagcgcggttgtgcgctaagcgagtactgtgtatcagacacttag

SEQ ID NO: 89917 - DNA, 441 bp, Glycine max
  Peptide Sequence Number=SeqID_181602
atggcgctacatgacttttatgtcaagatgggagatgaagatctagcaatgatttggttaacctttcttccttcctcctatgagaattttcttcgactaaaggcgtatgggaatggagatgaagcctctatggccagattatcggtgattggaaggggactattcaaagaaagcaaagaagaaaggcaaaggtggcaagactgcaaagaatcaaataattggaaggggactatccaaagaaagcaaagaaagattatgttgttgctcttgtttagaatgacgccgcatcgaaaagcaatttggttttggattttggactcgagttgttcttatcatatgtctccatatagacattggtttgtgaaaaatgagaagaagtctagtgttcacatcttcatagtggtcttaccggcaagcgcaccgggtcgccaagtaaaataa

SEQ ID NO: 89918 - DNA, 249 bp, Glycine max
  Peptide Sequence Number=SeqID_181603
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggttggggagtagtgggtggtgtgtttgttgtggaagttgaggataactatttggttgtggcagttatcatggcatatttgagtagcttcaatttcaacaaccatggctag

SEQ ID NO: 89919 - DNA, 741 bp, Glycine max
  Peptide Sequence Number=SeqID_181604
atggtgatttcccatggagatgcagcggaagacaaaggagaagagtattggatatatgagcactttcctagtgttcatgaaagtgtgactgataaagggtacgatgagacatcaccatgtgcctgtcgatggcttactacgaaagcttattcgaagggattcgcagcatcgacataccagacatgtatagatgcactaacgatccctgacggtaagcttagatggggtcccattgtggtcacacatcgcccggtggtgcaccaatttgtctacattcataccattcctccactgcctattggtgccaccttgtcatttaaggatatggatggcaggtggatgcattactcggaccatctagtagctgcgggacagatttgtcttgtgcctggccagtgtgtagcagattacatggacttgttctttgggatatctcattcattcatcacacccacacagtcaactgattcacctaaacatccacctgtcccacagcatgagacatacgtggagccagatatcccggaggtcccagtggcaccaaaagctggaccttcagagtcagttgatcagcccagacatgcagtggatgcttgcgaagcgatcgcagaaaggttggagcatgtgctcaacctaaggatggtcactgtaggcacagagttacatgacatcatggaagactaccagaggatcgctaggggtgtcaccttagatggaaatatgtatgttagggtgcgatga

SEQ ID NO: 89920 - DNA, 276 bp, Glycine max
  Peptide Sequence Number=SeqID_181605
atgtcagatcagattctagactcttctttggtcattgtggacaacgacctttttgatacggtgagcattgatagtccaatgggctgcactctttctctgaggcccaaatttaatgttggaccaccttctaggagatctgatccctatctcgaatgtgggattaatagtctaacaccaccctttatcataaaccatgaatgtcagccaccacgatgtcgctcctactcaccaccaccttggggtatgcatctcgcaggagatggtcaatcaacttga

SEQ ID NO: 89921 - DNA, 192 bp, Glycine max
  Peptide Sequence Number=SeqID_181606
atggagttagttacttcagttaaaggatttcctggctgcacaaagctctcttgtagacaaaggaacaagctgaatgttttgatgatgccaaagtttcacatgcgtctcaaagctttattcaagacaaagaaattaaagatattcaagatggatgatcaagacaagtctctagtcttagaaagggtatattaa

SEQ ID NO: 89922 - DNA, 270 bp, Glycine max
  Peptide Sequence Number=SeqID_181607
atggcaccggtggctggaggatcctcaacagtgattaaggtggaagcgctttctgcaattgaggtaagcaaaggaagcgttgaaggcgtacaaattgagtacattgatatttcaccttggccttttgtaaacactgatcttgagggagatgagagttacccgccagaagttgaagccttacgccacaagattcttgcagcagatagccttctctcttcttcccttagtacaattattctgtcaaaggtccacctttattatcatttttaa

SEQ ID NO: 89923 - DNA, 189 bp, Glycine max
  Peptide Sequence Number=SeqID_181608
atggagcgagaggagggattcaaggtgaggagaaggggatcgagaagctggttccctaggagtggggtgcggcgtcacaaagctagggaggaaactagacttaagaatcaaggaaaccactccattcattatgtgaataatcagggagttggaatgaaagtcaacaagaaacatggaaaggacaaatga

SEQ ID NO: 89924 - DNA, 492 bp, Glycine max
  Peptide Sequence Number=SeqID_181609
atgacgcgcgttcgacatcgttcccgccatagacatcgtagtaggagtagtggtggcaattttgtaaataagttaccatttttagtcccatgtgcaaggcacgtgacacattcaacgacgttggccgtgggtgcccgtctttgtaggcagtgcgcaggaattgaagctcggggtttcatttttggttctcccattgcactggcaataggagcaaagtttctaccattgaggaaatcgaaaaaattgcctggcaaagttatttctcaagagcatattctggaatatggaagagactgtcttgagatgcatgttggtttggagctgttgaacctggacaatcccgaaaattatgatattgaagagctaactggaaatgaatcggatttgatgcttggtgtagctgatcttcatacactagaggcagtggctactactgaatctgcaatttccacttttctgcaatctgctgaatttgctgctgctgaatcttga

SEQ ID NO: 89925 - DNA, 732 bp, Glycine max
  Peptide Sequence Number=SeqID_181610
atggatttcttttccaatgagagttttgaatgcattcgggcatttgagaactccaatctcattcctttcatgtctttaaaattgcctgtttattctgaattagttaaagtcttctattctaacctcgaaattcaagaaggcactttgatttttgaggtttatgggataaaaatggtcattgaccaatccctattctatgacttgacccaattatctagtgaaggtgtaccatttgaaggtacactgaatgatgattggaaatttgatttctttgtgcatgatgcctgccggttggtttgcaccaaccaagcggatatgactggaaggcttcttgccggttcattggctttgaaagccgcatctttcattatctcattgttcgtatcttgcttccaagatcttcaaaccttgcacaaatgcttcttaatcggtgccgctgtgattgcatcttttggttaccataaagagcatgatggctcttgggtaaaaaagggtgctcaacccattgatgaagaaggacacttaccagttggagaagattactctcttcttcaaaggattttggacaggttcgatggtcttcaaaactttgttggtgaaaggtttgatgctctggagttacaagtggacatgcgattcgatgagatggattcaaggatcaccaaggttgaaggagatgtctcttacatctgcacatgctttgatctaccaccaccaccttcatcatcttag

SEQ ID NO: 89926 - DNA, 168 bp, Glycine max
  Peptide Sequence Number=SeqID_181611
atggaagacacacccgtgagccttcgcgtcgccctcccgccgaaggtccctactgccgcaatatgttcttcgaaggggatgatacctctagagaccatcaagagagatatgaccaccttgggaattatcattaaaaggccttttggttcctcccgtgtaggtccctaa

SEQ ID NO: 89927 - DNA, 228 bp, Glycine max
  Peptide Sequence Number=SeqID_181612
atgaaatccaaatggtctcgaccctttgtcatcaagaaagttcgaccttatggtgcaatagagctatatgacccacaatctcaggaccctgacagaatatgggtggcaaatggccaaagttgggctgagcccattgggccgctaagcgagatcatcgagagaaaccaaacatctctttctcgctcagcaagcataactcgctcagcgagtgcatcgaaatttgcttaa

SEQ ID NO: 89928 - DNA, 516 bp, Glycine max
  misc_feature (344)..(344): n is a, c, g, or t
  Peptide Sequence Number=SeqID_181613
atgactggtgagtggattagtccttacattcagactgtcctcttgaaatgtcagccatcccgcgtcaatgaagctttgtaccttatgcttgaaggccacgcactgctatatagaatgccccaaaacaccaccgtgataggcacgggttgcattgggattgtaccatctggggaagagagattgatagaccttctcgagtgggtcaagactatgcgagaaatgaattttatgggggaggcctttgtggttgagtgggcaatctttgttgttcgggcgtcggattgggaggggttccgatgtcggctgaataacttggttgacgcgaggaatattggtaggtgggnttgtgaggggtttgttgggattttggccatgtgggagctgaagttacgacataggtgtctccctccttcttcttggctccacttattccggatctcctattgcttgtacttgctgaagcagtgtaatcaaacttcccccatcttaagcccacttcaattctcttgcccttaa

SEQ ID NO: 89929 - DNA, 737 bp, Glycine max
  Peptide Sequence Number=SeqID_181614
cacgcagccagcgcaaaacagccagcccagcgtcgtgacgccgccgccggtgcaccagcagcagaaaccggcagagcaggtgaagccgaagccggtcgagcagccgaagcctaaaccggtggagcagccgaaaccgaagccggcagaacaaccgaaagcgacagaacagccaaaaactacagagcagcctaaagcggcggaaacgccgaagcagagcgaaccggccgcgccagcaggacaggcgtatgtggtacagctcggcgcgctgaagaacgccgccaaagtgaatgagatcgtggcgcagctgcggctctccggctatcgcgcctttaccgtgccgtcgacgccggtgcaggggcagatcacccgcatttacgtcgggccggatgcgtccaaagcgaaactgcagggcgcactcggtgagctgaaaggcatctccggcctcggtggggttgtgaagccggcgtttaatcgtgggacacatatggtctggattgattacgccatcattgcggtgattggtttttcctgtctggttagcctgatccgtggctttgttcgtgaagcgttatcgctggtgacctggggttgtgctttctttgtcgccagtcataactacacttacctgtctgtctggttcacgggctttgaagatgaactggtccgaaatggaatcgcaatcgcggtgctgtttaacaaaacgttgattgacggcgctatcgtcaattacgtgatag

SEQ ID NO: 89930 - DNA, 342 bp, Glycine max
  Peptide Sequence Number=SeqID_181615
atggttatgggggattccatcagcagactctccttccctgaaaacaccgagacttttccaagtcccacaagttatccagaactacgtaggtctgagttcctcattggaggatacgtaggagcaagagcctcgcttttgtcgaccacaccaccttttgtcgtcatgacccaagagctggtagcatgcggagacaccttacggttatccgcacctcgtcattcagtgaccccaagtgtgattaatgagcaaaggccagtgtggtcatttgcaccctttccggagatgtcagcatcttccggtggagactttttcaagtctcacaagttatctagaactacgtag

SEQ ID NO: 89931 - DNA, 357 bp, Glycine max
  Peptide Sequence Number=SeqID_181616
atgtggattaccaatggcggtgatgctgatgtcttagtggtatacgcaaaaactgatccacatgcaggcgcaaaaggcatgaccgcttttttaattgaaaaggacatgaaaggttttagtcatggtcatcacttagacaaacttgcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 89932 - DNA, 648 bp, Glycine max
  Peptide Sequence Number=SeqID_181617
atggacctcatcaaggctgctggactgatgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgctgtgatcaacaagtacctgggcagaccaactgaaggagtggtggatattgctgtttctgagcatcaaattgccaaggaaatcactgccaaacgagtccagcattggccaaagaaagggaagctttctgcagggaagctaagtgtgaagtatgcaatcctgcacaggattggggcagcaaactgggtacccaccaatcatacttccactgttgccacagaatcttttgctgtcaaattacccattgccttcccaactgtattgtgtggcattatgttgagtcaacatcccaatatcttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctaactcaaggacacatgcaaggtgctggaggtaa

SEQ ID NO: 89933 - DNA, 627 bp, Glycine max
  Peptide Sequence Number=SeqID_181618
atggctgcaagtgacattgctattctcagagatagagcccacgcaccaacaaagaaaagtcttctggaacttacatcgcaagatacgctgttggcacataacaagttgttgtccaagcaattggaagcattgactgaaacactaaggtgtgccatctgtggtggagctcacaatttggctgttgtatccccaatgaagaaccagctcatgaacatgcccagccatataattcacaacagggacagtggaggaatcaccctggaaaccagttcaacaaagaccagggtggtttcaatgtttaaccataagagcacagagtcagccattaagaatttggaagtccaagtgggacagctggcaaaacagttggcagataagttatcaagcagctttagtgctaacattgagaagaatccaaaggaagaatgtaaagatgtaatgacaaggagcagaatggcaattcagcttgatgaaggtagagctgaagagaaggcggagggacataaacaacagtcggcagctaagccggcactagaaccagtttttgattttgttgaacttgaggaagttgtggaagatgaagatgaccaacaggagagagagagagacaccaataaaagaaagtga

SEQ ID NO: 89934 - DNA, 322 bp, Glycine max
  Peptide Sequence Number=SeqID_181619
atggggagtgatagtgatgcaatcctccctaggaagggactagtcactagagccatgagcaagaggctccaagaggattgggctagagctgctgaagaaggccctagggttctcatgaacctcaggggtagatttctgagcccatgggccaacgttgggattcacgatgtcggatacaatgtccaggacatcctgcctgaaaatactggaattgctaaaagcattgaagctgcaggatccacgatgtcggatacaatgtccaggacatcctgcccgaaaatactggagttgctaaaagcattgaagttgcaggatccacgat

SEQ ID NO: 89935 - DNA, 114 bp, Glycine max
  Peptide Sequence Number=SeqID_181620
atgaagatgctcttgataccacatgatatgaatgacagcgaaatggagaaggaagagagagaggaaacgccacttcaaggagaagatgagtctagaagaagctcaccaccatag

SEQ ID NO: 89936 - DNA, 317 bp, Glycine max
  Peptide Sequence Number=SeqID_181621
ctgttgaagcggtcaatgatgttgttgtagatgaccccttgcacgagttgattaagagcctagttgacatttatgagaagcctgtagagttagtgtgggatgctactaaatttggaattccaaatgcaactgcatcattgttcgtaacctgtgctgatactttggaaaccaagagtgaggggaaatttggtcacaatacactgcggtggattgaagtgaagggtcacgttcaaagcggagcctatgagtgtggctattatgtcatgcattggatgtggaacataatcgtcgggcagttgaagactaattggatgctg

SEQ ID NO: 89937 - DNA, 294 bp, Glycine max
  Peptide Sequence Number=SeqID_181622
atgtcttcagtcattgcatgccttcaaaaagcgaaaatgtcttcatttgcatttcgaagacgacaatgtggaagcaatgccttccaagattattttgatgatgccaaagaatcaagagttaagcaagtcccaaagaatcaggagtcaaaaagcttcaagaatcaagtttcaaagaatcaagattcaagaataatcaagtttcaagatttaatcaaatttcaagaatcaagattcaagaataatcaagataaagattcaagaatcaagagaagactcaatcaagataagtactaa

SEQ ID NO: 89938 - DNA, 333 bp, Glycine max
  Peptide Sequence Number=SeqID_181623
atggatatggttaggagtatgttaaacaattcaactttacccatatctttgtggatgtatgctttgaaaactgtcattatgagaattgtcaaaactggaaatgcaaggttcattgaaaatggtgaaattagtggaagtatagttccacgagaaatgaaaattaaagaagttagagtgcaagttcctttagcttgtgcctctagcagtaaggtgattgctcctttagttattgttacaaacaataatgaagaagcacaacacaataatgagtccatgatacataatgaacctattgtggaagaaccacatgaagtagcattaaggaggtcttaa

SEQ ID NO: 89939 - DNA, 612 bp, Glycine max
  Peptide Sequence Number=SeqID_181624
atgaccgggattaagggagccccttacagagcacgtattgatgccctgacagtgatcgacgtatgttggatgccgtatgctgagcatcggggagttcagggctatgacttgatctcctcgtgcatggggcaagtcagatggggtcagatcattgtctacattcgaccggagagggtggttcggcagatggggtacattcataccgttcctccgccacgggttcgtgattcgttgacaggtactgatatagacgaccgatgggtacacttttcagatcatttggtgtctacaagggagctcagtgtagttcctgggcaggacactactgagccgagacctgcgcctccccctcccactcatgatgatgacttcgtcgagccacctgtccccgaggttctagtcgcgttggatctccctacgcattctgtggttgattgcataacatgtgtaaggattggaaggattgctgagcatttggagtgcgtcatcaacttcaggatggtgactgaagggactgacttatatgatatcatggatctttgtttgaggatagctagagatgacgatcctgatgacagccttaggtcgcgacagagaccccgcatagattag

SEQ ID NO: 89940 - DNA, 1027 bp, Glycine max
  Peptide Sequence Number=SeqID_181625
caagcaaagaagaagaatctgtcaactggttccctcgatggaaagaaggaagaaccgactcttatttcgtgcggaggatttccaaatgttcccttgatagggacaaggggttacatcagttacaatcccgttcttgctataagacaacttagctaccctatgagaggggcaccactagaggaagagctcgcacctattattgcacgaggtttcaataagaccaacgtggaggcacttcagaaggtcagcaaggcgtgggagatggtgcaaaagaaggacaaagaactcagaggcagtaacaacgggcccatcggcgactactgtaagtggttgaaagcccacatgcaaggtatggattggctcccgagtttgagaaccactaaaggggaggaagttgaggcaccggaggaagacgaagaggtgcaggcccttagggcaaaactcgagcaagcccaaacagtcaaagaaaggttcaaatcagcagctcttaagattcgaaaggagaatgccaaactgatagatgtaaatatagctaccaccaaggccttggaacaagagaccaaaagggctcgtagggaagaacacggtcggaacaaattccgaggggctctgtggggcagtaatagtgagcttaagctccggagagaggaaagggaccaatcacgagtagacagtttgatcttgaaggatgagttgaaggtttgccttaggtccaagagaagcttgtctcaacgtttttgcgagacagagaccaacatgttagccatcgtcagcaagtaccaagaagaattaaatctagccacagcccacgagcacaaagtggcggatgagtatgcccgagtgtacgcagaaaaggaggctagaggaagggtgatcgactcgttacatcaagaggcaacaatgtggatggaccgatttgctcttactttgaacgggagtcaagaacttccccaattgctagccaaggccaaagtaatggcggacacctactccgtccccaaggagatccacggacttctcagctatt

SEQ ID NO: 89941 - DNA, 381 bp, Glycine max
  Peptide Sequence Number=SeqID_181626
atgactaatgctgtgaccaagaaagaggaagagcgtgcagagattgaaatacatcaagaaagcattcgtcaagttacctccatccatcatcaattgaccaatgaagaggaaaagcctgaagtctccaatactctagaatatccctccttggccactattggctatgttggagggaaagataaaggtagattggaactcagtgtggaggatcaaaagatctcttttgacctctttgaggccatgaaacactcagacatcggtgatgcctgtttcgaaaaaagaataggtggagaaggaaatggcactgttagcctcaaccatggtactacagtcccttttggaaaaagaacatggctatgggagagattgtttagcttgtga

SEQ ID NO: 89942 - DNA, 327 bp, Glycine max
  Peptide Sequence Number=SeqID_181627
atgggagagcaacttgacactacacaacataatcaatttgtcgcccatgacagctcacattccaccgataatgatgcagttgttgcagaaatcaaactactcatggacaaatatgctgagcgaaggaagcgtaggcaaagtattttacaagacgaaaaagacaacgttcagctactaatgtctaactcacaatgtagtgcaaccattaacgataataataaccccgctacaagcttccaatatacaccaccatcacacgggactttatatatgaatgattctagacattgctcaaaaagacatacaatcaatgtttcttccatctag

SEQ ID NO: 89943 - DNA, 267 bp, Glycine max
  Peptide Sequence Number=SeqID_181628
gcttgctctgaccttgaatgggccttcctagttgggaccaagttttcccgtttagggatcttttctggcttcacctcagacttgtcatatgaggtcaccaagttcaaaggctcatggttgaacctttttaatgtatctcctcgttgcttggagtctagtaacttcttccctgatcatggccatgtctgggacttcggctctgaggatgactttattggctgcctttgcctgcttgttggtttggggaagttcgacagaggtgacaag

SEQ ID NO: 89944 - DNA, 102 bp, Glycine max
  Peptide Sequence Number=SeqID_181629
gctcatgagaaccctagggccttcccttggatctctagcccaatctacttggagtcttctacccaatgcccttgcgggaaggaatgcattaaccgtatcctg

SEQ ID NO: 89945 - DNA, 478 bp, Glycine max
  Peptide Sequence Number=SeqID_181630
gggccagtagtttccttttatcagttcctgggccaccccctgatattagagggcaaccaactgtgcgagcacatccagagagggaggctatcatgcatctactatgcataccggggcaagatttcacccgtgccactgcaaaaagacgagtgtggatcatgcgcaccaacatgaccaattttacatggatatggacgacgttgctatttagtaacattctgcccgggatcgcgcccacaagacgcccagtggacccgaagaagtccaacagggccctggggtttccagctctggttacgggcctctgtcagtcctacagggtgcctgttcccccagcgaggtcatgccatcgtgacatagagatcgtgcccgcaagacacccagtggacccgaagaagtccaacagggtcttgaagttttcaagctctaattacgggcaggcgcagggcaaaacaccacagcagcctggggatggcca

SEQ ID NO: 89946 - DNA, 462 bp, Glycine max
  Peptide Sequence Number=SeqID_181631
cagatgtaccaacgcaataccgattcaacgggattggatcgcctgtacgattttcatttgcacatttagatgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtag

SEQ ID NO: 89947 - DNA, 426 bp, Glycine max
  Peptide Sequence Number=SeqID_181632
atgtgcgtgatgcatatgcgaaaggcgcaacacgggaatgtacactatgacaatattcacaaaatacaagcaaaagggtacgtgacacttatgcatgggagtgtgaaaaatggcacgcagcgtgtccgctccgtgcccctattcaagggacctatatgggagggagctaacaaggcttttagtgataattcccaaggtggtcatagcatgatcacgtccctagtggagtcgccaactgtcgcaacctacccttcggcgggagggcgacgcgtgactcgcgggatgcgtgttccacgaaaggcatacgcgcggagtcgccaccaacgtttatttgaggaaaacgtcggaaaaaccggaaaagacgcgatctatgaacttttaagtgaaaggttcgggagttgtatttacgcacggggaaggtattag

SEQ ID NO: 89948 - DNA, 482 bp, Glycine max
  Peptide Sequence Number=SeqID_181633
atgcccttgcggggtaggattgcatcatttatcttcactgatatcaattacaacaaagtctgctgggaaggtaaaatgttttactctgaccaaaacgtcttcaattaccccatatggtctagtgatggagcggttaaaaaaaggctaagtcatgaagtgctaaaagtgacagttgagctcagctcatcagttggggtaagcgcatccattgctaaacgtggctccagtgcgcttagcacgatagaagaatctggcagagcatcagtatcaaggccgcgcgctaagcgtgagatcagtgagctaagcacaacagttgtcttcagccaggctcagcgcatgactggtgctaagctcaaatccacttactcgacagagacagacacaaagagggaggcagagagagatagagcacaccatagtgcctatttcgggaaaagagctctggaggcagcaaaaggagcagcttttgtagaaagacctag

SEQ ID NO: 89949 - DNA, 153 bp, Glycine max
  Peptide Sequence Number=SeqID_181634
atggaggatggatctttgagcttcaatgaggtccttcaatggcaaaggagaagaagagaggggagacaccatccactagggaataagccaaggaagaaggagcttcaccaccaagaattgccttggataagaagcttgaagatgatgctttaa

SEQ ID NO: 89950 - DNA, 771 bp, Glycine max
  Peptide Sequence Number=SeqID_181635
atgtatggacctaagaatgaaaatggaaatgagaaaagtgtctttcacttaaaattaaaatcaactctcctccctacacccatcccttccctcctgtttcagtctttgttgtcccaccttgttgcaccacgctgcgagttcccttcgttcatctttaccattgttgttgtggtgtcgcctcccactatcatcgtcgccgtcgtcattattgttagaactagaggattgcgtcgggctttaggcagagttttaggaagagccttagggagacatgttcatgaggagcctcaggaaccagttacaaatcatgtagctactgatacaaagggttttccaagcgggccccaagatgcatcaccattgatggattattcttatcatatggcaaccagagtttgggcaggagaggaacgtactgagttgaagttggcatctcatgggaggaaggtagagcaatttggaaggcctggactcgagattgaaggcatagtgactgctacaggattaagttctttgatttcatattcattggacacaggtgacaagggacttttatctgcttttgtagagaggtggcacaaggaaactggtagtttccatttaccggtaatgaaggtgagtataaccctcgatgatgtggcatacttgttacatctacctaatacaggtgccttccttaccgtcgatgctcttgatgtagaccaagtcgtggagttgttagttgagttgcttggagtcagtacacaagaagcaaaagatgagactgagtaa

SEQ ID NO: 89951 - DNA, 270 bp, Glycine max
  Peptide Sequence Number=SeqID_181636
atggatcagactagaaaggatccaagaaactatagagaaagaaaagataaggataaaagttccatcatatgctatgagtgtgagaaaccaggacacttcaagttagaatgccagaccttgataggtcaaatcacaagaaaaggtacttcaaaccaaaggacaagaaatatattcaagggaaatgaaacaccgaaaagcgcaccgggttgtcaagtatttaaaataaaacggagtaatccgagtatcgaactcagggaacttgtttattag

SEQ ID NO: 89952 - DNA, 444 bp, Glycine max
  Peptide Sequence Number=SeqID_181637
atgcctgtaagagggagaagcccctcatttctgctagaaatcgcgatgaacgtgctaagcacaccagctatgcttagttggcttagcgcgcctactgcgctaagcccatgttgtctttttgagaggaagatcctgcctgagagaaatgtcatgatatatcatacagaatttgatgagttcaaggctgagctcgatagaaggaattggcacaaggagctgaccaatttcatggatggaagcattgatgttgcaatcgttaaggagttctatgctaacctttatgattcagaggataactcaccaaaatgctttgaatacttttctgaagacccctgtgatcatagaggagggggaagagctaccttcatactccagattctgtcgtctgaggctagacccacacgaactggcaaccagattatgcatccctgggatgggatttga

SEQ ID NO: 89953 - DNA, 153 bp, Glycine max
  Peptide Sequence Number=SeqID_181638
atggctgtcattaatttagggacgccacacttgtgctcttccagattctctcatcatgctaagtgcattgtaggtgcgcttaacgataaacgcgagctgagcccacaggtttcgcttagtgcgactgctccttttagcacttcaagactttaa

SEQ ID NO: 89954 - DNA, 114 bp, Glycine max
  Peptide Sequence Number=SeqID_181639
atggcatttttccaatgctacttggactacaaggctcaaaacgcacaagtgagcaatgctctcggaaacggaaatgtcacgcacactccagacatcttctcaaagaccgcaacg

SEQ ID NO: 89955 - DNA, 235 bp, Glycine max
  Peptide Sequence Number=SeqID_181640
gcagcctgatggtcacattgatgtggccttggtcaaggagttttatgccaacctctatgatccagaggataaatcccccaggcaggttcgagtgcaaggaaagcttataaagtttgatgctgagtctctgaacaccttcttagagacccccatggttttggagccaggggagaggtacaccacctaccccaggttcagcagcactcacccagaccctcaggagctcgctgcctga

SEQ ID NO: 89956 - DNA, 163 bp, Glycine max
  Peptide Sequence Number=SeqID_181641
tttttgcttccgtgtctcttgcttcctattgaagttatttgtggttctgctcgatggtgtggatagtgctgttagccttcgctttgtggcgtcgagccctgactcaagggggcgtgttgcgagtcccacatcgggtggttcatgccaggacattgctgattaa

SEQ ID NO: 89957 - DNA, 345 bp, Glycine max
  Peptide Sequence Number=SeqID_181642
atgtggtcatttgcaccctttccggagatgtcaacatcttccggtcgagactttttcaagtctcacaagttatctagaactacgagcaagagccttgcttttgtcggccgccccacaagatctgtcatactgaccctgaggtcatgtgacatgcggagacaaaatttggtcattccgcacccctttgccattcagacacagtcgtgtccgatggcgcgcagagacaaaatttggtcattccgcacccctttgccattcagacacagtcgtgtccgatggtacgcagagacaaaatttggtcattctgcaccttttgtctccagaggcggcgggccagcgatttga

SEQ ID NO: 89958 - DNA, 312 bp, Glycine max
  Peptide Sequence Number=SeqID_181643
atggataacgaggagggagtgcaagaacagattaaggccgacatgtcggcctttaaagatcagatggcttctatcacggaagccatgctaaaaattcaaaaatcaatagaagacaatgctacgacaaccacttccaatacagctagggaagcagaaccagtgctacagccagcaatgaacttgggccaggacagaagcgcgacgggcttcaatcggagacttcactccccttaccgctccagacgatttgagccaagcccctaccttcgaggggcaactccctcctcatgccgactatcctctgcaggatga

SEQ ID NO: 89959 - DNA, 859 bp, Glycine max
  Peptide Sequence Number=SeqID_181644
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatatgttttggagtcatctcaataatcgcattgtattgcctaagctcgaattcttaccttgcatcatttgacaacacgcccaaaaccaaatttttagtgccagtcaagtatgagtatgttgtgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 89960 - DNA, 63 bp, Glycine max
  Peptide Sequence Number=SeqID_181645
gcttgtagtgagcttcaaaacaaggacaaggctcaaaagggctatcaaaggaattaattcaag

SEQ ID NO: 89961 - DNA, 441 bp, Glycine max
  Peptide Sequence Number=SeqID_181646
caacattctgcccagcgaccgcaatgccgatctccccctgtggaagtatcagttggtctatgtcgttccgacatagggatcgcacccacaaagacacccagtggacctgaagaagtccaacagggccctggggtttccagctctggttacgggcctctgtcggccctacaggggatcgtgcccgcaaaacactttgttgacccggagaagtccaacagggagtgcctgtcgcccccagcaaggtcatcaggcccccctaccaatcgagctttcatcaagaagtactacgcccccaggcaggcgcagggcgaaacaccacatcagcattgggatgacgcaccgccatcacctctagagttcacctctgctcatccacaaaaaggtttgagtattgcctacaccacatggccgaccaataggcgaccaagtccaaagccaaag

SEQ ID NO: 89962 - DNA, 744 bp, Glycine max
  Peptide Sequence Number=SeqID_181647
atgggaacaaatcaaaccggcaagaggttctaccaagtcaaggtcaaaagcctagatatcaccagcatcaaggaattagggcgaattgcaactgtggtcaaggattcagcaagaggtttggaccgcataaaacagactcggaacggcatagcgggcctaccacagaggtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggagagtccggtggtagctgtcttggcagatctatttgacacatttgaccgaaggtgcgaaaagagtagcgcacggatcatctgttgcttacccgccctctgtgtttggttggtttcccatttgttccaacaagacacaagacatccatgtccgctcctgagccatcgctcgtgtactgaaaagaggagaatagattgggaccagctcttggccgggataggaggtagaacaatcagttggttcccccgatggaaggaaggaaaagaaggagtccttttctcatgtggaagatacccaaacattccgctggtaggaacgaggggttgtattaattacaatcccacgctcgctataagacaactagggtaccccatgaggggagcaccgacggaagaaagcatgtctcctttcctg

SEQ ID NO: 89963 - DNA, 174 bp, Glycine max
  Peptide Sequence Number=SeqID_181648
atggtgaaagttggaacctcttacgtgccgatcaacgtctcattttcgccaaaagttggcccagggcttcccggtatcaacagggacaccaggatttatttattctgcgaagtgatcttccgtcacagtggcttcttcaagcttttcaataccgtcgcctcgagggggggcccg

SEQ ID NO: 89964 - DNA, 903 bp, Glycine max
  Peptide Sequence Number=SeqID_181649
atgttagctatcatcgccaagtaccaagaagagttaggtctagccacggcccacgagcatagaatcgcggatgagtatgctcaagtgtatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaagcagctcatagagaagaacgcggccactgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccaggcacattgcctcaacccaacatcgcagcatcgccaatagttttgtctatggaagggccgcccccggcaactgaagaaaggaggaagctcgatctccttgaggaaagattgagggct

SEQ ID NO: 89965 - DNA, 273 bp, Glycine max
  Peptide Sequence Number=SeqID_181650
atgggtaaagcagaggaggtgcaaaaggtgaaggccgacatggaggccatgaaagagcaaatggccacaatgatggaggccatgatgagcatgaataagataatggaagccgatgcggttgcagtcgccactaccagggctgttgctaaggcgaacccgatgcccccatatgccattgaagggcaagcagttggtgatataccccgcaaaacgctttggagggcccctcagtatcacccacaacccacacccctcacattccacagcgattaa

SEQ ID NO: 89966 - DNA, 853 bp, Glycine max
  Peptide Sequence Number=SeqID_181651
atggcttcggacgacggtttttctgtcattgattatcatgaagttgcacctgaaacaggagcatggcgagacgttgccgaattaaaacagtcaaccagtttgatgtttgattttgtctgtaaccacatgtcagccaaaagcaaatggtttgctaattatcttaaacaaaccccagggtacgacgatttctttattgctgtcgatcctcaaactgacctctccgccgtaacgcgtccgcgcgcattaccgcttcttacacctttcacgcttcatgatggcagcgtacgccacctgtggaccaccttcagtgacgaccaggtcgatctcaatttcgcctcgccacaggtgctgattgcgatggtcgacgtgctactgcattacctgattgaaggggcgcgttacatccggctggatgccgttgggtttatgtggaaaacgcccggaacatgttgcatccaccttgaacaaacgcatctcctcattcagctcttccgcgccattaccgacgtcgttgcacctggcacggtgatcatcacggagaccaacgttccgcatcaagacaacatctcttactttggcaacggtgaaaatgaagcgcagatggtttaccagttctcgctgcctccgctggtactgcatgcggttcatagtcaggatgttcgtgttctcagtgagtgggctgcgtcgctaacgctgccctccacgaacaccacctggttcaacttcctggcctcgcatgacgggattggccttaatccgttacggggaattttacccgaatcagagatcctctccctggttgaaaaacttcagcacgaaggggcgctggttaactggaaaaataacccggatg

SEQ ID NO: 89967 - DNA, 176 bp, Glycine max
  Peptide Sequence Number=SeqID_181652
atgggggtgcaaatagcaaccagacccacttgggccctccagaagattcctccagaaggctgttgcttctggaggaagcaaccttgctcgcctgggcgagctgggaatttcgcgaaggtttcgaccgttcttcgacattcttcatccgttcttcatcattcttcgatcttcaacgg

SEQ ID NO: 89968 - DNA, 216 bp, Glycine max
  Peptide Sequence Number=SeqID_181653
atggtgaaagtggaacctctacgtgccgatcaacgtctcatttcgccaaaagtggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 89969 - DNA, 717 bp, Glycine max
  Peptide Sequence Number=SeqID_181654
atgacttccatctttgaagatctagacactttaatcataaaaaaggcctctagcttcgcggatctagtatttgcgagcgagaggattgaagtaggcctgaaaaggggaaagtttgactatgtcacccctaccggtacaagcaacaaaagattcagagcgattggggcaaagaagaaagaaggagatgcccacgccgtgacctcggctcctacttggccgaaaccccagcacacccctcacgatacttaccagtatacccagcatcatccaagcttttcggcccgtgccggaaacccctccaacttggcgcccatccaacaaaggacatccgttcagccacaaagggctctagctcaaagctcggctcccacgcaacctcgccccgccggcgattccaatcctagcatgagcgccaatccggggaggaaccctccaatgaagaagcttccggagttcgccccaattctgatgtcgtacggggacttgttgccatctttgatcgccaaccaaatggcggtagtgacccccggaaggatttaccggtctcctttccctcggtgtccaaagcttgatcgatgcggggtggctaacattccaagaagacggtccaaatgtaaagacaaatttgcttgccaatcatggaggatcgatagtaaacgcaatagaagagtgtggactgtagaggttgaagcaaatgaaggacgtggtaacctctag

SEQ ID NO: 89970 - DNA, 300 bp, Glycine max
  Peptide Sequence Number=SeqID_181655
atggttcaactaagcacacattgttgcgctaagcccaacatcttcactgtaagttgcaccttaagcattgggcttagcgtggatgatgtgctaagcgccacttcctctctgcgaaaatttattatagttgtgctaagcgcgccatcctgcgctaagccccagattcattctcttgatgttacgctaagcctcacatctcaggctaagcgcatgttgcagagaaattttgtgttgcagaaagcactaagcccagccagccccagatgctcactggacattacaacttcaagttgggcttaa

SEQ ID NO: 89971 - DNA, 217 bp, Glycine max
  Peptide Sequence Number=SeqID_181656
atgtcttggaagaggacacattacttctcaatgcccacggagaaaactatgattatgaggggccaagacatttatagtagccaagacatttatagtagccaagatgaggctactacttcaccttcctttagtgaaagtgaagaagcaaaaggggaaggatctagcgaagaaatctacccccaagaagaaggacaacctttaatggttagggaggagt

SEQ ID NO: 89972 - DNA, 273 bp, Glycine max
  Peptide Sequence Number=SeqID_181657
gattcaacaagcgattctcctcaaatttcagccagcccgtatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtggtcttcgtcatttggaagtgcggtagacagacttttgtggttgatttagggatggccttttgtggataa

SEQ ID NO: 89973 - DNA, 822 bp, Glycine max
  Peptide Sequence Number=SeqID_181658
atggccccgaggaaacttgcctcaaagagatccaggaaggataaagcggccgaaggaaccagttccgctcccgagtatgacagtcaccgctttaggagcgctgaacaccagcagcgcttcgaggccatcaagggatggtcatttctccgggagcgacacgtccagctcaggaacgacgagtataccgatttccaggaggagatagttcgccggcaatgggcatcactagttacccccatggccaagttcgatccagacatagtcctcgaattttatgccaatgcttggcctacagaggagggcgtgcgagatatgagggcctgggtgaggggtcaatggatcctgtttgatgcagatgctatcagccagttcctgggataccctttagtgctggaagagggtcaggagtgcgagtatggccagaggaggaaccggtctgatgggttcgatgaggaggccatcgcccatttgctatgtataccggggcaggattttgcccggactactgccgggagacgggtgcggatcatgcgcaccaacatgaccaccctgactcagatctggatgactttgctgctcagcaacatccagcccagcgatcataattccgacctccccctgccgaagtgtcagctggtgtacgccatcctgacacggatgagcattcacgtggctcagttaatcgctgatgccatctatctatttgcaggtatggcgcctaccaggcaccctctgaacccggataagtccaacagggccctgagatttcctgccttgatcacaggactgctgccagtcgttcggagtccccgtcgcacctag

SEQ ID NO: 89974 - DNA, 318 bp, Glycine max
  Peptide Sequence Number=SeqID_181659
atgttagccatcatcagcaagtatcaagaagaactaagcctagccacaacccacaagcatagagtggcgggcgagtatgcccaagtgtacgcggaaaaggaggctagaggaagggtgatcgactcgttacatcaagaggcaacaatgtggatggaccgatttgctcttactttgaacggaagtcaagaacttccccgattgctagccaaggccaaagcagtggcgaacacctactctgctcccgaggagatccacggacttctcagctattgtcaacatatgatagacttaatcgaacatatgattagaaaccgctag

SEQ ID NO: 89975 - DNA, 393 bp, Glycine max
  Peptide Sequence Number=SeqID_181660
atgaatttaagaggaagacaagtggagatagctgatccattgtgcccattctacaacaatttggatgaagatgcagcgcaccttttcttcaactgcagcaaggtacttcccttgtggtgggagacagtctcatgggtcaaatcagtgggtgctttcccaaaagaatcgaaagaccacttcatgcatcatagcagatcgaatgctacacaaacaaggctttttgtatcactagaggatgatagcaacacactaacagcagtaccagatatcacacagataacagcatcagacaataattccaaccaagaggaaatcatgactacaaatagcagaggcaataacagaccaaaacgcaacacacacaagcccaagtaccttagtgacttcgtataa

SEQ ID NO: 89976 - DNA, 393 bp, Glycine max
  Peptide Sequence Number=SeqID_181661
ccttgcaaagttgaacttaaggatgactcaagcttgctagttgcaacctatcaaccactaccagcagcattcacaaagcaaagcagctgctacaccaaagcaaatagtttctatataacatgctcaaaactaaagtactcaaatcaaaactggagaaacagtgttgggcttggttggaaaaggatgaaagagaggctgagagacaggaaaatgcagagggtacagagaccaacaaagcatgaacagagagtgagaaacaggcatatgcggcttcacgatgcaaaaaacaagggtgaagtagtggcaatatgctgtagcagggggtgggctatgcaatttccttgtgtttatgagaagagtaggcttgaaattcctatggctcacaatgtgtga

SEQ ID NO: 89977 - DNA, 141 bp, Glycine max
  Peptide Sequence Number=SeqID_181662
atgaatgcaaagagaagagaagatatggttggtgtgcttccaaagagaagaatattgatgcagcatgaaaatgatcatcagtgtgaaggaagagtcgcgagttcgagaatgggacttcgggaacttttaggtggaagatag

SEQ ID NO: 89978 - DNA, 324 bp, Glycine max
  Peptide Sequence Number=SeqID_181663
atgaacaactcatccttcttccagattcttcctcgtgctcagccaaggagtgttgcgctcagtggatggctcgctaagccagcagattggcttagcaagaggatgaaaatcaatgaagttaggcataagacagtgtcgcaacctacccatcggcgggagggcgacgcgagggctcacgggtgcgtcttccaagggaggaaaacacacggagtcgccaccaacgtttattcgaggaaaatgtcagaaaaaccggaaaagacgtggtctatgaactttaagtgtgaaaggttcaggagttgtatttacatgcggggaaggtattag

SEQ ID NO: 89979 - DNA, 276 bp, Glycine max
  Peptide Sequence Number=SeqID_181664
atgcatacccaagtgggaaaagggggaggaggttgccgcccagctcacccaggcgagctaggttgcttccaccttaagcaaggaaatgcccagaatcctctagaagggcccagatttgaaaatttctatttacaccctcagcttgataagttaactccccattttgtgttttctttcttttttccttctgaaacctcacgaaactttacggattccacggcgatgggtgttaaacattttgaggtggtcaaacaaaggtcgcatgccatcaaataa

SEQ ID NO: 89980 - DNA, 414 bp, Glycine max
  Peptide Sequence Number=SeqID_181665
atggatgaagatcagcggatgtatgacaacataatgtctgaagaagttgatatgaatgaagaaaataaagaggaaccaggtgtgaatgaagaaaatggagaggagcctagtgtgcatcaacatgctcgatctgttgtgtatgatattggttttgtgggggtgattatgaggtcagacacaaatactgaaattggaggaaggacctcatttgttttaattggttgtgaaaggagtgaacaatataagtccaggaagaaagatttagtacgaaaagttactggcaaatatggttgtccatttaagttgcgagcgaaactagtggtgggaggtgaaggatggatggtgaagttaatatgtgggaatcacaatcatgcattggctaagtcaatagttggacatccatatgttggttga

SEQ ID NO: 89981 - DNA, 369 bp, Glycine max
  Peptide Sequence Number=SeqID_181666
atggtggatggtggaaggccaaaattctgccatataaacatgtcattgtggtctgtggtgccaccacagcgagcctcccttgaaaaatttactattgcgttggcaaaaaatatgccacgccattctgccatgtctttgtctgctgatgcaaggatgagttcgttctccatcacgcggaaaaagacgccgttccagaagcatagagaagaggaggaagcaaagaagaagagagcagaagatgagactgctcgcctgtatgctgagtttgtagagtcatttcaaggagatactactcctgggtcaaagacttttgttcgaggaggaacaattaatcccaatgataaatttaaagatgattctgagggttag

SEQ ID NO: 89982 - DNA, 1641 bp, Glycine max
  Peptide Sequence Number=SeqID_181667
atgagtgatggattttgcggtactcatttgcagatcatggttaggaccagaggattaggtcgtgccttaggtcagcgagtcactgtgactgcggatcacgtcgatgagccagtcatccctgacccagacgttcaggatgacccgatggaggcactagctgctgtggaggacattcatgcggacattcctgcggacgcaggcatagaggcggctgaggatcagcctcagggatttccgggtggtccgagcgacccatctgtgctgacaacgtatgcggatcacgttgcttgcagcgtatggacgggagaggagcgtcctgaattgaagttatcctcgcatgggaggaaggtccatagtttaggctggcctgtccctgccattgagggacttatcgctggtacaggactaagtcctctgatcgggtgttcggtagacaccggcgatcggggacttttgtccgtgtttgtggagcggtggcaccgggagacgtctagtttccatctcccggtgggtgagctcaccatcacattggacgacgtctcctctcttctccatcttcccgttataggcgactttcacgcatttgagcccttgcacgtggatgatgcggttcagatgttggtggacttgctgatggtgtctccagagtctgcttgggctgagacagtccagtgtcgtggacctgcaaccaatgtccatgttgtctacttggaggcccttcgggacctcaatatgacagataggtacgcttggggagtggctgctttggttcatatgtacgaccaactaaacgatgcatccatgagccacagtcgacagcttggcggttacatcacactgctgcagtgctggatttacgagcacttttcctcagttgcggagtccaccgctgatcaggactacgacgagacttctccgcgtgcgtgcaagtggattgcgacgaagaagaccgtgaagagcattcgcacgccgtcgtatagggagcgcctggaccgactccggattccggatgtctgttggatcccgtatggggagcattgggaggtccgagacttccacgtcagatcatgctactccggtctcttgcgctgggggcctgttgctgtgtattaccgaccggagagggtcgtgcggcagtttggttacacacagaccattcctgctcctcctgtcgattcatgggtcttgtatgatgatatacacgacaggtggatgcactacgaggatcatatcgtacctgcaggtgaggtgtacgtggtgccaggggcgtgttccagtgactacatcgactggttcttccgcatctcccatcctttcatgacaccaggccacacaatagatcctctgcctcatggtcacgccccgcagccccgagtcgtccctcaggccccgcagacagatatccctcgtgtgccggagtcaggagcatcgtcgacatctgcggaggagcccagacatgcagtggaagtttgtgatgacattgttaagcggttggagcgccatctgagtctaggggtggtcacgcttggctcatcgacacatgaggtgatcgaagaatgcctcagattggccaggagtgtcacgcaggaccatctagtatacgttaggtgtagacacaggcggcgcactgatcaggcttag

SEQ ID NO: 89983 - DNA, 461 bp, Glycine max
  Peptide Sequence Number=SeqID_181668
ggcacttcgagtcggagtcaacggcattccgggtcataggacacgccaattccttcctccattccctctagatcattgttttcatcagaggaacagcgtatacgtcaaagccttttattctaatttagaaatccttgaaggcactctaatgtctgaagtttatgggattaagatggtcactgaccagtccctattctatgatttaacccaattgccaagtgaaggtgtaccatttgaaggtgcactgattgacgattggaagtttaatttctctgtacatgatgtccgccggttggtttgcaccaaccaagcggatatgaccagaaggctacttgccgattcattggcttttgaaagccgcatcctccattacctaattgttcacatcttgcttccgagatcttcaaaccttgctcaggtttttgaagaagatctcattgttatgtgggcctttcataaag

SEQ ID NO: 89984 - DNA, 209 bp, Glycine max
  Peptide Sequence Number=SeqID_181669
ggtaaggattatggtgagttgggattttggctcaaggcttgtagaacggctggtcatgatacatgtcaggatttggccagcggttcggggataaaggggatgatgcgtgttccacgaaaggaatacgcgcggagtcgccaccaacgtttatttgaggaaaacgtcagaaaaaccggaaaagacgcgatctacgaacttttaagtgaaag

SEQ ID NO: 89985 - DNA, 540 bp, Glycine max
  Peptide Sequence Number=SeqID_181670
atggctccaaaaaatctttccgcgaagagatctaggagggacatcgcggctgaagggaccagtgccgcccccgagtttgatagccaccgtttcaggagcgacgagcaccagcagcgtttcgaggccatcaaaggatggtcgttccacagagagagacgcgtccagctcagggatgatgagtacacagattttcaggaggagattgctcgccaacattggacgtcgctggtcactcccatggctaagtttgacccagatatagtcctggagttttatgctaatgcttggccccagaagagggagtgtgggacatgcgatgccctcagccagttcctgggtaacccgctggtgttagaggaaggccaggagtgcgagtttagtcagaggaggaacagggccgatgggttcgacgaagaggccattgcccagctattatgcataccgggtcaggattttgctcggaccgatgcagaggaggcccgcatggatgaggaaatgacagacttgctcggtttcttgggagggagcggagccacgtga

SEQ ID NO: 89986 - DNA, 252 bp, Glycine max
  Peptide Sequence Number=SeqID_181671
gtgagactagagactgctgctactcctgagagatcacttgagggcacatcacagcctcctactcttgtggcagacctctcctcaccacagcctacagctgacccttccactcatttacttgacataccagaggacccgaccacaccagtcctagcattgaacacctctcctccagctactccagtacttcacttgacagatgaggaggatgctcagactcaggatacacaggatcgatctcaggaattttaa

SEQ ID NO: 89987 - DNA, 354 bp, Glycine max
  Peptide Sequence Number=SeqID_181672
atgatcgttcgaagctttgggttcgatggcccctatgacgtctatcccccacatggaaaaaggccaaggggcgggcatgacattcaggggatgtggcggagcattgacattgtccgcgaacgcttgacatttatggcatttccttacatgggtacaacaatcactttccatattgagccagtaataacctgctctcaggatcttcctggccatagcatgcccattggcatgcgttcaacacgaaccctcatggacttcctcgatcatgtggtttgcttctttggcatccacgcatcacaggagggtcatgtcatgcttttctcttatataagtatggctactgctcatgaataa

SEQ ID NO: 89988 - DNA, 978 bp, Glycine max
  Peptide Sequence Number=SeqID_181673
atggggacaaggggttgcattaattacaatcccatcctcgccataagacaacttggctaccctatgagaggggcaccattagaggaaggcctcacacctattattgcacgagatttcaatagcaccaacgcgggggtgcttcagaaggtctgcaaggcatgggagatgatgcaaaagaaggacaaggaacttagaggcagtagcaacgggcccatcagcggcaaccatggttggttgaaagcctacacacaagatctggattggctcccgaatttgagaaccactaagggggtagaggttgaagctccggaagaggacgaagaggtacatgcccttaagacaaaactcgagaaagcccgaacagtcaaagaaaagttcaagttagcagctattaggatccgaaaggagaacgccgaactgagagatgtaaatatagccaccaccaaggccttagaacaagagaccaagagggcccgtagtgaagaacatggccgaaacaaattccgaggggctctgtggagcagtaacagcgagcttaagctccgaagagaggaaagggaccaatcacgagtagacagtttgatcttgaagaatgaattgaggatttgcctaaggtccaagaggagcttgtctcagcggttatgcgagaccgagaccaacatgttagccatcatcagcaagtaccaagaagaattaaatctagccacggcccacgaccacaaaatggcggacgaatatgcccgagtgtatgcgaaaaaggaggctaaaggaagggtgatggactcgttacatcaagaggcaacgatgtggacggaccaatttgctcttactttgaacgggagtcaagaacttccccgattgctggccaaggccaaagcaatggcagacacctactttgcccccgaggagatccacggactcctcagctattgtcagcatatgatagacttaatggcccatataattaggaaccgctag

SEQ ID NO: 89989 - DNA, 159 bp, Glycine max
  Peptide Sequence Number=SeqID_181674
atgccaaaagttgtagcggatcgtttgatacaggctacgaagatttggatgatgccacttccagtgaaggaagataagtcaggtgcctctgcctctgggcctttgatggaagcttgcttgtggagcttctatggaggctggatctttgagcttcaatga

SEQ ID NO: 89990 - DNA, 423 bp, Glycine max
  Peptide Sequence Number=SeqID_181675
ttgtttgctagccgcgatgaagttttacattgggctcgattggtggcttgtgacattggatttgttgccgtgctttgtctctatgacgtgttggacctgtttaagtctgcctctggtcatgggcccttcaagtgcttcatggtccttgtccttagttgtgtcctcatcactgatgacatgatcctcactaggagcagatcgcttgatacaggctacgaagatttggatgacgccacaaggattaccttgataagtctgagattggttcaacaaggaacccagagagaagctctcaccaaattttatgaaaatgccaaaagtttttttttattgaaaacaaaaaccaatacttatagtgtatctgaacaaaaagataaaaatagacatggaccttctaaacagtttgggccaaaattacgataa

SEQ ID NO: 89991 - DNA, 648 bp, Glycine max
  Peptide Sequence Number=SeqID_181676
atgaccggccctctcgatgagtcgatctcttgttttctcataaaggtggacccttgggtactagtacctatcacctttagaggaccatatgtcctcgccatcagaggactgcacatcctcgcctgcagagggctgcatgccctcgcctttagagggctacgcgtcctcattttcagtgtgctccatattcacaccttagaagaatataagttcctgggccacccccctgatattggagggcgaccaactgtgcgagcacatccagaaagggaggctatcacgcatctagtatgcatactggggcaagatttcccccgtgccgctacaaaaagacgagtgcggaccatgcacaccaacatgaccacccttacgtggatgacgttgctatttagcaacattctacccagcgaccacaatgccaatctccccctgcagatgtaccagttgggatcgcgcccacaagacaccccgtggacccgaagaagtccaatagggccctggggtttccagctctggttacgggcctctgtcagtcctaccgggtgcccgttcccccagcaaggaatcgcacccacaaagacacccagtggacccggagaagtccaacagggccctggggtttccagctctggttacgggcctctgtag

SEQ ID NO: 89992 - DNA, 360 bp, Glycine max
  Peptide Sequence Number=SeqID_181677
atggcagtgccgttaatccatgatcgcgtggtgatggagtgcctagagggagtttgggagacccttgaaggcaatgagaggtgccgattccgtggcacgattcgactcactgctacttcattggtacatccagagccagttcaagtgatagaggtgtcatcctctgaagaggatcctgaggaggacccagaggagttacctcctgagcccgctgtggatgctcttgacttacctgaggatgatgaagacccactccttgatgttgattttccagaggatatcatgtcagcatctgaggcagactctacaaaggggagtggccctggagggatagcgaatagtgaagactcttcatcatag

SEQ ID NO: 89993 - DNA, 117 bp, Glycine max
  Peptide Sequence Number=SeqID_181678
atgaggatactgggctgccttgcggcagtgctttccgtttgtccagagttgggcaagggacgacgatccatcggtcgtgaccctagcctctacttgcatccgtccctaagtacctga

SEQ ID NO: 89994 - DNA, 258 bp, Glycine max
  Peptide Sequence Number=SeqID_181679
atgaagcacttgaagacttatcaaggtaatccttgtggcgtctaccctgacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaagctctacagcctgtatcaagcgatccgccccgtaagattcacatcatcagtgatgaggacataa

SEQ ID NO: 89995 - DNA, 81 bp, Glycine max
  Peptide Sequence Number=SeqID_181680
atgggttcgaaaaaggagatgaaggagaaagattgcactccactaaggtgcaacttgtactttagaactacgcatatctaa

SEQ ID NO: 89996 - DNA, 669 bp, Glycine max
  Peptide Sequence Number=SeqID_181681
atggccgcagcttacgcagaaggtattgcaaggggtgtgccagaaatgaaaaccagaaggaactgcggaatgactgttagcgcgtcgcctcattttggtgcatcaggcgctcagcgattcttcctcacgcacgctggccgccagctcttcgcctgccagctgaagctgatacatctgccagtaacgtcccttggcttccagcagttcacgaatggtatcggcatcaacgatggtggaaagacggtgggcaatcaccaccagcgtcgtatggtcacgcacggccgacagcgcctgctggatggcctgctcggtaccggagtcaatactggctgtcgcttcatccagaatcagaacctgcggcgtttcaatcaacacccgcgccagggcgaggagctgtttttgcccgacggagagattgttcccctgctcgcccagcttcgtattgatcccctcactaaacccgcgcgccagatccgccagctgcactttttccagtacctcccagacctgctcctgcgtgtagtcccgccccagggtcacgttcgcatagaaggtatcggccaggacgaccggatcctgctgcaccatcgcgacgcctttacgcaacacgttgtggctaagagacgcgagcggacgtccgtcgatccggatttcaccgtgcgtaaccgg

SEQ ID NO: 89997 - DNA, 195 bp, Glycine max
  Peptide Sequence Number=SeqID_181682
atgcagagtttaaaacgcgatgtctaccttggagcctacctgaatggtgctttaaatggtcttgatgatgatccacagcctaaatcaaaggctcctgctaggtggattgtcgtcaagtattttaacgatcctagaccattggagccagagagattaaaggtgcttcagatccagtgggcacaatattatctctga

SEQ ID NO: 89998 - DNA, 814 bp, Glycine max
  Peptide Sequence Number=SeqID_181683
caaggaaaagtgggcccagttttgccagactcgcagagacccttcttgggagaagaagctggaggaagctgcacagtcaggaagcgttgatggcgtcatcgaccctccatccccggtcagacgccacgtgaagtggaagatggcccgcacgaagaagacaggggagatgacgactgaggccgcaaaggaaatcgctgagaagattgcaacacagggatcgttcgtcccccatggacgtcaggatgttctcgccgctgctattggacgtctagagcaccctggacgtgttcgtgctgctggagccgcagctgacccaacaaatcagggactagctagaggagtccatcagagagaaagtgacgaggcgggtcatggcatccttcagccacatgcagtcctagcttcagtcgcagatgcaatctcagggacttgcagaaacgatcctgagacgggtgactctgacaggtgcggcttgtacatagaagtagatcctacccgtctggttgccatggggagagtttatgagggatccactgttgttcataacactcctttgttgcctggccaagtaaaggtgagtgtgaaggaggttacagatgcagatgctccagttcctgtacccactgatgaggtttccttagtggggcagacacttcacaccttccttgcttggccgacacatctggtcaagtctttatcacagcatgtagctgtgtctccggaaaaaccacctccgaagctcgatccggaggtcgatgatccgctttatctgatgacattgaccatcccagagcttttcttgaggccttatcag

SEQ ID NO: 89999 - DNA, 391 bp, Glycine max
  Peptide Sequence Number=SeqID_181684
atgaaaaaccttgaaatggatttgatggagccggccatgctttggttgttcagcttaccatgcagagagagtgtgtgtatcccaagtgagcgtgagacacttttgaagattaagaataatctcatagatccttcaaataggctttggtcttggaatcataatcataccaactgttgccactggtatggagtcctctgccacaacgtcacttcccatgttcttcagcttcacctcaacactacgttttctgctgctttctatgatggctactatcacttcgatgaggaagcttatgagaaatcccagtttggtggagagataagtccttgtttggctgatttaaagcatttgaatcacttgaacttgagcggcaattatttccttggagcag

SEQ ID NO: 90000 - DNA, 141 bp, Glycine max
  Peptide Sequence Number=SeqID_181685
atggcttcctcttcaagctccggtggctttgatcgtgcttgcgcgcttagcacaactctgaaccgcttagtgcgcattagtgaatttcggcttagcgcatgcttttctaactcagtggatggactgaagcgatgcgcttag

SEQ ID NO: 90001 - DNA, 420 bp, Glycine max
  Peptide Sequence Number=SeqID_181686
atggcggaaaatcttcacggatttgcttacgaaaacgtctcggacgagttacggaagcgcctcagcttggattttcttcacggaactgattttttttcagaaaatgggggaggagcttgccatccagctcgcccaggcgagctaggttgcttcctccagaagcaaccgccttctgcaggaacatcctggaaggcccaagtgggcctggttcctatttgcaccccctatttactaaatacacccctgcctttttttgctgattcttttttaatgttacggaacctcacggattgcgtaacaatgcttccttttgatttccggcatgttacggaacttcacgtattgtgcaataatgggtgccaagtacctctaagcggtcaagcaaaggttgtatgccatcaaacaatggtcctcggatga

SEQ ID NO: 90002 - DNA, 300 bp, Glycine max
  Peptide Sequence Number=SeqID_181687
atgacagattttgtgagcgtggaagataagacacaaaaagtttatacggataaccactcgggtatttcctcccgtcagcgtgactcaaaagtcagtatgacagaatcttgtgagcgcgcagaagatgacgtaaatctccgcatgtcaacgggcttgtcggccgcgattgacgaagggcagcagaagacgacgttgtctctgcgtgctatcaggctttttcgtcttacagacaacaaaaactttatacggataaccactcgagtatttccgccagtcagcgtgactcaaaagtcagtatga

SEQ ID NO: 90003 - DNA, 195 bp, Glycine max
  Peptide Sequence Number=SeqID_181688
atggaagcgcagacacgaactccacaaacgccaactcgacaatgtggttgcagtgacggaagcgcggcctatcacagaagcacaggcgactttgacacaaggagaaagaagaagaacgatagggttcaagcgcaaggagaaagaagaagaacgatagggttcaagcgcgcgggttgtgcaatttcagaactttaa

SEQ ID NO: 90004 - DNA, 429 bp, Glycine max
  Peptide Sequence Number=SeqID_181689
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaaccggaagacatgcaaaagcaccactggcagcagcactggtaattgatttagaggagttagtcttgaagtcatgcgcgttaaggctaaactga

SEQ ID NO: 90005 - DNA, 549 bp, Glycine max
  Peptide Sequence Number=SeqID_181690
atgaaagaaataagtcaagatgaaaaagagaaaataagggaagaagaaagaaggaaaatactaaaagagttaagaaaagaaaaacatgcctcctatagcagtcataactcttgcaagagactaagtgaagaacttcgtgactattacgaaggaaggcataggtcacatcttagacctcactcccataggagagaaaaggaaagaaagcctaatgaggctaacattaacctcccatacttccacgggaaggacaataaataccaaggtcaaggtatcttaggggtgacaccttctaagcccaaagacgataagggaaagacaatagaaaagcaaccccttaaggctaatatgcaagagaagactagctccataaagtgctttaaatgtcttggaagaggacacattacttctcaatgtcccaccaagaaaaccatgattatgaagggccaagacatttatattagccaagatgaggctactacttcaccttcctgtagtgaaagtgaagaagcaaaaagggaagaatctagtgaagaaatctacccctaa

SEQ ID NO: 90006 - DNA, 1380 bp, Glycine max
  Peptide Sequence Number=SeqID_181691
atgggatttcctcgcctcgatggtgcaggccggcgtgggcatcgccatgctgccggagccggtctgccgctggctggacaaggaaaacctggtctggctgccgctggagccacgcatggagtggaaaatcgggctgatctggcgccagggcagctacctgtcgcacagcgcgcaggcctggatcgcctgctgccgcgactactggccgccgctcaacagcgcttcgagcaagtcgagatcgtgcagcagtttttgcagcgtctcgttgctgattttctgcgtggcgcgcagatggtacagctcgccgcgctcggcgcgcagcgccgtcaggcggaaacgccgctcgaggttttccatcgccagcgcattctcgatgtcgtctttcgaggcgatacgccgccgcagcatgcccgtcacccgcgagctgacctctttcaacacctgcggatcgaggttctcttcggtatcggcaaccaggcgctcttccattttattcacgctctcgatcgccacttcggccgccatggcgatcgccatgcgttcttcctgcttgctggcgctcttgtcggccacctgcacgccgcgcagcagcagcggcaacgccagcacgccgacgatcaacgacagcaggatcaccccggcggcgataaacaccagctgatagcgcgccgggaaggcggtgccgtcgctcagcaacagcggtatcgacagcacaccggccagggtaatcgccccgcgcaccccggcgaacgacgccacccacagctcacgcgtgctgtagtcgccgaactgcagcgggcgctttttcataaagcggttgctggccttcttcattacccacagccaggtgaaacgcagcaccagcagcgcggcgtagatggtggccacgtcggcgaacaggtaccaggtctggatggtcggatccagctccgcctgcaggatggaggtctcaagaatgcccggcagctgcaggcccaacatgatgaataccatgccgttgaacacgaattccagcatcgcccacacgctgttggcgcgcaggcgcatcgccaacggcgcgttgcggatcacgccggactggctgattgtcatccccgccgctaccgccgccaggatgccggaaacgccgatatgttcggcgatcaggtaagaagcgaacggcagcagcagcaggaatacgatctgggtcgccggatcgtcgccgctccagcggctcatcacccgcagcgatttactgtaggtccaggtgaccgccacgccggccagcaggccaccgatcgccactttgagaaactcgagggttgcgccgcccacggtgaacaccatggtgcccatcgccaccgcgatggcgaacttgagcgacaccaggccggacgcgtc

SEQ ID NO: 90007 - DNA, 969 bp, Glycine max
  Peptide Sequence Number=SeqID_181692
atggctacctcaccaaaagaaactgcagcttctggttcacccgcagtaccatcatctccgcaccaggaacaacctgaattcaacatccaacccatccaaataattcctggtcaagcttctgtccctgagaaactggttcccagaagacaacagggagtgaagattgctgaaaaccctagccctgcaacgagtcctagggaagtagacacggagatggacaagaaaatccgcagtattgtgagtagcattctgaaagatgcttctgtgcctgatgctgagaaagatgttccaacatcgtccaccccaaatgtttctgtgcctgatgtcaagaaagatgttccaacatcctccgctccaaatactgaagccctcccttcacccagtgaagaggaatcaacagaagaagaggatcaagcctcagaggagactcctgcaccacgggcaccagaacctgctccaggtgacctcattgacttagaagaagtcgaatctgatgaagaacccattgccaacaggttggcacctggcattgctgaacgattacaaagccgaaaagggaaaactcccatcaagaggtctggacgaatcaaaactatggctcagaagaagagcactccagtcactcctgccacatccagaagaagcaaggctgctatcccctccaagaagaggaaagaaatttcctcatccgattctgatgatgatgtcgaactagatgtctcgacatctaagagggccaagaaatctggaagaaaggtgcctggaaatgttcctgatgcaccattggacaacatctctttccactccattggcaatgctgaaaagtggaaatatgtgtatcaacgcagacttgcggttgaaagagagctgggaagaaatgccttggattgcaaggagaccatggacctcatcaaggctgctggactactgaagacagtcaccaagttgggagactgttatgaaggccta

SEQ ID NO: 90008 - DNA, 153 bp, Glycine max
  Peptide Sequence Number=SeqID_181693
atggaggctggatcattgagcttcaatgaggtccttcaatggaaaaggagacgaggagaggggaggcaccatccactagggaataagccaaggaagaaggagcttcaccaccaagaattgccttcgataagaagcttgaagaggatgctttaa

SEQ ID NO: 90009 - DNA, 285 bp, Glycine max
  Peptide Sequence Number=SeqID_181694
atgaggcaccgaatccctgtgattggtggcataatgaatgtgttgagtagtgcaacaatcttttgtaaaatcacccatgcatccaacatctttatgattcacatacatagcgactcattaggtgttgagggaagaagcccagagtttcaagaacctctggatttaaggtcaaatccttttcaagggggagggaatgatgcaatcctacccccccaagggtattggatagaagactccaagaagattgggccaaagatgcaaaagaaggccctagggttctcatga

SEQ ID NO: 90010 - DNA, 693 bp, Glycine max
  Peptide Sequence Number=SeqID_181695
atggggacaaggggttgcatcagttacaatcccgttcttactataagacaacttggctaccctatgagaggggcaccactagaggaagagctcgcgcctattattgcacgaggtttcaataagaccaacatggaggcgcttcagaaggtccgcaaggcatgggagatggtgcaaaagaaggatacgaaactcagaggcaataacaatgggcccattggcagctaccgtaggtggttgaaagcccgcatgcaaagtttggattggctcccgagtttgagaaccactaaaggggtggaagttgaggctcgagaggaagatgaagaggtgcaggcccatagggcagaattcgagcaagctcaatcagtcaaagaaaggttcaaatcagcagctcttaagatccgaaaggagaatgccgaattgagagacgatgagctaaaggtttgcctaaggtccaagagaagcttgtctcagcatttatgcgagacagagaccaacatgctagccatcatcagcaagtaccaagaagaattaaatctagtcacgacccacgagcataaagtggcggacgagtatgcccgagtgtacgcggaaaaggaggctaggggaagggtgatcgactcgttacatcaagaggcaacaatgtggatggaccggtttgcttttactttgaacgagagtcaagaacttccctga

SEQ ID NO: 90011 - DNA, 267 bp, Glycine max
  Peptide Sequence Number=SeqID_181696
atggtggctgtgggtgatggagaaagtgcttgggacattagaaatgggtttggaagaaagaaaggagaagaaatggcgtttttcctaagctacacgaaagcaaaggctgaacttctagcacactccagatatcttctcaaagatctcaacggtcagatcatggacaactgtcttgtgaagttgcagaccaaatttcgagaagatccaacagttaacgaaggctgggaagcatttttaccgaggcggcttcatgtagctttctcttga

SEQ ID NO: 90012 - DNA, 639 bp, Glycine max
  Peptide Sequence Number=SeqID_181697
atgattcttgaagataagtccatgagcgagtttctgcttaggatcaaagccatttccaaagcacttgctttagtcaaaatttcagtctctcttcaagaacatattgatgctattcttgaaggacttctgcaagactatcattttgtaatctcagttatagaaagtaaatttcaaccactacctattgaagaaggtaaagcattattgctaggtcacgaagctcgactgctgaagtttcgaagactgttaattaggcaaattggcaaaagtgttgttttcaccttctcgataagccaatttgttggcttagcaagcattcctaagcgcgacactcagtggttaagcgcgaggaagaagctagaagaagatgagctatcaggttcgctgagtgcaccactccaggtcatcaagcgcacacctttagctcatccgctaagcgagacaagcgcgctaagccaaaatacagttatgcaccctaagcaattcagatttgagctaagcgtgagtttggcattttttcttgagaagcctctgcttgcacgagagtctagccttggcttgaagcttttgcatgttaaggaagttctagagagagaaaggtccaagttccaaaaagttttgagagattttgctgtgtga

SEQ ID NO: 90013 - DNA, 432 bp, Glycine max
  Peptide Sequence Number=SeqID_181698
atgaaggtccacagtgaagtctttgtcttgaatggaaatgttgactccaacacagagttggtggcagacgagacgggcttgcacaaaattgtgggtactcccaccgtcaatcagaacaaccacgggtttattggtgatccgactcaacattctgtgggtctctggggccaagggtgcatcctcatgttcggcaatgaggatgaagaatttagaggagcaatggtggccacgggagaacttctcgtcacggttgaagtagagtcctctctctcggcgtatcaccatttcctcaggaaaaacggctgcgaggaggatgacgatgatcagccagtttctcttcgtgcaactaggcgagggctgccacatgcgtcatggttaagggctaagcaacttgaacctcacgacgaatctaaggagataagcccgagatga

SEQ ID NO: 90014 - DNA, 432 bp, Glycine max
  Peptide Sequence Number=SeqID_181699
atggcagcgcagttcatccatgaccgagtggagatggagtgcctagagggagtttgggagatcctcgaaggcaatgcgaggtgccgattctgtggcacgatccgactcacggctacttcgttggtacatccagaggaaccagcacgcacgcttcagcgcactgtggaatggatattacctacacctactccatatcgtctagtggagccaatccaagtgatcaaggtgacgtcatccgaggaagaccctgaggaggacccagaggagctacctcctgagcctgctgtggatgttcttgactttctagagggtgatgaggacccactcccagaggtggattctcccgaggacgtcatgtcggcatctgaggcagactctatggaggagagcggccctggaaagatggcgactagtggaggctcttcatcatag

SEQ ID NO: 90015 - DNA, 528 bp, Glycine max
  Peptide Sequence Number=SeqID_181700
atgaggataagggctacgtgggagtacgtgagctcagttaagggtgggcaactagggatggtgggttcatgcgtgatttgtggatgtggagagttgttttgcaccatcgcccgatcgccacctagtaccacatgtgacggagtggtacctagagatatgtcgcaggggtcaggagaccttggggacgtcaggcgagctcctggcagtcaaccgataaaagaacaaagaccacaaagcaaggaggcttatgtggtggctggccagctgcttagaaatgggactggaatgttgaaggggcctctggtaatcgattaccagtgctgtgtaatcgattacacagaggaacagctgtgtaattcgagtttggcctctggtaatcgattaccaaggctgtgtaatcgattactgatgcaatcctaccccgcaagggcattgggtagaagactccaagtagattgggctagagatccaagggaaggccctaggattctcatgagccttagggtagatttcgagcccatgagctaa

SEQ ID NO: 90016 - DNA, 369 bp, Glycine max
  Peptide Sequence Number=SeqID_181701
atgacggcacctcctgactctattccttcagtagagcagtttaatgagatggtagccttcccaggacctaaccttctcttcatagggaagacgaaggccaccatcccagagccatttgatataggagaagaggcagaggagacacaggtgagacaggtagctgctgccactcctgagcgatcccttgaggctacttcagagccttctgcaccagtggtaaacccaccctcacctcagcctgcagcagacccctccactcctcttctacaaatgccaaaggactcgactacaccagtcctagctgtggacacttctcctccaactacctcaatgcttcagctgacagatgaggaggatggtcagacatag

SEQ ID NO: 90017 - DNA, 405 bp, Glycine max
  Peptide Sequence Number=SeqID_181702
atgtttgtcccaaagggtgctaagtacctcgaagcggtcaaacaaaggttacatgccatgaaacaatggtccccagacgaaattaggggtccttataatcaacaaggacagtggaggacacaccctggcaaccagttcaacaaagaccagagtgggacttcaaacaggccaatcccacaagggcctaacatattccagaggactactaagctggaggagatcttgactcagtttatgcaggtgacaatgtcaaatcataaaagcactgagacaacactaaataaccttgaggtccagatgggacaactggccaagcagatagctgacaagtcatccaacaattttgtggcaaatacagaacagaatcccaaggaaggaatgcaaaacttcgatgacaaggagtaa

SEQ ID NO: 90018 - DNA, 360 bp, Glycine max
  Peptide Sequence Number=SeqID_181703
atggactctagagatggtggctattgtagaggtggtggtggtgtgtctgtggccggttgctactactggtcttgccccagctcctttgtctgccttggcatgcagtatttctcaatgaacgacctattaatgggagataagttaggctacacaaacactgatctaggtcaaaatagcataaaccagctagcatttaggcagccggagatcagagttatggttgttgggaaggatgttgctgaggagaagcatcattcagatctgtgtctaggtggtcatgctagtgcgcatgatccacacccgccttggatcttcttcatcaacggagtcctttgcttcttgaagtttaatggcaattga

SEQ ID NO: 90019 - DNA, 382 bp, Glycine max
  Peptide Sequence Number=SeqID_181704
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccctaatgaggatgtcccatatgttcttaagattggactgattcatttgcttccaaagtttcatggccttgcag

SEQ ID NO: 90020 - DNA, 1212 bp, Glycine max
  Peptide Sequence Number=SeqID_181705
atgcggggcctcacgctttcctccgcattgatcttccttctgatgacgggaagcgcgctggcgcaggtcgattccagcggcaatggcaacacggttccgcaattgcagaaccccgccgatgagaccatcgaaatcggcctttcgaccgaaaccatcgccatcacatcgaatttcggcggcaccgatctcacaatattcggcgccctcgacaatgccgatcccacgatccagcgacagggccgttacgacatcatcgtggtgctgcaaggcccgtcccgcgatctggtcgtgcgcaagaaggaccgttatctcggcgtttgggtgaatgcggtttcagagaccttcatgggggtcccgctctcatactcgctggcatccacccgcaatttgcaggacattaccgacgagaaaacctatcgccagctttccgtgggcgtgcgcaatttctatctcgtgccggaagaccctgccagtctgtcgggcaatattccgagatttggcaatgaactgcgcgagatgaaaatccgccagggcctctatacgcagcgcatcggtggcgtggagttcatttcgcgcacgctgttccgcgccacgctgaacctccccgccaacgtgccggtgggtcgccacaaggcccgggcgcttctgtttcgcaacggcgttttcctgcgggaagccaatgccagcctcgaaatcgtcaaggcgggtttcgagcagagcatctacaacgcggcccatcagaacagctttctctacggcctgtttgccgttttccttgccgtcttcaccggatggttcgggcgcattctgttccggtctcgtcagcgaacagtcctcggaaagcgcgatccaaaatattcagcgcacccgtgccctgcaatctcgccctgcccggccttgcgcgatggttcatgccggaaggtaagcggcccgactgccagttcctccacacaatcgcccggccgcccccaccgggcgatccggatcatgattgccagtgatccagaaccagtcccgatgctccataagcgatttcagccgggatggaataaagcgacggcaggcgttcgctggccgtcgcatcgtgaaaactgtcaccaagggctgatgacgggttcgcggctgatagcgcgcaatggccagcgccagcatgtcgagcgtcgccgctgtgtcataaggcgggatgagctggccgcgccgggcaaaggatga

SEQ ID NO: 90021 - DNA, 447 bp, Glycine max
  Peptide Sequence Number=SeqID_181706
atgggagcccgttgccatcagacaccgaccagagagggtcatgcgccagtttggatacgtctagagtattcctgtagaggctgttgtttcatgggtgtcattgaagaaatagacgatagctggatgcactactcagaccatcttgcatcagcaggtgagatatgtcttgtgccaggtcagtgtgcgcccgactacatggattggttcttcgtccccgagccaccaacaacattgacacatgcccgttctgatgtggaccagactagacatgcagtggatgcttgccatgcgatcgctgaaaggttggagcgtctactcaaccttaggatagtcacggttggcacagagacacacgaggtcatggaacaatgcatcaagattgccaggggtgtcatagaagaccacattgtgtatgtgaggtctcgacgtaggcggcgcacggattag

SEQ ID NO: 90022 - DNA, 225 bp, Glycine max
  Peptide Sequence Number=SeqID_181707
atgccgatctccccctgcgaaagtatcggttggtttgtgccgttccaacatagggatcgtgcccacaacacactcggtggacccggaggagcccaacagggccctggggtttccagctctagttacgggcctctctgtcagtcctacagggtgcccgttccccctaccaagggatcacgcccgcaagacaccctgtggacccgaagaagtccaacatggtcctag

SEQ ID NO: 90023 - DNA, 570 bp, Glycine max
  Peptide Sequence Number=SeqID_181708
atggcgtattccgagttgtggccctcattattggaaaatcatttggtggtggccatacccggaaaggtcttccagccaccataccccaagtggatgacgttgctgctcaacaacgtcctgcccagcgatcataactccgacctccctttgctgaagtgtcaactggtgtatgccatcctgacacggatgagcgtccatgtggctcaattgatcactgacgccatctatttatttgcaggtatgccacctaccaggcacccgctagacccggataagtctaacagggccttggggtttccagcattgatcacaggtctctgccagtcattcggggttcccgtcacacctagtaaggtgattcgaccgccaatcacccgggccttcattgagaagtattgcacgcctagacagacgcagggtgatgcaccgcaggccgcagacgcgccgccaccacctcatcaggctaatccagctgggtcatttggcatggagcgatatttacagtacttggttcgccagcaggcggccaaccacagggggcaggtgcagatacatgagtgtctctactag

SEQ ID NO: 90024 - DNA, 363 bp, Glycine max
  Peptide Sequence Number=SeqID_181709
atgccaatctccccctgcagatgtatcagttgggatagcgcccacaagacgcccagtggcccaaagaagtccaacagggccctggggtttccagctctggttatgggcctccgtagtcctacagggtgcccgtccccccagcgaggtcatgccatcgtgacatacgtaagatcgcgcccacaagacacccagtggacccgaagaagtccaacagggccttggagttgccaagctctaattacgggcctctgtcagttctacgaagttcctgtcacccccagcaaggtcatcaggccccctactaatcgagctttcatcaagaagtactgcgccctcaggcaggcacagggcgagacaccatag

SEQ ID NO: 90025 - DNA, 288 bp, Glycine max
  Peptide Sequence Number=SeqID_181710
atggggatcgcaccacaagacacccagtggacctggaaaagtccaacagggccctggggtttccagctctggttacgggcctctatcagtcctatagggtgcccgtacccccccgacaagggatcgcgcctgcaagacacccagtggacccgaagaaagtacctgtcacctccagcaagggcatcaggtccccaactaatcgtgcttttatctagaagtgttgcgcccccaggcaggcgcagggcgaaacaccacagcagcattgggatggccggtagcgggcaatag

SEQ ID NO: 90026 - DNA, 387 bp, Glycine max
  Peptide Sequence Number=SeqID_181711
atgacttacgaccacccttttgttcatccagaggcggcgggcccgatgacaagcagagacaaaatttggtcattctgcacccttgtgtcatccagaggcggcgggcccgatgacacgcggagataccttacggttatctgcacccttgtgtcatccagaggcagcgggctcgatgatacgcagagataccttatggttatctgcacccttgtgtcatccagaggcggcaggcccgatgacacgcggagataccttacggttatccgcacccttgtgtcatccagaggcggcgggcccgatgatacgcggaaatacccgagtggttatccgtataaactttcttttgctatctgtaagacagaacgcttgatagcatgcagagactga

SEQ ID NO: 90027 - DNA, 375 bp, Glycine max
  Peptide Sequence Number=SeqID_181712
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccccccggacatcagcgctggcaagtgtagcggttccccctgcgcgtaaccaccacacccccccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 90028 - DNA, 660 bp, Glycine max
  Peptide Sequence Number=SeqID_181713
atgtcctcaccttcagaggactacatgtcctcacctttagaggactacacgtcctcccctttaggggactacacgtcctcccctttagagggctgcacgccttcgccttcaaggactatgcgtcctcaccttcatagggctacacaccctcacggctacacgcgctcgcctttagaggacaagggctacacgtcctcgcctatagaggactacacgtcctcccctttagagggctacacgtcctcgcattcagagcacaacacgtcctcgccttcagaggactacacgtcctcgccttcaaagggctacatgtcctcacctttagaggactacaagtcttggcctttagaggactacacatcctcaccttcagagggctacatgccctcgccttcagagcactacacatccttgctttcaaatggctacatgccctctccttcagaggactacacgtcctcgccttttgaggactacacgtcctcacctttagaggactacacgtcctcgccttcagagggctacacgtcctcaccttcaggggactacacgtcctcgccttcagaggactactcgtctcaccttcagagggttgcacgccctcgccttcatagggctacacgccctctccttcagacgactacacgtcctcgcctttag

SEQ ID NO: 90029 - DNA, 716 bp, Glycine max
  Peptide Sequence Number=SeqID_181714
tgttggctgaaaacccggttgcgctggtagacaaagtggtcgataagaaaggcacacgcaaagtcgcgcaggcttacctggagttccatttttcaccacaaggccaggcgattgctgccaagcattatttgcgtccgcaagaaggaatcatcatgacacaacgtcaacctaaccaggagccacaccacgtcatacagttacgtgccgaattaaagcaggcactgtcgctggacctagaggagctggggctgctggaagccagttcgggcgaatatgagagcacctttatcggcgtgcacctcaaaaccgctttccagccgatttatgatgccaaacaaggagatatctatggctacgaagccctgattcgcccatccttgtttggtacgctgggcagcacgccagagttcgcattcacctatgccgagcaatccggcaagctggtgcagtttgaccgagtatgccgctcgcaacacgtgctgaactaccgtgccatccatcaggaaaacggcttgctgtttttgaacgtgcatcccaagttgttgctggaagtcagtgcacacggcaaggtgtttgagcagattttgcataaatattctgtgcctacacacagagtggtgctcgagattaatgagtcgttaatcgagcaggataaacacctgatttcagccattgagaactatcgttcactgggttaccgcattgcgtttgaccat

SEQ ID NO: 90030 - DNA, 405 bp, Glycine max
  Peptide Sequence Number=SeqID_181715
atggtgaaagttggaacctcttacgtgccgatcaacgtctcattttcgccaaaagtggcccagggcttcccggtatcaacagggacaccaggatttatttatttttgcgaagtgatcttccgtcaccaggtgctccagtggcttctgtttctatcagctgtccctcctgttcagctactgacgggggtggtgcgtaacgggcaaaagcaccgcccggacatcagcgctggcaagtgtagcggtcccgctgcgcgtaaccaccacaccccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 90031 - DNA, 248 bp, Glycine max
  Peptide Sequence Number=SeqID_181716
actttgtaccttacacttcgaggttatatcgtgcacaatggaatgtcctgaaactcctccatgatatgcacatgttgcgttcaagtcgtatcctcgaaaaaatggaggctttttgctgcaaaattccttccttggttggtgttttggtttgtgctaaagggatgacctttgtggatgactgggtggtgggtaatgagaagggtcgatattggctgagcgatgacattattgggctggggatcctctag

SEQ ID NO: 90032 - DNA, 192 bp, Glycine max
  Peptide Sequence Number=SeqID_181717
atgtctgaagaagttgatatgaatgttaaaaatgagaaagatgctggtgtgaaagtagaacacgttaattgttctgatacctttaatacttctcagaccttctttgaattgtgttatagttgtttgctacccgtgatgaagtcttacattgggcttgagaagtggctcaagaaattggatttgttgtcgtga

SEQ ID NO: 90033 - DNA, 474 bp, Glycine max
  Peptide Sequence Number=SeqID_181718
atggcttccatgatggatgccatgttaggaatgagacaactcatggagaataacatggccactgctgccgctgttagttcggttgccgaagcagacccaactctcccagctaccgcgcaccatcctctcccaaatgtggtacgacgagaaaaaaccacactggggcacatcagcaaacccatttgggatacaactggatggcttacccttatggattaccacctaattacatgccaccagtcatgcgtgatgacgcgggtcatgttccttccctcatccttgaaggggagcctcctcgacagtcggacgaggttcacgaggatcatagagagtatgcctaaggagacatcgatttctaccccccggtccccgtcgaggggccggcacccaacatactgcctcagcccaacctcccagtacaaccaatattcttgtccacagaaggatcacccccagcagtggaagaaagaatga

SEQ ID NO: 90034 - DNA, 273 bp, Glycine max
  Peptide Sequence Number=SeqID_181719
tgaagaagcaaaaggggaagaatctagtgaagagatctacccccaagaagaaggacaacctttaatggttaaggatgagtgtaaggagacacttgttagcattgccacatctcttaggcttgagtttattcctcaagtaaaggagttgttggatgagggtgttgagggaaggagcccagagtatgaagaacctcgggatttgaggtcaaatcctttccaaggtgtagggaatgatgcaatcctacccgcaagggcattggtagaagactccaa

SEQ ID NO: 90035 - DNA, 396 bp, Glycine max
  Peptide Sequence Number=SeqID_181720
atggaaacctgtcccgcggtggaagagttacttcaacggctcatggactgggggcagctcgaagtgtccaagggagatagggaagaaccacagatttgcatgcagtcggaagaaaagaaggttcccccaacccccaaagccctagtaatatgtttcactaggaatgggaccggctccaggcccatgtaccccccgatagcgcccaagccaacgccatttgcatatcaaagcaataaggtcattccgtggaagtatacccctcccgcttttggagaaagagttgcaatcgaagttgactccttgtcagccaaggtgaccaacatcaccggccttagtggcataacccacagtggttgggtgttcgctccccctcactcggcgaaacttccctcctag

SEQ ID NO: 90036 - DNA, 642 bp, Glycine max
  Peptide Sequence Number=SeqID_181721
atggaggctagtttgtgcattccgggcaagggctttattctaaacatggagggccaaccatggaagcttctcagaaaagatcttaccaccctggctcagacatggagcgtcttctcgtactcaaacctagctcatacatccctcatttcagatttgaacacagatagagctaggtcggtctatggcttaatcacaaggatggacatgaacattggcggtttgatctctagacaaatgaccatgatggctcaatctaactcttctcgtttaggcttcccagctttaatcacatccttgtgtagatcaaggggagttggatctgatgctctcacctcctacgaaaacctaaggctggaactagctcagcaaaggccaattatgagtgtagagcagttcatgaaaaggtggcctggcctggagcccgaccttctttccatcatccctgaagctgttgaattttcaaaaagaaaattagagacgagatccaatgaggttgctcatcctggaccagtgccagtaccagctgatgtaccatttccaggggctctggacacttctcctccaactacttcagtattgcatctgacagataaggaggatgttcaggcacaggatacccaagaccagttacaagaattttga

SEQ ID NO: 90037 - DNA, 221 bp, Glycine max
  Peptide Sequence Number=SeqID_181722
atgacggcaaaagctgcagaagagaatgttagtcttcgtaggtcagtgggctcgtttgcccctggtgctgaagacgatgtcagtctacgcgcgtcaatggactcgtttgcccctggtgaagaagacgatgttggtctccgcgcgtcaacgggctcgtttcccctggttgacgataggtgcgggaaccataaggtaacccagcatgtcacctgtgttcacgg

SEQ ID NO: 90038 - DNA, 228 bp, Glycine max
  Peptide Sequence Number=SeqID_181723
atggctccgaaacacatggagcagttgacgcaaaaaatcagggaccagctggaggagtcgatcacagaaaaagtgactcgacaaatgcaatctcaggtactcacactacctcctgagcctgtagatttttggtcgttcagctactcatgtcagacaaaggaaaatgttgttatctggttttgttcgttgcataataggctagacttcgacaaaagtgaaaggaattaa

SEQ ID NO: 90039 - DNA, 360 bp, Glycine max
  Peptide Sequence Number=SeqID_181724
atgtctatttctattattaccaaaatcattgagaggtatcgccaatgtcgttacagcaagtcacacactggtgattcattggaacacgattcacagagcgcataccatgaattcttgaaattaagagcgaaatatgaatctcttgagcggacacaaaggcattttcaaggagaagaccttgagccacttagctttaaagatttgcagagcctggagaagcaactagacataacgctcgcactaactcgacagcaccaaacgaagaaactcatggcacgagcggatgaattacgcgaaaaggacctcaacatgcttcatttttctcatggttcctcgccatgtgggactttctacacctag

SEQ ID NO: 90040 - DNA, 243 bp, Glycine max
  Peptide Sequence Number=SeqID_181725
atggcgagttcagtgcgaaacggatgcgtgacaggtaaaccgctagtacggctggcgacttcgcctctggtggatctcgccacctctactggcgagtcagccagtggtttcacaaaccgctggtttgactggcgactcgcaagtgcaggaggtgcagtggtagggttgctttttcaaagaaaaggaagttgcaactcccattggcgagttaaggccaagttgcaactcccattgacaagttag

SEQ ID NO: 90041 - DNA, 294 bp, Glycine max
  Peptide Sequence Number=SeqID_181726
atgaaccaaattgaagagatcttcaggaaaggaggaagggggaaaactagatctccaacaacattgatgaccttgtcgacttccaatcctagtgaagtggagagaatcaatgctggtggctggtggagaggatcattgctggtggatggtggagaggatcgatgcaagggacagagatgtcgagagaatggttgtagtcacttggagcagcaccagcggctgcagttgcaaggagcgacgctggtgatgcgtgaagagagaaaaggttttggagagaaaggtttggacgtgtga

SEQ ID NO: 90042 - DNA, 422 bp, Glycine max
  Peptide Sequence Number=SeqID_181727
atgaagcagctcaagcgtgaagaggcccgaaagcatgatgccgagctctacctcaatcgactccgcatcgctcaaggcttggcattgtcgatcgagtgtgggccatgtgtcgtcactgccgaagctagaggattttctcagcaactcctccgtcgtgatgtgctactcggaccaccaccactgcttaggaattatgtcccaccgaagtccccagcaaggatttcgatgtcatcgagcctcacggtagcggtgcgcgggaacgaccactccatcaacggttgggccatggcggagcaaggcctggtccttgacatgcatgccatcatggtccttgacactttggcttcggagccgagacggaacacggctcaacgagagaaaggaagattcggaattgaaaaaaccctaggaggagcacgcta

SEQ ID NO: 90043 - DNA, 1149 bp, Glycine max
  Peptide Sequence Number=SeqID_181728
atggccatagagtgcataacaaatatacaatcaatgtctcaaccacaaaagcaccaccaagagcacaaagaagatgaagcaccattggtttttgatgcctcacttctcaggcaccaactcaacctaccaaaacagttcatttggcctgatgaggaaaagccatgcatgaatgtgcctgagcttggtgtccctctcattgacttgggggggttcctctctggtgaccctgttgcaacaatggaggctgcaaggatagttggtgaggcatgccaaaagcatggtttctttcttgtggtgaaccatgggattgatgccaacttaatctctaatgctcatagctacatggatgacttctttgaggttcctctgtctcagaaacagagggctcagaggaaaacaggggaacactgtggttatgctagtagcttcactggcaggttctcttcaaagcttccatggaaagagacactttcttttcagtactcggctgaggaaaattcatccactattgtcaaagactacttgtgcaacacattggagaaagagtttgagcaatttgggagggtttaccaggactattgtgatgccatgagcaatctttctttggggataatggaacttttgggaatgagtcttggagttggtaaagcatgttttagagagttctttgaagagaataactcaataatgaggctcaattactaccctccttgtcaaaagcctgacctcactttgggcactggacctcactgtgacccaacatctttgaccattcttcaccaagaccaagtgggaggcctccaagtttttgttgacaatgagtggcattccattagcccaaatttcaatgcttttgttgtcaacataggtgacaccttcatggctctttcaaatggaaggtacaagagttgcttgcatagggcagtggtgaacagcaagaccacaagaaaatctcttgctttctttttgtgtccaaaaggtgataaggtggttagtccaccaagtgaattggtggatgatttgacaccaaggatataccctgattttacatggcctatgctgcttgagtttactcagaaacattatagagctgacatgaaaacccttgaggcattcaccaactggcttcttcaacggaaaatgagctga

SEQ ID NO: 90044 - DNA, 618 bp, Glycine max
  Peptide Sequence Number=SeqID_181729
atggagagccttcttcgatgtcgcttcctccatgccaaacgcaacaagtttggtcttgaccgtgctagggtgtggtggcacgacaaaatggcttggggtgggtgggcagggccacacgaagaagagagattgcacagaaaaataatggactatcctcggaattatttaaattttgggcctgatttgacccaaaacgaagtcggaatgcttctgcatgaagaagtgaacttaagatggaaaacaacttggtgtggtattgcctggtccttgtggaacgttggaaacaacaaagtttttagagggaaagctttcaataaagatgaagctttgcaaaagatcatgtttcatgcatgggagtggcttagaacgtacaattctagcttcctttattcattctcccagtggtcatccaatcctggagcctgcataaaaaatcgatcaactttagctccaacagttgtgtggcttggatttggaacagctttggtgtggtttgggaaggctaacgtgatacgtgcatgtggtggtgtaattagaatgctttgtgctttaatctctgcaggatatgtaatattgccgttgatagataaatatgtacatgtggttggtgtggcctaa

SEQ ID NO: 90045 - DNA, 345 bp, Glycine max
  Peptide Sequence Number=SeqID_181730
atgtcggggtatcatgtggttattcacacctttttgttatctagagacggcaagtccgatgacgtgcggggggacgacaagtacgatggcatgcgggggtaccgtatggttatccgcacctttggtcatctagagacggctagtccgatgacatgcggggacggcgagttcgatgacatgcgggggtaccgtatggttatccgcacctttcatcaaccaggggcaaacaagcccgttgacgcgcagggactaacatcgtcctctgcacaattcatcatccagggggcaagcaagcccgttgacgtgcagggactaacatcgtcttctgcaccttttttcatctag

SEQ ID NO: 90046 - DNA, 249 bp, Glycine max
  Peptide Sequence Number=SeqID_181731
atgaagcttgcttctacaaaggatggtccagccatcagcacaaaactgatgaagcttgattttgccttggttagtttcaacttgaagattaggaatagtgtctccgatggtaagacctggcattttggatgcagagaagttacttgtgtcattgatcagaacgtgaagctcaataaagaggaatttaggtatgatgatggattcaactactacaagaaatcagattttgatgcctctttaagcaagtaa

SEQ ID NO: 90047 - DNA, 171 bp, Glycine max
  Peptide Sequence Number=SeqID_181732
atggatgtcttgtgtcttgttggaacaagtgtgaaaccaaccaaacacagagggcgggcaaggaaagcgtcgattgctgctaggtctatcaaaccatccacgtttggaaagaggacgaccccaaaaattagcaaagctaacacatccataaacgggactcagtctccttga

SEQ ID NO: 90048 - DNA, 429 bp, Glycine max
  Peptide Sequence Number=SeqID_181733
cctgcccaccctggaaacggctcagccggaggtaggggacagcgggctggaagagcaccgcacgtcgcgtggtgtccggtgcgcccccggcggcccttgaaaatccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 90049 - DNA, 213 bp, Glycine max
  Peptide Sequence Number=SeqID_181734
atgtggtaccatccccaagaaaatagcctaagcgtgtccacacgacactctcacttaggaaaactaggcagtaagtgtcgaggtcaccctatgatgcaatcctaccccccaagggcattggatagcagactccaagaagattgggccaaagatgcaagagaaggccctagggttctcatgagccttagggtagatttcgggcccatgggctaa

SEQ ID NO: 90050 - DNA, 731 bp, Glycine max
  Peptide Sequence Number=SeqID_181735
gtgcttgcgcatctggcggtggtctttcagcgtttgctgggtgtcccgcaccatttgtgggttgccgcacagcatcacgtggctggtttcggcgtcgatggtcaagccgatcgccgcttccagccggccgtcctcgatcagcgctggtacgcggccgcgctgctgcagttgctgcatcagcggcaggtagctcaggtcacgcgcaaagcgcgcggcgtgcaccagcaccaggggccgatggcggtgccggtcgccagcatccacagcgtgtcgcagtcgggcacctcgtccagcacgaagaagccggcggcttctttggttaccatcacgtccgagcccggctgcagctgattgaggcgcgggctcagtttgccttctggcacggtgaccagatagaactccagattggcgtcgtcgggggcattgacgtaggagtaggcgcgctgcacccgttcgccgtcgatctccagcgccagcttggcgaattgcccggcggtgaaaggatcgatgggggcattgaccaccaggctgaacagcccgtcggtccattgttttacctgcgtaaccttgccgcggtgaaacagctgcagctcggaattgcacaggctactgcagctggagccggccacgccgatcgggcagtggttttccaccagcagcgcgccgtgcgggtggtcgagcaattcagccatgtaaccgtcatgttgccgcaggcgcaccagtcgggctaa

SEQ ID NO: 90051 - DNA, 237 bp, Glycine max
  Peptide Sequence Number=SeqID_181736
atgagtgagataggaaggtttgggggtttgagaatggaggaacgtcgcaaggaggaaggggctgcacaggggtttctgaaaaacgtgatatttatagaccaggacgcttggtggaggcagcctactggtaatcgattacatgaagactgtaatcgattacaggccatctgttctagcgtaattgattacagtattcatgtaatcgattaccagaacaaaacaatagccttttcctaa

SEQ ID NO: 90052 - DNA, 228 bp, Glycine max
  Peptide Sequence Number=SeqID_181737
atgggtcagctccagcgacaagcctttcgcaaagcttatggagttagaccgcggaaagcaagtcgaaaatggggtggttggggtaccaagaaaatttttggaagcaaaggcaaaattcttggcaagtcaaggcgaatgggccccattcatggacatcctggcacttttgacattcggggtggtcctctttccaaatgtggatgggttggtggaccgggcagcgattga

SEQ ID NO: 90053 - DNA, 447 bp, Glycine max
  Peptide Sequence Number=SeqID_181738
atgagtgaccaagaagaagtacaggaacagatgaaagttaacatgtcggctttgaaggaacaaatgacttccataatggatgccatgctgggaatgaaacaacttttggagagtaacgcggtcaccgctgccgctgttagttcggctgccgaggcagacccgactcttcctacagctgcgccccaccctattccaaatatggtgggacgagagaaaagcatgccgaggcacgttagcaacccccatctgcagtacaaccaaggagcttacccttatggtttaccacctaattacacaccaccagtcatacgtgacgatgcgggtcacattccttccctcatacttgaaggggagcctcctcgacatccggacatggtccacgaggatcatcgagagcatgctcagggagacatcgactcctactcctcgtttcccactgaggggcca

SEQ ID NO: 90054 - DNA, 360 bp, Glycine max
  Peptide Sequence Number=SeqID_181739
atgttgatgttggttgacttactactggtctcaggagaggtagacagggccgagacagcacattgtcatggaccatatatacgcctatcatggctacgagatatatatcagcgcagatgtcaggccggacattggacagctatagctcgtgcctatctttttcatcttctaggttgcactctttttgctaacaagagtgccacccatgttcatgttgtcttcttagacgctctgtgtgacctcggtcagactgggaggtatgcatggggagttgctgccctggtgcatatgtacgatcatttgaatgatgcttgtatcagcaccagccgacagcttgttggttacatcaccctcttacag

SEQ ID NO: 90055 - DNA, 457 bp, Glycine max
  Peptide Sequence Number=SeqID_181740
gaatggggtggtagggataccaaggcagtgcttagaggaaagggccaaagctttggcggatcaaggaaagtggacttcattcgttgatattctagcactattggtgttcaagatcgtactctttccaaatgtggacgggctagtagatttagcagcaatcgacgcttttcttgcttatcactatagcaaggaaagcccagacattgctattttggccgatgcctatgacatattcaacctgagatgcgaaaagagcaatgcgagaattgtctgttgtacacccgctctttatgtatggattcccaaacatccctttgatgggaacaagggggtttcagtgaaggcaatgcaaaaatgcttcagagaatccaaaaagcatgaaatacagtggaaagaaaagataaagagcttaggggaagcagcaacagtgtcatcaggggctatcataaatggttga

SEQ ID NO: 90056 - DNA, 144 bp, Glycine max
  Peptide Sequence Number=SeqID_181741
atggaggttgaggaaccttggttggggttatggctactattgaattatcgagttgatatgggatcaagtttagcatatgacaatggaacttggggtggtcttcgtcattggaagtgcggtagacaggctttgtggttgatttag

SEQ ID NO: 90057 - DNA, 76 bp, Glycine max
  Peptide Sequence Number=SeqID_181742
tcatgtggctccgcatgccaccagactcttgggtcacggtaacaaaaagtggggtggtcaacaggggatcctctag

SEQ ID NO: 90058 - DNA, 222 bp, Glycine max
  Peptide Sequence Number=SeqID_181743
cacctatcgggtcctcatgaatcgagtttgcaaggcttgaagaaaaactggccaagaggtgaactggctgttgctagtcatccactggaaccacaccagggcacgaccatccatataaaacgaagcaatggtcaagcgttcatgggttacatgtttctcaaagctttattcaagacaaggaaatcaaagatattcaagatggatgatcaagacagcctctag

SEQ ID NO: 90059 - DNA, 51 bp, Glycine max
  Peptide Sequence Number=SeqID_181744
atggcaacccaaagaacacgagatggaactattgagattgcaccaaaatga

SEQ ID NO: 90060 - DNA, 873 bp, Glycine max
  Peptide Sequence Number=SeqID_181745
agggtacacgccctcacctttagagggctagcacgccctcgccttcagagggctgcacgccctcgccttcagaggactgcacgtcctcaccttcagagggctacacgccctcaccttcagagagggctacacgccctcgccttcagaggactacatgtcctcgccatcagaggactacacgtccttgccattaaaggactacacgtcctcgccatcagagggctacacaccctcgccttcaaagggttgcacaccctctccttaagaaggctgcacgccctcgctttcagaggactacgcgtcctcaccttcagagggcttcatgccctcgcctttagagggctacacgccctcacctttagaggactacacgtcctcaccttcatagggctgcacaccttctcctttagtgggctgcacgccctcgctttcagagggccggacgcccccgccttcaaaggttcagttcctgggccacccgctgatcctggaggagggccaactgtgcgagcacaactagaggaggaggctatcgtatcaaccactatgcatactggggaaagattcacccgtgccgttacaaagagacgagggtcgcgcccacaagacacccagtggacccgaagaagtccacagggccctggggtttccaggtgcccgtcccccccagcaaggtcataccatcgtgacatagggatcgcgcccgcaagacacccagtggacccaaagaagtccagcagggtcttggggtttctagctctgattacgggcctttgtcagttctacgaagtgcccgtcgcccccaacaaggtcactaggccccccattaaacgggctttcatcaagaagtactgcgcccccaggcaggcgtag

SEQ ID NO: 90061 - DNA, 471 bp, Glycine max
  Peptide Sequence Number=SeqID_181746
atggtaccccagactcagacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgggaccgctacacttgccagcgctgatgtccggggggtgcttttgccgttacgcaccaccccgtcagtagctgaacagggagggacagctgatagaaacagaagccactggagcacctcaaaaacaccatcatacactaaatca

SEQ ID NO: 90062 - DNA, 222 bp, Glycine max
  Peptide Sequence Number=SeqID_181747
atgttgctaagtagcaacgtcatccatatctgtgtaagagtggtcaagttggtgcgcatgatccacactcgtctctttgcagtggcacgggtgaaatcttgccccggtatgcatagtaactgcgtgatagcctccctctttggttgtgctcgcacagttggtcgccctcaattatcagggggtggcctaggaactgataaaaggaaactactagccccttaa

SEQ ID NO: 90063 - DNA, 695 bp, Glycine max
  Peptide Sequence Number=SeqID_181748
ttggcccagggcttcccggtatcacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaaagtgttcaattggaacatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 90064 - DNA, 149 bp, Glycine max
  Peptide Sequence Number=SeqID_181749
caccggttctattatagaaattgtcgccaattgtttagctaataagcccgtggatattgaggttccacaagcggtacttcctgatactgtatttgaagcagttgttcgaattccttatgatatgcaagtgaaacaagttcttgctaatg

SEQ ID NO: 90065 - DNA, 432 bp, Glycine max
  Peptide Sequence Number=SeqID_181750
atggcagcgcaattgatccatgatcgtgttgtgatggagtgcctagagggtgtttgggagaccctcgaaggcaatgagaggtgtcgatttcgtggcacaattcgacgtaccgctacttcattagtacatccggcggaacccgcacgcacacttcagaagcctgtggagtggatactacctacacctactccatatcgactagtggagcaagttcaagtgatagaggtgtcatcctctgaagaggatcctgaagaggacccagaggagttacctcctgaacctgctgtggacgcccttgacttacctgaggatgatgaagacccactcattgatgttgattctccagaggatattatgtcagcatctgaggcagactctacagaggagagtggccttggagggacagcgaatagtgacaactcttcatcgtag

SEQ ID NO: 90066 - DNA, 219 bp, Glycine max
  Peptide Sequence Number=SeqID_181751
gatagatcgacaggccagcaaaggccttctaccgcagcgggcccacaggcctatgccaatctcttagggcaggttctctttcatccgtctttcctaggtgcgcatctccatctactaaaaggtatccgagaggggcacaatgcaggctggagatcatctggtaaggagaatccccaggctttagatagtttagagggactaggcaatgagcccggataa

SEQ ID NO: 90067 - DNA, 2354 bp, Glycine max
  Peptide Sequence Number=SeqID_181752
ggactccaggaaaagggattttgttcaaacaaaacaagagtgtaagtcttgaagcatatgcggatgcagattatgctaggtcagttgtggataggagatcaactactggatactgcactttccttggtggaaacttggcgacaacagaagaatatgcagacgtaacagggagagggggagagacagagataggaggaaagaggaacattcctcatgtcgtcggagcaattccagaaagttgcggtatgaaggaaacaaatggaagctcgaagggggggaaccaggaacacaatcgacattacgaggaatgctggaacaagaacgtgaatgacgacagacttggtacaaaggaagaatggacaaaggtgatcagtaggagggaagcaaagacagtaaagaagattattccagagaacagaacaacccataatctttcgtccaagcgtcccaactggagagataaggaggatattacatccttctatttcactaacttcacagacgatgttaatgaagtgtggctttgggagaagtttaagacttggggtgatgtccgtgaagtttttatagccaaacgctgtaacaaggagggtagaaggtttggttttgggaggttcaagggtgtttcggatgtaaagattctggagacgcacctggataacattttcatagacgaccacaagctgttcgtcaaccttcccaggttcacaaggttagcttcgaatctccagacgcatacaagagtagataaaggggggaagcaaaacaaagaagatgtcaagggtcttccggtggtgggtcagaaaggagtttcaggaggaacgatgacaggtgcagatggtactccaacaattaccatcgaacccactaaaggtcgtgatttctggtgtaaaggggcttgggttggtaagttgaagaaacccatgaagatggagaaaatggaggattacatatcgtgggagctgggatataacatcagcactagattccttggagacgacatggtccttctcattggactttcagaggatcaagctcaacagcttatcaactcagagataaacggcggcaataccctattctattcccttgagagatggcgaccaggctacaggtcatctaatcgggttgtgtggcttcaattatggggctttccgattgaagcatgggaagtggaccacatgaagcacattgtctcaactattggagatgtcatagaggctgacgaagacaccgaagaccggcgacgactggaccgtgcgcgcttgctggttcgaactcctttgccgccggcaatcagcaaggaagtgaaggttcgttgtgggggagaagatcacagggtgtggctggtggaggaggtaggtgtcgatggggatgcgtggagaaccaaaacgtccatgtccgaagagtggacggaggagatcacgtcggaggaggaaggtgtcgacgcggaagaagacgacgacgatacctccttttcgtattcatcggagttgtcagccaccaacaacaaggcctcttcgaaccaccagtcaaacgatttacccagcggtttctacggccaatctcggaatcgtgttgacccagtggataataacccattttttgatgcatgcaaacatagcgcaggagacgcagcgagacacgttcaggactctactttggcaaaggttgaccaacggactgctggtgcagagaaaaagcagggaaatatttcctcagaggtcataaccttggaccctgttatagtcgggcctcgaaaggctgaggaagaccaagatggaaagtttttaaattctgaggaagcagcaagaaatcagattaacatccaaggggcatataagacatgtgcaacggatacaagatattatcatgacataagccagactcagggtcaaaaggagattgggccaagttccatatcgggcccaataaagatattggaggagtgcaaaaagaaaaaacatataatcttgacccaagcatcaaaaaggaatatggactggttccctaaagtttatgctaggcaaagacacgccccatcaaagggctgccttcttatgcctgtagctgaagaaaatacatcattaatggaggataaggctgatccgggtttaaaggataaccttttcaaaggcacaaaccgtagtaacacggtggagatggaggagattaacagtgtggatggaaattctcttgaagaatttgaagaggccaaccagcagtggattcttgcgaaatccttaggcctccaacatgaatcggatcaggacggtattcacagcttcaagaacatggagattcgggataggaaagaggctttgcagctgggaaacaagaatattcatagatga

SEQ ID NO: 90068 - DNA, 456 bp, Glycine max
  Peptide Sequence Number=SeqID_181753
atgcccacacaaaccctaacaccttcttctccaccacccacaaccactggtggccaccatgagccgccgttgcttgctgcggaaccaccacacctagaggaatgttttaatcggagcggaatcctcagaatccacctcaaggattcggtggagaacaatccctcaaatcctttctttggtagcttctctgaggaggaatacttgtacttggaggcatgtcactcggtttggaactcctttgagactcaggctgagcatcatgggggtggggggagtttcctgtgcacgcagggtgacctcgacacttactacttagttttcctaagtgagagtgtcgtgtggacacacttaggctatttccttaaggatggaaccacattgcatttgaatgttgagaaggacaacagtagagtacgtgaagtgggattcttttgtggagccgccaaaccgatgtga

SEQ ID NO: 90069 - DNA, 290 bp, Glycine max
  Peptide Sequence Number=SeqID_181754
gattcctgaacacaagggatgggttgtccctgtgtggttcagactttgtaatggattttacaaagatagtggaaatctcaagccacaaggtccaacacctccaactggggaatcagggggatcaactgcttctccagttggtgaattagggggagcaacagtttctccagatgggaaatcggagatgataatcagaggtggagacgggggaactacttcaagcataggagaagaaggtggattcaccactggagattgtggatcagttggctatggttcaacccgtgcaa

SEQ ID NO: 90070 - DNA, 289 bp, Glycine max
  Peptide Sequence Number=SeqID_181755
agggctgcacgccctcaccttcagaggactacatgtcctaacctttagaggactacacgtcctcaccttcagaggactacacgtcctcacctttaaagggctacacgtcctccccttcagaggactacacgtcctcgccttcagagggctacacgtccttcacttcaaaggactacacgtcctccccttcagaggactacacgtcctcgccttcagagggctacacgctctcgccttcagtgggctccacatccgcaccttaagagaatttgaggtcttctacccttaa

SEQ ID NO: 90071 - DNA, 396 bp, Glycine max
  Peptide Sequence Number=SeqID_181756
atggagaggtgtacatggttttataatggagaggcttttaccagtgccgccatcccctctgccactgccaccaccatgctcaccaagtacaccatactcaaccccaagtccaccatcagctccaccaacgccttcataacccccgtgtcgcaacctacccttcgacgggagggcgacacggggctcacaggtgcgtcttccaagggaggaaggtgttcggagtcaccaccaatgtttattcgaggaaaatgtcagaaaaaccgaaatgtgtggtctacgaactttaagtgtgaaagggcattggatggaagactccaagaagattgggccaaagatgcaagagaaggccctagggttctcatgagccttagggtagatttcgggcctatgggctaa

SEQ ID NO: 90072 - DNA, 243 bp, Glycine max
  Peptide Sequence Number=SeqID_181757
atgcccttgcgggatgatgatgatgatgattactatcatcatcatcatcatcatcatcatcatcatcatcatcatcatcatcatcatcatcatcatcatcattattattattattattattactattattattattacgatgatgtcttgggaactctttttttcctttcatatgaatacaagttcaaggatccaattgaaacaaaaaattgcaaaagtgagaataccgacctgcagaggtga

SEQ ID NO: 90073 - DNA, 447 bp, Glycine max
  Peptide Sequence Number=SeqID_181758
atggctccaaagaagcttctagctaagacggcaaggaaagatgccactggagaaggatccacaatcaagggttggtctttcctcaaggagagacaggtccaattgagggaaggagaatatgctaaattccaggaggaaatttctaggaggcaatggactcaacttgcagagcccatggctaagtataatccagaaatagtcatggagttctatgccaatgcatggcccacagaggaaggggggcaacactgcgaattcagtcagaggagccagacctcgggatttgatgaggaggccataggccaactactggatcacgccttccagacacctagtggacctagagaagtccaacagagcactgaggttttcagccttgatcacgggcctctgccagttctatggggtgccagttactccctcaaagcttatccggccccccattaa

SEQ ID NO: 90074 - DNA, 732 bp, Glycine max
  Peptide Sequence Number=SeqID_181759
gacaacccaaatgtaaagaccaatcctctcactggtcatggaggctcggcggttaatgcggttgaagagtgggaacctcgggggccgaagcggatggaagacatgttaacctctaggaggttcattttggaagcactgtgcgaagctgggatgattcgccttgacgggaacaagggggactcttgtttaatacatttgggggcatcacacgacgtagagacatgcccaatggcgggagaattactacaagggatgatggatagaggcctaattgaagtttgtagcgcaagaaaaggggaaggggatgtgtgcatgcagtcgattcataagagctcgagtaagcccaagccattggtgatccacttcacaagggatgttgccacacataagcctcgaggtttccagtctgtcccagttaagaagcctacgccttccccttacaaaagtgataaggatgatctatcctctactaaggtcacaaacatcttcagcacaagcggcatgacttgtagcggacgaatcttcgcagcactcgagccactggtgcgatccaaagacccaaaggggaaagtaaaggcaaacgtggaagagagcggtaaggtgggcttgattctaaataatgaggtcctggttggaaggtttgccaaggaagaggatgactttagcaaaaaggaattatacgctgaagaagaaatcgagttcctgagaatcatccaacagagcgagttcaag

SEQ ID NO: 90075 - DNA, 261 bp, Glycine max
  Peptide Sequence Number=SeqID_181760
atgggatcgaaccaagcaccctcttttaagagaaggttctatcatgtcaaaatcaagagcctagaagtagccagcttgcgagagctagggcagcggatggatcaagttcaacgtcaagccttccacaagacatatgggaaaatctgggacttggctatgatagaagtttccgtggaagccatcgcatccctcactcagtactacgaccaatcgcttagatgcttcacgtttggacacttccagttagtaccaattatataa

SEQ ID NO: 90076 - DNA, 441 bp, Glycine max
  Peptide Sequence Number=SeqID_181761
atggtttcaaaattgtcttctggtaatcgattacactgcctggtaattgattaccagagccttgatctcttggaaacatttgttttgaggcaaaagcttgatcttgaattaatcttgaagcaatgtctaacctttgaatgtttgttgaatgatcaaggggttcccatggaccctaagagaataaaggctattcctgattggcccactccaccaagtataagggaaatctggggctgccatgacttaacaaacttttacaaaaggagaagaggtgagaggaggcgccatccactagggaataagccatggaagaaggagcttcaccaccaagatgagccttggataaaaagcttggaaggatgcttcaatggaggaaaagaaagagggagagaaagagagaggggggagcacgaaattgaaggaataaaagagggagagtag

SEQ ID NO: 90077 - DNA, 270 bp, Glycine max
  Peptide Sequence Number=SeqID_181762
atgcataatcatcatggatcaataggagtttataagtgtggaagcaatgacttcaaagattattttgatgatgccaaagaatcaagagttaagcaagttccaaagaatcaggagtcaaaaagcttcaagaatcaagtttcaaagaatcaagattcaagaacaatcaagtttcaagatttaatcaagtttcagaatcaagattcaagaataatcaagatcaagattcaagactcaagattcaagaatcaagagaagactcaatcaagataa

SEQ ID NO: 90078 - DNA, 231 bp, Glycine max
  Peptide Sequence Number=SeqID_181763
atgaggggatgcaagtgcataccctcactcacatgtaggtctgccactgttcatgattatgcaattgataactggactctgggtatcctttgctatgagttactttatggtgctcctccatttgaggttgagagtcaagttgataccttaaaagaagccaaaaatcttattagtcgagttacagagatttggatgacgccacttccagtgaaggaagataagtcagggtag

SEQ ID NO: 90079 - DNA, 478 bp, Glycine max
  Peptide Sequence Number=SeqID_181764
atgtcagcattttccgatggagactttccaagtctcacaagttatccagaactacgtaggtctgaattcctcattggaggatacgtaggagcaagagcctcgcttttgtcgaccacaccgccttttgttgccatgactcaagagctggtagcccgcggagataccttacggttatccgcacccctttgccattcagacacagtcgtgtccgatggcacgcagagaccaaagaccaagtttggtcattctgcacccatgatacgcggagatacggttatccgcacccctttgccattcagacacagtcgtgtccgatggcacgcaaagaccaagtttggtcattctgcacccatgatacgcggagataccttatggttattcgcacccttttgtcatccagaggcggcggggcccgatgacaagcagagaccaagtttggtcattctgcaccccatgatacgcggagatactcttatgg

SEQ ID NO: 90080 - DNA, 252 bp, Glycine max
  Peptide Sequence Number=SeqID_181765
atgaaactaatgagaatcatgaaactggccaaatacaggctaaaggcccaagtggagaaggacgaaggcccaagtggagaaggacaaagcccccgagtggagaaggatgaaggcccaagtaatccttgtggcgtctaccctgacttatcttccttcaccggaagtggcgtcatccaaacctccgtagcctgtatcaagcgatccgctcctactcaggttcacatcatctggtatcagagcttcggctcttga

SEQ ID NO: 90081 - DNA, 813 bp, Glycine max
  Peptide Sequence Number=SeqID_181766
atgattgggcagatcggcggcgtccaccagcgcgcgcgcctgttcataaaacggcgagaccagctggcgcagcagctccatcgtgtcgttgaggttgtgatagaactgggtgttgttctccagctggcactgttggtagcggtaaaattcctgcgccagcgccggcggcaccatggcttcctgcagacgctccttgagctgcagtttccagcgtggcagatcgcgatccagcgcccggcgaagggccggaaactttttaaagaacaccgacagctgcggcgccgccagcatgccgacgatcatctcctcgatcatttcgccttcggcgatcgccagcagcagatcgagcgtctccagactgagcatggttactggccgcgcatttgctgcagttgctgtttaacctgctctgccacctgcagcagactggcttcgatcttggccaggccggcggcgggcgcggcgctgctccgccaggcgttgggccaacgcgtccatttcgtccagcagcgcctgcggcgtggcggtggcctgtttgcccggcagcgccagcagcgacggctggcggctgacgtccagcaccgtcaggtgcagttggtcgtcgacctccaaatcgatcggctgcgcgaagccgatgccgttcagcttggcgcgcacatcgccgcctttttgcagccagttgtccagcacgctgctttcgatgctcagatggttgacctgaatgtcatgcagctgcagcggcttttgcagcaacagggtgagggtgccgccggcgaacggcgtggcccggcgcgtaatgcgggttacggctga

SEQ ID NO: 90082 - DNA, 357 bp, Glycine max
  Peptide Sequence Number=SeqID_181767
atgggaacaaatcaaatcggaaaaagattctatcaagtcaagattaaggacctagatgtcaccagccttaaggagttgggacggttgatgggacccctccagatgcaagccttccgcaaggcgtacgaaaatattttagatttgaccatagcggagggattcggcaagagagttcgatcgtgtaaagcaaactcgaaacggcgtagtgggcctaccgcggaagtacttggaaggcaaggtaagggatatggcgaatcaagaggagtgggtcccgtttgcggacgtattagctttgctaatctttggggtggtcctctttccaaacatggacggtttgatggacctagccgcgattga

SEQ ID NO: 90083 - DNA, 72 bp, Glycine max
  Peptide Sequence Number=SeqID_181768
atggagatgaagcggaagacaaaggagaagagactaggtagcttccttgagaagctttctggggtcctctag

SEQ ID NO: 90084 - DNA, 883 bp, Glycine max
  Peptide Sequence Number=SeqID_181769
gatgtcaaccagcccaaagcgcgtattacccgccagcggctgaatcagttgaacccggatattacgcttattgcgcgccaggagcggctcagcggcgaacatttgcagcgtgaagtcgcccttgctgatgtggtgctggactgtaccgacaatatggcgacgcgccaggcgatcaacgccgcctgcgtggccacgcatacccccctcgtcaccgccagtgcggtggggttcggcggccagatgatggtcctgacgccaccgtgggcacagggctgctatcgctgcctgtggccggatgatgccgaaccggaacgcaactgtcgcacggcaggcattcttggtccggtggtcggcgtaatgggcaccatgcaggcgctggaagccatcaagttactcagcggcatggagacggaacgcaataccctgcggctgtttgatgcccccgctgcccggtatgcggaggccacaatgcgcattctgtttaacgatgagccgatgaaatgcgatgacggcctcaccgttgccgtcctgctcgacaagctgcgccagctcaggccgggaacggcgctggcactcaatcaacagatcctgccgcgcgagcagtgggaacatcagcagggggctgagatgttacgtattgctgataaagtttttgattcgcatctgtttaccggaaccgggaaattcgcctcgccgcagctgatggtggacgccattcgggaaagcggcagccagctggtgacgctggcgctcaagcgcgtggatctgcgccaccacagcgacgccattctggctcccttactggaagcgggcgtcacgctgctgcccaacacctccggtgcgaaaaccgccgaggaggcgatttttgcggctcagctggccc

SEQ ID NO: 90085 - DNA, 1257 bp, Glycine max
  Peptide Sequence Number=SeqID_181770
atgggtcaacttcaatggcaagccttccgcaaagcctatggtaagatttgggacctagctagggtagaagtctccacagagtccattgcctcccttgcccagtattatgatcatccgttgaggtgcttcatctttggggacttccagctatcaccaatggtggaagaatttgaagagatcctaggatgtcctctagggggaaggaaaccatacctcttctcaggaccgccaaaggcaagtcgaaaatggggtggtcggaataccgagaaaatatttggagtcctcttttcgaatgtggatggattggtggacctagcagcgatcaacgcttttctcgcctatcatgaccacacaaggaaagcccggttggtttcgcacctgtttaaccaagaggtaaggcatgcttgcccgctagaaggtcaccgttcatgcacagagaaaggaggcgcaaattgggaccaactcttagcaaacaaagaaggatcgtctatcagctggttccctcgatggaaagaaggaagagtcagagttcttatttcatgcagaggatttccgaatgttcccttgatggggacgaggggttgcatcagttacaatcccgttcttgctataagacaacttgcctaccctatgagaggggcaccactagaggaagagatcgcgcctgtccgcaaggcatgggaggtggtgcaaaagaaggacaaagaactcaggggcagtaacaatgggcccatcggtggctaccgtaagtggttgaagccacgtgcagcaagcccaacagtcaaagaaaggttcaaatcagcagctcttaaaatccgaaaggagaatgccgaactaagagatataaatatagctacaaccaaggccttggaacaagagaccaagagggctcgtagggaagagcacggccggaacaagttccgaggggctctgtggggcagcaacagcgagcttaagctccggagagaggaaagagatcaatcacgagtacatagcatggtcttaaaggaggagttagttgcttgctcaagatccaagaagagtttggcccaacacttagaagccacggagcaaagcatgctagctataatagggcagtacaaagaagagttaaaccagtctttgacccatgagcaaaagctagtagaggacttcgcacaagcatacgccgagaaggaagcaagagggagggtgattgatgcattgcatcgagaagcgaccatgtggatggaagtcaagacctcccgcgactactag

SEQ ID NO: 90086 - DNA, 549 bp, Glycine max
  Peptide Sequence Number=SeqID_181771
atggcgcctaccaggcaccctctggacccggataagtccaacaaggccctgggatttcccgccttgatcataggactctgccagtcgttcggagtccccgtcgcacctagcaaggtgattcggccgcccatcacccgagcttttattgagaaatattgcatgcagagacaggcccagggggatgctccgcaggccgcagacgtgccgccacctcatcaggctggtccagccgaatcgtttgatacggagcagtgtttgcggcatttggttcgccagcaggcggccaaccaccgggctcatgtacagacccatgattgtctttaccagatgagcctcatcctacagagccagggttttacttcttttccgtgccctactccggaccagttcagggtagaggtcgcatggcctggagattggcctgaggcccgggcaggagaggcgccagcagaggcaccagcagaggatcccgacgaggcagatgaggcccgcgaggacgaggagatgaccgatttacttgatttcttaggaggaagcggggccacatga

SEQ ID NO: 90087 - DNA, 381 bp, Glycine max
  Peptide Sequence Number=SeqID_181772
atgccaatctccccctgcaaaagtatcagttggtctgtgtcatcccgacgtgggattacacccacaaagacacccagtggacctgaagaagttcaacagggccctggggtttccagctctggttacgggcctctatcggccctacagggcacccgttcccccccagcaaggtcatgccatcccgacatagggatcgcgcccgtaggacacccggtggacccaaagaagtccaacagggtcctagggtttccagctctgattacgggcctctgtcagttctacggagtgcccgtcgccccaacaaggtcattaggccccgcattaaccggactttcatcagagtactgcgccccagacgggcgcaggcgagacacacagtag

SEQ ID NO: 90088 - DNA, 486 bp, Glycine max
  Peptide Sequence Number=SeqID_181773
atggaagaacgaatgaagaacgtcgaagaacggttgaacctttgcgaaattcctcacggaaaacgttacggaaacgtttcggaagcgcctcggcttagattttcttcacggaaacaatttttccaagcaaattcgaaagagagagaagtgcctaaggggctggaccctttcttcttcacttcctcccctatttatagcaaaataggggaggtggttgccgcccagctcgcccaggcgagctcagctcgcccaggcgagcagggttgcttcctccagaagcaaccgccttctggaggaatcttctggagggctcaaatgggcctgggtgctatttgcacccccatttttactaaattgccattctcgactagcgatatcccaccccacatgaacaaagaggaaaagaccgaaacacccagcttcttctccaaaaacactaccctcgagaaaatcctattggtccgtgatcgtacgtttaatctttga

SEQ ID NO: 90089 - DNA, 642 bp, Glycine max
  Peptide Sequence Number=SeqID_181774
atgagcgctttagggcgtcctcaagatatgttttcagatacggctatacaattacaaccggtctttgctcaatggatacaaaatacccatgctttagcaccaggcacaacagccccagtgggcggtaaagttgctttgttacctattccgttaggaactgcggattttttggtccatcatattcatgcatttacaattcatgtaacagtattgatactcctaaagggtgttctatttgctcgtagttcacgattaataccggataaagcaaatctaggttttcgttttccttgtgatggacctggaagaggggggacatgccaatcagatgtttggggtagtataagtgatcaagggatagtaaatcatatcacaggaggaaatttgcgcagagttccattaccattaatgggtggctccgtgatttcttatgggcacaggcatcccagcgggcgtggttattggcaagaacttattgaatccattgtttgggctcataataaattaaaagttgctcctgctactcagcctagagccttgagcattgtacaaggacgtgctgtaggagtaacacattaccttctaggtggaattgccacaacatgggcattcttcttagcaagaattattgcagtaggataa

SEQ ID NO: 90090 - DNA, 399 bp, Glycine max
  Peptide Sequence Number=SeqID_181775
atgaagaccaatatggaggccttgaaagatcaaatgacttccatgatggaggccatgttaagcatgaaccgaatgatagaaagcaacatggccgcaatagccgccaccagcgccgccgctgaggtggattcgacccatccccctgccataaaccaagcaaaccaacccatcccgaacgtgttgggtcaaggaggagagggtcagcaaccccagcctattaggggcgcccgtgaagaacctcaggagcatgctcaaggtgacttctacccatacctcactttcaccactgagggaccagcatttaatgctatatgccttgaccccaataccgcgggagctcctcaaccccgccctctacaaccgctgcatttcttagtagggggccgcctccgatactag

SEQ ID NO: 90091 - DNA, 216 bp, Glycine max
  Peptide Sequence Number=SeqID_181776
ccttcaaggatggaggttgaggaatggaaggtggtgacttttgtggcgaaagcggaggcgtataatgtagctccatatagagcttgtaggccttggatcttcttcatcactatagtccttcactacctgaagatcaatggtagcagaaaagagaaggaggaaagggagacagagaaaggggaacaaaatttagacaaagagaagagggagaatgag

SEQ ID NO: 90092 - DNA, 1182 bp, Glycine max
  Peptide Sequence Number=SeqID_181777
atggtagccacggcataccaaacatcccatgagtgtctagaagaaacaattgtagacattcttgtggcaggattctctgtttggaaagataggtcagcagaattactatacaatcttaagtgtaggactttggcagactttaggtggtacagagacaccttcctgactagagtttacactagagaagatagccaacaacctttctggaaagagaaatttcaagccggacttccaagatcattaggcgataaggttagaggtaaaattcgtagtcaatctatcaacggagatattccatatgacaatttaagttatggacaattaatttcctatgtccagaaggtagccttaaaaatttgtcaagatgacaaaattcagagacaactagccaaggagaaagcccaaactaaaaaagatttagggtctttatgcgaacaatttaggtttccagcttgtccaaaacaaaagaaaaaacaaaaccccaaaaaagaatttcatgagaacaaaaatttcaataaaaagagatttccaaacaggaaatactcgcacaaagcctcaatcagcagagacaccaatatgcctaaaccggttatgaaacctagaaccaaagtagtatgctacaattatgggaaacaaggtcacataagcaaatattgtaggttgaagaagaaattaagaaacctcaatctagatccatccattgaagagaaaattaataatctactcattgaaaccttagaagaagaaactggggaagtatcttcggaggaaaatcttaaccaaatccaacaggatgatcaagatctcttgtttgaagcaatcaattccatacctgaccctcaagaaaagaaggttttcctgaataaacttaaaaaatctttggaagccaaacctaaaccaatagaatttattactaacaacaaatttgatgtgagtaatattctcaacagattagaaaatacttccgttaaaccaaccccaatccaagatcttcaaacagagattaataaccttaaacaagaagttaaagagctcaaacaacaagaaattcatcaaatcatcctttctcattttgaagaacacagtgattcgaataatgaggtcaaagaagaaaaagatgaaggtcaagatgatgaaatgttcatgggattaatcaacaagattaaaatccaaaagttttaa

SEQ ID NO: 90093 - DNA, 207 bp, Glycine max
  Peptide Sequence Number=SeqID_181778
atgatcttggagatgataagggaggatagatcggtgcttcgaatggtccgtggcggcgatggccagcagcagcggtggtggaggatgatccctttctcttcttcgatgattctgccatttgaggaagtttttgtgaatttcaatcggtggaatcgaaagaggagtgaaaatgaggaagattgggctttacgagacgtgttttggtga

SEQ ID NO: 90094 - DNA, 112 bp, Glycine max
  Peptide Sequence Number=SeqID_181779
ccgaggggctggcgaaacgtttccgtaacgttttccgtgaggaattcgcaaaggtttcaaccgttcttcgacgttcttcattcgttcttcatcgttcttcgatcttcaacgg

SEQ ID NO: 90095 - DNA, 507 bp, Glycine max
  Peptide Sequence Number=SeqID_181780
atggtagaatcgtcaaagaagcgaaagggatcatcctccaccaccgctgttgttggccatcgccgccacggaccatttgaagtacccacaacacctattcatccttctttatcatctccaagatcatctactgtattttcttcagatgatcaacgtgtatggtacctttctcaattttcttctaggatcattctaaaccctaagtacctagacatagatttctttaatgatgagacatttgactgttatcaagtgtttcaaaactctggattgattgattttatgtctttaaaattgccttactatcctgaacttgtcaaagtcttttacaataatttaaaaattcaggatggtattatttcttctgaggtgcatggtatttccatgatcattgatcaatctttgttcttttcattaacaaagttacccagtcaaggtgcaccttttgagggcaccattgttgatgactggaaattcgattattctagtcatgatgctcgccgtatg

SEQ ID NO: 90096 - DNA, 240 bp, Glycine max
  Peptide Sequence Number=SeqID_181781
atgggggttgagagatacgagaatgaaggaattcgtattcgacgtcaaaaagtaaagacacaagacaaagaagaaagcaaccgcaaaaccaaagaagaaacaaaagaatttattgtagctcaagagaaaaataaagaagcaaaagctgaaggaaaaagtgaagcaaaagatatgagagtcattgttgaagagtttctttctaaagctcattacaagcagcttcacatgttcaacccatga

SEQ ID NO: 90097 - DNA, 419 bp, Glycine max
  Peptide Sequence Number=SeqID_181782
gaaagtaatggaagatattagtttttcacccgaaggaatttaccctattccttcaccaattaatgagcctcatccaccttcaccaattgatcaaactccttcacctattcaagttgatcttgcaccttctccttcacctattaatgttgatcatactccttcacctcatgaagatgaagctgaatggaagtattgtaagaaacttcttggtggaaaatcaaaaaatggaaccaagcatttgtggcagcataatgagatttgtgttcagtacaagatttttatgagagggatgaagggccaaacatttcttgcacctaaggtcgtgcaaggaaagcaagagttggagcaaccagaggaatctcaggaacttgttagagatgtctctatcgctgtcagaagacacgtgagtccgcttagag

SEQ ID NO: 90098 - DNA, 755 bp, Glycine max
  Peptide Sequence Number=SeqID_181783
ccttcggacacttaatcccaagccttgaacttgccaagctcattgctcaaaagggtcatcatattagtttcgtgtccaccccaagaaacatagagtgtcttcccaaattgtccccaaacttggtttcattcatcaaatttgtgaagcttgcactgcccaaagtggacaaccttccagaaaacgttgaagccaccattgatgtcccttatgatgtcgttcagtatctcaaaaaagcctacgatgatttggaagaacccttgacctgttttctcaaatcttccaaagttgattggcatttctatgacccatatatgttacagttaccaaaaaggttcaaagagaaaaccaaatggtgtggaatagtaagccccgaccacggattgaactcgagggtgttggaagtgaagaagatggggtattcaattcctaaggatgaacaagatggatcattcacgagtgatgcggtcgctaacttaataaggttggttatggttgtggaaaaaggaaggatttacagagaaaaggttaaaaaggttagacatgttttcataattcccaatggtgacaatgttcagaaatgtgtttcgaacctggtgctcaaatttcacgacgatccaacggtgaatgatttcgagatcgccctttttccgagacaggtttggtggtatgcgggaaaagatagggtttttagaggtggagaagggaaaacgaaattgaaaggaaaaggaggcgtaggaagtatcgtcaaaaactaa

SEQ ID NO: 90099 - DNA, 468 bp, Glycine max
  Peptide Sequence Number=SeqID_181784
ggagaaggtgcaaatacattaaatgcaaaagcaaaaaccttagaagagggggagagtaagccgactcctaatgttgatggattggagtttgtgctggtcaacactaggtttgagggcgacaaggataatgtgacatggcagtggatgaaggagtggttagacaatcaagaatgtgggagtgtgttgtatgtggctgttcaaaatgagaaacctgtatttctattaatgtttcttgaagaccaaggattgaacacaaaactgttggaagagaagaagatgaggtatttgattcctagggatgaactagatggatctctcacgagtgatgcggtcatagactcaataaggctggcaagaaaggccttgaatcttcttcatcagtggaatcctttgcttcttgaagatgaatggcaacggaatggagaaggaagaaagatgattggagacgccacttcaaggagaagatga

SEQ ID NO: 90100 - DNA, 180 bp, Glycine max
  Peptide Sequence Number=SeqID_181785
atgtcagtgaaaatcctcgttgggcgcctaggagtacatgacaagacaaaccacacactagcaagtcaggtcactctcactaggcttaaaggagcacttaaaccgggtatatttacccccaaggcctacactccgaagagtgcgttagggcctctccctcctgattcaggcccaacctag

SEQ ID NO: 90101 - DNA, 804 bp, Glycine max
  Peptide Sequence Number=SeqID_181786
gcacgccctcgccctcagaaaaagtgcaacgtcctcgccttcagaagagttgcatgccctgctccagaagaactacatgtcctcaccttcagaggactacacatcctcgtcttcaaagggctacatgccctctccttgaaaggactacacgggctcacctccagagggctacgcgccctcaccttgggaggtccacacgtcctccccttcagagggctacacgcccccgcctttagaggactacacgtcctccactttagaggactgcacgtcctcgacgtcagaggactacgtgtcctcaccttcatacggctacacgccctcaccttcaaaggactacacgtcctcgccttgaggactacaggtcctcaccttcagacgactacacgtcctcgtcttcagagggctacaagccctcgccttcagagaactacacgtcctcaccttcagaggactacacgtcctagccttcagagggctgctcaccccttccttcagagaactacaagtcctcgccttctgaaggctacaggctctcaccttcagtggactacatgtcctcgcattaaggactacgtgtcctcatcttcagagggctacacactctcaccttcagaggactacagactgctgcacgccctcgccttcaaaggactacacgccctcaccatcaaaggactacacgccctctccttcagagggctacaagccctcaccttcagaggactacaagccctcaccttcagaggactacaagtcctctccttcagaggactacacgtcctcgccttcagaggactacac

SEQ ID NO: 90102 - DNA, 474 bp, Glycine max
  Peptide Sequence Number=SeqID_181787
atggtgggagcaggtttgaaaaaggatcttagagtgtctagggttgtgccaggagggtctcttaatgccttcctttttcttctcatcggagttatttcacaaagacttgccatggcgggtaatgatagtatcttgtaccctgaacccggtggctcactttttctaagtaatgggaaagaggaccgaaacatgccactgaaagactctactgagacaaagacgggctgtcaagaacgtagaggaggtaggatgggcagttggtcagatctaggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 90103 - DNA, 327 bp, Glycine max
  Peptide Sequence Number=SeqID_181788
agatggaagaagaaaaagcagcggcgtactatgacaaggtgactcgtaagggcgagagagctgcgaggttcaagcaaggtctcgaattttcctcttcagcaccaaatgacgatgttgcaaaaccctcctcctccttcctctccaaattcatcaaagcctcctccgagtcgaagatggaagcgcaactccaatccatccacgacaggctcaaggaaaagccttctttcgagtctagggtttcgagcagggatagggacaggaaacatgaagacgaagcaggagtagagaaagacataaggatagtcaaagagggagacagaaaattgg

SEQ ID NO: 90104 - DNA, 777 bp, Glycine max
  Peptide Sequence Number=SeqID_181789
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctgttagtaaaagccaatctaaaagaaacttctatcttcaacttggctaagaaactcgacgtggatccacttgctttaacggcattttacaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 90105 - DNA, 453 bp, Glycine max
  Peptide Sequence Number=SeqID_181790
atggcaacaccaccagcatcccctccgcagtccaatcagcagtcagaggcgatgtctaggaatactagacgatccacacagctcaggattttgactagaagaaccttggatcagccgcaacctattgtcaccgtttatgctgcaattgggcgaggatcgagcccatataaagagagattccataactatttaggtgttatagctagagaaaaagttccaattgtacataacaattggaaggatgtaccggacacactaaaggagctagtatggaatgacattttggccaagtttgatatcccagaagccatacatgcaaagaaaaaggtgatgtcaactgtggccactagatggaggcagtttaaatcatccttcacaagtaaatttgtgtttagtaattttgaggaccaacataaagaagatccttccgtcaaatatggctttgatgcataa

SEQ ID NO: 90106 - DNA, 357 bp, Glycine max
  misc_feature (52)..(52): n is a, c, g, or t
  Peptide Sequence Number=SeqID_181791
atgaggtttggttcgcaagagcttaaatccttgttctttgttggtgcccaanatagtgatcaaggggttcccatgaaccctaagagaataaaggtcattcctgagtggcccactccaccaacaccactcattgagttggtgaggaaccatgttccttcatgggaagatgcccaggaaatgggttttcagaccttaccttacttcaacataccaaacaccactaacacaaatgtttttgttctttttacaggtgttcagggaaggaacccagagtatgaagaacctcaagatttgaggtcaaatcctttccaaggtggagggaatgatgcaatcctaccctgcaagggtattggatag

SEQ ID NO: 90107 - DNA, 591 bp, Glycine max
  Peptide Sequence Number=SeqID_181792
atggaagctttagagaatgtgggtgatatatatcaagaggaaattttgaaagctcctgtaccacttgttgaacattttgccatggtattaggaagaaagttaaaccattcttctggtgttggtagtgcaccaatagcaaagaagttttcacacaaacaaattattcgaaatcaacttgaaaatgcacaaaaccgagcaaataatttggagttgaaagtgcaacagttgacaaatattacaaaaaagcaagaggatgtcattacccaacttcatattgaagtacaatcccaaagagaacaaatgaagcaaaatcttgaaaataaagtgaagcgccaaattgtaggcttattggaactgaatcacctactaactcaagtgctcaggttagtcatacgtgtggaagcaatgttttccaagtttattttgatgatgccaaagactcaagttaagaatcaagagtcaagcaagtttcaagaatcaaatagtcgttcaattaaagcaagtttcaagaatcaaagagtcgttcaatcaaagcaagtttcaagaattaagattaaagtaaagattcaagagaagactcaattaagataa

SEQ ID NO: 90108 - DNA, 606 bp, Glycine max
  Peptide Sequence Number=SeqID_181793
atggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgtcgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagatatgctcggagggatgtcgagttttatcccccgatccccgaagggccggcaccgggcacgttgcctcaacccaacctcgcagcatcgccaatag

SEQ ID NO: 90109 - DNA, 579 bp, Glycine max
  Peptide Sequence Number=SeqID_181794
atgggggagacacatgaaattccccaccaaaatctagctgacttcgagccttggctcggatatgccactgaagggcaagcagttggtggtgtaccctttgaaaacactttggagagccctcagggtttgcccacaaccacaaacattgcatttttgcggtgggaagagcccctcatgactatggcaggaatgggaaagttggatcatctagaggaaaggctcagggccattgaaggaggtgaagattatgcctttgctaacctagaagagttgttcctaatacccaaacatggtcattcccaagttcaaggtgccggacgggggcaagtacaaggggactactcgctccaagaaccatctaaagatgacctaatggttgccttcgttaggcagtgtcagtacaattctgatatggctccggataggatgcaactacaaaaagtgtgcaaaaagggggcacaaatctttcaaggaatacgcccaaagatggagagacttggcaactcaagtagcacccccaaaaacagagaaagagattatcacaatgatagtagacacgtgaccggtgttctactatga

SEQ ID NO: 90110 - DNA, 147 bp, Glycine max
  Peptide Sequence Number=SeqID_181795
atgtggaccaccacgggggagaagcttgccgcccagctcgcccaggcgagcaaggttgcttcctccagaagcaacagccttctggaggaatcttctggagggcccaagtgggcctggttgctatttacaccccctctttttaactaa

SEQ ID NO: 90111 - DNA, 1061 bp, Glycine max
  Peptide Sequence Number=SeqID_181796
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgttggcgccgtactgacgctcgtacttgtcggcgaagtccaccgccaccttcttgaccgggttcgagtcgggcagctcgcgcgccaccacgcccgggcccgtggggaacagcgtgccttcgacatcgcgcccgcccacctgcaggaattccagcgtgccgatgccgtgggtctggtagatggcgccggtgtagccccgttcgagcagcgtcttctgcggcagcgccgacggcgtgccggcgccggcgatcagcacggcatcgggcttggcggcgatcaccttgagcacctggcccaccaccgacgcgtcggtgcgctggaagcgttcctgcgccacgaccttgacgtcgttgccggcggccgcggagaactccttccaccagctgtcgccgtaggaatcggcgaagccgatgaaggccacattcttgaagccctttttcttcatgtcctcgaccagcacggtcgccatcagcgaatcgttctgcggcatcttgaaggcccaggcgcgcttggggtcggacagcggctcgacgatcacgctggaggccgccagggcgatcatcggcgtgcgggtctcggccagcacgtccagcgcggccagcgccgcggcggtggtgttgggaccgacgatggcgtcgaccttgtcttccgaggtcagcttgcgcaggttcttgaccgcgcggctgacgtccgtgccgtcgtccagcaccacgtagcgcgccggctcgccgcccagcgtgctgggccacaggcggatggcgttgttggtctggatgccgatcgccgcggccgggccggtggtggagacatccacgccgatcacgatctcggcttggacggacagggcgggaaccgccagcgcgacagcgcaggcgtagcgaaggaagaaacgggacatgacgaggggatcctctag

SEQ ID NO: 90112 - DNA, 300 bp, Glycine max
  Peptide Sequence Number=SeqID_181797
atggaaaattgtcttgtgaagttgtcgaccaaatttcgagaagatccaacggttaacgaaggctgggaagcatttttaccgaggcagcttcatatggcctctaggaaacacaagagtatcggttcaagacccacaactcaatatgatacaaggagatttcactccttagatgcatggaactggtacacggataatgtattggggagaaacatcttgccggtggagctctaccacattgagtttgatgattttaagactgagttggagaggcgtaatctccataaatgcctcaccaatttg

SEQ ID NO: 90113 - DNA, 261 bp, Glycine max
  Peptide Sequence Number=SeqID_181798
atggttgctataaccctagccaaggttcctcaacctctatttttcagaggatacgactcgaacgcaacatgtgcatatcatggaggagttccaagacattccattgagcactgtatgacctcgaagcataaggaatgtgggtgcaagccattggtttgtttgctcaagcgacatacgctcctgagtttggacttccaagactgttcaatcagaaattactcgtgctacacatttggtgaggatgtcgtaaaaaccgagtaa

SEQ ID NO: 90114 - DNA, 1326 bp, Glycine max
  Peptide Sequence Number=SeqID_181799
atgccgacacgtcctcgaccggaacatccttccggagaggaacgtcagctttatatcacggagtttgacgagtttagaagggagttggagaggcgcaacctgcacaagcgtctcaccaactcaactgatggcagtattgatgtcgcggtggtcaaggagttctacgcaaacctctatgaccctaaagataactcaccaaagcaggtgagagtgagagggcacttgataaagttcgatgcagacaccttcaacacatttctggggaccccagtggtattggagcctggggagaccatccccacatattccagattttgcagactgaggatggatcctcaagagatagcggctcgcctctgtattccaggcaggggatttgttctaaatgttgaaggcaagttatggaagctcctgaggagagacctcaccaccttagcacagacttggagtgtgctatcatattctaacctggcccctacatcacatacattagacctgaacttagacagggcacgattagtttatgggttggtgatgaggatggacatgaacattggagcactattttcaggacagatctcactcattgctcagtccaactcctctaggttgggatttcctgccttgatcacagctctctacaaggcaatgggagtcacttctgattccctctcttatgaatcactgagcccagccattaatttggaatatatcaagaaaaattgctggaacctggatgaaccttcgttctactttccaatgacttgcaaggctagggccagagcagctaagatcccttcctcatccactcctctggaccctcctgtacccacttatgctccacgaccagctccagctcatccaggaccttctatagaccttatcatgacttttcaaaacttagctcagcatcagccgttcatatccctggaggagttcactgggcaggtggtctggccaagagcccagccttctcctattggagggggtgaggcctctgcagcccagaagcctcagccacatcaggatgagtcttcctcatcttcaaattcagagaccataccaccagagccattcatctatgaggaagatccaggcaccacactggaggagactcagaaggctgctacaccaaagactaccccacagcaagcagtagaaccttccataccagttctagatttgtcttcaccacaaccatcccaggagccatctacacctgtcctgggcttgtcatcccccactacttcaccagcaggcacctcagtgcttcacctcatagatgaaaaggaggatatcatggaccaggaccaaccaaaagactag

SEQ ID NO: 90115 - DNA, 1124 bp, Glycine max
  Peptide Sequence Number=SeqID_181800
gccgggctggatccggggaagaaaaaaatcaggcgggattcgggatgtcgataaaggtcacatcaaagccgtggtgctgcgccagccagtcgcccagcgccttcacgccgccgcgctcggtggcgtggtggccggcggcgaagaaatgcacgcccatttcgcgcgcgctgtgaatggtctgctcagacacttcaccgctgatgaacgcatcgacgccgaagcgcgccgcgctgtcgataaagccctggccgccaccggtgcaccaggccacccggcgaatgtgctcaggcgcgttatcgccgcagtgcagcaccgcgcgccccagccggctttcgatacgctgctgcagcgcttcgccggtcagcggctgttcaaattcgccgtgcggcaccagcggctcgacgtcgccaatcacccgaatgcccagcgcctgcgccagctgcgcgttgttgcccagcaccggatgcgcgtccagcggcaggtggtagccatacaggttgatatcatgggtcagcagcgttttcaggcggttgcgcttcatgccgcgcaccgccggcgcctcgtttttccagaaatagccgtggtgcacgataatcgcgtcggcctgatgcaccaccgcggcgtccagcagcgcctgacaggcggtgacgccggtcacgatgcgctgcacgtgcgggcggccttctacctgcaatccgttgggggcgtagtcctgaaacgccgcggcgttcagttccgtgttgatcagttgttccagatcgaggctgggcttgatgtggctgatcaccaccggcaaaccgttcagcgagccatcgccgccgctgtactgcgtcaggttcttcagctccttcagcagccaggccggcgtcaaatggccgtacagatgtttatcctccaccccgttagggtaagaggtttcgataatcatgcccttgagcttcttctgctcgacaagcggccccagcgcgcgccagacggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaaca

SEQ ID NO: 90116 - DNA, 465 bp, Glycine max
  Peptide Sequence Number=SeqID_181801
atgccgatctccccctgcggaagtatcagttgggcttgcacccacaagacacctagtggactcggaggagcccaacagggccctgggtttccaactctggttacgggcctctgtcagtcctacagagtgcccgtcccccccaacaaggtcatgccatcggatcatgcccgcaagacacccagtggacccaaagaagcccaacagggtcctggggtttccagctctgattacgggcctctatcagttctacggagtgcccgtcgcccccaacaaggtcatcaagcccctattaatagggctttcatcgagaagtactgcgcccccaggcaggcgcaaggcgagacaccacagcagcctggagatggacggcagcgggcaacagacgcgtcgtcgccacctccaaagccccacagctcatccacaaaaaggttagaacgttgcctacgacacatggccgaccaatag

SEQ ID NO: 90117 - DNA, 612 bp, Glycine max
  Peptide Sequence Number=SeqID_181802
atgtgggttttcttaaccagtcgtcaaatcgactgggcccatcttgtgagatatcgcatgcataaggcattgcgatcaaatgctccacttccatatcctcatttgatcaccttgttcttacaacattttaatgtccctcttgactctaaaccttttgttaaagtcaagagatctttctctatcggtgcgaatgtggtctcctcttttggataccgcaaagagagggatggttcttgggtgaagaaagatgcaccagcacaggccgcagaagatcattctccatcaccacctcccgagagagatgattcttcatctcttatgcacaacattcttgacagattggatggactccacaccttcgttggtgagcgttttgattccttggacagccacattgatgctattgatgcacggtttgcaggaatggatacttgcatcactcagcttgaggaggattgtcatcatcaaaaaaggggagattgtggaagcaatgttttccaagtttattttgatgatgccaaagactcaagtgaagaatcaagagtcaagcaagtttcaagaatcaaagagtcgttcaatcaaagcatgtttcaagaatcaagattaaagtga

SEQ ID NO: 90118 - DNA, 156 bp, Glycine max
  Peptide Sequence Number=SeqID_181803
atgggaacatttcctctccccagcctaagaagatgtgaaagcgcctctctctataagaacggtgcgttccgaggtgacctcccctacagtatcgtcaccgcagtagagtttaaccaccaagttcgggatggattggtgtggttcctctacgcctag

SEQ ID NO: 90119 - DNA, 239 bp, Glycine max
  Peptide Sequence Number=SeqID_181804
gtgctccagtggcttctgtttctatcagctgtccctcctgttcagctactgacggggtggtgcgtaacggcaaaaagcaccgccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 90120 - DNA, 153 bp, Glycine max
  Peptide Sequence Number=SeqID_181805
atgggggtgcaaatagcacccaggcccacttgggccctccagaagattcctccagaaggcggggaggaagagcaagaaaggggttcagcccctgaggcacttttctctctttcgaatttgcttggaaaaattgtttccgtgaagaaaatctaa

SEQ ID NO: 90121 - DNA, 564 bp, Glycine max
  Peptide Sequence Number=SeqID_181806
atgactgctttaccaatagtgaactccaatcgggagatgtttccagcttatattcctactaatgtaatttccattacagatggccaaatattcttatctgccgatctattcaatgctggaatcagacccgctcttaatgtaaggtatttccgttttccagagttggatcggcggcttcaaattaaagccatgaaacaagtagctgaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacaggtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacaggtagaaaaaaattga

SEQ ID NO: 90122 - DNA, 336 bp, Glycine max
  Peptide Sequence Number=SeqID_181807
atgaccgtttggcaactaaagaaagccatgattatgaagggccaagacatttatagtagccaagatgaggttactacttcaccttcctctagtgaaagtgaagaagcaaaaggggaagaatctagtgaagaaattgactcccaagaagaaagggaccttttaatggtcagaaggcttctaggaggccaatcttgtgacttggtgcacttgtctatacataagaaacttaatcttgctaataatctctattacagaaaattgataatcttcaaaaatcagcttgttcctagacagtcagatgtactagactgtaattgctatagccaaacaacgtaa

SEQ ID NO: 90123 - DNA, 480 bp, Glycine max
  Peptide Sequence Number=SeqID_181808
atgctaacgaggaaagctgtgaattcatttcgtcaggtgctacttacaagagatctgcttccagattcccatgatgattatcatgaaatgctgaggtttctgaaagccagaaagtcgacattgataaaaagtccagatgtgggcagatatgttgcattggaggaggagtatggagtagattctatttacaggaatttgtatataaggagtatgaagaggtatagtgttattatcctcatggctaccatgggatttgagaaaatgtttaaagagaaattcccagcatgttctattgcagcaaagaggcatatagataaaacaacaacaatacttgatgtgcatggagtgaattgggttagctttagcaaagttgcacatgatcttgttatgcgtatgcaaaaaattgatggtgataactaccctgaggaaaaaggaggcaagctattcatgacaggggaaggtgaatttagtactaagtag

SEQ ID NO: 90124 - DNA, 879 bp, Glycine max
  Peptide Sequence Number=SeqID_181809
atgtggaactgctgccttaaaaacaaccaagtatcatcacaagatgaagataaagaaggtgagaaagttgagaagatcataaagacaatttcatgtggcatgaagaagaaggtaaggctcaaaacagaagatggtgaaggaagtcatcatggtgattctgcaagtggccctgtgaggattaggctggtggtgactaaggaagaattgaagaggatgttgagaaataggaatgagaatgatcctcagcacacttcgttggagcagttactaagcgatatggtgttgagagataaaagggtgtttgaggttgaaaaatatggtgggagcgtaaattcttggaggccaggacttttcatcagctttgataaatctgtcatatactctgtcggtattaggcctcatgagctttctcatattcagcagcttactggatttagcttgggtgacttcccttttagatacttgggtaagttagagttgatcagagcagttattcaaggaattgtgaatttctggatggagatttttcctttgccgcaatctgttctggaccggatcaacgcttcgtgccgtaattttctgtggggcaaagtggatattggcaaaaacaagcccttggttgcttggtcagtaaaagattctctatgggttcggtgggttcaacattactatttcagaggaagcgatgtgtggaattataatacttcttcatcagattcagttttgataaagaaaatcattcagctaagtacgaaagaggtcaaaaagaggattcaatcttggagcaccaacgaacaattgcttgttggcaaagtctatgaatacattagaggtgtcaagcctattgaaatctctccaagtttgggctcacattcttga

SEQ ID NO: 90125 - DNA, 1053 bp, Glycine max
  Peptide Sequence Number=SeqID_181810
atgggaagcgtggtagaaagcagagaatggtacttagctgcatattcccctcacggtgtaccaaattccgataatctgaaactccgcaccgtcgctctctcattatcctctgattcaatccccgacggccacgtgtccctccagatcctctttctctccgtagacccctaccttcgcaccagactcaccggcaccctcgacggtctttacattcagcaatatccactcaacgaggtgattacagcatatggagttggcagggtaataggatctaaagacagcaagtacacggagggtgatcttatattaactccttctgcgccagtggctgagtactgtatcttaccctcctctcgtgtaattcgaaaaattgacgctgctagtggaatttcgctgccggattatctaagtgccttaggggtgccagggtttgcggcgtgggtgggtatagtggttctgggagacccaaagcctggttcgaatgtgttcatatctgctgcgtccggtgcggttggtatgagtgctggccagttagctaagattcgaggttgtagggtcatcggaagcactggctccgacgaaaaggtgaagctcattaaagaggaatttgggtatgatgatggattcaactacaataaggaatcagattttgatgccgctttaagcaaatactttcccgatggcattgatgtctaccttgataatgttggcggtaaaatgctcgaatctgtacttaaccatgtcaacaagtatgcaaggataccactttgcgggatgatatctcaatataataaggtttggactgaaagagaaggcgtgaggaatcttttgaatatggtgggcaaggaggtgaggatggagggttttatgctggaatcgtattggcatcgttttgaagattttgctaaagaaatggaaggatacataaaagagggcaaggttacgtccaagaataaaataaacattggaatcgagagctttttggatagcttggcctccttgttctctagctctaatattggaaaagttgttgttcaagttaataaggcctag

SEQ ID NO: 90126 - DNA, 1089 bp, Glycine max
  Peptide Sequence Number=SeqID_181811
atgggtgaagaggtgaaaagcttggttgttgaagaggaaatgggggtggtggaaagcaaagaatggtacttggtatcttatgctccacacggtgttccaaccaccgatcatcttaaactccgcaaggttcgtctatcaattgcacctgaatcaatccctgacgcccatgttgccattgagatgctgcttttctctgtagatccatatcttcgaggcagattcactggaaccttagatggcctttattttccgcagtttgaactcaaccaggtgatcacaatatttgggattggaagagtgaaacgatcaaatgacagtaaatatgaagagggagatattgttttgagtgcaagttttcctgttgctgagtattgtgtgatgccctccagtgagatcgatgcaaaaattgatgctgcaagtgggatttcattgccggattatctgagcactctaggagtgcctggatttgcagcatggctggggatagaggtggtggcagaccccaaacctggttcaaatgtgttcatatctgcagcttcaggtggtgtgggaatgattgctggtcaattggctaagatcagaggttgtagggtcatcggaagcacgggatctgatgaaaaagtgaggctaatcaaagaggaatttgggtatgatgatggattcaactacaaaaaggaagaggaccttgatgcagttctaagcaagttctttcctaatggtattgatgtttaccttgacaatgttggcgggaagatgcttgaatctgtactgaatcatgtcaacaagtttgccaggataccactttgcgggatgatatctcaatataaccaggcttggacagaaagagaaggcgtcaggaatcttttgaatttggtgggcaaggaagtaagaatggaagggtttttgctgaaaacacatttcaatcgttttggagactttgcaaaagagattgagggccacataaaagaagggaggcttaagcccaagactaaaataaacttcggaattgagagctttttggatagcttgaactccttgttttctagctctaatattggaaaagtagttattcaagttaataaggcttaa

SEQ ID NO: 90127 - DNA, 228 bp, Glycine max
  Peptide Sequence Number=SeqID_181812
atggcgatgctctctacttttatgctttgttcttttcctaaaaacagtagacagatgcggcgtgcctataccaaacttttttactgctgtaatgttccccagtattcgtccaggttcatgttcctccaaggttttgatctcaatccattacaaactagacaacctaatatccgttgctttcagtggaatgaagatgtaactcatcagggaacggaaatgccttcatga

SEQ ID NO: 90128 - DNA, 1134 bp, Glycine max
  Peptide Sequence Number=SeqID_181813
atgctcaaaagaaatactgattcagaaggagcaacattgacagaggccagaccttttggtggctatgaaaattctgatgacacaagtattattcgattaaagaactacatgaatgctcagtattttggagagattggtataggtactcttccacagaaatttactgtaatatttgacactggaagttccaatctttgggtaccttcctccaagtgttacttttcaggtcatcagctgaaatccattatggaactgggcatatttcaggtttctttacccaggaccatgtcaaggtttgagatttggttgtttatgaccaggattttattgaggcaactagatgttggatttcaagagatatctgttgggaatgctgctccaatctggtataacatgcttaatcaacattttctcacacagccagtattttcattctggttaaaccgtaatactaatgaggaacaaggcggccagattgtatttggtggaattgattcagatcattacaagggtgagcacacatatgttccagttactcagaaaggctatttggcaggattatgtgctgccaagtgcttggcaattgttgattctggaacctctttgttagctggcccaacgggggtcattgctcaaatcaatcatgcaattggagcggttggtattgttagccaagaatgcaaggcattggtagctcaatatggaaaaaccatattggataagctgataaatgaggctttgccacaacagatctgctctcaaattggtttatgtacttttgatggtactcaaggtgtaagagaacatcttgtagttggaatgatgccggatgcacagcttctctgtgatttggtccccagcccaaagggagagtcagttgttgaatgcaatactttatctgaaatgcctaatgtttcattcaccatagggggagaagtgtttgagctttccccagagcagtatattcttaaagtgggaaaaggagccacagcacaatgcattagtggatttatagctttagacattgctcctcctcgtggacctttatggattttgggggacattttcatgggtagctatcatacagtgttcgattatggcaatatgaaagttggatttgctgaatcagcataa

SEQ ID NO: 90129 - DNA, 825 bp, Glycine max
  Peptide Sequence Number=SeqID_181814
atgggcaaaaacttaaggcttttggatgatcttcatgttcacattcttgcttctcgtgaatctagttcgggaagggataccattcgcatggaataccttactcttcttaaagaaatgacagagcccctgccaaccctgcctaaggtggctgaagcagttcagcaagttgtggaattgatgaatacatactctatcagtcaagaagattttgatactatatctttattccatataggaagggagccaaaaaatccaacactttcctattatatccttttcttctccttcctctctcttctctattcttcttcttcgccgaaaaccattatttcccttcatcaacacactacaccatatctcaaatcgctaacacactttgtcgcacaccgccattacaaaccactatttccactcaccaacactcttcttcttcccttcgttctctactcccatcgcctcaaagctccaccatctccgccattattgacgacaaacacttcatcatacctagcggtcgcaacaccacctcaaggttgctccgccacaaaccttaactgtggtccctcgcatagtggcgtgctaactctcctacaacgacgagatcgagatcgcgttccactacctccgcaacgtagaccccctcctctcccctctgatcgacattcaccaaccctcaaccttcgacaatttctacactcccttcctcgccttaacctgcagcatcttgtgccagcaactcgcgtacaaagttggctcctctgtctacacacgcttcatcacttgatatttaacattattttgagaatattgctacatcttttttaa

SEQ ID NO: 90130 - DNA, 1620 bp, Glycine max
  Peptide Sequence Number=SeqID_181815
atggtggattttttgccaaccgctgtagacaatttgcgaaggaaggcctgccatggcagcgccataagctgtacacttgaagctggagtcaaaatatactccttaagggtggattcggtgcattccgaggcatataaagtccttgctagaatgaatagagcaggccaagataccgaggaagttgcatttgctgtggatccactctatcgtcagatgtcagcacaatttgatgaaggtggagccaaaggccttttgatgaataatcttggcatatatggtaaatgtaggttgctcttcgattcactagaagtgccagggaagtgcataaccagtcaaaatgaaagtgatatttcagatacaattgatctttctttcgccagagattgtgttgaacaaatgatattggacatacatacgaagggtgaaatctctccaactctgagggtgatagtaaatcaatttgatgaaaataataaaaggccttctgattttcaatcttctactgagaaatcaggtgaagagtttgatgcagctattgatagtgaacttgccactgaaaaagaatatgagaacttcccctcctggagtaatgatcatgatagtgaagcatttcctgctgaatggggctctgatgatgcagacccaacttttccaagttaccatcaggaaaaagaaccttttcattcccaagaccctcctgatatggatgacatatttgaaaatgttgatgggtatttgtttttgagtctgggttttaggtcaaagaaaaatgcatgggcaggcactgatcattggaagtttcaaaaagctaaaggctcagaatcagaggttcatcgtgcttctgaggatgtgttggtccagaaaaccaggcagccagggacaaagagacaagtcgaagttgatttagatttcacaagttttgtcgagaaaaaaatatccgatatcttttctcctcccaggaatcccaaatcattacagctacctgaaaatataccacctagcattacaaaacttccagaggactgccactatgaaccagaggatcttgtcaatttatttcttttgccttatgtaaagtgcattgggaggaaggcaagaaagctctcaggtgaatttgcagatgtatcaggagaacaatgcaataactatgaatcattcccttcctgggacaatggaagtgtttgtgatgatgatgttactgatgtacatagtgaaatggatgactctacctcacttatttctcagccacgtcagttagagcataagtatgattatttccaaataacacagatcaataaagttgaagtccagtatgacaaaacattcaaacaagtcaatgttcaggctctgaaaataacactttgggaccatattcaagaatccgttcaagttccgattcagggtaaaaaagaagtggtatctttcaagcacatgttgaccaactttcctagtaaatgcaatgctgctgcaactattagtgacatatctccacatttgtgtttcatatgcctattgcatttggctaatgagaaaggattgaacatccaaagctgccccaacttggatgatcttggcatatgcctacctgatgatggtgccactattactggaacagtttag

SEQ ID NO: 90131 - DNA, 579 bp, Glycine max
  Peptide Sequence Number=SeqID_181816
atggcggacgtcacggcgaacttgcaagcagcaaccaccgcatccaccccttacgcgctccccaccaatctccctctcctctccgctttcctctccttcgctctcgcacagttcctcaagatcttcacctcctggtataaggaaaagagatgggattctaaaaggctgcttgattcgggtggaatgccttcgtcacattctgcaacagtctcggctctggctgttgctataggtctccaagaaggggcaggatcaactgcttttgcagttgccgtggtcttggcgtgtattgtcatgtatgatgcctcgggagttagacttcatgcaggtagacaagcagaattgcttaatcaaattgtgtgcgaactacctccagaacatccttgttccaatgtcagacctctgcgtgattcacttggtcatactccacttcagattgaagattcaaatagaattcctccacaccaagatggagaacttactcgtgaaagattgaaatgcctcaaaaggtattttgatgatgataatgaaagaaggcaagtgaacgcaaagtttgcaaacttttctggtggaagataa

SEQ ID NO: 90132 - DNA, 1209 bp, Glycine max
  Peptide Sequence Number=SeqID_181817
atgccatatatgacgctgcctcgaggattctccattgtgttcctccttcttgctctgtactgtgcattagacccctttgagcccagccccattgtgggtttccctccctttgacgtgcacaaaattgacatgcccgcatggtctgaggttcctacggaccgagacaaagacaactcgttgctgaaatcggagctcttgtttgtgaaccaagtgcaaggaccagagagcattgcctttgatcctcttggtcgtgacccttacactggtgttgcagatggaaggattttgttttggaatggacagtcttggactgattttgcatacacctcccccaataggtcacacttctcttcattcctcctcactttgccaactcaactgctaaatattacaattctcacttctcagactaaaaagctaggcttcaactcttctaaacacgtgtcagaacaatataatcctaaggcatctgcatctccaatgagttatgtcaaaactgagcacatctgtggaaggcctttgggactcagatttgacaagaaaagtggtgatttatacattgcagatgcatattttgggttgatgaaggtggggcctcagggtggtttagcaacatctcttgcaactgaggctgaaggggtgccgctgagatttactattgatgtagacattgatacagaggggaacctttattttacagatagcagcacaaactttcagaggagcaatttcattcagctggtactatctggtgaggctagtggcagggttttgaaatacaaactgccactaagaaaccactgttctcatgaggaacgttcaatttccaaacggcatctccttaagcaaggatggttacgtaagtactggctaaaaggagataaagctggaacttcagagatcttagcaatcctccctgttttcctgacaacaaggtatatgtacagttacctgaatagtctatacccaaaaatgagaaaagtcatactcaagctacctattccaacaagaattcaatacatgtttcatattggaggcaggttccatgcagtagctgtcaagtatagccctgaaggtaaacttctgcggatattggaggacagtgaggggaaagttgtgagagctgtgagtgcagtggaggagaaagacggtaaactttgggtgggaagtgttcttatgccttttatggcagttcacaacttgacatga

SEQ ID NO: 90133 - DNA, 1272 bp, Glycine max
  Peptide Sequence Number=SeqID_181818
atggatcctctatgtgagttttgtggggtggtgagagctgtggtttactgcaagtcagattctgctcgtctctgcttgcattgcgatggctgtgtacactctgcaaattctttgtctcgcaggcattcgcgttccctcctctgcgataagtgcaattcccagccggcaatgatccgctgcatggatcataagttgtcattgtgccaaggttgtgactggaatccaaatgactgttctgcattgggacataggcgtgttgcattgaattgttacactggttgtccctctttggctgagttttccaggatttggtcctttgtgtttgatgctaattcctcacttggtggttgggaatcggttggtactttgccaaaaagtgagagctgcactagccagtgtttggagcaaactgatcataacggtggttcctttggtttggtgagtgacaagttggatgaaattgaatcttgtgtcatatatgaaccttggatggggcagtctcaaatcattccatcaaatccaaattacacgccgttctgcaaagacgaagcatttttctttcctcaagactcaaaccagccaaaggaatgtcctaatctaggaattcatgatgggagtgaactttgtgaaggtttcaatgttgataaccttcaattaaactttgaaagtgctgatgaaatatttggctgttcacaagatgccacaagataccaccttgaagatggaggaatggactgtttattgatggataaaaacatatcagtcacagaatctaattcacttattgagagtgccttggaggcatcatcatctatccaacaagattgtgtggcttttcaatcatccagggcgggtgggtcagctagtgtgatgcaggttatcaacagcaatacaaattctgcactaatgaatcctagctgcactagaaacatcagtctgggatttcctcagggtgttcattcaaagatgccacttcaatttcccaacattgttggtgaaaataattctactgaatatcaagactgcaggttttcgcaagtgtttctgccgggtgaatccccctgggaatcaaatttggagggtacatgcccacaagcaagggataaagctaaaatgagatacaatgagaaaaagaaaactcgaatgtttggtaagcaaataagatatgcttctcgcaaagcaagggccgatacaagaaaacgtgtgaaaggtagatttgttaaagcaggtgaagcatatgattatgaccctcttgggacaagggacatctaa

SEQ ID NO: 90134 - DNA, 435 bp, Glycine max
  Peptide Sequence Number=SeqID_181819
atggaagattacccaatagtgactgaaggtacaaaagttgacctaaccatcaaaccagtggagccacaccctaacaaaatgcaaatcacggaaaaattttcagctagaaagtttgacattgaggtggacagaacagacactcccttgaatcgatcaagagaagaacctcccacaaggaagttaagcttggtagtacaaacttcctctagtttgcttaatgctgccaccattccactggagatgagagatgcaagcacagtcggagacctgaagcagttactgataagcagaaaaattcttccagttgatgactatttgttcatacacaagcagaggatcatgcgtgatagctgtagcctcaggtggcatggaattgaaaatggagactgtctctatgtgtttaaggggacagttagtcgcagtggttatgcatga

SEQ ID NO: 90135 - DNA, 624 bp, Glycine max
  Peptide Sequence Number=SeqID_181820
atgggggaaatgggggttagatcagctaccaacttaaaccagttgtttgacctgctacacaccaaagtgcctcctactggttatggatatggttccattggccaaggcatggaccaagtgaacggtctagccttgtgtcgcggtgacgtcaacgccacaaactgcatggcttgtgtcaatgaagcaaccaaaaagcttcaagagaggtgctcaaagaagaagggggcaatagtatggtacgattactgccttctcaagtactcaaatgaatacttctttggtgaaattgatgagaagaacaagttctatatggttaacatatacgacgtggatgacccctctactttcagtgataaagtcaatgagttgctaagtggtttgtcttataatgcttctcaaactcccatgttgtatgccgtaggggaattgcaactccaagagtcaaaaacgttgtacggtttggctcagtgtacaagggacctccttggccctggttgtaagaagtgtcttgatgatgctattagtgatcttccaaattgttgtgacggaaagcaaggtgcacgggttgtgggtgggagctgctatgttagatatgaactataccctattgttgaggacccctag

SEQ ID NO: 90136 - DNA, 603 bp, Glycine max
  Peptide Sequence Number=SeqID_181821
atggggagaacaagcacaggtgttaacgctcctgctaatagtccacacttacgcaagtctgggagtagacctgtcgtttatgatcttgatgaacatgaggtggaaaatggcgtcgaggagggtctattgcatcccgtggaggcatctgattcaaagggtggtgtgattcccgtgagtgctgctgcaatgatgccatcgcccgttttgttgtggagattcaagattgagataatgggccctgacctcaaggatttcatcatatttctacaaactggaggattgcaggttggatgggattctgtcatgagaatgagtgcagacaagcgggagttgttcctttatgaagcatttttgtattttaatcctcttcttctagcggctttgatggtttggctgtggggaatcaacttatggtttttttctcaaggtggagtcaattatgcaaaaatatttgatcttgatcaaaatcatctgactcatagagaaatatggaaggtatcaactcaccactttgatttatgccttgtttggcacataaaatcagcttttgccagatctgaggggaataaaaatggtagtgtcatgacttgggaacaagagtag

SEQ ID NO: 90137 - DNA, 1167 bp, Glycine max
  Peptide Sequence Number=SeqID_181822
atgtgttattgtttatccagaaagagcagtggtggtggtggtggtggtggtggtagtaggagtgaatcgaagataatgttctcaagcccattcgtgttaaccttgtctctcttgatatccctaccaatcctgttcttggtggccccacgcatcctccctcctcctcctcctcctcagtccttccacatctccccctccgacgaagtcgatgacatcaagctcttcaaccgcgccatctccctttcctccccccattcccacttccacctctcctccaaaaacccctctcttaaaatcgcctttctcttcctcactaactccgatctccacttctcctccttatgggaccagttcttctccaacaccccctccaaccttttcaacatctacatccacgccgacccctccgtcaacctcacccgccctttgtcccctcttttcatcaacaaattcatctcctccaaacgcaccttccgctcctcccctaccctaatctccgccacccgccgcctcctcgccaccgccctcctcgacgacccctccaacgcctacttcgccctcctctcccagcactgcatccctctccactccttctcctacacctacaagtccctcttcctctcccccaccttcgactcccaagaccccgaatcttcttcttccacccgcttcggcctccgcctcaaatacaagtccttcgtcgagatcctctcccacgctcccaagctctggaagcgctacacctcccggggtcgctacgccatgatgccggagatccccttcgaagctttccgcgtgggctctcagttcttcacgctcacgcgccgccacgcgctggtcgtcgtcaaggataggaccctgtggcagaaattcaagatcccgtgttaccgtgacgatgaatgctaccctgaggagcattattttccgaccctgttgtccatggcggatcctgatggctgcaccaaatacacgctcaccagggttaattggaccggcaccgtcaacggtcatccttacacttaccggcccacggaggtctcgccggaactcattctccgcctccggaagtccaaccattccgagtcttacctcttcgccaggaaattcaccccggattgcttggagcccttgatgcgcattgccaaatcggtcatcttcagggattga

SEQ ID NO: 90138 - DNA, 2115 bp, Glycine max
  Peptide Sequence Number=SeqID_181823
atggatgtcgattcctcgatggtgccggagaccgatcacgatcccgccgtacagaaccacgccgccgatgacccggcgccggacgcggcggagggagaacagctaggggagccgccgtcgtccggaggcggatctccggagcagacgcagccggcgcctgcttcggcgccgcagagtccggtggtcggaccgaggctggcgcctagttacacagtggtgaatgcaattttggagaagaaggaggacggaccggggccgaggtgcggccacacgctaacggcggtggcggcggtcggagaggaggggaccccagggtacattggtccgaggttgattttgttcggcggtgccactgctcttgaaggcaattccgcggcgacagggactccttcatctgctggaaatgctggcatacgtttagctggtgccacagctgatgtccattgttatgatgtcttgactaataaatggtctaggataactccctttggagaacctcccactcctagggctgcacatgtggcgactgctgtaggaactatggtggttattcagggtggcattggtcctgctggtttgtcagcggaggaccttcatgttcttgatctcactcagcaatggccacgctggcatagagtgtctgttcagggccctggacccgggccacgctatggacatgtaatggctttggtggggcagaggtatctaatggcaattggaggcaatgatggaaagagacctttggctgatgtatgggccctggacacagctgctaagccttatgaatggcgcaagctagagccagaaggagagggcccacctccatgcattgcatatggacttgctaaacatagagatggtcgttgggaatgggcaattgccccaggtgtctcaccatcaccaagatatcagcatgcagcggtatttgttaatgcaaggctccatgtgtctggtggggctcttggtggaggacggatggttgaagactcatcaagtgttgcagtattggacactgctgctggtgtttggtgtgatataaaatctgttgttacgagttcaagaactggtagatacagtgctgatgcagcaggaggagatgctgcagttgagttgactcggcgttgtaggcacgcagcagctgctgttggtgacctaatttttatttatggtggtttacgtgggggagtcttgctagatgacctacttgttgctgaagatcttgctgctgctgagacaacagctgctgcttcacatgctgctgctgctgcagctgcatctgcatctaatgtacaagcaggacgcttacctggacgatatggatttgctgatgatagaacgagggaaacgatgcctgaggcagctgctgatggttctgttgttttaggaaatccagttgcgccaccaatgaatggtgacatttatactgatatcagcactgaaaatgccatgcttcagggacctcggcgaactgctaaaggtgtggagtatctggttgaagcatcagctgcagaagctgaagctatcagtgcagcactggctgctgccaaggcacggcaggagaacggagaagttgaattgcctgacagagaccgtggggcggaggctaccccaagtgggaaacaaacatcttccttgattaagcctgactctgcaggttcaaataacattactcctgggggagttcggctgcatcacagagctgtggttgttgctgcagagactggtggagcattaggaggcatggttagacagctttcaatagatcaatttgaaaatgaaggcaggcgggttggttacgggactccagaaaatgcaactgctgccaggaaattattagatcggcagatgtctatcaatagtgtgccaaaaaaggtcattgcacacctcttaaagcctcgtggatggaaaccaccagtacgccggcagtttttcttagattgtaatgaaattgctgatctttgtgatagtgctgagcggatattttcaagtgaaccaagtgtcttgcaactaagggctccaattaaaatatttggtgatctacatggacagtttggtgatctcatgcgcctttttgatgagtatggtgcaccatcaactgctggtgacattgcgtaa

SEQ ID NO: 90139 - DNA, 1359 bp, Glycine max
  Peptide Sequence Number=SeqID_181824
atgaagcaaattcatgcccaattaatcactaatggcctgaaatatcccaccttttgggccaagttaattgagcattattgtggctcaccggatcaacacattgccaataatgcacgtttggtgttccagtactttgacaagccagacttgtttctcttcaatactctgataagatgtgtgcaaccaaatgattctattcttattttccgaaatgagttttctaggggactcatgttttttgacgagtacacttacaattttgttcttggagcctgtgctcgctctccttcagcttcgacattatgggtcggtagacaactacatgctctgatagtaaaacatggggttgagtcaaatattgtggttccgactaccaaagtatacttttatgcgagcaacaaagacattatctcatcccgaaaagtgtttgatgaaatgccgagaagaagcactgttacctggaatgctatgataacaggttattcttcccttaaagaaggaaacaagaaatatgctctcaatgcgttatacttgtttattgacatgttgattgatgtaagtggaattaaaccaacagctacaactatagtttctgtgctttcagcagtttctcaaattggtatgctggaaactggtgcttgcatacatgggtttgcagaaaagacagtgtgtactcctgaagatgatgtgtttataggcactgggcttgtcgatatgtactcaaaatgtggatgtcttgatagtgccttgtctgtcttctggcgaatgaaccagaagaatatcatgacttggacggcaatgactactggcctagccatccatgggaaaggaaaacaatccttggaggttttatataaaatgggagcttatggtgtgaagccaaatgaagcaacttttactagcttcttgtcagcctgttgtcatggtgggcttgttgaagaaggccttcaattgttccttgaaatgaagagaacatttggtgtgatgcctcagatacaacattatggttgcattgttgaccttcttggccgtgctggaaagttagaagaagcctatgattttatcatgcagatgccaattaatcctgatgctgtaatatggaggagtttgctggctgcatgcaatattcatggggatgttgtgatgggagagaaggtggggaagtttcttctccagttagaagagtggagttctgcagagtctccgaagagcgaggactacatagctctgtcaaatgtttatgctttagcagaaaagtgggatgacgttgaaactgtaaggataaaaatgaaagctaagagtattttaaacaaagctggttctagcgctgttcaaactgtcagcatggctgtgttgtaa

SEQ ID NO: 90140 - DNA, 2883 bp, Glycine max
  Peptide Sequence Number=SeqID_181825
atggggtttatgttgaaagaagctttgaggactctctgtggtcggaatcagtggtcttatgctgtgttctggaagatcggttgccacaattccaagctattaatttgggaagaatgctattatgaacctttaccatgccctccgcacatgtttgggatgcctgatttaccttaccaaaatggggaaggatgctggttttctttagagtatcggtcatcgcagcttgggattcaagaggatgaccaagtctcttctttgattaacaaaatgacagtaaacaattcagttatcattgcaggtgaaggtatagttggacgggctgcatttacaggcagccatcagtggattcttttgaacaatttcactaaagatgcatatcctccacaggtatatgctgaggtacatcaccaattttcagctggaatacagacagtagcagttattcctgtgcttcctcatggggttgttcaacttggttctttctttcctataattgagaatatgggatttgtgaaagatgtgaagagcttgatcttgcaattgggatgtgtttctggcgcccttctatctgcagactattcagaaaaactttctaatgaaagacttgctggacctcctattgctggtgtacctgtgtctgtcgatcgacctgtcattacctcaaactgtcctccctcagtaactactggctccaatcagcaaaataattcatctcatgcttcaatgccttgtcctctaatggaagacacaaatacttgccagggttctgcattgacacccctaacccgtaaactgagccagatatccaataaaccttgccaaccaaaggttattcgaatgagtaaaacaagctttgctagccaacaagagaatagagctgtcgaagctgaagtaataccctcagatcttgattcatgcctgcagcagcattctgtttcatataatgcaagatctgcattcagtaacataactggtttggggtctcttggtcaatctggtctaagtgttgataatcttgcattaatggagcaacaaatcttatcaggcattgggaatcgagataatgttaacccttgtgtaaatgcctcaagttccttgaacatgtctcaactaaaaacagatggagaccatctacttggccacaatatgagttttgacagtacttcactagtgggaggagtcccactacatggtgggatgagtactcttttgagttcaactctgattactagttctggttcaaaatctccccgagcatccacagctgttttatctggagtaggagttgggattggacctcaaaattgtgtttcttcaactaaagcaagggtttgttctttggcaaatttgactagtcaaccaggcaccttccccaagcatgtagaaggttctgatcagaagattctccctgtagatttaaagtgtgcttcaacaaatcaaaagatagactatgatatgcttcaggcccctaatctcccttctttccaagttgaggaacatgtgcccattaatagtcaaatccctggttttgcccacgattgccttcttaaagatggtagtagtcaatctatgatgacaatggatcctaaacacaaactagattgtgctaaacctccatcgggtgatgacttgttcgatgttttaggggtggatttgaaaaaccaattgctgaatggaaactgggataatctctttacttatgaatcagatgctaatgcagaaaatatggacaaaaagatagcacctatgaacatgcaaggtgcaacaactaatcctgatatttattcggttaaagaagcaatatcagactgcggcatcttttctgggatgggaacagaccacctcttggatgccgtggtctccaaagccaaatctgttgtgaaacaggattctgatgacatgtcttgcaggacaacattgacaaggaatagtacttcctctgttccttctcctgcacggaggacggtagtgtctggtcatttccaagggggattatttgatttgcctaagaatgatggtaaaacaggtgccacagaaactagttttcttaggtctggatgtaacaaggatgatgctggaaactgttctcaaactagttctgtttatggctctcaacttagttcatgggttgagaatagtgggagtgtgaaatgtgagaatagtgcttcaactagatactcaaagaggccagatgaagcttgcaagccaaatcgtaaaaggcttaaacctggagagaatcccaggcctcgaccgaaagatcgtcaaatgattcaagatcgagtgaaagagttacgagaaattgtgccaaacggagcaaaatgtagcatagatgcacttttggaacggaccattaagcatatgcttttcttacaaagtgtgacaaagcatgctgacaagctgaaacaaacaggggagtctaagctgaaacaaacaggggagtctaagattattaataaggaaggtgggctgcttttgaaagacaactttgagggtggggctacatgggcatatgaagttggctcacaatcaatggtttgccctattgtagttgaggatctgaatccacctcgtcagatgctagtggagatgctttgtgaggaacgaggtttctttttggaaatagctgacttaatcagaggattaggtttaaccatcttaaagggggtaatggaagctcacaatgacaaaatctgggcgcgctttgctgttgaggcaaacagggatttaacaaggatggaaatatttatgtcactagttcgtcttttggagaaaacggtgaagggcaacacatctccatccaacgcaattgataacatggtgtatcactctttcccacaggctgctcagataccagtaaccggaaggcctagtagtttgcagtga

SEQ ID NO: 90141 - DNA, 384 bp, Glycine max
  Peptide Sequence Number=SeqID_181826
atggcgaagacaaagacgaagaggaacttacctcgacaatgccgacgcgaggacgcaacaacaccaccgtcaacacccatagaagacgaacgaagcacgcgattggaaggtcacgaagaagaccaacgaaggtcacgaagaagacgcacaagaagacgcagccaagctttttcgaaaggaagaagaaggattcgaagaaggatgcgtaggtcaccaatgaaggtcacaaagaagcaacaatggcgaggaagaagaggaagaagcaatagaaatcgtgaagaagaagaaatggcggaaatgaacccaataatgttgggtgcacctagcagcactcaaagcaaagaggccaacaacaggtccactggatttaatttttctcactaa

SEQ ID NO: 90142 - DNA, 999 bp, Glycine max
  Peptide Sequence Number=SeqID_181827
atgaacgaccttctcactgattcatttgttggtgaggctagtaatggccagcctgcaagacaaagtgatgttgaaatgggacaagttcctagaagcaactctgatatgggaatggaagcttttaataagcagatacatgaggctgataaacaaatcgataagctgtctgtgctacttcaaaagctaaaggaagctaatgaggaatcgaaagctgtcacaaaagcatctgccatgaaaggaatcaaatctgttgctaaagcatctgccataaaagctatcaagaagaggatggaaaaagatattgatgaagttggaaagattgcacatggtgtcaaaacaaaaatagaggctataagcagagataacctatccaatagacaaaagcctggatgtgagaagggaacaggtattgacagagcaagaatgaatatgacaaatgccttgactaaaaaattcaaggatctcatgacagagttccagactcttagacaaagaatacaagacgaatatcgtgaggttgtggagagaagagttattacagttacgggaactaggccagatgatgagacaattgatcgcctgatagaaactggaaacagtgagcaaatcttccagagagcaattctagaagcaggccgaggacaggtagtaaacacagtagaagaaattcaggagagacatgatgctgtaaaagaaattgagaaaaaacttcttgatttacaccagatttaccttgacatggcagtcttagttgatgctcaaggagaaatcttagacaacattgaaagtcagggcacatttagtttgatttgcgttaatgagaggcttgttcaggtcaacaatgcagtcgatcatgtccagagagggacatctgcacttcaaaatgctaagaaactccagaagaactctcgaaaatggatgtgcattgccatcattatactgttgataatagtagctatcatagttgtgggtgttctcaaaccttggaagagtagctag

SEQ ID NO: 90143 - DNA, 945 bp, Glycine max
  Peptide Sequence Number=SeqID_181828
atgatgcgtgaaatggagcaaaagcttgcaaaggttgatgcactttcagacaaggtggagggtatttctaatcagttggacaaaaggtgtttgcaacaacatggcaccttgtcagaaattaataatgcatttgatgcgatttcttgtaaattttgcttatctgaagactatcttgtcgatgcttatttggctggtttgcaagatgaatatgttaacccagtccgtttattcaagctaagaaccatgagaggagcttgcagcttggcacaagaaataaatcttcgacaacatgatgagaggaaaatggctaccaagaacatgagttacatggctcctggaagcaataatacaatagagagtacccaagataatcgaaagtccatcaagaacgcaatagtagagagtgagtcccagccaaaagagaagtcagcagcagggacaataaatagaatcgtttttccccccaagaattcatcaagaacgttgaaagctttaactgtagaagaactcattgagcttgatgaagaagaagttactattgtagaagaagctgaatgtgataatgaagataatcctaacattagcttgcttgcaattgaagtaagttggaataaaaagattgaaggagtatggtatgtggaagagattgaaggtgtatggtatgtctcatttaacttggatgggaggaagaaagggaagttattaattggcaatgatgttgagttgaggcatcagttactagaatggatgcattctagcattcaaggaggtcattcaggggatactatttgggttgttattgatcgtatgagcaagtatgtcgatttcgtggccctttcacagccatatacagtggcaacacttgctcggcatttcatggatcagatttacaaactacgtggagcactagttgagataattagtgatagggatttgttttcatga

SEQ ID NO: 90144 - DNA, 1335 bp, Glycine max
  Peptide Sequence Number=SeqID_181829
atggagcgtgtcgcagaaccgcatcatgtgctttatgtcgtaaacgttgttcccgaaaaacgccctcaacatgttcaagaactcctccaacccgctcggcaggctccgccgggtcaggatcttaaccaagtacccgaaatcgtacgcgctgtgaaacgtcacccaactcaccgagtcgttgcagacgagtcccgaggacatcacgagttcggcgaacaggtaggagtcgacgccctccgccgcgttgcggcggaagtcgattccctggcggcggaggagatcgatggagtcaggcgcgtgggcgtcacgctccacgtcgaagtcacggaagttgaattcccagatgaagcggttggcggttccgaggtgggggagatttccgttggaatcagagagagtgagaccgatctggatcaggttaagtgcatcaacgttggacttgagaaagcggtagtggacggaaggtgggaggtagggttttgtggggtctacagtgtggggacggaaaacgacgccggggaattcggtgtccatggaaatgaaagggtaatcatcgatgacttgacgaatcagctggaattcggattcgaggttggatgcccagacctcgcggatcaggatggtcttggaatgattagggtgagggtgtgggcgcgcgtgaagcggtggggtgtggataagttcagtcaaagtatcaatcgaagtaatgggagcagtgaggtaagagtgttgctgtcaatgaggcatgatgctttctacgtcaggacttctacgacggttgcaaagaaccgtcgtaaaagcacgtggcaaccacctgagtgggccgacgagtatacaaagacggtggtctgtataaacacgtcatcatcttcgtcatttagttacgaagacggtcatgcccaagacctgtcttcgtattgttggtggttacatgtggatgacacgttctttaatgcgtcaacatacaaagacggatttattctaagagccgtcgttgacccgtcgttgtatcccaaattgtatcacgtttacggcacgtgctcgttactttctcttactttggcgcgccgtatcacttctttgctcgatttttcgactacttacccttactttggcgccctagctacacagagcttcttctccgacaaagaccttcgtctccgacaaacagcatctcgtgtccgttgcctcttgttccgtttgcagccgccgccgacaaagtgtttaaggaagataaggtggttccataagtggggtttaaaatccaaagacgagcttcgggaacagcctgctgccatccttcatcagtggtgtcatcctgtgccacatcattag

SEQ ID NO: 90145 - DNA, 717 bp, Glycine max
  Peptide Sequence Number=SeqID_181830
atggctcacctcgcgcacgtgcatcgcgccgccgaccttcccgcagcacgtgacctttacgacgcactggactgtctccatgggcacggcgtagagcacctcgagctccgccgtgagccagtggcgccgcgccgaaaccgggcggcggctggagaggttcgcggcgcgttttcgggtcgggtcgatgatgatccagctgagggcgagattctccacgaggtggttgagcaattcgatttcgtcgttggtttgggcgaatttcaggggagtggggaccacctcggtggggtcgaggaggtccacccagaggggggagcagaggaaccaccccttgtgggtttcggttcggatgacgcgggaaaagacgggtttgcccttgtagtatatgtccacggcggagatgagctccggcggcggaggtgtcggtggttgtgttgggatgggattgggaggggagtggtggagggaggggaaggagtcggagaagatggagcggtgggtggcggggaaggtggcgatggtggccgcggcgaggggatcgttgagagaaggccacgtggcggcgcagatgttacgccagaggtggtgttcggtgcagaggccgcggaggtgagaggtggcggaagcggcggaagcgagggtggggccgtcgaggcgattaaggatgtgggattgaaagatgtcggggtggacggtggtgatgtccgacgaggatga

SEQ ID NO: 90146 - DNA, 273 bp, Glycine max
  Peptide Sequence Number=SeqID_181831
atgacagaaaagcagggagaaaggcaggaagctctgacagtcaacaggggaaatgatgaaagagctgtgtgtgagtctggctcattttataaagagaacgatcagatggaccagaggacaagggcttgcggaataacaaacatgaaggagagttcaggagacggggacattgatgaagctggctcaacaggtgcaagatcaaagttgggtattggagtcaaatgttttcactgtgaagaacagtttttttcccaggcacatgtgtcagaataa

SEQ ID NO: 90147 - DNA, 1335 bp, Glycine max
  Peptide Sequence Number=SeqID_181832
atgcgaatgaagccaatccagctcccggagccgccaagccccacggcggcgcgtggcactccggacatcttcgaatccggcgtccacaccctcgtccgccgcgccgtcgtcatcggcaacggcttcccctcctccgagaatcacagcatcggtttgctccgcgcccttggcctctcccacaaccacctcctctaccgcgttacgaggccgagaggtggaatcaacgattggctccattggcttcccctctctgtccatcgaaaatttcattacctaatttccatgttccgcgccttctcctccaaatctcactacctgcccctcacttcccaccctaacggcttgtcctctattctcgaagctgatgccaatcacatagtcaatttggctcgcgaaacttgtgaaaaggagggaccgttattggtggttgcatctggaagagacaccatttctgttgcgagttccataaaacgtttagctcctgaccttgtttttgttgttcagatacaacatccaaggtctcatttgaataggtttgacatggtaattacacctcatcatgattattatcctttgactccagaaggacagaagcaggttcctaagtttcttagaaggtggataactccacgcgaacctccagatagtcatgtggttctgacattgggagccttacatcgaatagattttgcttcacttcgcagtgctgccattacatggcaagatgtgtttgcaaatgttccaaggccattgctcgtggtcaacattggaggaccaacaagttgtgaaaaagaaggactaacagtataccctcagaagaaaaaaaggataatgcttatgatccaattgcaaggaaactgtcggtatggtgtcgaccttgcaaagcagttagcaacatgtttgctcagtgttcttggtagttgtgggagtgtaagaatatccttttcagataggactccacaaaagttatcgaatattatagtcaaagaacttggaaataatccaaaagtttatatttgggatgggcaagaaccaaacccacaaatggggcatctagcttgggccgatgcatttgttgtcacagcagattcagttagcatgataagtgaagcttgcagcactgggaagcctgtgtatattatgggagctgagcgttgcagatggaagttcacagaattccacaaatcattgagagaacgaggagttgttcggccttttacagggtctgaggatatatcggaaaattggagttatccaccccttgatgacacttctgatgcagctaaacgggttcatgaagcgcttgctgcccgagggtggaaactgaagatatag

SEQ ID NO: 90148 - DNA, 114 bp, Glycine max
  Peptide Sequence Number=SeqID_181833
atgcattccgccgaggagcactgtcgaagagacaaaaaggaagaggaagaggaagcgtcaaagcgtgaaggagtaaacctctcggagcaggaaaaatctctcatgacaacttaa

SEQ ID NO: 90149 - DNA, 333 bp, Glycine max
  Peptide Sequence Number=SeqID_181834
tgtggaaggtgtggccaaacccatcataacatcagaagctgcaaaaatattggagttcctattaggccaaagaaatatgttgcaccaccaacttcaaatgaggatgacgacctactagctcaagatgagcaagctttgaatgaggctgaagaagctgctgctcatgttcaagaaggtccggtggagattaatttatctcagcttaatttgtcacaagatagtgacatgaagttcatggtccttgcaactattgttccactagtagcaaagaataagctaaacataacaagacccaaacaaaggaaggttgctgataaggatgatgcagtataa

SEQ ID NO: 90150 - DNA, 576 bp, Glycine max
  Peptide Sequence Number=SeqID_181835
atggacataaacacacacctagcactaggaggccttctggggacctcaggttcaaactcaacaggcaagcccaagaaaccattgaacctatcaaaggtgacatgcgcaacatggcgcacgttcgttggggagccaatgtccataatggagccgatgtttttgcgaggaagctggaaggatttcctgagaagggtcagaagaagcgccaagagaggtcggaggagaaaggcattgggagaagagaatgaagaggttgttggtgttgttgtccttgtctttgttgttgttgttgttgttgttgtccttgtctttgttggtggtgatgaagcaacaaaacgaggtggggaggagtggaggacctcggtcatggctggcaatgaaagaggcctttacttggaatataaaaaacgaaagcacaaagattttgtttcagaaaatgccaaggttgtgacttggagttggattgaaggaaagtgcagtagtgtttctagggtgtgggacgtgagaatcattaactcagtttttctttttaattttcatattttttatgttatgttgcgtgctgtggagcgttga

SEQ ID NO: 90151 - DNA, 201 bp, Glycine max
  Peptide Sequence Number=SeqID_181836
atgtcgataggccacatgccgttttggaagtacaaatttctagcgggagttcaatttgaaaaagagtttaagcttctaagcgaagtgtttcatggcctcattcgtatgattgatttgaatcttcaagaagaattagatggactaaaacttgaagtagcccaacttcaagcagcattagatggactaaaacccttgaagtag

SEQ ID NO: 90152 - DNA, 1416 bp, Glycine max
  Peptide Sequence Number=SeqID_181837
atggaagaaagcaaattgtcccacaacatacctacagggagttcgagaaaactcgtcacttcccaaagccctccttcactttcccttgaaccaaatgagaagctcaagaataacagtcaagaatgcaagtctccaaatactaatgacaaggccaaggacccagaaaaagggcatagtgagaatattggtaaggttgatgatgatgtagaggaaacggggcgtgagaggctgaagaggctccgggaagaggtgaccatggagaaggtcaacattccagaaaattggggtcaggagccaaagttgaaggactggatggactatactatgtttgatgcattctttcctcatagcttgattgtgactgctcgtgatgctcttattgctaatacacgtaaagcaaataagcttcagagtgatgctcttagagaagctatctcaggaatcatgactgattccaaggaaaagaacaggaaatttgtggagaccattgaactccaaattgggctgaaaaactatgatccccagaaggacaagcgttttagtggctctgttaagttgcctcacattcctcgccccaagatgaagatttgtatgcttggagatgcccaacacgttgaagaggctgagaagataggattggactacatggatgtcgaggccttgaagaagcttaacaaaaacaagaaattggtgaaaaaactagccaaaaaatatcatgcctttttggcctctgaagcagtcatcaagcagattcctcgtctcttgggacctgggaagttccctacgcttgtgactcaccaagaatctctcgagtcaaaggttaatgagaccaaggccatggtgaagttccagcttaagaaggtgctttgcatgggagtagccgtggggaatgttagcatggaggaaaagcaaatcttccaaaatgtacaactgagtgttaacttccttgtctctttgttgaaaaagaattggcagaactacagagtgaccgtgatgcaagcttggtcaatcattgcagctgtttattcttatatgattgggttgaggaggataattggtgcgaactctgaaattaacgtgtggagggtggaggcaaccatggcagggaaccatggtttagagcaattgcctattagccgactgcaagcgaaggatagagtaatatggagattgtcaccaaatggtgtttatttggcgaagagtggctatcaggccatcgaaagtagtcatagaaacaagctctccacaatttcaactgtggagcttcatcatcaaatggtggtgaagacgaagattatatactcggttcatcatctgagaagggagagaaaatcatcacggtttcatcatcaagtgaagggagataacactatgggtcaaaaaggcaagaaactggtcatgaggggttcttcatga

SEQ ID NO: 90153 - DNA, 255 bp, Glycine max
  Peptide Sequence Number=SeqID_181838
atggatgaagaccaatggatgtatgatagtatgatgtctgaagaagttgatataaatattaaaaatgaggaagatgttggtgttaaagtagaacacgttgattgctctgatgcctttaatacttctcagttgtttgcttgtcgtgatgaagttttacaatgggctcaatcgttggctcatgacattggatttgttgtcgttataatgaggtcagataacaataccggtgttcaaggaagagttgatagcttgtga

SEQ ID NO: 90154 - DNA, 1062 bp, Glycine max
  Peptide Sequence Number=SeqID_181839
atggtagtttctgagacaaaagctgtcgcttatgacaggttgttccaagaattagcacctttatcgacacacatgtctctccaacaaccaaatcaagaggtgccattgcaagaaccagaagccacattttctcaactaagcaaacaaaactcaatactctcactcacccttgatgagttctattgcaagaatggaaagagcttaggatccatgaacatggatgaattcctttctagcatttggaactctgatgacaacaaccaagttaacccatcactacccacccttgatgaagctgcaaagggtaaaagtgtagtagcaacagaacccaccaccatttcccagccattatctgtccctcccccaatttgcaagaaaactgtggatgaaatttggtctcagatccacaaaagccaaccacactacaatgaagctaacaatagccttgccaggaatgagccactactcaaaaggcagcaaacacttggggaaatgactttggaggatttcctagtaaaagctggggtggtacaagaatcatcatcactattcaagtcttcattactatatcaaaatcagattggtaacattgcaagtaatgggccattgagtgcaagttataggttcaggcatgtaatagggacaggatctagtgtgtcttgtaatgggcttgaaacacaaaacatgttggcacagaataacaacttagttataaaggatgtcactacaaatggtgctgtggagaaatgtccaagcttaggagaatcaagtgggaagggtaataggaagaggatcattgatggccctcctgaagtggtagtagagagaaggcagcgcagaatgttgaagaatcgagaatcggcggcacgttctcgagcaagaagacaggcatatacggtagagcttgaagcagagctgaatctgctaaaagaagagaacgaaaagctcaaacaaactctggccgatgctgaacgcaagagaaaacaagagaaagcacacaacaatggctcaaaagaggacagaaaaattgaggtcaatgaagaggcctctaagcgcatcctg

SEQ ID NO: 90155 - DNA, 534 bp, Glycine max
  Peptide Sequence Number=SeqID_181840
atggccatgaatatgatatcatcagatcctcttgttatagggaaggtgatcggagatgtagtggatcatttcactccaactgtgaaaatcactgtctcctacaacaataataagcaggtctataatggtcatgagtttttcccttcctcagtaaccactaagcctaaggttcagattcatggaggtgatatgagatccttcttcactctggtcatgacagatccagacgttcctggccctagtgatccatacctgagggaacacttacactggctggtcacagatatccccggcacaacggacgccacatttggaaatgaggtggtggagtacgaaattccaaggccaaacatagggatacataggtttgtgtttctggttttcaagcagaagcggaggcagggagtgctgaaaacaccaacaacaagggacctctttaactcgaggagctttgcagaggagaatgagttggggcctcctgtggctgctgtgtttttcaatgctcaaagggaaaccgctgccagaagacgttga

SEQ ID NO: 90156 - DNA, 570 bp, Glycine max
  Peptide Sequence Number=SeqID_181841
atggctctagtgaggctggtcaaagctcaagtgttggtagtaatcctggtgctggcagctccagagctagctcaagggaggcttcaaaatttgttcgctggaatgcccatggaagcaggtatgatgtgggatggaaatatgcagtttcagttgaaggcaactacaaagcttcaacgcaagcttagtcaaaaagttgtggctggtttaaaaaaaatgatgaaaaaaccagggatgacaaaggagtctataggagctgaaaagagaaaaggcaatgaagtggatgacattgataatgttggaattggaaacattttcaagagaagggcagttagctcccaagacacaaacaaccccatgtttaagaaggatcttcatgatgttttctctgataatgagtggaccatggagaataatgatggaattgaaggtttggatgtggccaacttggatttggatgctccaattcaagatgagaacttggttgaagaccaagagatagaggatagagatgaagacttagttcaagaccaagttggagaggaaacacttggtgatcatgatatgatatga

SEQ ID NO: 90157 - DNA, 228 bp, Glycine max
  Peptide Sequence Number=SeqID_181842
atgtcagatatcaaagtaaagaatgaaaacaaattgaaattcattggtgaatgtgctacaagaaatgactttcgatatatgtcattgggaagcaaaaagtgtaaaaggtggtcaagaaagccgattaatttttttgagacattagtaaaggttgaagagagtaaaggatacatggaggagatgaggtcgttttatgaagaaaaaaaaacaaaaacaaagtctgaataa

SEQ ID NO: 90158 - DNA, 426 bp, Glycine max
  Peptide Sequence Number=SeqID_181843
atggatgaaacaattttggttggtgatgatttaatgacgggtcctccatcacctgtagtaccaccagaaatagcctcccatgtactccaaggtgttgatttgtgtgatggaattctcaggaatctctttctctgcttgcaaatcaatgacatcgaaccattttgtcaagatgaaattgctttatataaacaatgtgctgaaagaagggataaggagatacggaagcggcttcaagatagtgaattcaaattaggttcatcaatgcctctagatgaagccaaggggagggcatctcagcttgaagcagaagttacatcattggagagtgcatttgttggaggttctcttgtatcttcattgattatagtggagttatttttctggtctggacgacccgtgatttttacccttgcattttttccttaa

SEQ ID NO: 90159 - DNA, 204 bp, Glycine max
  Peptide Sequence Number=SeqID_181844
atgacagaaccaccgtttagaccacgagagaaacttattgagaagcaaaagtatttccagaatatccataaacacacatacttgaaagggccatatgacaagatcacatctgttgcaataccactcgcattggcagcaacttcgttgtatctgattggaagagggatctacaatatgtcacatggaatagggaagaaagaataa

SEQ ID NO: 90160 - DNA, 1881 bp, Glycine max
  Peptide Sequence Number=SeqID_181845
atggcagcgatagttagccaccaccaccatcgcctattctccgcctccacgcgcttcaactctacttcgagagactcgcggcggcgaaggagcggctcaaactctgttcggtgcgctgacgtaagcacggccacgagcgagaatcggcgagtgacggtgagtaacaggaacgattcgctggagatatgccgcgtgctgaacggaatgtggcagaccagcggcggatggggccgaatcgatcgagacgacgccgtcgaggccatgctccgctacgccgacgccggtctaaccaccttcgatatggccgatcactgtacgttctcttcttactcgcaattgcttctgctgacgtggagttttccgattggcctgttattcctcctccctccgttactgcctgataacagaagcattgccgtcaagaatggcaatgattcattggtcatatgtcgggttgtgaatgggatgtggcagacgagtggtgggtggggcagaattgatagggatgatgctgttgatgctatgcttaaatatgctgatgctggcctcaccacttttgatttggctgatatatatggacctgctgaagatctatatgggattttcattgatcgagttcgtcgagagcgtcctccagaattattggaacaggtcagaggtctcactaagtgggtgcctccgccagttaagatgactagtagctacgtaagagacagcataaatgtttcaaggaagagaatggatgtggaatccttggacatgcttcagttccattggtgggattattcgaatccaggctacctggatgcactaaaacacctaacagatttgaaagaagaaggtaaaatcaagactgtggctctgacaaattttgatacagagagattacaaattattcttgaaaacgagattcctgttgtaagcaatcaggtgcaacattcacttgttgatatgcgtccccaacagagaatggcagagctttgtcagcatacaggagtcaaactgataacgtatggaacagtaatgggtggtctgttgtcggagaagttccttgacaccaacatatctattccttttgctggtcctgcaataaacaccccctccctccaaaagtacaaaaggatggtagatgcttggggaggatggagtttgttccagggactgcttcggactcttaaacaagtagcttctaaacatggcgtttcgatcgcaactgttggagtgaagtatatactagatcagcctgcagtagcaggatcaatggttggtgtcagactaggcttggctgaacatattcaagataccaatgctatcttttcgcttgttcttgatgaagacgacatgaacagcataagagaagccacagcgaaaggaaaggatctgcttaaagtgattggggatgaaaaaaagggaggggacaaaggaaaagtgttcgagcccaattttgtgtcagttgaagaattttattggaacaacgaggatatcatcgtcgttgatagcagtgcttcccatggcattaacattcatcaaataagtgagagtggtgaagtacctagcagcaacgacaacgagggtatcaacggggcgaacaacataagagaggtaaatcgcggggagagagttattggagccgttgaaataggtgcaagggagaggaacgatgaggttttggctcacatcagggttggaaatggagttagcctcgcagagctggttggaggagacgaggccgacgtagacggtgtcggcgatggaggagggcgtcagagggctgcgtcttgtagaagagcttcaaggggagaatgtggtgctccacgtcgggtaagagatatcgatgacgttcacagtgagaagcgcaatgggatcgatttggaagagtga

SEQ ID NO: 90161 - DNA, 450 bp, Glycine max
  Peptide Sequence Number=SeqID_181846
atgccatcaacatctcttacctcgacatggagcaccacattctcccctcgaagctcttcctcaaagtccccatctcctgctcctgcattgagaacattcgcaaatccgtcgctactcactacaagacccgcccctctaacaccctcctccattgtcgacgttgcctatgttggtctcgtctcctccgaccagcttcgtgaggctaactccatttccgatcctgatgtgggccaaaacctcgtcgttcctctcccttgcacctgcttcaacggctccgataactctctccccgcgatttacctctcttatgttgttcgccctgttgataccctcgctgtcgttgctgttaggtacttcactactttcactgatttgatgaatgttaattccatgggaagcactgctatcaacgacggtgatatcctcgttattccaatactcgataattaa

SEQ ID NO: 90162 - DNA, 2148 bp, Glycine max
  Peptide Sequence Number=SeqID_181847
atgtccgattccgttcccaaaacgcgaaaccgtccggggccgtggccgccggcgccggacgccaaggcaatgccgcctgcttcctgggctaagaaaacaggcttcaagcccaagttctccggcgaggccaatgccagcgactctggccagataagcctgcagcccaagcctagggagcccgacgctaacgtggatctcgaagcgggccggcctggggctccggcgaacggcgtgacccaccaaaataaggctccgccgcttccaccttccaaggatcaggtcgtaaagaagcgaaaggactccgacggactgcccaagagctctgttcccatcaccaatggccaggcggtgacggctccgcctccgccgccgccgccgcctccacggaggacggcgaggcatgaggaagtcgtggacgcgccgccgcaggaagacgacggtttcgtgtcgaggcattcgcatatgaagtatgagctcagagattcgcccggtttagttcccattggtgtgtacggtattcaacattacttttcgatattgggttcgttgattctcattccgctcgttatagttccggcgatgggaggctctcatgaggatacttctgcggtggcatcaactgtgctctttgtttcgggagtgactacactgttgcatacaagttttgggtcgaggttgcccttgatacaagggccttcttttgtttatctggccccggtgttggcgatcatcaactcccccgagtttcaaggattaaatgcaaatttatttgtgagatgtcatgggcttttgtattatgtatattgtgaggtttttgatgggaaattcaaacatataatgaaggagctgcagggggctataattattggatcggcttttcaaacttttattggatattctggacttatgtcactgttagtaagtatggtgatattcacctctgaatacccccgagtcccagatgtatccactttatggttgatcaatcctgtggttgtatccccaactattgctgcagtaggactttcattttacagctatggttttccactagttggtacatgtctggagattggtgccgtgcagatattagtggttattgttttttctctttatcttcgtaaaatatctgttcttggacaccgcatatttctaatatatgcagttcctttgggtctggcaattacgtgggctgttgctttcttgttgactgaagctggagtctacaactacaaaggatgtgacataaatatacctgcctcgaatatggtttcggagcactgcagaaagcatgtctcaaggatgaagcattgtcgagttgatacttctaatgcattgaaatcatccccgtggtttagatttccttatccattacaatggggtactcctatctttcactggaaaatggctcttgtgatgtgcgtggtttccttgatctcatctgtagattcggttggttcgtatcatgcttcttcattattggtagcatccagacctccaactcctggagttcttagtcgaggaattggtttggaaggtctttctagtgtcttggctggtctctggggaactggaacaggttctactaccttaactgaaaatgttcatacaattgctgtcactaaaatgggaagccgcagagcagttcaattgggtgcatgctttctgattgtgttgtctctcgtgggttttagaaggatattttggtggggtaaggttggagggttcattgcttcaattcctgaagtcatggttgctggtctcctatgctttatgtgggctatgcttgcagcattgggcttgtccaatctacgttatagtgaggctggaagctctcgcaacatcatcataattgggttatcattgtttttctctctttccatacctgcctactttcaacaatatggcatctctccaaattccaacttgtcagttccaagttatttccaaccctacattgtggcttctcatgggccattccacagcaaatatggagggtgtactagcgctaataataaacatgagtattggggagtcgtcataactcataacttggtttcctttttaatttatggcactggaatgctggctacttccatttttaagagaaaatttaatatcgttggtttacatgtcaggcttttctaa

SEQ ID NO: 90163 - DNA, 499 bp, Glycine max
  Peptide Sequence Number=SeqID_181848
atggagtcgcgcaatgatggtagctctttcggtgaagaacaaggtggccttcatagacggttccctcccgatgccaaccacaagtccacaaccgatcctacatatgctgcatggactcgtgaagaagcacaaagagaaattattgtcaattgcataccttctttaaactctaacattatggcctttgctgtcaattctacaaccaagaacactactaatggtaagagtagaaatcccaagaaagagagacctcaatgtgctcattgcaacttattgggtcatacaaaagacaagtgttacaaacttgttggctatcctccaaattatttcaagaacaagcctcagcacactgtaaatcaagtaattgattatgatgagtcctcaagtcaaggtgccacaaataatttgtccactgctcaatgtcaacagttgattagcttcttgacaaatcaattgaaaactgagaacagtgttgatactcttgccacaaatgtttcag

SEQ ID NO: 90164 - DNA, 4773 bp, Glycine max
  Peptide Sequence Number=SeqID_181849
atggaagaacctcccgtcgtgagatccaggggccgcccgcgcaaacggaggagagaagacgacgcaaccgtcaccggcgacgcgaaaactcttcccgaggcgaagaagatgatgccaattgcattggttggacgatacgtgctgaaagagttccgcagaaacacggttcttctcggcaaagtcgcgcgttacgcgagtggattgtacagagtcgtgtacgagagtggcggtttcgaggatttagatagcagcgagattcgtaggatacttctccttgatagttatttcgacgacgatttgattcggaggaaggttgaattggaggaatcggtgttgccgaagatcgctgcagaggaaccggagaaaggttcgagcgaattgcaaggtgaattatcggttgagaacgaggaggaacgagctaagacggatgatgatgagtcgttcggtgaggctagggattcaagttccggttccgaaatgccagaaacgcagataccgccgccgcttacgctgccgccgtcttccggaacaattggagtgccggaaccgtgcgttttgaatctcttttcggtttacggatttttaagatcgtttagcattcgcctgtttctgagtccatttactttggatgagtttgtcggtgctctgaactgtaaagtttctaacacgttgctcgatgcaattcatgtttcgctgatgcatattttgaaacgtcaccttgaaaatatttcaccagatggctcgcggcctgcaacaaaatgccttagctttatctcatttgtctttgatcatgcttaccgtgttatagaccgtagtgtgtatttagcaatttttggatacacaaaaggacctgagtggaaaggattttatgatgaaatcttttatggcgagtattatttattgcctgcaagtaggaaattgacaatattgcaaattctctgtgatgaagttttggcgtctgaggagctaaaagctgaaatgaacatgcgtgaagaatcagaggttgggatcaattatgataatgaagatagccttcctgctgaaaatgggcctagaagagtccatccaagatattccaaaactactgcctgcaaggatgctgaaactaagaagtatgtttcagaattgaatgcggaggatgatggtgatgttgatggaaatggagatgaatgtcgcttatgtggcatggatgggaccttgctttgttgtgatggttgtcctgctgtttatcattcaaggtgtattggtgtgatgaagatgcatataccagaaggggcatggtattgtccagagtgcaaaataaatttgattgggcctacaattgcacgggggacatcacttaaaggggctgaagtatttggaaaagatttgtatgggcaagttttcatgggtacttgtgaccacttactggtactcaatgtcaaaagtgatgacttttgtcttaaatactacaatcagaatgatattcctagagttctccaagtcctttatgcatccgaacaacatagacctgtatacaatggtatttgcatggcaatgttagaatattggaatatttcagaaaacttcttacccctctgtgtcagtaaacttcctcctatgattgaagaagagcataaagctgttagttcggtgaaggcagactacagtttaacgtttgggaatgggatttgtagtgataatttggtgccatctcttgatgcttcattggttacaactcgaagtcctgctcctggaagcagtggcaatgcaagaactactgtgaatctgaagcttcacgaggaaactgcaatggattcgtctgtttcaactaaccatcagtctgacccaaagtgccgaaattatgttaataggtcagctgcagtaagccctgccaagtgctccttggtaagcagccaatttagtaattatggggacgctaatgatatagggttgcctatgaatttgtctttgcaaactaaaggtgaccaatctggttttggaaagtgcaaaagcagtttaattaatgattttgtgtacatgggttgctcctataaaccacagtcatatattaattactatatgcacggtgattttgctgcatctgctgctgctaacctggccgttctttcttcagaggattctagatcagagggtcatgtgtctggcaacttggggaaagctacatctggaaacacttatttgctagcaaaagcattctcccaaacagcttcacgctttttttggccgagttccgaaaagaagcttgtggaggttccaagagagaggtgtggatggtgcatttcttgtaaagcccctgtttcaagcaagaaaggatgcatgttaaatcatgctgctataagtgccaccaaaagtgcaatgaaaatcctttctggttttgctcctgtaaggagtggagaaggaatcatccctagcattgctacatatgttatatatatggaggaaagtttgcatggtttaatagttgggccctttctaagtgaatggtatagaaagcattggcgtaaacaggtggaacgagctaaatcatttagtgatataaagccccttttactcaaacttgaggagaacattcgaacaattgctttttgtggggactgggttaagttgatggatgattggttggctgaattttctacaatgcaaagtgctgcatgtactcttggaacaacacagaaacgtgcaacttgtgggaggcgtaagaaacagttatctatcaataaagttacagctggtggttgtcaggaaaattttgcatggtggcatggcgggaaatttaccaaatctgtatttcagaaagctgttttgccaaaatccatggtcagaaaaggagcccgccaagcaggtggtttgaggaaaatttcgggtatattctatgctgatggctctgagattcctaaaagaagcagacagctagtttggagagctgcagttcaaatgagtaggaatgcatctcagctggcacttcaggtccgatatctagattttcatatcagatggagtgatctgattcgtcctgagcataacctccaggatgtgaaaggtcaagatactgaagcttctgcttttaggaatgcaaatattcgtgataaaaaaattgcagagggcaaaattttatacagagtagcctttggaagccagaaacatcttccttctcgggtaatgaaaaatgttgaaatagagcaaggtcctgaagggatggaaaaatattggttttctgaaacacgtattcctttatatttgttgggtaatgacttttacttggttactgttttgttcatgtgtttatgtgctattccttcctttttctctcgccagttctttctaaggccgcaatttttctcttggtttaatttcaggaatgctctcaagtgcagtgcctgtcaaggttattgtcacacgggttgttccgtgagttcaacagtctctacatgtgaagaagttgagttcttggccacatgcaaacaatgtcatcatgccaaattacttactcaaaaagagtcctgtaatgaatctccaactagtcccttactcttacaaggacaagaacgtagcactttggcagttctgaaggggccaaggcctaaatgtgatggtcaaggattgatttctactaggacaaagaatagtcgacttgacatgaaactagttgcttctgatttccctttggaaacaaaaggccgtagcagaagttgttcttggggtgttatatggaaaaagaagaataatgaagatacaggctttgatttcaggctcaagaacattcttttaaagggaggttcaggcctgcctcaattggatcctgtttgtcgcttgtgccataaaccatatagatctgatctaatgtatatttgctgtgaaacatgcaaacattggtatcatgctgaagccgttgaacttgaagaatccaaactttttgatgtgctgggcttcaaatgttgcaagtgtcgcaggataaagtcacctgtgtgtccttactctgatttgtataagatgcaagagggcaagaagttactcacaagggcttcaaggaaagagcactttggggcagattctgattctggtacacctattgacacgagaacatgtgagcctgcaactcctatctatcctgcaggggatgtctctagacaagacaatgatcctctgttgttctccctttcaagtgttgagctcattacagaaccccagttaaatgcagatgttgcaggtaatactgtctctgggccagggcttctgaaattacctaaacgtgggagggagaacaatggttcttttagaggtaatcttcatgctgagttttcaacaagcaatgaaaatgaaatggtgtccaaatctgtaaaagatttatcacctgtagaatatggctctgctgactgcaatcttctgaataactccgaaattgttaaatttgatgcattggtggattttgaacctaatacctacttctctctgactgaactgctccacacagacgataatagtcaatttgaggaagctaatgcatctggggacttagggtatttgaaaaattcttgtagattaggtgtacctggagattgtgggactgttaatttagcatccaactgtggatctacaaattcgttacaaggaaatgttaataattgtcggctatgttcacaaaaggaactggcccctgatctctcttgtcagatttgtgggattaggattcacagccattgttcaccttgggttgaatcaccatctcggcttggtagttggagatgtggtgattgccgggaatggcgatag

SEQ ID NO: 90165 - DNA, 453 bp, Glycine max
  Peptide Sequence Number=SeqID_181850
atggagtgctgggagggggggacaagcctcggggacagaggggaacttgggggagaaggagggagtggggtgcctggggtcgcgcctgcagcaggggcgccaccagtcgcgcccagtcctaaggcgctagcagacgcgtccgcgtcaggggcgttacctgctgctccctcgtgcgccgcgccgacgccacatgtcgcgtgcacagcggaggcacatatctgggaggctctttgtaataaaaaaacagacccccagagtaaggtggaaaaaagagggtctttccttccctcgcctatggctccagctgggaagctttctgggtttcgtcgagaaggcagtgactggttctgcaatgggggactgccaagtgatatcactgtttccatcgatggtgtcactttccatcttcacaagaaactaagtatccctcttcaaataagggaattggattag

SEQ ID NO: 90166 - DNA, 1893 bp, Glycine max
  Peptide Sequence Number=SeqID_181851
atgccagctggtattatgattccagcaagaaacatgccctcgatgattggaagaaacggaaccgttggtggctttggattatcttcagggctctctcttggccatattgaaaaccataaggcttcggaatctcaaagatctgtagaaatgttccagccaaacctgatggaagctggtcagctccacccactggacatgcctcagaacacttcagagagcgatgtccctagaatccgtgaagatgactttgacagtgccaccaagtcaggtagtgaaaatctagaaggtgcttccggtgaagaccaagaccctcgtcccaacaagaagaaacgctaccaccgccacactcagcaccagatccaggagatggaagcgttctttaaggagtgtccgcaccctgatgacaagcaaaggaaggagctgagtcgagagttagggttagagccattgcaggttaagttttggttccagaacaagcgcactcagatgaagacccaacatgaacgtcatgagaacacacagctgagaactgaaaacgagaagcttcgagcagataacatgaggttcagggaagctctcggcaatgcctcgtgtcctaactgtggtggaccaaccgctataggggaaatgtcattcgatgaacatcacttgaggctcgaaaatgctcgcctgagagaagagattgataggatatctgccattgctgcaaagtatgttgggaagcctgtggtgagctatccacttgtttctccttcatctgttcctcctcgtccactagaacttggggttagtggtggttttggtggccaacctggaggcattggaggggacatgtatggtggagctgcaggagatcttctaaggtcaataagtggacctactgaagctgataagccaatcataatagagcttgctgttgcagccatggaggagctcattggaatggcgcaaatgggtgagcctctttggttgactaccctggatggcaccactgtgctcaacgaggatgagtacatcaggtcttttcctcgagggattggtcctaaacccgttggtttcaagtgtgaagcttcgagggaaactgctgttgttatcatgaaccatgttaaccttgttgagatcctcatggacgtgaatcaatggtccacggtgttctctggcattgtctcaagagcaatgactttggaagtgctatcaacaggggtggcggggaattacaacggtgcattgcaagtgatgacagcagaagtgcaagtaccttcacctctggtgccaactcgagagagctattttgtaaggtattgtaagcagcacggtgacggaacttgggcagtagtggacgtgtccttggataatttgcgtcctagtccttcagccagatgtagaagaaggccctcaggttgcttaattcaagaaatgcccaatggctactctaaggtcatatgggttgagcacgtagaagtggatgacagaggtgtccataatctatacaagcagcttgttagctcggggcatgcatttggtgcaaaacgttggattgcaaacttggatcgacaatgtgaaaggcttgctagtgccatggcaacaaacattcccacagtagatgttggagtaataacaaacccagatgggaggaagagcatgttgaaactggctgagagaatggtcataagcttttgtgctggagtgagtgcatctactgcacacacatggacaacactttctggaactggtgccgatgatgtaagggtcatgacacgtaagagtgtagatgacccaggaaggcctcctggcatcgttctcagtgctgcaacttctttttggcttcctgtgtcaccaaaaagggtttttgaattcctccgcgatgagaactccagaagtgaggtaacctag

SEQ ID NO: 90167 - DNA, 399 bp, Glycine max
  Peptide Sequence Number=SeqID_181852
atgtctcaaaaagttgatatggattatgaaaatgaacaagaatgtggtgtgaatgaaccacatgttgattgtttggatgcttttaatacttctcagtgggctcgatcggtagcccatgaaaatgaatttgttgcagtcattatgagatttgacacagaggaagaagatgagaagataattattgttgatatgacaaagtcgatggtgaaaccaagaaacatcctactaacattgaaggagcacaatgtcaatagttgcacaactatcaaacaaatatacaatgcaagaagtgcatatcattcttccattagaggaagtgatactgaaatgcaacatctaatgacgcttcttgaacatgatcaatatattcattggcatagattaaaggatgaatttgtg

SEQ ID NO: 90168 - DNA, 1557 bp, Glycine max
  Peptide Sequence Number=SeqID_181853
gcaaatgatgtttcccagcaatgtaggcctaccgtatccgcacgtagacaacgtgaagctttccctgttgctgaggatgtttttgagatgattgaggacgtacctgcacctggtgcagagggattagttggtgatggtgctgagggattagctggtgatggtgctaagggagtagctggtgatgatgctgagggattcccaggtgggccacgtgacccatcagtgctgacttcgtttgctgaccatgttgcacatagcatatggaatggagaggaacgtcctaaattgaagttagccttccacggaaggaaagttgagaaatttgggagcccagctcttgagattgaagggttagtcgttgccatagaattaactcctttgatcgcgtgttcagtagacactggcgatcggggagatatatccgcttttttcgagaagtggcacaaggagactagcagcttccatcctccagtaggagagctgaccatcacattggatgatgtggcgtcactccttcatctttcgatcataggcaccttccacagcttcgagcctctacatgtggacgaggcggtcatcatgttagtggagttgcttgaggtctcggctcgtgcatatctcctacacttggttggttgcacttttttcgctaacaagagtgcaacacatgttcatgtagttcatttggacgcttttggagacttggctcggagtgggagctatgcatggggagttgctgccccggtgcatatgtatgatcaattaaatgacgcttctcaaagcactggccgacagcttgctggttacattactttattacagcaatttcccagtgttcatgagagcgtgactaatgatgggtatgatgagacgacaccacatgtctgccagtggcttactacgaaggattatatgaagggattaacaacatcgtcgtaccgaacacgtatagatgcactaacgatccctaactttggctacattcagaccatccttccactgcccattagtgccaccttgtcatctgaggatatcgatgataggtggatgcattactcggaccatctagtagctgctggacagatttgtcttgtggctgggcaacatccacttgtcccacaacatgaggcatacgtggagccagatatcccggaggtcctagtggcaccagaagctggaccgtcacaagcaactgatctgcccaaacatgcagtggatgcttgtgaagcaatctcagaaaggttggagcgtgtattcaacctaagcatggtcactgaaggcacagagttacatgacctcatggaagactgcctcaggatcgtgttgaggaaagaatggataataaaagcaaagaatgtagagagaaaagggagagttcaggcttggaatgctaagagaagtgctctaaggccaggtactcagcatgtgcttatattggattgtgcgcttggcgcgtgcctcgcgcttagcgcgtgcctcgtgcttagcgcgcgtaacgaatcatgtttcttcatgcttaacggctcgcttagcgcatgtgctaccttgcacgcttag

SEQ ID NO: 90169 - DNA, 708 bp, Glycine max
  Peptide Sequence Number=SeqID_181854
caccgttactatgggaaatcagtaccatttggatcgagggaagaagcactgaagaatgcaagcactattgggtatttcaactcagctcaagcaatagcagattatgcatcagtcctcatacatattaagaagacattacatgcccaaaagtccccgtgcttgcttcatggtttaggctcaaatatccccacctggctattggtgctctggcctcatcagctccaatcctctacttcgataatattaccccacaagacggaggccagtgaaacatgctaccaaactatattgaagtcctggtctgaaatcgacagagtagcttctcagccaaagggtctttccattcttagccagagattcaacacttgccgtcccttaaatgagtcttcagagttgaaagactacctgattaatatgtatgcttcttcggctcaatacaatcatccgccaagatatccagttactgtgatttgtggcggcattgatagagcttcttttggaagtgatatcctcagtaagatatatgcaggtttggtggctttaaggggaaacaccacctgcaaagttaatggtcctattattgtatctgagacaaccctgggatggagatggcagattgaatcatccattaagggaacacataatatatatacagctgagatggaaggatttggattatcacttccatacttggtaacaaaggattaa

SEQ ID NO: 90170 - DNA, 300 bp, Glycine max
  Peptide Sequence Number=SeqID_181855
atgtatatgatgatgattccagttgaccagagtgggcattctttaggattgaattctactttagagtcagatggttttgcaactaggctgatgggtgtgaaggtcttggtgcttgatgaagaagctatcaacatccctgctcttcctgcagcaacatcaagtcaaagttcttcttcatcaacgacggtgctacaaaagcacgtcattgaacagtcctttcctgttttgccactgcgtttttgggaagcaccgtcgttgactatcccatcatttagtcacgtgaaagctttccctccctga

SEQ ID NO: 90171 - DNA, 831 bp, Glycine max
  Peptide Sequence Number=SeqID_181856
atggggaggaggatgatgcaatggaacaccatcaccaaagcttcaattctcatcaccatcaccctccacttgattctccccgtggccgttaacagcatgaggctcgaactggtgcacaggcaccacgagcgcttctccggcggcggcggtgacgtggatcaggtcgaagcggtgaagggtttcgtaaacagggacggcctgcggcggcagaggatgaatcagaggtggggtgttagtaattacgacagaagaagaaaaggcttggaaacaacgacgacgacggaggtggaaatgccgatgcgcgcggggcgcgacgatgccctcggcgagtacttcaccgaggtcaaggtcgggagccccgggcaacggttctggctcgccgcggacaccggcagcgagttcacgtggttcaactgcgtaatgcggaatgctacaacaacggcaacaaccaagaagaccaggaagaacaaaaccaaaaagaaacatcatcatcacagcaagaggaacaggacgaggacgacgaggagaacaaagaagaagaaggccaagagtaatccctgcaagggggtgttctgtccgcataggtctaagtcctttcaagctgtcacgtgtgcgtcgcagaagtgcaagattgatctcagtcagcttttctcgctcagtctttgtcccaagccttctgatccttgcttgtatgacatcagttggaaaaaaatgaattggatgagggagggagagtggatgaaggtggaaggagagagaagggagaaatcaatggctgtctttttgggcctcaaatttagtttgtgttttgtgggcgacggagatggctaa

SEQ ID NO: 90172 - DNA, 4887 bp, Glycine max
  Peptide Sequence Number=SeqID_181857
atgggaacacctgtgaacatcatcgttggatcacaggtttgggttgaggatcctgaggatgcatggattgatggtgaggtgacacaaatcaaaggcaaaaatgccaccatcattgccacaaatgggaaaactgtggtggcagaaatttcaagcatataccccaaagatacagaggcaccacctgcaggagttgatgacatgaccaagctagcataccttcatgagccaggagtcctgcataaccttgcaactcgtttttctctcaatgagatatatacatatacagggaatatcttaattgcagtgaatccttttcgaagactgccgcatttgtatgacatccatatgatggagcagtacaaaggagcagcatttggagagcttagtcctcacctttttgctgtagctgacacatgttacagggcaatgataaatgaaaatggaagccaatccattttggtaagtggagagagtggagctggtaaaactgagacaacgaaaatgctcatgagatatctagcattcatggggggtagatctgctacagaaggaagaactgtagaacaacaggttttggaggtatatgcagtgacattttcacttctgcagtcaaatccagtgttggaagcatttggaaatgccaaaactgtcaaaaacaacaactcaagtcgttttggtaaatttgttgaaattcaatttgacaagaatgggaagatttctggagctgcaatccgtacatatctcctcgaaagatcacgagtttgccaggtctctgatccagagagaaactaccattgcttttacatgctttgtgcagcaccaccagaggatgtcaagaagtacaagttaggggatccaaggcaattccactatcttaatcaatcaaactgttatcaagtatcgaatgtggatgatgcaaaagaatacttggagaccagaaatgcaatggatattgtaggcattagccaagaagagcaggatgcgatcttccgtgtggtagccgcaatcctccatcttggaaatgttgactttgtcaaagggaaagaagttgattcttccaaattgaaagatgataaatcactcttccacctccaaacagccgcagatttattcatgtgtgatgcgaaagcactggaagactcactttgcgagcgtgtcattgtaactcctgatggtaacattaccaaacctcttgacccagatgcagctgctttgagccgagatgccttggcaaagactgtctactccaaattgtttgattggattgtggacaagattaacagttcaattggtcaagattccaatgcacatgtattcaagatggagcaagaagagtacacaaaggaggaaatcaattggagctatgtagaatttgtggataatcaggatgttctcgatcttattgagaagaaaccagggggaattattgctcttcttgatgaagcctgcatgttccctaaatcaactcatgagacttttgcacaaaagatgtaccagacatataaaggacacaagcgcttcagcaagccaaaactttctcgaacaaatttcacaattaaccattatgctggagatgtcacatatcaagcagattattttcttgataaaaacaaagattatgttgtagcagagcatcaagctcttttatgtgcttccaagtgttcatttgttgctaatatcttccctcctttaccagaggagacatcaaagcaatcaaaattctcttccattggttcacaatttaagcaacaactgcaatctctcatggagacactgaacacaacagagccgcattacataagatgtgtgaaaccaaatacagttctgcagccaggaatctttgagaacttcaatgtcttgaaccaactaagatgtgggggagtacttgaggcaataaggattagttgtgctggatatccaacaaaaaggacatttgaagaatttcttgatcgctttggaatgctagttcctgatgtccttgatggctctgatgagaaaaaggcatctatggccatctgtgataagatgggtttaaaaggctatcaaatggggaaaacaaaggtatttctcagagctggtcagatggctgaattagatgcacgacgagccgaagtcttagctaaagcggccaaactcatacagagacaaatccgaacacatttaacgagaaaggagtttatcaccttgagaaaggccactattcatatccaaaagatttggagagctaaacttgcacgtaaactctatgagaatatgaggagggaagcagcttctatcaggatacagaaacacgtgcgtgcacacagagcaagaatgaattatacaacgttacaagcatcagctatagttattcaatcaggtttgagagcattagcagcaagaaatgaatataggtacagaagaagaacaaaggcttcaacaaaaattcagacacaatggagaagagcccaagctctttctggttacaaacagcagaagaaagcaactgttgcacttcaatgtctatggagagctaaagtagcaaggaaagagctcagaaagcttcggatggctgcaagagaaactggggcacttaaggaagcaaaggacaagttggagaagcgtgttgaggagcttacatggcgactggatattgaaaagcacatgaggacagatcttgaagaagctaaagggcaagagattgcaaaattgcaaaatgctttacaagaaatgcaaggtcagttagatgaagcccatgctgcaattatacatgagagagaagcagcaaaaatagcaattgaacaagcaccaccagtaattaaagaggtacctgttgtggacaacacaaagctagatttactgacaaataaaaatgaggagttggagactgaagtagaagagctgaaaaacaagattaaagactttgaagaaaggttctcagaagtcgagaacgagaaccaagaaaggctgaaagaggcagaagaagcacagcttaaagcaacacaacttcaggagactattgaaagattagaattgagtttgtcaaaccttgagtctgagaaccaggttctatgccagaaggctttggaagaatcaaaaaatgaagaactctttgaagagatcaaaatcctcaaggatcagatagcaaatctagaatcagagaatgaatccctacggaggcaggcagcggctgttgctttcgagcagaaagttcatccagaaaaaatagaatcagaccattcagcagcttctttggagcagaaagttcaaccagaaaaaatagaaccaggccattcagcaactgctttagagcagaaagttaatccagaaaaaatagaaccagtccattcagcaactgctttggagcagaaagttcatccagaaaaaatagaaccagatcattcagcagctgctctagagcagaaagttcatccagaaaaaatagaaccagaccatgaagttgctgttgcagagaaaatgcaagtgcaaccaagagttattgcagataatatgacttcacaaatcaagaatttggataatggaagttcaaccgaggaagaatggcaagcaagaaaagaaccgagagcaccagtcttcttgcttactaaacaaagatcactcacagataggcaacaggaaagtcatgatgcactgctcaagtgtcttacggaagataagcgatttgagaaaaacagaccagctgttgcttgtattgtatataaatcacttcttcattggagatcccttgaagcagaaaagactcatatttttgataaaattacacatgctatccgatcatctatagagagtcaagaaggaatccatgatctagcctactggctttcaacaacatcaacacttctgttttatctacaatgtacaatgaaggccagcaatacaactaaggcagtgtcacgtaatcgaaactcgcccgcctctttgtttggcaaaatggcacaaggtttacgttcatcttcaatgggcttggggatttcaagtggctacagtggaatggtggacaagacaaatggtcaatctaaagtagaagccaagtacccggcaattctgtttaagcaacatttaactgcatatgttgagaagatatatggaatgatccgtgatagtttaaagaaagagattagccccttcttaaatctgtgtatacaggcaccaagatccataaggactagatcaataagagggtcatccagaaacatccattcaaatattgttgcaaaacaacaggcattgcatatgtactggaaaggcattgtggacaagctagatactgccttgcgtatattgtctgataactatgttcctcccatcataacaaggaagatatttagtcaggttttctcattcatgaatgtccagctctttaatagtttgttgcttcgccgtgagtgttgttcctttagcaatggagaatatttgaaggcaggtttgcatgagttggaactatggtgtcttaaagcaacagaccagtttgctggatcatcttgggatgagctcaaacacatacgccaggctgtgggctttctggttttgcatcaaaagacccaaaaatctttggaggagatcacaaatgagctctgcccggtgttaagtattccacaaatatatcgtataggaactatgttctgggatgacaagtatggagcacatggattatctgcagaagtcattagcagaatgagagtgattatgacagaagactcaataaacatacacaacagctcattccttctagaggtggattccagcataccattcttaatggaggagatgttccggtcaatgagtgacatccgcctatcagacatggatgtggatccaccaccaatcctcaggcaaagatctgacttccaattcttgttgcaacaaatggatagtgactctcagtga

SEQ ID NO: 90173 - DNA, 507 bp, Glycine max
  Peptide Sequence Number=SeqID_181858
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcgcgacgtgagcgttcgctgcccgcgacgtgtgagaagtccactgaacctatcatttagaggaaggagaagtcgtaacaaggtttccgtaggtgaacctgcggagggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 90174 - DNA, 774 bp, Glycine max
  Peptide Sequence Number=SeqID_181859
gaaggcaaggaaggagttcttttctcgtgtggggactaccctaatgttccattgatagggactaggggttgtattaattataatcccgcactcgccataagacagctagggtaccccatgaggggagcgccaacagaagaaagtctctcgcctttccttgtgagggatctaggcgcgcaaagtctcaaggtgatgcaaagagtccacaaggcgtggagaagtccgttgaggaaagacaaggagcttagaggcatccgaaatggcgtcatcagtggttatcatggatggctaagagttcacacgcgagggttagattggctctccaaattgaaagttatcaatgaggagaacttcgaagctccggaggaagatgaagaagtccaagctctaaaattagagctagggaaggcaagactcgccaaggagaagttcaaatcagccgctacacacatccgaaaagagtatgcacgagttcaagaggaaacgcagccactgcaagagcccttgaacaagaaaccaaagggcccgcaaggaggaatatggccgagagaaattccgaggagcattatggggtccaagaggagtttggcccaacacttggaagccacggaacaaagcatgctagctatcatagggcaatacaaggaagagttgaaccagtctgtgacccatgaacaaaagctagcggaggagtttgcacaagtgttcgccttgaccttgaatggaagtcaagacctcccgcgtctattagccaaagcaaaagccatggccgaa

SEQ ID NO: 90175 - DNA, 399 bp, Glycine max
  Peptide Sequence Number=SeqID_181860
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagtag

SEQ ID NO: 90176 - DNA, 468 bp, Glycine max
  Peptide Sequence Number=SeqID_181861
atggaaaatgaagagggcgtgcaggaacagatgaaggccgatctatcgcccttaaaagatcaaatggcttccatctcggaggtcatgttaaaactccaaaaaaatatagaggataaagccacgacaaccgcctccagtacagttagggaagtggagccggtgctgcagcccgccttaaatctgggccgagacagaaacacggcagtgtttggtcgaaggtatagctcgcaagcttacccctatggcttgcctccgaacttcgctcctcgtgccgccccggaagatttaagccaagcccctaccttcgaggggcaactcccaccttatgacgactatcccgggcaagacgatgaggaaggagatacccatctcggccccctgctccacctcaaagatccgtccccccatgaactaccccaaccaaacatagtccgccatatcccggcttcacccacacccgtaaaataa

SEQ ID NO: 90177 - DNA, 741 bp, Glycine max
  Peptide Sequence Number=SeqID_181862
atggccagaacacgaggtttaggtcgtgccataggtagagttgtaggcagagatagagctgctgacgaggatgctggcgatgttcccgagaggcgtaggcctactgcctcagcccgtaggctacgcgttcatcagatgactacggagggacgtgatatggctgaagacgtcgctgacatgactgatgatgtccctgagcagcctacggaggcacctgagatgcgtgcggacgcacagggtgctgatagtggtgaggggtcagatggtgatgatgctgcagagggattccctggtggtccacgtgacccgtcagtgctcacatcatttgccgagcatgttgcacatgccgtgtggagtggacaggaacgtcctgatttgaagttagtgtcacatgggaagaaggtgacactgattgggaggccagtgcctgagattgaaggcctggtggctgccacaggattaagtccactgatagattgttcagttattactggcgatcctggacttatatccgcatttgtggagaggtggcacagtgagactagcaccttccaccttccagtaggagagctgacgatcacattggatgatgtgtcgtccattctacatttgcccatcactggcgccttgcacagtttccacgctctttctacggaggaggccagattcttgctcacggagttgctggaagtgtctgcggaggaggccagagccgagacagcgctcacacgtggagcatat

SEQ ID NO: 90178 - DNA, 300 bp, Glycine max
  Peptide Sequence Number=SeqID_181863
atggaaaaatctgaaaagaaaaatcatagtgagaagaaactaaagaaagcatacatcacatgggatgaaaatgatttggaatcctctgatgattctgaaaatgaagagataaatctttgccttatggcaaaaagttacgaaagtgatgaagaggtatctttgagaaagaagtggtacatagatagcggatgctcaaaacatatgactggagatgcatcaaattttacaccatatctccaaagaaaagcgggcatatgtcgtaccggatgtcacgacatcacgcttcagaacatgcagatt

SEQ ID NO: 90179 - DNA, 405 bp, Glycine max
  Peptide Sequence Number=SeqID_181864
atggaaccgattgcatccctttcccagtattatgacctgcccctaaggtgcttcacattggaggacttccagctagtgccgactgtgaaagagtttgaagaaatcctgggatgcccactgggaggaaggaagccatatcttttctctggttctatccctccacgacaagagttgccaagaaaggacagagagcttaggggaagcagtaatgggatcatcggtggctatcataagtggttgagagtccgaacacaaggactggattggctcccaaatctaaagactgtgagagacgatgaggttaaggcttcggaagaaagtgatgaggtacaagccctaaaggcagagcttgaaagagcccgagtagtcgaagagaagttcaagtccatagccatcaaagtctga

SEQ ID NO: 90180 - DNA, 546 bp, Glycine max
  Peptide Sequence Number=SeqID_181865
atgactaggggcaatccaggtgatttacaaacctttgatcctgaaatagatagaacctttcatagattagttaggcatagtgtgcatcctgatcattctgtgcattttgagcattctgagcatttcgtgcattcagtgcattctgagcattctgttgctggtgattctgaacattctgattttgagcattctgctgctaattttcatactgagaacatgactcaatctccacctcgtgagaggactcttagggagatggctgcacctgacttcacttatgaaagcttgtgcattcaatatcctgatgaggatgttccatatgttctcaagactggactaatacatttgctgcccaagtttcatggtcttgcaggtgaagatcctcataagcatcttaaggagttccatattgtctgttccaccatgaagccccctgatgtccaggaagatcatatctttctaaaggcttttcttcattctttggagggagtggcgaaagattggctgtcaagcttcattctacacctgaaaaagaagatgagctag

SEQ ID NO: 90181 - DNA, 603 bp, Glycine max
  Peptide Sequence Number=SeqID_181866
atggagagaagtatgatagatgctgctagtggtggagcccttggagacatgactcctactgaagccagaaatttaattgagaagatggcttccaactctcagcagtttagcgccataaatgatgccatagtcattagaggagtgcatgaggtagctacaaactcagctgcatcatctgagactaagaagcttgaaggaaaactggatgcattggttaacttggtaacccagttggccttgaatcagaaatttgtacctgttgcaaggacgtttgccctttccatgcagcaacctggagcaatcgagcagcctgaagcttatgctgcaaatatttacaatagactcctcaacttcagcagcaaaatcaaccacagcagaacaattatgacctctccagcaacaaatacaaccctggatggaggaatcaccctaatctcagatggtccagccctcagcaacaacaacagcagcctactccttccttccaaaatgctgttggcccaagcagaccatacattccttcaccaatccaacaacagcaataaccccagaaacagccaacggttgaggcccctccacaaccttccctcgaagaacttgtga

SEQ ID NO: 90182 - DNA, 208 bp, Glycine max
  Peptide Sequence Number=SeqID_181867
ccaccttgatgatactctaacatcaagtgttggacctgagtgtgtagagttgatctctatagtgtgtggagttgatctctattgttcagagagcaatctctgtaacatggagagaagtatgatagatgctgtcaatggtggagcccttggagacatgacccctgctgaagccagaaatttaattgagaagatgccttcaaactcctag

SEQ ID NO: 90183 - DNA, 252 bp, Glycine max
  Peptide Sequence Number=SeqID_181868
atggagtgcctgtcgcccccagcaaggtcatcaggcaccctactaaccgagctttcatcaagaagtattgcgccctcaggcaggcgcagggcgagacaccacagtagcctggggatggccggcagcgggcaacagacgcaccgtcaccacctccaaagcccctcagctcatctacaaaagctggagcgttgcctacgacccgtggtcgaccagcaggcgaccaagtccaaagccaaagtaggacacacctag

SEQ ID NO: 90184 - DNA, 352 bp, Glycine max
  Peptide Sequence Number=SeqID_181869
atgagtggaagtggatccaattcaagtggtggagatacaactgcgggtagctcttcttcggttgctagaagtaaatacaaaaatgcccctgggaataggactgatattgggtggaagcatgggattgatgttgatggcaatggtaagaaagtcaaatgcaagtattgttcaaagattgtgagcggtggagtttttagattcaagcaccatcttgctgggactagagaagattttgagccttgtgctacggtgcgggatgagatcaacttgctaatgatgaaaattgttgctgaatctaaagcaacaaaagaaaagaaaaggagattgaatagtatttatgaagatgaagaaa

SEQ ID NO: 90185 - DNA, 204 bp, Glycine max
  Peptide Sequence Number=SeqID_181870
atggggttctatgagttccagcgaggacaatgtgagtttttcggcagtgtaggggattttgtggcttcaactgacgacaatgtgggtgtcgagggagcggtttccggaagatttcaggcgggaggagaaagaggagcgatttcacgcaggaggatgacaaagagaagagggaggacaaggttttcgagtgcgcgcgacttgtga

SEQ ID NO: 90186 - DNA, 339 bp, Glycine max
  Peptide Sequence Number=SeqID_181871
atggaagactaccagatgggattcctcccccgtgaaaaagttatcaccccaatagacttgactttaggagataatataaaatttaaaggaaaaaggttgcccatagaaccaacattcaatatgtcgtctcttttactgaacataggaagtattgacccccaattacttccaaactacatagaacagtggacttttactgttatgagagactatagagtgaaccatggaagtcatgtatccaacagccaagacatgatagcaagagtcaaaacatatctaggagatatagctagagcctgttgggactcctttaaacaaacttttccagaacaaatctag

SEQ ID NO: 90187 - DNA, 528 bp, Glycine max
  Peptide Sequence Number=SeqID_181872
atggagagaagtatgattgatgctgccagtggtggagcccttggaaacatgacccctgctgaagccagaaatttaattgagaagatggcttcaaactcccagcaatttagtgccagaaatgatgttattgtcattagaggagtgcatgaagtagccacaaattcatcttcatcagctgagactaagaagcttaaaggtaaactagatgccttggttaacctggtacaaccccgggtgggggatcatcccaaccttagatggtcgaatccttcacaacagcagcaacaacaacaacaccaacaaccccagaaacagcaaatagttgaggcccctctgcaaccttcccttgaagaacttgtgaggcaaatgactatgcaaaacatgcaatttcaacaagagaccagagcctccattcagagcttaactaatcagatggggcaattgaagagagagaggagacgccacttcaaggagaagataagtctagaagaagctcaccaccataggaggccatggataagagcttag

SEQ ID NO: 90188 - DNA, 75 bp, Glycine max
  Peptide Sequence Number=SeqID_181873
atggtgtttcgaaaggatatcattgctaagattcgaagaaaaattattacttttttgatacacagagcacttcgg

SEQ ID NO: 90189 - DNA, 213 bp, Glycine max
  Peptide Sequence Number=SeqID_181874
ttggcccagggcttccccggtatcaacagggacaccaggatttatttattctgcgaagtgatcttccgtccacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 90190 - DNA, 444 bp, Glycine max
  Peptide Sequence Number=SeqID_181875
atggaaacctgccccatggtggaagagttacttcagcgactcatggactgggggcagctcgaagtgtccgagggagatagggaagaaccacatatttgcatgcagtcggcaaaaaggaagattcccccaacccccaaagccctagtgatatgtttcactaggaatgtgaccggctccaggtccaagtaccccccggcagcgcccaagccaacgtcgttttcctatcaaagcaataaggtcgttccatggaagtacacccctcccgcttttggagaaagggctgcaatcgaggttgactccttgtcagccaaggtgaccaacattaccgaccttagtggcgtaacccgcagtggccgggtgttcgctccccctcactccgcggaatttccctccaaggggaaagcacccatgatccaagagcccgcagacgtggccaccccctaa

SEQ ID NO: 90191 - DNA, 294 bp, Glycine max
  Peptide Sequence Number=SeqID_181876
gacttcacatattgtgcaacaaagggtgccaagtactttgaagcggcgtgcagccctctaaaggtgagggtgtgcagccctctcatggcgagaacatgtagtcctctgaaggcgagggcgtgtagccctctaaagatacggacgtgcagtcctctaaaggcgagggcgtgtggccctttgaaggcgagggcgtgtagccctcagaaggcaaggacgtgcagccctctgaaggtgagaacatgtagccctctgaaggcgatggccgagcagtcctctgaagcccaaggcgtgtag

SEQ ID NO: 90192 - DNA, 156 bp, Glycine max
  Peptide Sequence Number=SeqID_181877
atggtttttcacttaaggcttgcaatgagcttcaaaataaagaaagggaaacataggctcaaagggctatcaaaggaattaattcaaggaagcatcaacaagaatctagccaaggctattgtgcgtgcaatccatggggcaaaacacaccaaatga

SEQ ID NO: 90193 - DNA, 855 bp, Glycine max
  Peptide Sequence Number=SeqID_181878
atgtctcgacatcaaaccacggccaagaaatctgggagaaaggtgcctggaaatgtccctgatgcacaattggacaacatcttattccactccattggcaatgctgaaaggtggaaattcgtgtatcaacgcagacttgccttggaaagagaactgggaagagctgccttggattgcaaggagatcatggacctcatcacggctgctggactgctgaagactgtcaccaagttgggagagtgctatgaaagtctagtaagggaattcattgtcaacatgccctctgacataacaaacagaaggagtgatgagtatcaaaaggtatttgtcagaggaaagtgtgttagattctcccctgctgtgatcaacaagtacctgggcagacctactgaaggagtggtggatattgctgtttctgagcatcagattgccaaggaaatcactgccaaacaagtccagcattggccaaagaaagggaagctttctgcagggaagctgaagtgtgaagtatgcaatctgcataggattggcgctgcaaactgggtacccaccaatcatacttccactgttgccacagggaaagctgctgcttcaggtgctgtgtccaaggatgctttgattgctgaactcaaggacacatgcaaggtgctggaagcaaccatcaaagccaccacagagaagaagatggagctggaacgcctgatcaagagactctcagacagtggcattgatgatggtgaagtagctgaggaagaagaaggagcagctgaagaagaagatgaagcagctgaggaagaggaagatgcagcagaggatacagaatcagatgatgatgattctgaagccaccccatga

SEQ ID NO: 90194 - DNA, 192 bp, Glycine max
  Peptide Sequence Number=SeqID_181879
atgtgtaatttcaggctaagcgcgcatccaccgctaagcgcaacttcagcacgcttagggcgacagaagaatctggcatcagcatcaaggctgcgcgctaagcgcgagatcagtgcgctaagcgcaacaggtgtcttaaccgagactcagtgcacgactggcgctaagcctgaatccacttacccgcgctaa

SEQ ID NO: 90195 - DNA, 322 bp, Glycine max
  Peptide Sequence Number=SeqID_181880
cactggttttctcaaagagtggacactagtttgtaacaacacgttggacactggatatgatgtagctccatgtggagcttgtaggccttggatcttcttcatctatgaagtcatttgcttcttgaagatcaatgacaatgaaatggagaaggagaaaagggcatgtcatgagctagagaactctgatttgaatgattcagaactttttggaaagctaagacaagatttacaatttcttttctcacaagctaaagccatttctcacgttttcagggttaattttgcgtctgaagttgctgcccctgcacctcacgttttcagg

SEQ ID NO: 90196 - DNA, 441 bp, Glycine max
  Peptide Sequence Number=SeqID_181881
ggcctcgtagataaaccttctgggggtcgtcacgtccttcaaaggcttggacttgcttggcttacccaactcgacgacattaaccgctccccctccatgattggcaagcagccatccggcttctatcaaactttggaccttgtgtttcaaggtcaggcactgtttggtggagtggcctgggattttcccatgatctttccgagagatatcacagccatctggttggcgacgagggatggaaagaggtcttcatacgtcattgggatcggggtgaatgttggcctcgggggaaagttccatatcgctttggaaacgacgccaaagtgggcattgccggccgcgcgagtcggggttggagctgtagcttggggggtctccctctggatgggtgcaggcaccctagcttatacgggtgctgagtcggaagagtcccctgcatga

SEQ ID NO: 90197 - DNA, 216 bp, Glycine max
  Peptide Sequence Number=SeqID_181882
atgaagaaacaacaatggaagagaagatgcaatggaaggcaaaggagaagaggggaggggaggcaccatccactagggaataagccatggaagaaggagcttcaccaccaaggatgtgcctttgataagaagcttgaagaggatgctttaatggaggaaaagaaagagagaaggggggagcacgaaattgatggaataaaagagggagagaagtag

SEQ ID NO: 90198 - DNA, 309 bp, Glycine max
  Peptide Sequence Number=SeqID_181883
atggagaattgcactaagcaatcagtacgcatggctccaaactcgtgggcggaggatgcacgaacaaaaacacaattcatggggcttcgaaaaaggtgtagagaatggagaattacactaagcaatcactacgcatggctccaaactcgtgggcggaggatgcatgaacgctccaaactcaagggtggaggatgcatgaacgaaaacgcaattcatgaggctccgaaaaagggtagagaatggagaaatgcacaaatcaacactatgcatggctccaaactcctgggcggaggatgcatgaacacctaa

SEQ ID NO: 90199 - DNA, 420 bp, Glycine max
  Peptide Sequence Number=SeqID_181884
atgatgcacagagaccaatgtggtcatctgctcttttcatcgaagactgaacgtctatcgaccgagactactttagtctccattttcgctatccagagacaatcgagtctgatagcacgcagagacgaatatggtcatctgcccctttttgtcgaagactcaatgtctttcgaccgagaccgttatagtccccttatcatccaaagacaagcagttccctttgctatccggagatcatcaagtccgatggcattcagagacaaacatggtcatctgcttcccttgtcaagagactcaatgtctgttgaccaaagctaccgcaccccccctgctatccctagacaagcgagttcgatagcatgcaaagaccatcacggtcatctatttttatcgctttcaaggcaccaaggattttgctga

SEQ ID NO: 90200 - DNA, 252 bp, Glycine max
  Peptide Sequence Number=SeqID_181885
atgaagaagatacaaggcttacaagctccacatggagctacgtcaatagcatggcgggaagcgattgcggatcatgcaaacaaatatggccactcttactcaaatctagatgacctttctcctgaacaccttcaccagtttttcataacagaacctcttaggctccaactgaaaccagaaaaatcaaacaaagaattgggttgtccagctttaataagaggtctctgcaagttctatggagtgtcggtctga

SEQ ID NO: 90201 - DNA, 318 bp, Glycine max
  Peptide Sequence Number=SeqID_181886
atggggtttttcttggtgggaaatttggctttgagtgtttttggccttttttcttttctgtttttgtttagcacgaggcgaacaagtcatcgacacacaggattttggttgggcaaggtttatggtgagttgggactttggctcaaggcttgtagaacggatggacatgatatatgtcagggtgttggtctggttcagggatataaagggaataattcaaagaagaatcaaacaaggctacttcaaatgataagcatttgcttcaagaataattcaagattgcttcaacaaacaaagccttgtttcaagattcactaa

SEQ ID NO: 90202 - DNA, 534 bp, Glycine max
  Peptide Sequence Number=SeqID_181887
atgtaccctccactagaactgatccacaagagatgtaccctctcttgttctcagtcaacaacccaagtagatgtaccctctacttgtaccacaaaggatgtaccctccaatgtgttaagacaaagttctcaggcggttaaacctttgaaactttgtgaatggggatacaaaagaattcttaggcgggagaagggagacacaaaagaattcaggcggttagtccttcgttcttttggaaaagggaggagagagacacaaaaagaattcaagcgagagtacaagagatccctggagaagttggacgatgcaactaggaatgctactattcaaaagggtaggtgcaaggtgctcccacaaggttttggacctaccaatgtgaagcagatgaagattggtcttgatatgaagataagacgtattgcaccattgactaaagaggaattgagagtagaaagggagaagcgtctaatgcctccactttttcaaggcattgaacccaacattatttgctactgtacccagcaatttaagtga

SEQ ID NO: 90203 - DNA, 632 bp, Glycine max
  Peptide Sequence Number=SeqID_181888
atggggacgaatcaaaatagcaaaaggttttatcaagtcaaggttaaaagtctagatgtcaccagcctcaaggaattgggacgattgatgggacctctccaaaggcaagccttccgcaaagtgtacggaaagattctagatttcaccgcggcggaggtatttacggaagctgtcgtatccctcgcccaatactatgaccagccattgaggtgcttcacttttggggacttccaaatggtaccgactattgaagagtttgaggagatactaggatgccctcttggggggagaaaaccatatcttttctccgggtttcttccctccttgagcaagattgcagctgtggtcggggattcggcaagaaagttggatcgcatgaagcaaactcgcaacggcgtagtgggcctgcctcggaaatacttggaaggcaaggcaagggatatggcgagccaagagaagtggggcccgtttgtggatatattagctttgttaatttttggggttgtcctctttccgaacgtgggcggtttggtggacttagccgccattgacgctttcctcgcatatcaccatagcaaggagagtccagtggtggctatcttggcatatttgtttgacacctttgaccggag

SEQ ID NO: 90204 - DNA, 357 bp, Glycine max
  Peptide Sequence Number=SeqID_181889
atgatacgcggagataccttacggttatccgcacccttttgtcatccagaggcggcgggcccgatgacaagcagagaccaaatttggtcattctgcacccttgtatcatccagaggcggcgggcccgatgatacgcggaaatacccgagtggttatccgtataaatattcttttgctatctgtaagacagaacgcttgatagcatgcgatacgcggaaataccttacggttatccgcacccttgtgtcatccagaggcggcgggcccgatgatacgcggaaatacccgagtggttatccgtataaatattcttttgctatctgtaagacagaacgcttgatagcatgcagaggctga

SEQ ID NO: 90205 - DNA, 288 bp, Glycine max
  Peptide Sequence Number=SeqID_181890
atgggggaatacgcaaaagatgaggaattgctgatacattccttccaagaaaagtcttactggggtagctgttacctggatgcaactacagaacatgtgcaaaaaggggggacagatctttcaaagaacacgcccaaaaggtggagggatctggcggcccaggtggtacccccaatgatggaaagggagacgataatcgtgatggtagacacattatcgatactctactatgaaaagatggtgggctacgcaccctcaaagctttgcggatttggtcttcgccagtga

SEQ ID NO: 90206 - DNA, 306 bp, Glycine max
  Peptide Sequence Number=SeqID_181891
atgagcctttggatttttgcaacttctcaaactgttagtctttctgatattcaatgtgatgttctcgaactcaaaggagataattgtaggatatggaaggagagagttcttctgcaattgaggtggatggacatagactatgctataaggaaagaagaaccatctgcaatcactgatgaaagtagcccagttgttgttgcactatgtgagcggatggagcgatccaacaagctcagtgtgatgttcattaagaccaaaatctcgactgggatatgtggttttgtcaaccagcatgaaaaggtctga

SEQ ID NO: 90207 - DNA, 267 bp, Glycine max
  Peptide Sequence Number=SeqID_181892
gatcaaaatggtcaatggctgaagaaagacgcactccctcctcaagatgagcgtactccttcacctcctcctcagcgtgaagattcagcactcctgaatgaagtccttaccgaattacgaggtcttcgttcttatgttggtgaacgtttcgactcattggatacacgctttgtcggcatggatattcgcctcacacaagttgaagaagatgtctcattcatccgtacttgctttgatccaccaccaccgcctccatcatcctcttag

SEQ ID NO: 90208 - DNA, 690 bp, Glycine max
  Peptide Sequence Number=SeqID_181893
aggatcccacacatcgaagaaaatcctccccgcctagttgccctaggaagagtttatgagggatccacaatcgttcacaacatccctttattgcatgatcaagtgaaggtcggtgttgaggaggttaaagatgcagatgctcccgttcctgtacccactgacgaggttaacttagtggggcagacacttaacacctttcttgcttggccgacacatctcgtaaagcgtttatcagaacagggagctatgggaccagcaaaacatgtagataggctagataatgaggtcgatgatcccctatatctgatgacattgaccatcccacaactttttttgaagtcgttgcaggttatgtgggatgctaccgtgttcggggtgtttaataaagacttccccttgtacataaagcatgaagatctatctgaaatagcacacggtggtcaatgtctcagcatctttgttatacagttgtggattcttgcacactggcaaatggtcgtcattttgcctaaggaaaatcttgttgtctggttttgttccttgcataacaggccggataactaccttaaagaaataattaacagtgctttgaaaggacttaacgatactccacaacctaaatccaaggctggtgctaggtggattgttgcactaagtgtgcttaggtgtcatgaggcatgtaaagcatga

SEQ ID NO: 90209 - DNA, 388 bp, Glycine max
  Peptide Sequence Number=SeqID_181894
gtattgcacgtctagacaggcgcagggtggcgcaccacaggccccagacgcatcgccgccacctcatcaggctgatccagctgggtcatttgacacagagtggtatttacgacatttggttcgccagcaggcggccaaccacagggggcaggtgcagacccatgagtgtctctaccagctcagcctcactccgcagagccagggtttcgattcttttgcgtgtcctactccagatcagtttagggctgaggtcgcatggcccggagattggcctgaggcccaggcaggggagccgcccgcagaggctcccggcgatggagaggaggcccgcatggatgaggagatgacggatttgctcgatttcttgggaggaagcggagccacgtga

SEQ ID NO: 90210 - DNA, 67 bp, Glycine max
  Peptide Sequence Number=SeqID_181895
atgccggtgtcggccgaaacgcaatcttcggttgagctcgatcgaaaagacccagccggcctgcatc

SEQ ID NO: 90211 - DNA, 269 bp, Glycine max
  Peptide Sequence Number=SeqID_181896
gcttgatcgtgtccagcaaaatgcagagacaaattatggtcattctgcgtcttgtatcaacaaagaggaacaagttcgacagtatcgggatgatgtgtcggtactgatcattttcaaatttttgcaggttccgctggcaggaaggttcactggccgtaagaaggcggttgcttctggaggaagcaacctagctcgcttgggcgagctagattttcaaccgttcttcgacgttctttgttcgttcttcgccgttcttcggtcttcaactg

SEQ ID NO: 90212 - DNA, 297 bp, Glycine max
  Peptide Sequence Number=SeqID_181897
aagtccaacagggtcttggagttgtcaagctctaattacgggtctctgtgagttctacggagtgtctgtcacctccagcaagggcatcaggccccctactaatcgagctttcatcaagaagtactgcgtccccaggcaagcgcagggcgaaacaccacaacagcctgggaatggccatcagtgggcaacagacgcaccgccatcacctctagagttcacctcagctcatccacaaaaggttagagcgttgcctacgacccatggccgagcaataggcgaccaagtccagagccaaag

SEQ ID NO: 90213 - DNA, 192 bp, Glycine max
  Peptide Sequence Number=SeqID_181898
atgggtgccaagtacctcgaagtagtcaaacgagggtcgcatcccaacaacggatggtccccggatgaaattagggtgtgcggaatgaccataatttatctccgcccacctctcgagttgttgttcctgaatgacaaagggcgcataatttgtctctgcgcatttatcactcaactcgcgaaatctgaatga

SEQ ID NO: 90214 - DNA, 267 bp, Glycine max
  Peptide Sequence Number=SeqID_181899
atgtcttcagtcattgcatgccttcaaaaggactcgacgtcctttgtttgtattgtcgcaacctacccttcggcgggagggcgacgcgtgactcgcgggatgcgtgttccacgaaaggaatacgctcggagtcgccaccaacgtttatttgaggaaaacgtcggaaaaaccggaaaagacgcgatctacgaacttttaagtgaaagggtgtttccctttgctcctacgtattcctcaatttgtgatgaggaaatcagacctacgtag

SEQ ID NO: 90215 - DNA, 420 bp, Glycine max
  Peptide Sequence Number=SeqID_181900
atgacgttgctatttagcaacattctgcccagtgaccacaatgccaatctccccctgcagatgtatcggttgggatcgcgcccacaaagagacccagtggacccggagaagtccaacagggccctggggtttccagctctgggatcgtgcctgcaagacatccagtggacccgaagaagtccaacatggtcttggagttgtcaagctctaattacgggtctctgtcagttctacggagtacctgtcacctccagcaagggcatcaggccccctactaatcgagctttcatcaagaagtactgcgtctccaggcaggcgcagggcgaaacaccacagcagcctagggatggccaacagcgggcaacagacacactgccatcacctctagagtttacctcagctcatccacaaaaaggttag

SEQ ID NO: 90216 - DNA, 228 bp, Glycine max
  Peptide Sequence Number=SeqID_181901
atgccaaacgaaacgagcctagtccgcacctgttgcatcgacaaccagttaccgttgaaaaccgaagggattaaggccggaaggcgagcgcctcccggcatgagtcatagacgcaagttatggttggccggggcgatgcttgccgggcaacaggcgattcaaccgatcgacgatccagtcgctgcaaggcgtcatcagcacccagctggcgccaaccagcaccactga

SEQ ID NO: 90217 - DNA, 534 bp, Glycine max
  Peptide Sequence Number=SeqID_181902
gatgttctggccgttgctattggatgtccagagcaccctggacgtgtccgtactgctgagccgcagctgacccaacaaatcagggaccagctagaggagtctatcacaaagaaagtgacgaggcaggtcatggcatccttcagccagcttcagtcacagatgcaatctcagggacttgcagtgcctcctgagcctctggggagttgtgttgatccctcaagaaacgatcctgagacgggtgactctaactggtgcggcttgtacatagaagcagatcctgcctgcctggtttccatggggagagtttatgagggatccactgttgttcacaacactcctttgttgcctggccaagtaaaggtgagtgtggaggaggttatagatgcagattctccagttcttgtacctactgatgaggttttcttagtgggacaggcacttcacaccttccttgcttggccgacacatctggtagctgtgtctccgccaaaaccatctccgaagccccatccggaggtcgaggggatcctctag

SEQ ID NO: 90218 - DNA, 100 bp, Glycine max
  Peptide Sequence Number=SeqID_181903
atgggttctccacctacttcccctcctcctcctcctcctcctgctccttcggacgcatcggcttcaccgtctgccgtgaagcggacacacaaagcctcac

SEQ ID NO: 90219 - DNA, 333 bp, Glycine max
  Peptide Sequence Number=SeqID_181904
atggcattaacccgctccccctccatgattggcgagcggggccaaacatttttcgatggaatgccccggggtattcccatgatacgtgcaagttacgttaggatcataccactttgggaaaggggggacggcaagaggtcttcgtacgtcattgggagtggggtgaattctgggattggcttcgggggaaagttcctcattgcgttggaattgccagccgggcgagtcgtggttggagccggagcttggggggcctccctctggatgggtgccttaggctacacgggtgctgaattggaggagttcccggcgcgagctgaaaagctcggatga

SEQ ID NO: 90220 - DNA, 231 bp, Glycine max
  Peptide Sequence Number=SeqID_181905
atgaggaaaggcaagagtgaggaaaacattgacaagaaaaaggatactactccaaatgaaggcaaggaagtaccttatcctttggtaccttcccggaaagagaaagaaagacatttgacaagatttcttgatatcttcaagaaactggaaattactttaccctttggagaagcacttcaacagatgccactctatgccaaatttttaaaagttaggacatcttgcttgtga

SEQ ID NO: 90221 - DNA, 510 bp, Glycine max
  Peptide Sequence Number=SeqID_181906
atggctaagcctagcaccaatgcgcttagcgagcttagagcgagattggcgctaagctcaaattcacttactcgcgctaagcgcgacgtcgagatcaggaagccccttttaagcctgatttgcacaaaattaaaagaggagagcctgaagagtgtgaatttcagagagcatagagcagagcaatgggccaagttttcatcttttagggagattagtgagtttttgagagattgtgagattcctagaggtggaggagacatccccactcctttaaaatctgtgttccaacacctaggctaccctcaccaaggcaacaagaatccatgtgaaggtgacattctacctagaaggagacatgccataggacaagggaaatctcctagtgaaagaaaggtagccaaggttaatgttagagaatgtgttactacattgaagataacagtaatgaatcagggagatgtgaagaatgcaaagactcaaaggcctagattgatagtacaaaaggaatag

SEQ ID NO: 90222 - DNA, 246 bp, Glycine max
  Peptide Sequence Number=SeqID_181907
atggcttcctatggtgccattaaacttcaagaagcaaaggatgtagaagcaaagcttcatggtgaatgtgattcaaagatgatgacaaaggtgatgaacaaaaaagctcaaagatcaaagaacaactcaagtgaatcaagaacaagtcaagagttcaagaatcaagaaggattcaagatctcaagaatcaagatcaagattaaagactcaagattcaagaatgaagaaaagactcaatcaagataa

SEQ ID NO: 90223 - DNA, 300 bp, Glycine max
  Peptide Sequence Number=SeqID_181908
atgatttactttgtgaggcatgtcaaaaggggaaacagattaaaaattcctttaccaataaaaacgtatccacctctagacctctccaactattacatcttgatttgtttggtccaactaggactgtgtccgctgatgaattcaaaagaagaagatttcaagtgctttaaagggatattgatgcaaaaactggaagaaaaaggccttgaagaaaagttggaagaagtggacagctcgcttagtgcacactctaggcttagtgcgaagaaagcccatagcgaagcccaaaggcatgcttag

SEQ ID NO: 90224 - DNA, 109 bp, Glycine max
  Peptide Sequence Number=SeqID_181909
atgagtctagaagaagctcaccaccataggaggccatggataagagcttggaggaagaaggagatgaatgaaggagagggagagaagagcacgaaattttgtgctctaa

SEQ ID NO: 90225 - DNA, 476 bp, Glycine max
  Peptide Sequence Number=SeqID_181910
atgatagaagtgccgtctttttaccaccgacaatgggcaccaaattaccctgagttagttacttttagatatgatggaataacataccaaatcaggctaaggcagcatcgtggaaaagtctactttgcggaaggcctggatgaattcaaaaaatatttatcaatttttgaatctgtgatcattaaattcttggcatgcaacaataaatccatctttgatctttatttcattccctcactggaatgccagacttgcgggaggccacaactcatgccaagacaatatatttggacagttgaaatcacacaatcgatgcttggtgcaccaggaccactgaggctccctaactgtgccatgctgcatgtaaatgcctgcggtcaacacttgactattctttggagatttggacctccattacagtggaatgtcgtggtggttgacggtggagttaggcgcatatatgttgtacaaccatg

SEQ ID NO: 90226 - DNA, 450 bp, Glycine max
  Peptide Sequence Number=SeqID_181911
atgtttgcacattcgataaaaggctgccgtcccttgggacggacgtatggggtgctaataccttccccgtgcgtaaatacaactcccgaaccttttcacttaagagtgggtagatcgcgtcttttccggtttttccgacgttttcctcaaataaacgttggtggcgactccgcgcgtattcctttcgtggaacacgcatcccgcgagtcacgcgtcgccctcccgccgaagggcaacactccaacctttgtagatgagctgaggggctctggaggtggcggcgatgcgtctattgcccactgtcggccatccccaggctactgtggtgtctcgccctgcgcctgcctaagggacgcagtacttcttgatgaaagctcggttagtagggggcctgatgaccttgctggtgttggatcaagtggcctcagaataattaagaaggggggttga

SEQ ID NO: 90227 - DNA, 297 bp, Glycine max
  Peptide Sequence Number=SeqID_181912
atggaggagttgattaacaaaacacaactctctcccaaaataatcccaacgtcatcatgtcggctcgacggctctacaaaagaatctcacttctcatactctactgctgtcattttgctcccacaaacaaaggttcgcgatcatcacaagcaactacccccccacggtgatcagcctaagtctcaagggagttccaaaacgagtgacatgcccccaagtacaagtattcctccttatgagaaactacaagtacttactgacaaagtctatactatttccatgtcatatgaagtatga

SEQ ID NO: 90228 - DNA, 219 bp, Glycine max
  Peptide Sequence Number=SeqID_181913
atgacatgtggagatacccaagtagagactaacgtcgtcttctgcaccctttgtcaatcaggggcaagcaaacccattgacacgcaaagacttatgtcgtcttccgcgttttctgtcatcctgacccgtgaagtcaggcggagatgcctaagtggttatccgtataaacactctttcgctatccatcagactcagagtatggtagcatgcagagactaa

SEQ ID NO: 90229 - DNA, 207 bp, Glycine max
  Peptide Sequence Number=SeqID_181914
atgacaaaagactttcattgtagcgaggacacttcttactacaacgaggcttcatcttttgcaaatgatacttcacttgaaccttcttgctctatgaccaacttacgctatggtgagagttgtactcgttgtggcaagtgcatgctcaatatcttagtcttcaacattcatattcgttgtggcaagtcttcacattcattcagttga

SEQ ID NO: 90230 - DNA, 315 bp, Glycine max
  Peptide Sequence Number=SeqID_181915
atggcagcggaatggagaaggaagagagagaggagacgccacttcaaggagaagatgagtctagaagaagctcaccaccataggaggccatggataagagcttggaggaagaaggagatgaatgaagggagagggagagaagagcacaaaattttgtcattcttagcctatctttttaattttgagtctaattcatgcatttgccatatagggaattggaaaagaggattggtgtcatcccttgaagaatttgagtcaagaagcaaggggccaaccaccttaagagctattggaataagaagcactccaaattga

SEQ ID NO: 90231 - DNA, 542 bp, Glycine max
  Peptide Sequence Number=SeqID_181916
atgtcggctttgaaagagcaaatggcttccatgatggatgccatattaggaatgagacaacttatggagaataacgtggccaccgctgtcgctgttagttcggctgccgaagcagacccaactctcctagctaccacgcaccatcctctcccaaacgtgtggcttaccctttatgggttaccacctaattacacgccactagtcatgcgtgatgacatgggtcatgtcccttcccccatccttgaaggggagcctcctcgacagtcggatgaggttcacgaggatcatgcccaaggaggcatcgatttctaccccccaatccccgtcaaggggctggcacccaacatactgcctcagcccaatctcccagcacaaccaatattcttgtccacagaaggaccgcccccagcagcggaagaaagaaggaaactcgatctcatcgaagagagattgagagctattgaggctttggcgactattcgttcgcggacatggcggatctttgcttggtaccgggacgtcggtcatcccccaaaaatcaa

SEQ ID NO: 90232 - DNA, 843 bp, Glycine max
  Peptide Sequence Number=SeqID_181917
atgtaccaggttagttatcgggccaggcaatggtttgctgcagctcgggcatacctacttcatttggttggttgcactcttttcgctaacaagagtgcaacccatgtccatgttgtgcacctgcaggcattcagagacctggcacaggcagggacattctcttggggagcggccgctttggtacacttgtacgatcagcttaacgaggtgtcgcaggcccctacacgtgctggatttacgagcactttccatcagtccacaggtaaggcccagatgatcagcattaaggaagccccttacagagcacgtattgatggcctgacagtcactgacgtctgttggatgctgtatgctgagcatcggggagttcggggctatgacttgatctcctcgtacatggggcaagtcagatggggtccgatcatcgtctaccttcgaccagagagggtggttcggcagatggggtacattcagacagttcctctgccatcggttcgtgattcgttgacaggtactgatatagacgaccggtgggtacagttttcagatcatgtagcgcctacaggggagctctgtgtagttcctgggcaggtggccccagactacatggagtgcttttttcagatttcacacccctttgtgacgccgacggaggacattgctgagcccagacctgcgcctccccttcccactcatgatgatgacttcgtggaaccacctgtcgcccaagttccaatcgcgtcagatcccccctacgcattctgtgcatgtgtcaggatgggaaggattgctgagcatttggagcgcgtcatcaacctcaggatggtgactgcaagaatctga

SEQ ID NO: 90233 - DNA, 912 bp, Glycine max
  Peptide Sequence Number=SeqID_181918
atgcggcgtgcccagccagggggcgaagcggtaggtggcccgcacggcgaggttgcggaggaagccgcccggggtggtgacccggtccagcagcatcctgcgctgcaggcggacgtcgctggagaacagccgccacccgccgcgccgggcgaacagcgcctcgtcgacgcggtagtcgacgagcacctcgggcaggttccccatccgggcgccgccgagcatcatccgctcccacagccagtagtcctcgagcaggtcgaggtcccggtagccgcccacggcgagcgccaccgagcgccgcagcaccacgctggggtggtggaaggggctgtggtggggcaggtagcgcacgatctcctcatgcgtgagcggccgggtgcgcagagggccggttccgggcgcgacccggtcgctgaactcgcgcatcgaggagcccagcagatccaggccctccgcgtccatccgcgggatctgcagggcgaagcgctcggggcggcagatgtcgtccgcgtccgcgcgcgcgatgagatcgtgcgggctggattccaggccgtcctgcagggcggaggcgacgccgcggtgggcatcgtggcgcagcacccgggcggggccgtacgcgccggcctccacctgctccacgaccgtctcgagctccgcggggagcgggccgtcgatggtgaggatcagcaggtccggcgggagctgctgatccagggtcgccgtgcgcagcgcgagctcgaatcagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 90234 - DNA, 49 bp, Glycine max
  Peptide Sequence Number=SeqID_181919
ggtgaatgctgtgaaaattttcacggacgcccgtaatggactcgaatga

SEQ ID NO: 90235 - DNA, 213 bp, Glycine max
  Peptide Sequence Number=SeqID_181920
atgaccctttcatcatggcagaacaagctagacaagtattttacgtgcaagacccttgtgatgaaaggtgaagatgatgattcatacacggacacctatgttagtcctttgaccgctcaaatcactggtaacgttgtcggagaagaagaagctgacgacgttcatgcaaatcgaaatgatcatgatgaaggagaattgattaacatcggctaa

SEQ ID NO: 90236 - DNA, 663 bp, Glycine max
  Peptide Sequence Number=SeqID_181921
atgttatcccaccgcctgaaacactgtaacgcgctggccgacagcatgagcaatgcctccccgacgcaactgcagcagctcaagacgcagttggccgaacagatgggtaatcctgtgggattacataccatgggtattccggcagcaatcagtacgctcggggtgattatcagtttcgccattccgcagctgtggttgggctatggggtactcgtcgcactcgggcagccagttgaacgcgtattcgtgcagcatgcgcgccgtacggatacaccttgcgctggcggtgataagcctggtattaacggcagcatctatctgctggccgcgctgagcggtagcccttttccgggcgtcagtctgactgcggcactgccttttataagatgctgctatttactctgcataatcgcgcctggcgcaagcagatcaggcagactcgcgatgcacatatgccacgctaagcctgcccctcgtaaccatcccgcccccattatcccagacgcgatatccttgacctcgcctcgtccagatggttgcgcaacgccgcaagacatggcgagaaactggcagagaaacggcggcaatcactggccagagcataaaaacgctcagccagctccagcgcttcatgccagatttctcctgcgaccgcgtcgataa

SEQ ID NO: 90237 - DNA, 357 bp, Glycine max
  Peptide Sequence Number=SeqID_181922
atgagtaaaattttcgggctttttatattgcaaccgggccccgtccctcaatggggcccggctgttttattaactaaagaggatgttatggtaacaattcgtttggcacgtggcggcgctaaaaagcgtccgttctatcaagtagtagtgaccgacagccgcaacgctcgtgatggtcgtttcatcgagcgcgtaggcttcttcaacccgatcgcttccggtcaggctgaagcactgcgtctggacctggaccgcatcgagcactgggtcggtctgggtgcaaccgtttctgatcgcgttcacgcgctgatcaagacgctaagaaagcagcttaatctgtcgcggtggtggcaatga

SEQ ID NO: 90238 - DNA, 642 bp, Glycine max
  Peptide Sequence Number=SeqID_181923
atgaccgaaaggcttcttatcggttcattggcttttgaaagtcgcatcctccattacctaattgttcgcatcttgctttcgagatcttcaaatcttgctcaggtttttgaagaagatctcattgttatgtgggcctttcataaaggtttacaaattgattgggcaaatcttgttagatatcgcatgcataaggcattgcgattgaatgccccattgccttatcctcatcttgttacctttttccttcaacacttcagcatccctcttgattctgaaccctatgttctaatcaagagatccttccttataggcgcttcagtcatagcatcctttggttatcaaaaagagcatgatggctcttgggtgaagaagggtgctcaaaatgttggtgaagaaggacatgatggagaatattcatctcttctttcaaagattttggacagaagttgtcatcatcaaaaagggggagattgtagagcaaagcttcatggtgaatcaaagaacaattcaagagttcaagataagaatcaagaagaattcaagactcaagaagaaagtttagagtcaagaatcaagattcaaggttcaagatctcaagaatcaagatcaagactcaagattcaagaatcaagagaaggctaa

SEQ ID NO: 90239 - DNA, 222 bp, Glycine max
  Peptide Sequence Number=SeqID_181924
atgcaagaacctcaagaaaaacatcaaggtgatgacaaaaagctcaaaggtcaatcaaagaatgagttcaagatgttcaagatagaatcaagaacacttcaagattcaagaggaaagttgatttcaagaatcaagaatcaagattcaaggatcaagcttccaagaatcaagatcaagatcaagattcaagactcaagattcaagaatcaagagaagacttaa

SEQ ID NO: 90240 - DNA, 225 bp, Glycine max
  Peptide Sequence Number=SeqID_181925
atgagtagaaaagatccatacatgtatataatatcaaaagagatatgtggaagcaatgccttccaagattattttgatgatgccaaagaatcaagagttaagcaaattccaaagattcaagaatcaagtttcaagaatcaagaatcaagattcaagattcaagaatcaagtttcaagaatcaagattcaagaatcaagagaagactcaatcaagataagtactaa

SEQ ID NO: 90241 - DNA, 276 bp, Glycine max
  Peptide Sequence Number=SeqID_181926
atggcttttactaaattgttaagagaaagaggagtagaagagaaacttaacacccacgtaaaagcagaaattaaatgcacagtggaaagtaaaagaatagggaagaaggaaacaaacacacaaggatttttatactggttcagcacaaacccgtgcctacctccagtccccaaggaacctgcggtccttgagatttctttcaaccttgttaagtggtggctggacagaaatatagaaatggcaataactgaagctacagggttccaaatgaggtga

SEQ ID NO: 90242 - DNA, 318 bp, Glycine max
  Peptide Sequence Number=SeqID_181927
atgaaactggccaaatacaggctaaaggcccaagtggagaaggacgaaggcccaagtggagaaggacaaagcccccgagtggagaaggatgaaggcccaaacttatcttccttcattggaagtggcgtctaccccgacttatcttccttcaccggaagtggcgtctatcctgacttatcttccttcaccggaagtggcgtctaccctaacttttcttccttcaccggaagtggcgtcatccaaatcttcgtagcctgtatcaaacgatccgctcctactcaggttcacatcatctggtatcagagctttggctcttga

SEQ ID NO: 90243 - DNA, 414 bp, Glycine max
  Peptide Sequence Number=SeqID_181928
atggcgaggaactttgattccataaaagatattgatggaacacaagagacattgcatcttgttattcgcataatagatctatgggttgtccctacgcgtgattactctggtcatttagaaatggtgatcatggactctaatggagataagattctatttatggctaggaaagaccagtttgatacatggtatgcaatgctgagagagggtagtacatatatcatgaataacttcagaactgtacccaatgatggacaatataagatatgtaatcatgcattgaagttgttatttactggtgaaacaacgctcaagactcaagaccttcttgatattgccaacaatgtttacggtttcatgaattttgaagatatcctgactaaaagggcaaaattcctatgtgttaattggtaa

SEQ ID NO: 90244 - DNA, 225 bp, Glycine max
  Peptide Sequence Number=SeqID_181929
atgggccttgtcattctcttccaaaggcccaccttgagtctgattcttcactctgttgacccccaccaagttggtaatggtgagaacaatggtggtaatgaaatgataatagtggtgatagttaagacaacaaatgtgatgacaatgatggtgagggtaatagtaaatgtggcaatagagatagaggtagtgataatgaggctcaagaataataacaaatggtga

SEQ ID NO: 90245 - DNA, 297 bp, Glycine max
  Peptide Sequence Number=SeqID_181930
atgccgatctccccctgcgaaaggatcgcgcccacaaggcacccagtggacccggaggagcccaacagggccctagggtttccagctctggttacgagcctctgtcagtcctacagggtgcccgtccctccggcaaggtcatggcatcatgagatagggattgcgcccgaaagacacccagtggacccagagaagtccaatagggtcttggggttttcagctctgattacaagcctctgtcagttctacggagtgcttgtcacccccagcaaggtcatcaggccccctactaactga

SEQ ID NO: 90246 - DNA, 300 bp, Glycine max
  Peptide Sequence Number=SeqID_181931
atgctccttctctccttctccctcccctcatcttctcctccttcaagctcttatccatggcttcctatagtggtgagcttcttcttgactcatcttctccttgaagtggtgtatccatcatctttcttcattctccattccgttgtcattaaaattcaagaagcaaaggacttcatcgatgaagaagatacaaagcctacaagctccacatggagctacatcatgtggtatcaagagcatcttcatctaggtgatgttcttttgcttcctctatctttttgttcggtcaattcactttaa

SEQ ID NO: 90247 - DNA, 615 bp, Glycine max
  Peptide Sequence Number=SeqID_181932
atgaccggaaggcttctttccagatcattgtcttttgaaagccacatccttcactatcttattatgcgtattttacttccaagatcttcaaaccttgcacaggtttctgaaaaagatcttattgttatgtgggcttttcatactggccgacaaattgattgggcacacttagtccaatatcgcatacataaggcattgcgattaaatgctccgttgccacatccacacctagtcactctcttccttcaacactttgacatccctcttgattctgaaccttatgttccaatcaagatatccttcttaatcggtgccgctgtgattgcatcttttggttaccgtaaagagcatgatgactcttgggtaaaaaagggtgctcaacccattgatgaagaaggacacttaccagttggagaagattcctctctttttcaaaggattttggacaggttcgatggtcttcaaacctttgttggtgaaagttttgatgctttggagttacaagtggacatgcgattcaatgagatggattcaaggatcaccaaggttgaaggagatgtctcttacatccgcacatgctttgatctacccccaccaccaccaccatcgtcttag

SEQ ID NO: 90248 - DNA, 852 bp, Glycine max
  Peptide Sequence Number=SeqID_181933
atgatcaatccgatcaccggccgggtacacacctcttatcaccaggcggtgacggccaccggacgactctcctcgaccgacccgaacctgcaaaacattccggtgcgcaacgaagagggacggcgcattcgtcaggcgtttattgcgggcgcggataagcgcatcgtggccgccgactattcgcagattgagctgcgaattatggcgcacctgtcgcaggacaaaggcctgctggatgcgtttgcgcagggtgaggatatccatcgcgccacggcgtccgaagtgtttggtgtggcgctaagcaaggtttccggtgagcagcgccgcagtgcgaaagcgattaactttggactgatttatggcatgagcgcatttggtttgtcgcgtcagctgaacattggtgccggcgaagcgaagaagtacatggatctctactttgagcgctatccgggcgtgctgcgttatatggaagcgacgcgcgcgcaagccgcggataagggatacgtcgagacgctggatggtcgtcgtctgtggctgccggacatcaactccagcaatgctattcgccgtaaagccgccgaacgagcagcgatcaacgcaccgatgcagggtaccgcggcagacatcatcaaacgtgccatgatcgccgttgacggctggctgctgcagcagaacagtgatgaggtgaaaatgatcatgcaggtacacgatgaactggtatttgagatccacaaagatgccgtcgcaggtgccagccagacgatccgcgaactgatggagaacagcatgaagctggatgtaccgctgcaggttgaagtgggaaccggtgataactgggatcaggcgcactaa

SEQ ID NO: 90249 - DNA, 300 bp, Glycine max
  Peptide Sequence Number=SeqID_181934
atgcacctcccccaactgatttctgatgtcatctattgtttgcagggattgtgcccggggtgcctgtcgcccccagcaaggtcatcaggccccctattaaccaggctttcatcaagaagtactgcatccccaggcaggcgcagggcgagacaccacagcagcattgggatggccggtagcgggcaacagatgcactgccaccacctcttgagttcacctcagctcatccataaaaaggttagagcgttgcttacgacccatgaccgaccaataggcgaccaagtccaaagccaaaggtaa

SEQ ID NO: 90250 - DNA, 348 bp, Glycine max
  Peptide Sequence Number=SeqID_181935
atgttggatcaatttgcgccatttatgcagggtttcattcacaacgttatggatgtgaaagcggacggtaattgtggatattggtccattgtcgctttatcaggtatgggggaagattcttggccgttggtgcacaacgaattgattaaagaactttgcagatggtcacatgactacatgaacctcttcggtggcacagagagatttgaacgattaaggttgtccctacttgttgatgggttttcgtccctacttgttgatgggttttccaaggtaagtgtggacaagtggatggatataacggcgatgggatatgtcattgcatcaaggtacattgaagatagttag

SEQ ID NO: 90251 - DNA, 324 bp, Glycine max
  Peptide Sequence Number=SeqID_181936
atggtgcaactatggtttgggattagggtgaaaaaactcggtggaccattcggtcctgccaacaaatcttatccagaaccccatgaattgattgtcattcatgcatcctccaccatcgagtctggagccccacgaattgattgcctagcgttgttcgtctatcctccaccctcaaatcttatttggagacccatgaatcgattgcctagcgttgttcatgcgtcccccgccatcgagtttggagccccacgaattgattgtctagcgctattcgtctatcctccaccctcaatctattcggagacccatgaattgatttcctag

SEQ ID NO: 90252 - DNA, 231 bp, Glycine max
  Peptide Sequence Number=SeqID_181937
atgaggcaggttgttacaagggcacacttgttgaagatgactggaaagggagttagagtttgtcaaaaggtaacaatttccaaacttatagatttaaagaaaatagacaataaggctacattgagggtggagaagtcaaaaacaaaatctgtgtcattgcctctggtttctactcaacaccaaatggatacaaacactcttggtgttgatccaaaaatgagaaagatataa

SEQ ID NO: 90253 - DNA, 231 bp, Glycine max
  Peptide Sequence Number=SeqID_181938
atggagatttttagaagtgtgtggaatgtatgcaaactcttggcatcgcctgtacctcctggtaaagttgagggtgtttgccctgagtattggctagtagaagccagctcgcaccactttggtggcaagggagcttcctctggtgcggagaccataaatcccttcatgaagaattttggtaaggatgttgtcaaccctcttttgaatagctctctatcaaggatgatgtag

SEQ ID NO: 90254 - DNA, 282 bp, Glycine max
  Peptide Sequence Number=SeqID_181939
atgcaccgcaggctgcagacgcaccgccaccacctcatcaggctggtccaactgggtcatttggcatggagcggtatttacagcacttgcctcaatcagcagagtcagggtttcgctccttttgcgtgccctactccagatcagttcagggctgaggttgcttggcctgaggcccaggcaggggaggcgcccgcagaggtttccgacaacacggaggaggcccgcatggatgaggagatgacaaatttactcgatttcttgggagggagcggagccacatga

SEQ ID NO: 90255 - DNA, 939 bp, Glycine max
  Peptide Sequence Number=SeqID_181940
atggccccgaggaagcttgcctcaaagaggtccaggaaggacaaggcagccgaaggaactagttccgctccggagtatgacagtcaccgctttaggagcgctgtacaccagcagcgcttcgaggccatcaagggatggtcgtttctccgggagcgacgcgtccagctcagggacgacgagtatactgatttccaggaggaaatagggcgccggcggtgggcaccactggttactcccatggccaagtttgatccagaaatagtccttgagttttatgccaatgcttggccaacagaggagggcgtgcgtgacatgagatcctggggccaggaatgtgagtatggccagaggaggaaccggtctgatgggttcgacgaggagaccatcgcccagctgctatgtataccagggcaggattttgcccggactgctgcagggaggcgagtgcgaatcatgcgcaccaacatgaccaccctgacccagatatggatgacgttgctcctcagcaacatcctgcccaccgatcataattccgacctccccatgccgaagtgtcagctggtgtacgccatcctgacacggatgagcatccatgtggctcagttgatcgctgatgccatatatatttttgcaggtatggcgcccactaggcaccctttggacccagataagtccaacagggccctgggattccccgcactgatcataggactctgccagtcgttcggagtccccgttgcacctaccaaggtgattcggccgcccatcacccgggcttttattgagaagtactgtacccagagacaggctcagggtgatgctccacaggccgcaggcgcgcctccaccacctcatcaggctggccaggctggggcatttgacatggagcagtatttacggcatttggttcgccagcaggcggccaaccaccgagcacat

SEQ ID NO: 90256 - DNA, 886 bp, Glycine max
  Peptide Sequence Number=SeqID_181941
atggcgttctggtgctttgcgatgatcgccaccatcgttccctatattttgctcaacctcggcattctcggccgccgttataaggtgttcatgggggacgccggcagtaccctgatcggctttaccgccatttggctgctgctgcaaagctcgcagggcaaggcacactcgattaatccggtgaccgcactgtggatcatcgctattccgctgatggacatgatagcaatcatgtatcgtcgtttacgcaaggggatgagccccttctctcccgatcgtcaacatattcaccacctgatcatgcgagccggctttacgccgcggcaggcttttgtgttgattaccctggcggccgcattgctggcggcggttggcgtgatcggcgaacgcctgacttttatcccagagtgggttatgttggcattattcttgcttgctttcttcctgtacggttactgcatcaagcgcgcctggcgggttgcgcgaggctttttggctgtgatgaatccagaaacaacgtctgacaagcataccccggcggtggataacgaactcgatatccgcggcctgtgctgcaccctgtggcgcggcaaaccgtggattatcggcattgcggtgctgttcgcggcggtcgcgctgatcgtctcttatctggtaaagcaagaatggagcgcgaccgcaatcaccgacaaacccacggtaaatgcgctgggcggttactactcccagcagcagttcctgcgcaatctggatgtgcgcacgctgccggcgacggccggcgatcagccgagcatcgcggacgaagcctacaatgagttcatcatgcagctggcggcttacgatacgcgtcgcgatttctggctgcagagcgattactacaagcaac

SEQ ID NO: 90257 - DNA, 327 bp, Glycine max
  Peptide Sequence Number=SeqID_181942
atgcagcacatttctatccacatcgaaggattaagggctaagcgatggaggtattggtggctggcagtaacatggtctatatggaagctcagaaacagaattttgtttgcaaatgcagaatttgatactaatcggctttttgaagatgctatctttataatttggacttggcttagacaatttgagaaggacttcacagtccactataatcagtggtcaaatagaatcccaactaaagggaatttacggagaagacagctggagaaaggctttgcccagccctacaactattggtctagtaatttatcaacaacattttttgattag

SEQ ID NO: 90258 - DNA, 431 bp, Glycine max
  Peptide Sequence Number=SeqID_181943
gaatcatgcctctgcctttttcttatttgggaataccaatcggggctaatccagaggaggttcctatggggatatgggatgtcagtctgcaaatgtttgggaatggaagcttgaatggagaagacacctttttgaatggagaagccacatccctaggttgcattaaatctcattacaggagcatcactacatccaacagatgggaagtcacaaagacaatgggtgggagtggagctttatttggagaaggccattgttttgacaatgaaattgatacggctggtgtttttctcaatgaggttcaggatatggccattcatcaacatggacctgatgtgtgggaatggactgctgaccctacagggacagtgaggatgatgcaattttcattctttggacctggcttaggaactttgagaaaggcttcatag

SEQ ID NO: 90259 - DNA, 201 bp, Glycine max
  Peptide Sequence Number=SeqID_181944
atgggacctaacaaactctctacgttcgtacctgcagctaacaagtcagaagtgccccctgagtctgagttagctgttctacttctagcttgggtctttcatttgggccctgtggaccagccaatgcgtataagcttgggctttcttaacgtggctcatttgacgactcagtacatggatgtcacgagtctattggcatag

SEQ ID NO: 90260 - DNA, 263 bp, Glycine max
  Peptide Sequence Number=SeqID_181945
atgggggtgcaaatagcaaccagcccacttgtgccctccagaaggctgttgctttctggaggaagcaaccctgctcgcttgggcgagctgggcggcaagcatctcccctattttgctataaataggggaggaagtgaaagaagaaaaggccgaggcgcttcccgaaacgtttccgtaacgttttccgtgaagaatttcgcaaaggtttcaaccgttcttcgacgttcttcattcgttcttcatcgttcttcgatcttcaacgg

SEQ ID NO: 90261 - DNA, 237 bp, Glycine max
  Peptide Sequence Number=SeqID_181946
atgttggtgcgcatggtccgcactcttctctttgcagcggcacgggtgaaatcttgccccagtatgcatagtagctgtgtgatagcctccctctctggttgtgctcgcacagttggccctcctccaatatcagggggtggcccaggaaccgcgagggagtgtattcctatgatggcaaggacgtgcaatcctctgaaggtgagggcatgcccccctttgaaaatggggaacatgtag

SEQ ID NO: 90262 - DNA, 396 bp, Glycine max
  Peptide Sequence Number=SeqID_181947
ttaaaactctctattgtgaatcaccttcttggtcttggaaaaacgtttgaagatgatgagctaaacatcaaaatcctcaactttctttcaagtacttgggaaccaaagatcaaagtgatcaaggaatccaaggacttagcatcaatgtcgatggaagctctgttcgaaaaattgcttgcatatgaacacgagtttattcaacaatctgatacagagaatttcagcttaatggtgaagaagtttggaaattttctcaaaaggtccaaagacagaaaattctctaagccttcaaagaaaatagaaagcaacaacaacaccttcacatgctttcaatgtggaaagcaagataatgcatccacatcctccgactcttctagtgaagaagaagttgcaaat

SEQ ID NO: 90263 - DNA, 1092 bp, Glycine max
  Peptide Sequence Number=SeqID_181948
atggcaaaagtatcattggagaaagacaggattaaattcctgttggtggaaggggttcatcagagcacggtcgataatttacgtgccgccggttataccaacatcgaataccacaagggtgcgttagacaccgaatcgctgaaggcatccatccgcgatgcgcacttcgtcggcatccgatcgcgtacgcatctgaccgaagaggtgttcgccgccgcagaaaaactggtggctgtgggctgcttctgcatcggcaccaaccaggttgatctgaaagcggcgaccaagcgcggtattccggtcttcaacgccccgttctccaatacccgatccgtggccgaaatggtgctgggcgagctgctgttgatgctgcgcggcattccggccgccaacgccaaggcgcaccgcggcgtgtggcacaaactggccgtgggctcctacgaggcgcgcggcaaaaagctgggcatcatcggctacggccacatcggcacccagctgggcattctggccgaagggctgggcatgaaggtgttcttctacgacatcgagaacaagctgccgttaggtaacgcgcagcaggtgcgtcatctgtccgatctgctcaatatgagcgacgtggtgacgctgcacgtgccggaaacgctggccaccaagaacatgatgggggcggaagagctggcgctgatgaaaccgggcgccattctgatcaacgcctcgcgcggcaccgtggtggatattcccgcgctgtgcgacgcgctggccagcaatcacctggcgggcgcggcgatcgacgtcttcccggaagaaccggcgaccaacagcgatccgttcaactcgccgctgtgtgagttcgacaacgtgctgctgacgccgcacatcggcggctccacccaggaagcgcaggagaatatcggcgacgaagtggccggcaagctggcgaaatactccgacaacgggtcgaccctgtccgccgtcaacttcccggaagtgtcgctgccggcgcatggcccgaacgccagccgcctgctgcacatccacgaaaaccgcccgggcgtgctgacgcagattaaccagatcttcgccgaagagggg

SEQ ID NO: 90264 - DNA, 775 bp, Glycine max
  Peptide Sequence Number=SeqID_181949
atgggttattttttactttgcggaagtgtgaccgatggctcacttcaatgcgggggaaatattgcggatttttggcccgctgcggacaatgaaacggcgttccgtcttcacgtgatgcaggccttgggcgccggttggcggttcgacactggagagattttcgctatgagcctgaaagccgtcgacgagaaagatgacaagaaagacaaaccgctgggcagccaaagcctgttccgcggtttgcagttgattgagatcctgagcaatttccccaatggatgcccactggcgcatctgtccgagctggccggcatgaacaagagcacggtgcaccgcttgctgcaggggttacacaccagcggctatgtgacccaggcgccgtcgccgggcagctaccgcctgaccaccaagttcatttccatcggccagaaggcgctgtcgtcactcaatatcattcacgtggccgcgccgcatttggaacagctgaacctggaagtgggtgagacggtcaacttctccagccgcgaagacgaccacgtcattctgatctacaagctggagccgactaccggcatgatgcgcacccgcgcctatatcggccagcatatgccgctgtactgttcggcgatgggtaaaatcttcatggcctacggcaacgacgattacccggcccactactggcagagccatcagcaggagattcagacgctgacgcgcaataccatcaccgagctgccgaaaatgtatgaggaactggccgatattcgccagcggg

SEQ ID NO: 90265 - DNA, 904 bp, Glycine max
  Peptide Sequence Number=SeqID_181950
atggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgaattgctaagagtaaaattcgggaaaaaagaaccgattgtatgggaaatacttcaagaagttatgcagggacatcccgtattgctgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgag

SEQ ID NO: 90266 - DNA, 360 bp, Glycine max
  Peptide Sequence Number=SeqID_181951
atgaattttgcagcgagaaagcctatccccctcaccccaattccagtgtcccatgctgacttgctcccatatctacttgataattcaatggtagccataaccccaaccaaggttcatcaacttccatttttccgagaatacaactcgaacgcaatgtgtgcttgtcatggagaagccccggggcattccattgagcattgtaggggcctgaagcgtaaggtgcaaggattttcaactttcaccggaattgggtgcaagccattggtctatttgctcaagccacctgtgctcctgagtttggacttccaagaccgttcaatcggagattactcgtcttgcacgttggtggggcttccgtaa

SEQ ID NO: 90267 - DNA, 532 bp, Glycine max
  Peptide Sequence Number=SeqID_181952
gatggacccttgggtactagtaccctcgtcttcagagggctgctcgccctcgtcttcaaaggactacacgttctcaccatcaaagggctgcatgcccacgccatcagaggactacccatcctcaccatcagagggctacacgccctcaccttcatagggttacacgccctcaccttccgaggactacatgtcctcaccttcagagggctacacgacctcgccttcagaggacaacacgtcctcgccttcgccttcgtagggctacacgcccatacctttagaggactacacgtcttcgccttcagaggactacacgtcctcacattcaaagggctacacaccctcaccttcagaggactgcacgtcctcaccttcagaggaccaaacatcctcatcttcagaggactacacgtcctcatcttcagaggactacacgtcctcaccttcagagggctacacgccctcaccttcagaggactacacgtcctcgccttaagaagggctacacgtccttgccttcaaaggactacac

SEQ ID NO: 90268 - DNA, 207 bp, Glycine max
  Peptide Sequence Number=SeqID_181953
atgccagagatgcagatgctcaaacttggagagggccaagcgtgggtgttgttgttgctttccatggaggggtttgtgtgggatatgattttgggtgtttgtaaagcggaagaaggagatgatggaagtggggaggccaatgcagtggtcatcggaaacagtggagaggaagggagagtaaaatttggtgggaaaggtgtacaatag

SEQ ID NO: 90269 - DNA, 177 bp, Glycine max
  Peptide Sequence Number=SeqID_181954
atgccggagatgcggatgctcaaacttggagagggccaagcggatgctcaaacttggagagggccaagcgtgggtcagattcggtttctctgcggtgtggcgattgggctcgacggtgctgtttcgaagaaggagatgaccgaagtgggggaggaggagaatagcggtgctcagtag

SEQ ID NO: 90270 - DNA, 432 bp, Glycine max
  Peptide Sequence Number=SeqID_181955
atgggggagcagcggagacaattcaagtctgatttgacatcgaaatgggcatttgcagccgacaaggaaagtgtcgacgacactgatatgcgcaagaaggcacaagccatccagaaacataacattgcccctcacttgttgcctcgtgagggttatgaatatttagaaaacaagttgatggatgagaagagaaagaaaaagctagaggaagctgctcaatccggaagcactgacaccgtgattgatcctccatctcccatcagacaacacatgaaatggaagatggcccgcataaagaaaactgggcaaatgacgtctgaggcagcaaaggaaattgctgagaagattgaatcgttggaggagcagagtcctgaatggccagttcacaactctattcggagtcatttctttctgctcactcataacctctaa

SEQ ID NO: 90271 - DNA, 228 bp, Glycine max
  Peptide Sequence Number=SeqID_181956
atgggtcagattcggtttctctgcagtgtggcgattgggctcgacggtgctgtttcggtaggtgttgctgtttctttccatggaggggtgttgtttgcggctgataggaggagaatagaggtgctcggtagtgatgggcggccgcaggccaatgcaggggtcattggaaacggtggagaggaagggagagtaaaatttggtggaaaaggtcttgctgcattcaaatga

SEQ ID NO: 90272 - DNA, 588 bp, Glycine max
  Peptide Sequence Number=SeqID_181957
atggatgcacatggagataagccggctaatgtggacacagatgatccaatgcgtgggctgataaagtacagctttgatatttacgacaagccagtggaatgcaaatttgatgggaccaaatttggaatcgcagatgcacctccatcgatattcctaacatattctgattggactgaaaccttggagcaaggttccaactatgcattccttgagccacagtcattggtggtatcaaaggagacacgtggcgaatgcgaaggatatcttgaaagatggttgaaggaatctaaccgagaggtgtacgttggaccttacttccatcagaaacctgatatgcatattaaagctgcaattaatagtgtaatgaccaaattaaagacgagtttgtctcctgaaagtaaggcagctgcacctaagtggattgaagttaagagtcacgttcaaaccggatgttatgaatgtggatattacgtgatgcattggatgtggaacatcataaccagtgacatcaagagtgattggtccatgtggtttggtgatgatacaccattggacaaggagaacatgacaacaattcgaaagaaatag

SEQ ID NO: 90273 - DNA, 267 bp, Glycine max
  Peptide Sequence Number=SeqID_181958
atgttatcaaagaggaaaactctagatgagggttcactgttatcaagcaagtcggagatccagcatgaccacagattcacctccactccttatgttcccatggactcgggtatagggcccccccttttcaactcacctccccagtggagtcgccaactgtcgcaacctacccttcggcgggagggcgacgcggggctcacgggtgcatcttccaagggaggaaagcgcgtggagtcgccaccaacatttattcgaggaaaacgttga

SEQ ID NO: 90274 - DNA, 557 bp, Glycine max
  Peptide Sequence Number=SeqID_181959
tatgggtcgatcccggagatgcggatgctcaaacttggagagggccaagcatgggtcagattcggtttctctgcagtgtggcgattgggctcgacggtgctgtttcggtaggtgttgctgtttctttccatggaggggtgttgtttgcggctgataggaggagaatagcggtgctcggtagtgatgggcggccgcaggccaatgcaggggtcattggaaactgtggagaggaagggagagtaaaatttggtggggaagtggatccctacaaccagcttggtgattcttgctttggcacctcaaacgtattcctaaaggtaattgcgcttctcaatgactctccttggcctgttaacgttactgctagcttctgttggctcgggaaagttctgatggagagggaggtaatggtccctgaaggagcttcaagagggaaatgtggaaaaccggatgaattcaagaagaaaccggcaattgcaatttgtatgctactggtccaatccgttctagcacctagaaaggcccgtcaaagtgtttggccaatttggtatgggtag

SEQ ID NO: 90275 - DNA, 401 bp, Glycine max
  Peptide Sequence Number=SeqID_181960
ccttcatcgagaagtactgcacgcctaggcaggtgcagggtgacgcacatcaggccacgagcgcactgccaccacctcagcaggccgatccggctgggccacagggcgtggagcattatctacagcatttggttcgccagcaggcgaccaaccaccgtgggcaggtgcagatacatgagtgtctctaccgattcagcctcaatcagcaggagcagggttccgtcccttttgtatgccttaccccggagcagtttggggccgaggtcacatggcctggagactggcccgatgcccaggtaggggaggagcctacaggatcccctggtgaggcggatgagtcctatatggatgaaaatatgacggacctgctcggtttcttgggagggagcggagccacatga

SEQ ID NO: 90276 - DNA, 384 bp, Glycine max
  Peptide Sequence Number=SeqID_181961
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggggtaggcagttcgctccaagctgggactgtatgcacgaaccccccgttcagtccgaccgctgcgccttatccgggtaactatcgtctttga

SEQ ID NO: 90277 - DNA, 420 bp, Glycine max
  Peptide Sequence Number=SeqID_181962
atggttttattcagcattttgtatttgactggcatgtacattgctaggtatagagttgaagtaatggttacccaaaacaatgagagtagcaagtttttgctctgggaccatgaatgtgctgaattgaatgatcaaacagctgatgaagtgaatagggtcaagattgaagtggatttttcctctttctggcacgatggtgatgttgatttgaatgcttctcctcaagcacttgataggctgttgggttatgtgcttgcttttaaggttaggattcaatcaaaattcaggaatgtcgttgttcttagatactcaaatgaactagatttgatcaatgttgtgctcgagatgctggctgatagtgaggcatgttccaaaatagatgcttcgaatgttgattgcaataatgctacccatccttaa

SEQ ID NO: 90278 - DNA, 288 bp, Glycine max
  Peptide Sequence Number=SeqID_181963
atggaatcttcccggatccattcttggaaatacctaatggatgctgtcgcaacctacccttcggcgggagggcgacgcgtgactcgcgggatgcgtgttccacgaaaggaatacgcgcggagtcgccaccaacgtttatttgaggaaaacgtcggaaaaaccagaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 90279 - DNA, 330 bp, Glycine max
  Peptide Sequence Number=SeqID_181964
atgtcattcgaccaaatgcaatcacagggactcgcactgcctcttgaggttaaggtttatccttttgttgctcgtgtcagcataaaagaaagttgtgtcgatcccacgggtcaggacccagaaacaggagactcagacaaatgtggcttgtatgtcgatgacagtcctccccgactggttactgttggaagagtttatgaggggtccacgactatccacaacattcctttgggcaatgatcaactcaaggttggagctaaggaagtccgagatgctgatgctcgcattctatacccactcaagaggtcagttagtggggcagacacttaa

SEQ ID NO: 90280 - DNA, 366 bp, Glycine max
  Peptide Sequence Number=SeqID_181965
atggctactcagatgaatcaagctcagtcccaaaattctgacaaattgccttcacaaactgtgcagaatccaaaaaatgtgagtgccataaccttgagttctggcaaccaaattcaagtgcctccatcagtagcagcacctgcacctgaacctgtcaagcttcattctacaactgaaaaagaggataagatagttgcacaaaagagaaagcttcctaacaaaaattttcatgcaggtggaccttcttctagaaattctgacttacagcagcctcctatctctcttccattcccacctagagcaattccaaacaaaaagatgaaagaagcggaaaaggagatctttgagaccttcaggaaagtagag

SEQ ID NO: 90281 - DNA, 359 bp, Glycine max
  Peptide Sequence Number=SeqID_181966
cactaagattagcaggggattcaatagcaatagcagctccttctgtgcatcttccttatttagctgcgggaacgagtgctgtgcttgccccgaccgataccaccattcattaccgtgaaccagcccctcctataggcaggtctttcttctttaaagcctggagctggtgtatgagtttattatatcctttccaactgccttcttttcagaaggactctaactggcgaatgaaactccaactcaatctcctggaaagagaagaggacaggctggaagtgggactgggactagatccccaagcccaaggaactagtattcccggaatgaaaagtacgctttctcgttccacttctttctga

SEQ ID NO: 90282 - DNA, 382 bp, Glycine max
  Peptide Sequence Number=SeqID_181967
gctctgcctgttgctttgatgattcatgataactcgtcggatcgcacggcctttgtgccggcgacgcatcattcaaatttctgccctatcaactttcgatggcgcgcaaattacccaatcctgacacgggaggtagtgacaataaataacaataccgggctcattgagtctgttaaaaagctcgtagttggaccttggggttgggtcgatcggtcccgcctcccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagag

SEQ ID NO: 90283 - DNA, 419 bp, Glycine max
  Peptide Sequence Number=SeqID_181968
acgcgccgctgtcgccacgtcagcaggacgcgctggccctgtccgatgaactgattgctgaactgcaggcgcacgataccgtggttatcgccgctccgatgtacaacttcaacattcctactcagctgaaaaactactttgacctgattgcccgtgccggcgtcaccttccgctacaccgaagcaggcccggaaggtctggtgaaaggcaaacgtgcggtgatcctctccagccgtggcggcattcacaaagacaccccgactgatctgctgaccccgtacgtgaaactgttcctcggcttcatcggcatcaccgacgttgacttcgtgttcgccgaaggcattgcctacggtccggaagtggcaaccaaagccgccagcgatgccaaagacgccatcaaacagattgttgctgcgtaa

SEQ ID NO: 90284 - DNA, 448 bp, Glycine max
  Peptide Sequence Number=SeqID_181969
atgggaacaaatcaaaccggcaagaggttctaccaagtcaaggttaaaagcctagataccaccagcatcaaggaattagggcggctgatgaaacctctccaaatgcaagccttccgcaagacttacagaaagatcttagagttgaccatagcagaggtgtccatagaagccattgcatcactcacccaatactacgaccagcctttgaggaaagatcaagagcttaggggcattcgtaatggcatcattggtgggtaccccgaatggctgaaagttcatatacgaggtttagattggctcgccaagttaaaagtcgtcagcgaggagagttttgaagcaccagaagaggacgaagaagtccaagctctcaaaagcgagttaggaaaggcgaaacttgccaaggagaagttcaagttggctgctacacacattcgaaggagtgtgccgg

SEQ ID NO: 90285 - DNA, 639 bp, Glycine max
  Peptide Sequence Number=SeqID_181970
atgttgacagatccatacaaagatgaatatcttttatggacaatgttagaatggttttcccctttggcatggtggcgcatgaagttgaagcaaattctagatattgaaagacaaagaggaatttcagaagatcacctagagaatttagtttctattgtaatcattcatcgtccttatttcatggaacgaggacaactctggtctagaaatgaagctcaagtctggggaacttttgaagcatatcccttggaagaaagttatcgtcatcagctagcaaggcatctctgtgagatcaataattacttatacaaaactgtagatccaaatctgccaacttcatctcaaaggccaaaagaaagttatcctattgataggataataccccagaatactgatgatggacaaattagaacagagttttatgttccagaaccagtgtttcaaaagatagaagatttagctaatgattattcttcattaaacagagattgggaagactataatgctcaattaatggaagacttactgcacaagaagaaataccgttatcatcacccggtatatggaagtcttaatagattagaggtgcaaaattacaacttgtcattatccaccagatccgactacaggtcaaactaa

SEQ ID NO: 90286 - DNA, 99 bp, Glycine max
  Peptide Sequence Number=SeqID_181971
atgactgaagcacgtcaaaagggggtacgaaaattgaagaccgcagaaaacgaagaaggaatgatggatgtcgaagaacggttgaaaaccttcgcgtaa

SEQ ID NO: 90287 - DNA, 196 bp, Glycine max
  Peptide Sequence Number=SeqID_181972
atgggggtgcaaatagcacccaggcccacttgggccctccagaagattcctccccccaggcggggaggaaatgaagaaggaagggccgaggcgcttccgaaacgtttccgtaacgtttccgtgaggaatctcgcaaaggtttcaaccgtcttcgacgttcttcattcgttcttcatcgttcttcgatcttcaacgg

SEQ ID NO: 90288 - DNA, 165 bp, Glycine max
  Peptide Sequence Number=SeqID_181973
gtcgactctagaggatcccacctcgtcctcgccataagacagcttggctaccccatgagaggagtgccatcagacgaaagcatcacgcctttcatcgcacggggtttcagtgaccacaacgcgagggtactccaaggagttcgcaaggcatgggatgcggcgtga

SEQ ID NO: 90289 - DNA, 231 bp, Glycine max
  Peptide Sequence Number=SeqID_181974
atgacagcggaatggagaaggaagagagagaggagacaccacttcaaggagaagatgagtctagaagaagctcaccaccataggaggccatggataagagcttggaggaagaaggagatgaatgaagggagaggaagagaagagcacgaaattttgtgctctaaaagagctctgaaatctgaacccactaatccaagatcaattccaagattctccactaagtgtgcttag

SEQ ID NO: 90290 - DNA, 330 bp, Glycine max
  Peptide Sequence Number=SeqID_181975
atgaggtcctttaatggtgattttccaccatggagatgcagcggaagacaaacgagaagaggtgagaggaggcgccatccactagggaataagccatggaagaaggagcttcaccaccaagatgagccttggataagaagcttggaaggatgcttggaaggatgcttcaatggaggaaaagaaagagggagagaaagagagaggggggagcacgaaattgaagaaataaaagagggagagaagtggaacttcgaagtagcttccttgagaagctttcttgagaaaacttccttgagaagcttctttgagaaaacttccttgagaagctag

SEQ ID NO: 90291 - DNA, 438 bp, Glycine max
  Peptide Sequence Number=SeqID_181976
atgtgggatgctaccatgttcggggtgtttaatgaacacttcctattgtacataaagtatgaagatctctctgaaattgtacgcggtggtcaatgtctcagcatatctgttatagagttgtggattctgcatctgactgagacaagtatgcgaacggggaattccaatgtgtatggattcctcgagccacagtccattcagagatctaggcaatcacaatttgaatctgaaagttacatgaagagttggatgcaaagttcaaaacgcgatgtctaccttggagcctaccgaatggcacaaactggcaaatggtcgtcattttgcctacggaaatatcttgttgtctggttttgttccttgcataacaggcaagacaactaccttaaaggaataattaacaagtcagtgttgtttttcaatacatttgcattagcataa

SEQ ID NO: 90292 - DNA, 747 bp, Glycine max
  Peptide Sequence Number=SeqID_181977
ggcttcccggtatcaacagggacaccaggatttatttatttctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatagaagaggagtggagggatgtattacaggctgaggtgaggatagaattcgctaagcgcaaccttcagtggctaagcacgaggaagaatccagaagaagatgatctgttaagttcgctaagcgcactgctccaggtcatcaagcgcaccacatcaactcatttgctaagcaaaacaagtgaaggagacatcctcaccacttgtgtttttgcagtctttcatcttgttcttctctttgttgtaaaggaggtttccgaactatggaaagctaaatcctctgttggatcttcccttgggaacttgtctgattctaaagtccttgatagtatgggactaagttgttgtgctatcacaaggaatcggg

SEQ ID NO: 90293 - DNA, 723 bp, Glycine max
  Peptide Sequence Number=SeqID_181978
atgaacacgtctcgtcttcagaggctacatgccctcgcctttagaggactacacgtcctcaccttcagaggacaacatgtcctcgccatcagaggactacatgtcagcgccttcagaggactacacgtcctcaccttcagaggactacacgtcctcgccttcagaggacttcacgtcctcacctttagagggctacacgccctcacctttagaggactacacgtcctcatcttcagagggctgcatgccctcaccttcagaggactacacgtcctcgcctccagaggactacatgtcctcaccttcagaggactacacgtcctcgccttcagagggccacacgccctcgccttcagaggactacctgtcctcgccttcagaggactacacatcctcgccattagagggttgcacgccctcaccttcagagggttgcacgtcctcgcctttagagggctacgcatcctcactttcagagggctccacatctgcgccttaagagaatttaagggatcacgcccacaagacacccagtggacccggagaagtccaacagggccctggggtttccagctttggttacgggcctctgtcagtcctacagggtgcccatcccccccagcaaggtcatgccatcgtgagatagggatcgcgcccacaagacacccagtggacccgaagaagtccaacggggtcctggggtttccaggtgggatcctctag

SEQ ID NO: 90294 - DNA, 90 bp, Glycine max
  Peptide Sequence Number=SeqID_181979
atgggtgacgagcagacaggtccacctggtcagtgggtcaccggaaaagtgacgacagtcgatgatgaccagacaactttctatgaataa

SEQ ID NO: 90295 - DNA, 1509 bp, Glycine max
  Peptide Sequence Number=SeqID_181980
atgggaacgttccagaccttaagaaaggcctacggtgctctcaaagactccaccacggttggcctagccaaggtcaatagcgaatacaaggaattggatattgcaattgttaaggctacgagtcacgtagaatatcctcctaaggaacgtcatggtgatcctactttcaaagatgacctcataaactatgcgcgcaggggacgttttcttcaaatatctaatttcaaagatgactcaagtgctctagcttgggactgctctgcatggattcgaacctacgcactatttttagaagaaaagcttgaatattttagaatcctaagatgtgacatcgaagctgagcgattaacaaaaccatcaccgactaaaactcagggacatagcagaacacggatgttgactagtgaagagctattggagcagctacctgcactgcagcaacttctatatcgcctcattggttgtgagcctgaagggttggctttcagcaattatctaatacagtatgcactggccttgttctttgatatgccaaaatatgatgcagtgaaggcgttacatatttataaaagagctggccaacaggctgaaaatcttgctgacttctatgaatactgcaagagattggaccttgctcggaattttcaatttccaaccttgagacagccacctgcttcttttcttgccacgatggaagaatacattagagaagcacccctgactgctactaagagactagagtatcacgaaaatgatcaatcacctcaaagagaagaagcaaaacacagagaagctgaagcaagtgagcaaccagatgaagaagttaacgaggaagaaccggtagataaggacgaaacacagcctaaggaagaggaagctgaacttcctcctttgatatcaactgatgatactgacgatttgctgggtctaaacgagataaatccaaaagctcaagaactagaagaaaacaatgctttggcgcttgcaattgtaccacccggtggacataactcgagcaatcttgctttgactaacataagcggaacttctggttgggaacttgcactggttacaacaccaagtagccatacaagccaagcaccagatcgcaaaatggcaggtgggtttgacaagctattactagacagtttgtatgaagatgaaaatgccaggagacaacttcaactccgaaatgcaggctatggatatgagggaatggttacacataatccattcgatcattataatcagcaggatccatttgcaatgtccaacatagcacctccagccaatgtgcaaatggcattcatggctcagcaacaacaacaaatgatgttccaacaacagcaacaatataacacgatgatggtcccttaccagtatccacagactcaatacaatcaacaaatgccagttattggttcttctaatccatttaatgatgccttacccatgcctagctatcctcatagttccatgcatcatcaaggaaactaccacttaatgtag

SEQ ID NO: 90296 - DNA, 117 bp, Glycine max
  Peptide Sequence Number=SeqID_181981
atgcagagacaaagaggaaaagggaagtctggatgtgggggaggatatcagttgggcaatgcatcaaatacttggtgggcagctatgatgaaggaggatcaatacggcccaaattga

SEQ ID NO: 90297 - DNA, 369 bp, Glycine max
  Peptide Sequence Number=SeqID_181982
atgcccactttgaatctcttcacaaacgttcctgtcgacaccgtcgttgcttctgacattctcagagatgccaccaaagctgttgcaaaaatcatcggaaaacccgaatcctatgtgatgattttgttgaatgggggagtgcctattgcatttgctggaactgaagagccagctgcttatggagaactgatctcgattgggggccttggtccgagtgtcaatggaaaactgagttctacaattgcagaaattcttgaaactaagctatacattgacagttcccgtttctatatcaagttttatgatgttcagggaattggttgctacttgctaataacagaagttattttagtagatgttgatttctga

SEQ ID NO: 90298 - DNA, 216 bp, Glycine max
  Peptide Sequence Number=SeqID_181983
atggaaacaaaaaagaaatacggatcaagggatctcccaatcatgtggctccgctccctcctaagaaatcaaagtagggcacagaaaagaagtaaaaccctggctctacaggctgaggctcaacttgtaaagacaatcatgggtctgtacatgtgcccggtggttggccgcctgctggcgaaccaaatgccgcaaatactgctccgtatcaaatga

SEQ ID NO: 90299 - DNA, 246 bp, Glycine max
  Peptide Sequence Number=SeqID_181984
atgccccattacttcagaatgcaccctaggcttaaggccatcgcttacacccctcaattcaacaaaaacaagcaacaattcaaggataaatccctcacgtttttgagcaaatacatgcaacttagatcaccaaaatacatcaatggaaagctagagagcccaagaatgaggtacttacttgttggagatgataatagcgcaaacggaatcaaaaatgcaaaaaatggtgacctagggctgcaactc

SEQ ID NO: 90300 - DNA, 491 bp, Glycine max
  Peptide Sequence Number=SeqID_181985
tcacgttcagaggaccgaggaaggtcaaagggaagagatctgaggccccttccatagcaccatcagaggtaccaacacccttttcttctacacttcctccttcttcctccacagatatcccagtgattcctcctgcacgcacacagagaccacttccaacccctctttctacaggtccagcagattttgttttcactcctcagatgcttcactccatgctccagagcatccatagagggaagtccatcatcgtggcctggctaggagaccagccttcttcctctagagggggtggggcctccacagcccaggagcctgcgattgaggagcccacagcaccaacatcatcaccagtagtagcagaggaggagaccactccagctcagacccctcagctatctccaccatctgcacctgctcctgaggagactcaaccatcatcagcactggaacttaatgaagaccagccacaggaggagcaggacgtttga

SEQ ID NO: 90301 - DNA, 576 bp, Glycine max
  Peptide Sequence Number=SeqID_181986
atgggatcaagtcaaaagccttcgcttaaaaagaggttctatcaagtcaaaatcaagagcttagaggtcactagtttacgagagttggggcaattaatgggtcaacttcaacagcaagccttccgcaaagcctatgctagtgccgacttgaaagagtttgaagaaatcctgggatgcccactgggaggaaggaagccatatcttttctttgggttctatccctccacgacaagagttgccaaggtggtgaaaatctcagcacaagagttggaccgtgtaaagcaaaacaggaatggggtagtcggagtaccaaggaagtgtttggaggaaagggcaaaggccttggaaaatcaaggcgaaggatgtccaaatgttctcttgatgggaacaaggggttgtattaattataatcccatcctcgccataagacaacttggctaccccatgagagaagtgccatcagacaaaagcatcacgccttttatcgcatggggtttcagtgaccacaaacgcgagggtactccaaggagttcgcaaggcatgggatgcgacgtgaagaaaggacagagagcttag

SEQ ID NO: 90302 - DNA, 289 bp, Glycine max
  Peptide Sequence Number=SeqID_181987
ttggacagcaatcacacagtttatccaccatggaatgctttatgttcctattggttatagttttggtatgctttatgttcctattggttatagctttggtgctggaatgttcaatttggagtccacaaaaggaggaactctatatggtgctggagtttttgctggagatggtacaagacaagcaagtgaaatggagctagagcttgcagagtatcatggcaatctatcccaaccaatgttgttaatggcggatggcggttcatggcggaaagccaaaaatccaccataa

SEQ ID NO: 90303 - DNA, 302 bp, Glycine max
  Peptide Sequence Number=SeqID_181988
atgtacatgatcagtttgaggttgtcggctttcaatgagtatgggagcggagttattgacatcctcactgggagtgtatgtcacattgggtggtgtatagttgggaggcaagccatatggtccacctcagcaatggtgatggtagtggctattgcagccgcattgacctccattatctcctttatgctcatcattgcctccatcattgtggccatttgctctttcaaggcctccgtgttggccttcatctgctcttacacctcctctacttcacccaatactctagctctagcacgggttcg

SEQ ID NO: 90304 - DNA, 358 bp, Glycine max
  Peptide Sequence Number=SeqID_181989
aagttgtcatcatcaaaaagggggagattgtagaagcaaagcttcatgatgaatcaagattgattcaaagatgttttgatgataacaaaggtgatgaaaaaaagctcaaagatgttcaagatgcttcaaggttcaagaggaaatttgatttcaagaatcaagaatcaagattcaaggttcaagcttccaagaatcaagatcaagattcaagactcaagattcaagaatcaagagaagacttaaaaaagataaggtacatctacttgggtttgactgagaacaagagagggtacatctcttgtggatcagttctagtggagggtacatccactaggtttttcaaagagaacaagggagg

SEQ ID NO: 90305 - DNA, 48 bp, Glycine max
  Peptide Sequence Number=SeqID_181990
gaatacgtaggagcaaagggaaacgtccttgtcgaccacaaaagataa

SEQ ID NO: 90306 - DNA, 288 bp, Glycine max
  Peptide Sequence Number=SeqID_181991
atgtcgcagaacttcaaggataacgatgggtgtcaagtacctcgaagtggtcaagcgagggttgcatcccaacaaacagatgatccccggacgaaattagggtgcataatgaccataatttgtcgttgcgtgccatcagacacgatcgtatctggatggcaaaaggtgcggaatgaccataatttgtctccacgtgccatcggacacgatcgtatctggatggcaaaaggtgtgcggaatgaccataatttgtctctccatgtcatcgggctcgccgcctctggatga

SEQ ID NO: 90307 - DNA, 286 bp, Glycine max
  Peptide Sequence Number=SeqID_181992
atgactaggggcaatccaggtgatttacaacccgttgatcctgaaatagatagaacctttcatagattagttaggcatagtgtgcatcctggtcattctgtgcattttgagcattttgagcatcccgatcattttgagcattctgttgttggtgattctgaatattctgattttgagcattcgactgttaattttcacactaagaacatggctcaacctccacctcgtgagatggctgcacatgatttcacttatgaaagcttgtgcattcaatatcttgatgagg

SEQ ID NO: 90308 - DNA, 207 bp, Glycine max
  Peptide Sequence Number=SeqID_181993
atgacagctcacccaggtgagctaaggcttagtcctgaagtcatgagctcgcctaagcgagctagtttcttaaccttgaagtcatttggtggcccaagtgagctagaggctagcctggaacattctacatcagttctaaaaccgatgttgaaagtgccgatgttgaatgtatcaatgttaacatcggttttggagaaccaatgttaa

SEQ ID NO: 90309 - DNA, 543 bp, Glycine max
  Peptide Sequence Number=SeqID_181994
atgattatgaggggccaagacatttatagtaaccaagatgaggctactactccaccttcctttagtaaaagtgaagaagcaaaaggggaagaatctagtgaagaaatctacccccaagaagaaggacaacctttaatggttaaggaggagtgtaagaagacaacctccaaatccccaaagaaggaaaggcaccaaatccctatgataggtggtatgatgaatgtgttgagtggtgcaaccctcttttgtaaaatcacccatgcatccaacatcttcatgattcacatagatacggactcattaggggttcccacgaaccctaagagaataaaggtcattcctgaatggtccactccaccaagtgttgagggaagaagcccaaagtttcaagtacctctagatttgaggtcaaatccttttcaagggggagggaatcatgatgtagctccatgtgaagcctataggccttggatcttcttcatcaatggagtcctttgcttcttaaatatgaatggaagcggaatggagatggaagaaagatga

SEQ ID NO: 90310 - DNA, 261 bp, Glycine max
  Peptide Sequence Number=SeqID_181995
atggcttattccctagtggatggcgcggggcgctcccctcttctcctttgtcttccgctgcatctccatggtggaaaaccaccattaaaggacctcattgaagctcaaagatccagccttcatagaagctccacaagcaagcttccatcaagtggtaatcagagcacaagagcttcaaagtttgcaccgattaaacttgctatagaagttagatttgattttctatggttcaaatttcttgttcttgttcttgaaccatga

SEQ ID NO: 90311 - DNA, 837 bp, Glycine max
  Peptide Sequence Number=SeqID_181996
gacttccagctagtgccgactgtggaagagtttgaagaaatcctgggatgcccactgggaggaaggaagccatatcttttctctgggttttatccctccacaacaagagttgccaagtcggagtaccaaggaagtgtttggaggaaagggcaaaggccttggcaaatcaaggcgaatgggcttcttttattaaacatcttggcgcttttgatctttggagttgtcctctttccaaatatggaagggttagtggacctagcagcgattgacgctttcctcgcctttcatcatggcaaggaaagcccggtcgtcgccattttggccatgtatgacacgtttgaccggagatgtgaaaagagcggcgcaagaattgtttgttgtacaccggctctctatgtgtggctggtttcgcacctttttctccaagaaggtaggcccgtctatccgctacaagaaggaaggaagaatcaggatctatcttcatgcgaaggatttccaaatgttcccttaatgggaacaaggggttgtataaattataatcccgtcctcgccataagacagcttggctaccccatgagaggagtgccatcagacgaaagcatcacgcctttcatcgcacggggtttcagtgaccacaacgcgagagtactccaaggagttcgcaaggcatgggatgcggcagtccgaacacaaggattggattggctcccaaatctaaagactgtgagagacgatgaggttaaagcttcggaagaaagtgatgaggtacaagccctaaaggcagagcttgaaagagcccgggtagttgaagagaagttcaaatccatagccatcaaa

SEQ ID NO: 90312 - DNA, 324 bp, Glycine max
  Peptide Sequence Number=SeqID_181997
atggagcccgcgaattcattgcctagcgctgttcgccaattctccattctcaattttattcggagacccatgaattcattgcctagcgctgttcatgtgtcctccaccaacgagtctagagccccgcgaattcattgcctagcgctgttcgcccgttctcctattctcaatcttattcggagacccatgaattcattgcctagcgctgttcctgtgtcctccaccatcgagtctggagccccgcgaattcattgcctagcgttgttcgcaaatatccattctccaagtcttattcggagacccatgaattcattgcctagcgct

SEQ ID NO: 90313 - DNA, 612 bp, Glycine max
  Peptide Sequence Number=SeqID_181998
atgaaactattcaagtcacggatgcatcgacatgcgcgctcgcaagcgggcttcaccctcgtggagatctccgtggccgtgctgcttctcaccctgctcaccgtatatgcatcagtggacatgcggcgcaaggcggacgagagtgccgccgaggccaccgcccgctatctgatgcgaattcggggcgctgtcgtcgacctgcagctcaagcacgaggcgtggctacgcggcgaagacctcacgggtctgccctctggctcctatcctacgcctccggctctagcgtgggccaacgtggcaggcgtgcaagttgcacgcggagggctggccgacctgacagcactaggcctgctgcccgcgaccatcccgcgatacccaaccttgggggacgttgccaggttcatcttggtccgtcagggcgcctgcccaggcgatgaatgccgcaccagcgcctacgtctacgtctgccaccccatcagcgcggcgcgcagcctgaggcagaacgccgaatgcgccccgcctggcgccgacagaagccgttacgaccaagccctcctgagcaaggttgttcttgcctctgaaggctatggtggccacgaggggatcctctag

SEQ ID NO: 90314 - DNA, 354 bp, Glycine max
  Peptide Sequence Number=SeqID_181999
atggataatgaagagggcgtgcaggaacagatgaaggccgatctatcggccttaaaagatcaaatggcttccatctcggaggtcatgttaaaactccagaaaaccatagaggacaaagccacggcaaccgcctccagtacggttagggaagcggagccggtgctgcaacccgctttaaatccgggccgagacaaaaacacggtcgtgtttggtcgaaggtatagtccgcaagcttatccttatggcttgcctccagacttcactccctgtgccactccggaagatttaagccaagcccctacttttgaggggcaactcccgccttatgacgactgggggcgggcaagacgatga

SEQ ID NO: 90315 - DNA, 298 bp, Glycine max
  Peptide Sequence Number=SeqID_182000
atggcaaaaggtgcagaagacgatgttagtctctacgcgtcaatgggctcgtttgccccctcgttgatgaaaggtgcgggtgcaggaggcgatgttagtctctacgcgtcaacaggctcgtttgccccctggttgacgaaaggtgcgggtgcaggagatgatgttagtctctacgcgtcaacgggctcgtttgccccctggttgacgaaagggaactccgtaggactggcagaggcccgtgatcagcgtcggaaaccccagggccctataggacttatctgggtccagagggtgccta

SEQ ID NO: 90316 - DNA, 1077 bp, Glycine max
  Peptide Sequence Number=SeqID_182001
atggtagaatcattgaagaagcaaaaagggtcttcctctaccaccactgttgctggcaaccaccgccaaggaacctctagagacccatctgcaccagttcctctttctctttcatcttctagatcatccacattgttttcctcagatgatcaacatcaaagatactattctcaattctgtaatagagtcattctagaccctaagtaccttgaccttgaattcattgatgaagaaacatttgattgttaccaatttcctgaattagttaaggtgttctataataacttgaaaattcaggatggtattctttactctaaggtgcataatattcccattgtcattgatcagtccttgttcttttccttgactaaactgcccagtcaaggtgttccttttgagggcacccttgttgatgactggaaatttgattattctagtcatgatgctcgttgcatggtctacaatgaccaggctgacatgaacagcagattacttgctgggtcattaacttttgattgtcgcatcatgcattatatcattgttcgtattttgcttccccggtcttcaaaccttgctcaagcctctgaggagtatttgattctgatgtgggcctttcaaactggttgtcagattgactgggcccatttagttcggtaccggatgcataaggcattacgggccaatgcacctctaccttatccccaccttgttactctttttcttcatcatttcaatattcctttggacgatgaaccatatgtgaaggttaagagatatttttctattggggctggtgtggttagctcttttggttaccgaaatgatgttgatggtcagtggattcacaaacaagacttgcctctgcctattccttacgagcttaccccatctcctccaccacaaaggggtgattccacttctcttctgaatgaagtcctcacagaactacgcagacttcaagcttttgtaggtgagcaatttgaagcaatggatactcgtcttgatgcgatggatactcgttttgatgggatggatactcggatcacccgacttgaagatgatatgagcttcatttga

SEQ ID NO: 90317 - DNA, 300 bp, Glycine max
  Peptide Sequence Number=SeqID_182002
atgtggcgtcatatgaaggaaagaagcttgacaaacaaaggaaatcgaagcaagcaagaaataaaatcaattattggcacaaaatcaattgtgcaaaaggcatttgaaatgaaagaagattcaatatctggtgagtggtcagatgttgtggaagtttggaaggccacacacatgagttctaatggaacttggtgcattccaaaaggagaagaaatcatggaagctttgcagaatgtgggtgatatatatcaaaaggaaatttcaaaagctcctgtaccacttgttgaacattttgccatg

SEQ ID NO: 90318 - DNA, 321 bp, Glycine max
  Peptide Sequence Number=SeqID_182003
atggctactccacctgcctcgcctcctccttctcatcctcctcctcctcctcctcctcctcctgcagtagcatcaacgtgtccatccaccttgaagcagacacgcaaagtgacacggctacgatccttggccactagaccacctggggcagagaaaccagtggtccacgtcgatcctgcgaccagcaaggccaacggtccccagaagaagaaattaagaacatatttgggaattgtcgttcgtgataagatcgatgtgacatacgagacctggaaggaagtctctgcttctcagaaggatttgatatgggaggatattcag

SEQ ID NO: 90319 - DNA, 450 bp, Glycine max
  Peptide Sequence Number=SeqID_182004
atggctatgttcctactcaacctatggattataccagccagtatcctaatcagaatcagtcttagacctctgctaaccccaatcaaaatagtctctaaagacgtgcttcttaaagggatggtaggctatgaacctgtgccaagtgcttcttctccaaattctatttcaactagtgtaaaaagaattagtcctagtgtgtctcatgcgaatactctttctaatagtgatctttcttttgccacttggcattccagattaggccacttccacttaacaaatatacagatcaagaaccatgatccaggtggtggagaaagaagcaatagtgacgaaacaaaagaaacagagaacaacaaccattttgataatggcagggacaaaaagtttaatcaatttagggaaaagagatgtgactctgcagagaaatactacagagaagttgtccaatag

SEQ ID NO: 90320 - DNA, 263 bp, Glycine max
  Peptide Sequence Number=SeqID_182005
cctgggcgttattgagagatactgggagtggccaaaatatgcaaaatgtgctgaatttgattcgtccaaatttgaagacggacgagtctggaatatggaataatcctatggaggggtgtatgaaaaataacagtggtggagcttatctaccagtagtaggagtagcttcatgtggtgttgtcataaaaggtaataatggtagctttgtttgggcttactctagaaggttagggcactgcttgattttagaagtagagctatga

SEQ ID NO: 90321 - DNA, 435 bp, Glycine max
  Peptide Sequence Number=SeqID_182006
atgcttacgaacccaaacacttcctaccaagaacaagctcaagaggttgctcttgtgtgtataaagaacaagctcaagaggttgctcaagaggttggcattaacagatccacttaaactgttacaagaacacaataagggattacaccaaacatacctacgtgaggtggcgaaggagaagaagcacagacttctgacgatgctcgacttcaaggtagatggagaacaaagagagcaagaaagcttagatggagaagaagacagagagaaggagaagacattgcgaaggagacgaaacatacctaggtatggtggcgaaggagaagaggcagagacttgtgatgatgctcgagtgcggcgaacacgatgctcagatgcagacagggaccttgaaggtagacggagattagaagaagaagagagcgcgaaagcttag

SEQ ID NO: 90322 - DNA, 594 bp, Glycine max
  Peptide Sequence Number=SeqID_182007
atggctgctagattcctatgtgacgtggaaggctgtcatatacaaaggaacataatggatgagtgcatttggaaacctcatccgagtggtttatattccactaaaagtgcatatgctgtgatgtggggggaggctgcagtagataatcaagtgcagcattttgaagaattatggaagttaaaaatcccacccaaagttgttgtttttgcatggagactctttagagatagagcgttggctgaaggtaaaagaggcactaatgagtcattgtggtggcaggatctaatggtggtcacacatgaacaacagctgaataatgtgatgcaatctggattatcatggaatgtggggtcgggtgataaaatcaaattttgggaagattgctggaatggtgaaagagttgcattaatgcagaaatttccaaggctgtatcagatatctagacaacaacacaacctcatccagcaaggagctctcacagctggggaagccatgattgcagaggtacatgggaagccaggatcgcaaaggtataacaaatggaagacttggtggatagccttaacttggtctatatggaagcatcagaatgag

SEQ ID NO: 90323 - DNA, 231 bp, Glycine max
  Peptide Sequence Number=SeqID_182008
atgtacatgatcagcttggggttgttggctctcaatgggtatgggtgcagagttgtcgacatcctcatgggagtgtgtgcaacattgggcggtgtatggttgggagccaagccatatggagatgacaaaaagctcaaagatcaatcaaagaacaactcaagtgaatcaagaacaattcaagagttcaagataagaatcaagaagaattcaagactcaagaagaaagtctag

SEQ ID NO: 90324 - DNA, 288 bp, Glycine max
  Peptide Sequence Number=SeqID_182009
atgggtgactatcttactagttggatttctttacataatttcttgctcttgaccagggaagaggacaaggcaaggttggtgcaggaaacaggcttgcaattaaagcagataaataactggttcataaatcaaagaaaaaggaattggcatactaatccttcgtcttctagtggctccaaaagcaaacgcaagaggtgggtttctagtttcttagtatatttttggattaaagttagaagagatcaaagtagtggtgcaggggaatcaagtaaccagagcttcatgtga

SEQ ID NO: 90325 - DNA, 318 bp, Glycine max
  Peptide Sequence Number=SeqID_182010
atggcagctccagtagtgcccccaatgatggagagggagttgataacgatgatagtagacacgttactggtgtcctactatgagaagatggtgggttacgtgccttcaagctttgccgatttagtgttcgcttgtgaaaggatcaaagtggtaaaaagcctggggcaaatggagaaaaggagaaggaggaaggaacccatgtcgtggttgccattcctacatggccaaatttcccaactgctcaacaatgtcattgctcagccgatatcatcccttctcattacccagcacccaatcatccacaaaggccatcactaa

SEQ ID NO: 90326 - DNA, 321 bp, Glycine max
  Peptide Sequence Number=SeqID_182011
atggaagcaaaagcgcaaaaatggtggcctaggggcaaaaaatctgcaaatcccgtgcaggggtgctcgcccaggcgagctcagctcgcccaggcgagctcagctcgcccaagcgagctaaccctgtattttttttttgggaagacacagagatgggcatgggacgaagatctatcgatcgtgatcctagcctctactcacgtccgtccccaagtacctgaaaacaggaaacgacattgcgcaacaaactgtggtcgcgttaccgtttaccttgattggtctctgcctttgggtttggcccggtatttgaccatcgcctaa

SEQ ID NO: 90327 - DNA, 1335 bp, Glycine max
  Peptide Sequence Number=SeqID_182012
atggctccaagctcgttgggagtcttcctgccgattaaggcaaaagagcttgtcgtgactgaaggtggtcatgaagtccatgtagcctttagtcttgactctctcgcttgcaaagccgaggagtggaccgacgtgatggtggacagtgttaggggagacctcaagtctctggaaggtttttcagtacaggatgtcaacggaacttccctgttcgatgaggaccctggacaccatgaagttcgctataatgatggagacaaccacgaggtcgtcttggttgacagggatgtttcccttgaagtccttgttcgtaaaggtgatagaagggagacttcgctgaaggagtgcggtgagaaaattaatgtcaatgtcccggatggcgtgcgggttcctgttctggtggaggttgtcactcacaggcctatggctggtgtctttgtctacctcagtcttctgctcttcttctgtctgcttcctggttcttgtgttgctcctctagatgtcctccagggcccagcagtcttcggtgttgtgaccaataccacggtgatatcgacagtggtgtgtaatactcgtactaatggtgtattgcacactaaatcattcgacgagggtgttgaagctgtttatggacttgggttttcctgtgtcaagatggcgtccaaatgctcatctggagctgttgtcccattgtactgctcaaggttgagtggtttccaccccaaggacgatgcacgtaggagggacttaggtcatctacagtgttgcctattcgtcgggggtgtgattccccttgggtgcgttcaggcaagtgatccctgcaaagattctttagcttatgttatgcctaacccttcgcggttggaagatgacctgagggttgatgccaaagctatattgaacactcctaccccgtatgctaccctgtttgatgacaacaaagtaatttggagactaagcaaggatggttgtctacctactagacatgctctcagtgcaacacaatgtgtggtacattcttctcagctcactaccagaggaaataacattggacatcgtcatgattttgtggagcttgtggtgagggcgagatctagtcaaagggttgaaccaatggtgaaccaccaattgcaaagatggatgctgccaccgccagggagtctaaagtgtaatcttgacgaaacgtttttcagccaagagatggcgttaagtaatgtcatccaagatttttcgaactggaagccatatttccccatggtcaaggaaggtgaagctatgaccttgaaaagtgcacttctatggcttcagactgagcgtggagaaggtcatcattga

SEQ ID NO: 90328 - DNA, 843 bp, Glycine max
  Peptide Sequence Number=SeqID_182013
atggattacacatccgtcccctctttggcttctgaaatgttacggaactttacggattgcgcattaacgcttcctttcaactcccgacatgtcgtggaaattcacggattgcctaacgatgggtatcaagtacctcgaagtggtcaagcgaaggaccgtggttgcctggtaaagagtaaagtgacgcgaagtcatctcaggtttgagttcaacctgattaaaggtcttgtcctccatctagtggggcttccttcttttgtgtggagcttctcctttgatatttatgaggagttgtgtttgaatttcccttggttgaagttcttgcctaaccaatgtggggatagttcgcttgacctgcaaagttcctcctctaatgattatgaggaggtagaccttgcgtatcttgagttcccatggggatggaacttagtaatggaaagggcttcaccaagggtgaccttgggtttgtcgagccttggaccagggacatgtttgtccaagtataagtgttatgcccttgcatacatggccctcgccgtgggtggcatatactggaggcgtggtggtgtgaaccaatgggacttaccaagggcagaccttgggttttgcaacccctttagaggattgacaaggaaattgttcgacctaggttttgaacatcgtgctcttgaacacatgtcactcgtcgtgggtggcacgcaccggagacgtggtgacatgctcttacatatatgtcactcaccgtgggtgacacatattggagtcatgatgggaggttgcttcatgtgggagctacctagctcgcctgggcgagctgggcagcagccacctccctcattttag

SEQ ID NO: 90329 - DNA, 129 bp, Glycine max
  Peptide Sequence Number=SeqID_182014
atgggcttaaaggagcactcaaaccgggtgacccctaaggcctacactccgaagggtccgtcagggcctctccctcctgattcaggtctaacccctaaaatcattttagcacacagactctatctatga

SEQ ID NO: 90330 - DNA, 715 bp, Glycine max
  Peptide Sequence Number=SeqID_182015
gcgccctcctctcccgcctcgacctcgccggaaactcccacaatcaccacaacagcaacaacggccaccacgaccttccttctccgaacaacctccgccaccgccgccgccccttcctccacctcacccgcgtcggaaccctagacgacgatttcttctccggcgacgacgacgacgcccgctccctcttcggctccatccccaaaccctcctccaacgccaccctcctcgccctctctcccttcaaaaccacctccgccttctccgatctcctcgccgacgacggaattagggtttcccaagtcatccgctctggcaccaccttcaacactcaaggattatcctccttatcgtcgcaccacgacgacgacgacgacgacgacgacagcgaggagaaggaagaaccgaagaaagagaaggttgatttgcaattcttcgtgaaggggatcgaggtgggccgccgcgacgctgcggctctcttctttctggtgagtttcctctccgccgcgtacggatgggtgatcctcgttttcctcgtgacgtattcgtgggtgttgggcgtcgttttcgtttccgtcgtgaacgatctgttgggtaggtttagttccgtcaccgttttggtttgggaaggttcgagattaggtctgaagaggctttcggggtttattctgatgcgttgggctgtgagggacgcgttgactcagcttctagggtt

SEQ ID NO: 90331 - DNA, 222 bp, Glycine max
  Peptide Sequence Number=SeqID_182016
atggaaaagtgtcttgtgaagttgcaaaccaaatttcgagaagatccaacggctaatgaaggctgggcagtgtttttaccgaggcagcttcatacccaatttcgagaagatccaatggttaatgaaggctggacagcgtttttaccgaggcagcttcatgtagctatctctagaagcttcattaagaggcttcctccagaagctcccttgtggcttctttga

SEQ ID NO: 90332 - DNA, 99 bp, Glycine max
  Peptide Sequence Number=SeqID_182017
atggagacacaaaagaattcaggcgaaaaaaccagaaaacttcagaaagcttttggtacaaagaagaagaagaagttcaaagagattgaaggcttgtaa

SEQ ID NO: 90333 - DNA, 498 bp, Glycine max
  Peptide Sequence Number=SeqID_182018
atgaattttgcagcgagaaagcctgtagaattcaccccaattccagtgtcttatgctgacttgctcccatgtctacttgataattcaatggtagccataaccccaaccaagggtcatcaacctccatttttccgagaatacgactcgaacgcaacgtgtgcttgtcacggagaagccccggggcgttccattgagcattatagggctctgaagcctaaggattttcaactttcaccggaagtgggtgcaagccatggtcagtttgctcaagcgacctatgctcctgagtttgggacttccaagaccgttggtgggggtgccgtaaaacaacaaggacaacccttcccttgtgttcaagaatcccctacaacaagagacccacggtctcttaatcccttttcagaaataagaagaagagaagaagaaatctctcttaaaagagatagattgtacaatgaagatcaatcaaaattccttattgaatatgcaagtggttga

SEQ ID NO: 90334 - DNA, 324 bp, Glycine max
  Peptide Sequence Number=SeqID_182019
atgcacacacaaattttctcaattccaccattccctaaaataggcctaactcacaaaaacagtccccagtggtgtcgccaattgtcgcaacctacccttttgcgggcgggcaaggcgaggctcacgggtgcgctttccaaaggaggaaaatgcgcggagtcaccaccaacgtttatttgtggaaaacgtcggaaaaaccgaaggaaaccggtcataaagaatattccaagttcgggagttgtatttacgtttgaggaaggtcgacaaaagcggggttcttgctcctacgtaccctccatcgaagaggaaatcagacctacgtag

SEQ ID NO: 90335 - DNA, 397 bp, Glycine max
  Peptide Sequence Number=SeqID_182020
ggtgaaagttggaacctgttacgtgccgatcaacgtctcatcgtcgccaaaagttggcccagggcttcccggtatcaacagggacaccaggatttatttattctgcgaagtgatcttccgtcacagctgtccctcctgttcagctactgacggggtggtgcgttacggcaaaagcaccgccggacatagcgctggcaagtgtacgtcacgctgcgcgtacaccacacccgccgcgctaagcgccgtacagggcgcgcccatcgccattcaggctgcgcaactgttgggaagggcgatcgtgcggcctcttcgtattacgccagctggcgaaagggggatgtgctgcaaggcgattaagttgggtaacgccagggttttcccagtcacgacgttgtaa

SEQ ID NO: 90336 - DNA, 321 bp, Glycine max
  Peptide Sequence Number=SeqID_182021
ataattgagcataagtgtcacaacctacccttttgcgggcgagcgaggcgagactctcgggtgcgtttttcaaaggaggaaaaatgcgcggagtcgccaccaacgtttattagtggaaaacgtcggaaaaaccgaaggaaaccggttgacaaaagcggggctcttgctcctacgtaccctccttcaaataggaaatcagacctacgtagttctttattaagggtgaatcaagcgattctttttacttggaaggtgatcattttaaggcgttggaccttaaaaatgatccatttacttgacgagcttgactttacgagttga

SEQ ID NO: 90337 - DNA, 453 bp, Glycine max
  Peptide Sequence Number=SeqID_182022
atggtgtcaccccaagggagtaacacatggacagttgatgatctcgtgtcttatatggagaagataatgattttatccgaagagcaagaaagaatcactgagtctgtgtcacatggtccaacatcagagcgtcaatttccagcacaagagtttcacattcttcagtcaagtgttgaaactcagggtattggcagacgaagggaggcagttgaagcggaagaatattcccaacaaatggtggagtgtggccatggaatgtattacatgccaccaatattttttcagtatccttcacagatgtatcagtatccttttgaaggtgttgatttgcgtcaccaattttctactgaggctgagcaagtagaagcggggagacatcggggcagaagaaatcctgatcgtcaagcgcaaagatgggatcgaccatgtggcacatcctcacggacatcataa

SEQ ID NO: 90338 - DNA, 399 bp, Glycine max
  Peptide Sequence Number=SeqID_182023
atggttcccaaagacctgaagcagctgacacagaaaatcaaggaccagttggaggattcgatcacaaaaaaagtggcttcacaactaatgttgtctttcagtcaaatgcaatcccaatttcagtcgcaaatgcaatcatatggactcccactacctctagagcttgaggttggtctttctactgctcgtgtcttgacaaagaaaagttgtgttgatcccttggggcaggacccagacattgtgagtcagagaaatatgagttgtacgtcgacgaaaatcctcctcgcctggttgcccttggaagactttatgaggggtcaaccaccgtttacaacatccctttgggaaatgatcaagtcaaggataaatagggagctgaggtaccaacgcaacctgtag

SEQ ID NO: 90339 - DNA, 375 bp, Glycine max
  Peptide Sequence Number=SeqID_182024
cattcaggcatcactccagaaaaagttgtcaatgctgccgaattaaacaatgatgttcctaagcaagaccccttgcgtgagttgattaagacccttgttgacatttacgacaagcctgttgagtttgtgtgggatcttattgaatttgggattccaaatgtaaattcatcgttgttcttaacgtatactgatgtcagcaaaataacatcaggcgaaaaatgcttgaacatagccatacttcaattgtggaccatcgcccattggcaaatggttgtgttgtgccctaaagacaatgtcgtggtctgtgcatacaagaaattaaacacgactgctgatggcaaagttcctaaaactggacccagtcgcttgaactga

SEQ ID NO: 90340 - DNA, 282 bp, Glycine max
  Peptide Sequence Number=SeqID_182025
atggcgaagtcatttgttgggcatccatatgtgggtcaactaactaaagatgagaagattgttgttgctaatatgctgaagtccatggtgaaaccaagaaatattcttttgatgttgaacgagtacaatgccaacagttatacaacaatcaaacaaatttacaatgccagaaatgtctatcgttcttccataaaagggaataacaccaaaatgctacagctcatgatgatgcttgaccgagatcaatatattcactggcctaggatgaaggatgaaaatgat

SEQ ID NO: 90341 - DNA, 180 bp, Glycine max
  Peptide Sequence Number=SeqID_182026
atggaggttgaggaatctttgatgggctcacgactaccattgcattatcgagcagatacgagagggtggtgtttggtcttagatgtgcaacaggtggattttgtggccgatttaggggtggcctttgtggatgattgggtgttcttggttggtagggtggtgagtaatgggaaggactga

SEQ ID NO: 90342 - DNA, 405 bp, Glycine max
  Peptide Sequence Number=SeqID_182027
atgtaccctctcttgttctcagtcacaacaacccaagtagatgtaccctcttcttgtaccacaaaagatgtaccctccaatgtgttaagacaaagttctcaggcggttagtccttcgaaactttgtgaagggggaaacaaaagaattctcaggcgggagaagggagacacaaaagaattcaggcggttagtcctttgttcttttggaaaagggagaagagagacacaaaaagaattcaggcggttagtccttgtcgaattctttttggcaaagggagaagagagacacaaaagaattcaggcggttagtcctttgttcttttggaaaagggagaagagagacacaaaaagaattcagacggttagtccttggcgaattctttttggcaaagggagaagagaatga

SEQ ID NO: 90343 - DNA, 540 bp, Glycine max
  Peptide Sequence Number=SeqID_182028
atgcagctactatgcataccggggcaagatttcacccgtgccgctgcaaagagacgagtgcgggtcatgcgcaccaacatgaccactcttacacagatatggatgacgttgctacttagcaacattccacccggtgaccacaatgccaatctccccctgtggaaatatcagggttgtgcccacaagacacccagtggactcggagaagtccaacagggccctggggtttccagctctagttacgggcctctgtcggtcctacagggttcccatttccccccagcaaggggttgtgcccacaagacacccaatggacccggagaagtccaacaaggctctggggtttccagttctagttatgggcctctgtcggtcctacagggtgcccgtttccccccagcaagggattgtgcccgcaagacacccagtggacccgaagaaggccaacaaggacttggagttgccagctctaattacgggcctctgtcagttctacggggtgcctgtcgcccccagcaaggtcatcaagccccctactaa

SEQ ID NO: 90344 - DNA, 498 bp, Glycine max
  Peptide Sequence Number=SeqID_182029
atggctccgaggaagctttccacaaagagatataggaaggacgctgtggccgaagggactagcaccgctcccgagttcgatagccatcatttcagaagcgctgagcaccagcagcattttgaagccatcaagggatggtccttccaccgagagagacgcgtccagctcagggacgacgagtatacagatttccaggaggagatagctcgccggcgttggacgtcgcaggtcactcccatggccaagtttgatccggatatagaggaaggcgcgcggggcatgcggtcatgggtaaggggccagtggattcctttcgatgcagacgccctcagtcagttcctgggatacccgttagtattggaggagggacagacgtgcgagtacagtcagagaaggaaccgggccgatggatttgacgaggaggccattgctcagctgctatggataccagacatggatgacgttgctgctcagcaacatcctgcccaacgatcataa

SEQ ID NO: 90345 - DNA, 309 bp, Glycine max
  Peptide Sequence Number=SeqID_182030
atgttggggaagcttgggaggattgatggggacccggtgttgagagaaacgaggatatgggctacgtgggagtacgtgagctcagttggaggtgggcaacaggggatggtgggtttatgcgcgatttgtggatgtggaaaaacttgttgtgcaccatcacccgaccgccacctagtaccacatgtgatggagtggtacctggagatatgtcgcgggggtcaggagaccttggggacgtcaggtggggtgctattgcccaaaaccaagcttgacaaatcccgacccaacccgggcatagtcagtcagtga

SEQ ID NO: 90346 - DNA, 135 bp, Glycine max
  Peptide Sequence Number=SeqID_182031
atgaaacaaagggatgttgtgaacccgctgtggatccctcataaactcttcctagggcaaccaggcgggaagggatttccttcgatgtacaacacaaataggaatagtgggggcaagatacgcgggctaggctaa

SEQ ID NO: 90347 - DNA, 510 bp, Glycine max
  Peptide Sequence Number=SeqID_182032
atgtcttgcctagcgatcataactccgatctccctctaccgaagtgtcagttggtatatgccatctgacacagatgagcgtcacgtggcccaggtgattgctgacgccatctatttttttgcaggtatgccacccactaggcaccctctagacccggataagtctaacagggccctggggtttctggcattgatcacgggcctctgccagtcattcggggttcccatcacccctagtaaggtgatccgaccgccgatcacccgggccttcatcaagaagtattgcacgcctaggcaggtgcagggtgatgcacttgaggccgcagacgcaccgccaccacctcatcaggccaatcccgctggatcactaggcatggagcgttatctacaacacttggttcgccagcaggcggccaaccaccgggggcaggtgcagatacatgagttctaccagtttagcctcagtcagcaggggcagggtttcgctccttttgcgtgccttactccatag

SEQ ID NO: 90348 - DNA, 222 bp, Glycine max
  Peptide Sequence Number=SeqID_182033
atgaaggcccagaggcagaggcacttaccaagactattaattattgttgaaggtaatccttgtggcatctaccctgacttatcttccttcaccggaagtggcgtctaccctgacttatcttccttcactggaagtggcgtcatccaaatctccgtagcctgtatcaagcgatccactcctagtcaggatcacatcatctggtatcagagctttggctcttga

SEQ ID NO: 90349 - DNA, 1434 bp, Glycine max
  Peptide Sequence Number=SeqID_182034
atgaagttagagggttgtgaatcatatcacaaatcagccaatactaactaccgtggttctaacttctgctctgctgatggctgcacgtttgcatctagcgggacagagaaaagaaatgaccggattcacaaccctaatgggcctaaccctaaaaggcagtgtattaatgaattatgccggatgaggttggatgttccacttctcgatcagcttgttagagagtattgtgtttatagaggcattgttgactctgcatctgggaagcaacctatcccagaacctgtgaaaatcaaccaacaagaccctgggtattgctcatcaagggattgttctctcgagctagattgtaatgccagcaagcattctgatggtgaaacttctgttaccaatgctcagatggatggttcccctgaaaataactctgatgtgacaagcatgagacgaattgattttgaagtgcgatatgcttctgaacttgcaagcattcatgaagactgtagtaccagtggatcacagcaacatgaagatgcaagtgttttgcaacgatgcagattgtctgggaatggagaaaggagcaagcgcaagcggtggagaggacgatatgatggcaatagttacatgtccgatgcttctttggaagagaacagcaaacaagagcatagcattggtactgttgtttcaactatattgaaggagaaacagggctctgaaaagctttctgtacatgatattaataatgtggaagatagatatgagattctgttgggaatgaaggaattagctagcaaaggaatggctgctgaagcagttgaggaagttgaattcctcaagttggtcagctctggtgattataatgctgctttaaaggttgcttgcacccatttgggtcctttagctgccagtgatcctgctttattaaagccattgaaggaaactcttttggctttactacgacctaatgaagatgctcttggaaatgcattacctctacatgctctagctgcttctctccaggttgcagttggtcgtaggcttggtgttgaagaacctcaactcatgaaaataatgcgagctactctttatactcataatgagtggtttaaacttcaaatgtggaaagatcgttttgaaggtcttttgaggcttgattccttgaaggaagccaacactcccttccttgcaccagtcactacatccaaatcgtatgctgatagctgcacaaatggatcttctcaggccacagtatcttcagggaccaggatgtcagaagatggtagtagtccaactcaagcatcttcaagggatgtcatctgtgacgaaggtgcaatacttaaagtaatggagtttttggctttgcctagggctgatgccatacatctgcttgcacagtacaacggaaatgcggagacagtcattcagcagatatttgcgtag

SEQ ID NO: 90350 - DNA, 1345 bp, Glycine max
  Peptide Sequence Number=SeqID_182035
atggctacaccacctagctctcctcctcctcctcctcatcctcctcttcctactgatgcagcatcacattccccttctatcttgaagcgaaaaataaaatccaaacgcatgagatcattgtttattggaccaattggggcagagagacccctggtccatgtggatcctgcaaccgggaaagccgacagtcccaacagaaaaaagttaaggacatatttggggattgtcgctcgagataaggtggatgtgacatacgagaatgggaaacaagtccttgctacccaaaaggatttgatatgggaggatattcaacctaatttgatgttgaaatgggaacttacaaccaacaaggacggtgttgatgacattgtatgtgaaaagaacgacatcagcaaagagaagtggactcaattttgtcagagttgtagagacccttcttgggaggcacaggtcattcagaaacaaaacactacccctcatgtgttgtctcgtgggggttatgaatatctagaaaacaaattgatggaggagaagaaaaagaaacaactagaggaagcagctcaatccagaagtactgacaccatcattgatcttccatctcctatcagacgacacgtgaagtggaagaaggcctgcaccaagaaatttggtcaaatgacgtctgaggcagcaaagaaaattgatgaaaagattgagcatgcctcacaaggaagctttattgcccacagacgtcaagatgtactgactgtggccattgggcaaccagaacaccctggtcatgtctgtgctgctagagtcggtgtcacgattaaacaatactttggaccggctccaaggatctcccacacatcttcgtccatggctcccgaagacttggagcagctgacgcaaaaactcaaggaccagggactcgcaatgcctcctaagcctaaggttggtccttcagctactcatgtcagcacaaaggagagttgtgttgatccctcagggaacgacttagacacgggtgagtcagagaaatatggattatacatcgaagaaaatcctcctcgtttggttgccattggaagactttatgaggggtcgaccaccgttcacaacatccctttggccaacgatcaagtcaaggttggtgttgaggaagttcgagatgcagatgctcacattcctggagctgtgggaccagggaaacctacagataggtcagatcatgatgtcgatgatcccttatatctgatgacattgatcatcccacaactttttctaaagccgatgcaggttatgtgggatgctaccatgtttggggtgtataatgacaactttcccttgtacataaagcatgaag

SEQ ID NO: 90351 - DNA, 282 bp, Glycine max
  Peptide Sequence Number=SeqID_182036
atggcaaaaggtgcagaagacgatgttagtctctgcgcgtcaacgggctcgtttgcctcctggttgacgaaaggtgcggaaattgactgtgcggagaaattacttgtgtatctccgcacgtcacctgactacagggtcagtgtggagaaattacttgtgtatctccgcacgtcacctgatttcagggtcagtaagacagataacgcgaaagacgacgtaaatcttcgcgtgtcaacgggctcgttggccgcgattgacaaagggtgcagaagacgacgttag

SEQ ID NO: 90352 - DNA, 647 bp, Glycine max
  Peptide Sequence Number=SeqID_182037
atgtgtttcgcaggaaatggccccgagaaagcgtccatcaaagagtactttgaggccatcaagggatggtcattccttagagagaggcgggtccagctgagggacaatgagttccctgattttcaagaggagataggccacaggcgctgggtgccacttgtgacacccatggctaaatttgacccagagatagtcatggagttttatgccaatgcctggcctactaaggagggagttcgggatatgcattcctggcattgcgaattcagccagaggaggaatcaggtctctggttttgatgaggaggccattgctcagctattatgcataccggggcaggatttcgcctggaccgctgcagcaagacggttgaggatcatgcgcaccagcatgaccaccctgacccagatatggatgacgttgctgctcagtaacatcctacccagtgaccacaacttcgatcttcctctgccaaagtgtcagctggtgtatgccatcctgatagagttgattgctgacaccatctatcaatttgcaggaacgacgcctacgaggcaccctgtggactcagaaaagtccaatagggcactagggtttccagctctgatcaagggtctctgccagttctacggagtgctcgtcgcccc

SEQ ID NO: 90353 - DNA, 1371 bp, Glycine max
  Peptide Sequence Number=SeqID_182038
atgacacgcaacgaccaacatggtcgtcctcaccctttgtcgaaggctcaatgtctaccgaccgagactactaaattctccctgtttcttcatccagaggaaagcgagcccgatgacacgcaacgaccaacatggtcgtccgcaccctttgtcgaaaggctcaatgtctaccgaccgagactactaaagtctcctcgtttcttcatccagaggaaagtgagcccgatgacacgcaatgaccaacatggtcgtccacaccctttgtctaaggctcaatgtctatcggctaagactactaaagtctccccttttcgtcatctagagacaatcgtgtccgatgacacgcagcgaccatcatggtcgtctgccccctttggtcgaagactcaataccatgatggtaactcgctttcattgctctgagactatcaaagtccccttatcatccagagacaagcaggttcgatggtgtgcggggatgacgatggggggtgtgcctatcactgggcccatctggaatattctggaggagggttacttcaggtggaagcaacccagcttgcctgggcaagctgagcaagctgggaggcaaccacctcccccatttttctataaaatggcatggatgggggctgaggaagggggtgatgtaggtccattattgatgttacaccccacttttgttggtcctcattctcctgaagaggatgattcacaccgttcttcctttttcactaccacttgtaccatcacaagtaaaggcactaatgccactgtgttccatcatctcttggtttctttttctattggccctgcttatacttatgagaatgtttgtaatgttgtccttatggatgcttgtcattgtttactaggttgtccttggcaatttgatcgcatagctattcatgatgaatttgatgatgtttttcctgacccacttcctaatgaattgcctccattgcgtaacatccaaaatcacattgatcttgtttcgggttatattcaggagagccttagcccgtgtgatgtgcctgctcttctcactccaaagaaagatgcatggcacctggcgcatagagattctcgtttcggtttaatcgattaccagttaaccgtaatcaattacacagttcagttgagaccatgtctgaacacttcaatcgattacatcaagaatctaattgattacattgttcttgatcttgttaagtgtgttcctataccaccattgaggagttcatctcctaacttcgccagcatcattccttattctggtgatgcttcttttggcaatgagacggttcctgatttgaggacgaatcttctccacctcagagaggatgatgcagtgcaaggtcaccaaagttga

SEQ ID NO: 90354 - DNA, 1041 bp, Glycine max
  Peptide Sequence Number=SeqID_182039
atggtactaaaagaagacatatgtttcttcaacaaggttgctagaacaagtgcttctaaagacattctggttatgaagcctcagaagaaatcgccactgttgttaaggatgtcggtgttgatcttttcaatgataagcacacacgcaaggactatgctcatggagttgcaaattgagaagccttctcggagtagtattagtagtattaatagattgaacctaacacatgatgttcctttgttgcattaccccgagcctgtgtctttcaacaggagtgagtgtgctggtaatcctgtgcggttctttgccatattgtcgaatcagagatctggcagtgggtggtttgagacccttttgaatagccatattaatgtgagctccaacggggagattttttcagttagagaaagaagagtaaatgtttctaccattgtgcagactctggacaaagtttacaacctggactggctcagtagtgcttccaagaatgaatgctcagctgcaattggatccaagtggatgcttaatcagggtttaatggatcaccctaaggaaattgcagattacttcaacagtagaagtgtttctgtaatatttcttttccgaagaaacttattacggagaatggtatcaatgcttgccaactcctatgatcgttatgctaaactatttagtggaactcataaatctcatgttcattctaaagaagaggctgatactctttcaaagtacaagcctaccattaattctacatcattgctggctgatttgaaggatatggaaatgagaactgcaaaagcgttggaatacttcaacaccactcggcatatgatcctgtactatgaggatcttatacaaaatcgtactaagctaaaagatgttcaagagtttttaggattgccacagatggaattaacaagccgtcaggttaagatacacagaggaccattgtcagatcacattaaaaattgggatgatgtgaacaggacactagcaggaactatttatgagagtttcctccatgccgattattcatcttag

SEQ ID NO: 90355 - DNA, 110 bp, Glycine max
  Peptide Sequence Number=SeqID_182040
ggaattggaaggaggattgcttctatgtcctttcccttgaagaattcgagtcaagaagaaaggggctaaccaccttaagagttattggactaagaagcactccaaattga

SEQ ID NO: 90356 - DNA, 237 bp, Glycine max
  Peptide Sequence Number=SeqID_182041
atgtctcctccacctttagaaacctcacaatctttcaaaatctcatccaaagttccgcaagatggcttcctcttcaagcctgaaggtgaagacggtgtgcttagcgagttggccttcgctcaacacctctatacaactcatccttcttccaaaattgtccatgcgcttaaccatcagattgggcgcttagtgaatgatgcgcttggccagaagataagtggcttagcgagttcatga

SEQ ID NO: 90357 - DNA, 459 bp, Glycine max
  Peptide Sequence Number=SeqID_182042
atggctgggacgccacacctcccaaactatacaccacccaatgtggcgtacattcccaatgaggatgtcaataactccactcccatactcattaagagccaacaacctcaatctgatcatgcacatgtctctcgacccatggaggagacgcatgaaattccccaccacgatctagccgacttcgagccttgccacggatatgtcgctgaagggcaagcagttggtggtgtacccctgcaaaacactttggagggccctcagtatcatccacaaccacaaccctcacgttccacaacaagtaaaaaccctcgtgctatggcagaaatggaaaagttggatcatttagaggaaaggctcagggccattgaaggaggtgaagattatgcctttgctaacctagaaaagttgttcctcctacccaaacatggttattcccaagttcaaggtgccagactttga

SEQ ID NO: 90358 - DNA, 1023 bp, Glycine max
  Peptide Sequence Number=SeqID_182043
atggctgctgaacctgatgcagtcccgtcactattacccactcaacgggggccgatggcgaccagttgctgggtcgtgaaacgtggttatcatttgctttatggacgtgtcgccctggtattgattggcgtgaaccttgccgatcgcgacgatacgcaaacggaagtgatcaacaataacgatccaacctataaaagcgatcacagcgacaccgtggtctacagcccgcaaggcgcgctgaactatcgccttattgcccagcatgttgaatatttttcagatgacggtatttcgtggtttacccaacctgtgatgaccacgtttgataaggacaaagtaccgacgtggtcaatcaagtcagaccgggcaaaactgacaaatgaccgtatgctttatctgtatggccacgttgaagtcaacgccctgaccgctgactcgcaactgcgaaaaattacgacggataatgcccagatcaacctggtgacccaggatgtgacgtcgcaggatctggttactctgttagaacctcctatgaaattcaaaacaaacaaactcagccttaaagtaattatcgccagcgcgatgctggcgaccagtctccccgcgcttgctgtaacgggcgataccgagcagccgattcatatcgagtccgacacccagtctcttgatatgcagggtaatgtcgtcaccttcacgggtaacgtcgtcatgacccagggcaccatcaaaatcaacgccgacaaagtggttgttacccgtccgggtggcgagcagggcaaagagattatcgatggttacggtaatccggcgaccttctaccaaatgcaggacaacggcaaaccggtgaaaggccatgccacgcatatgcactatgagctggcgaaggacctggtgatcctgaccggaaatgcgtacctggaacagctggacagcaacattaccggcgacaagattacctatctggttaaagagcaaaaaatgcaggcctccagcgagaaaggcaaacgcctcaccaccgtactg

SEQ ID NO: 90359 - DNA, 150 bp, Glycine max
  Peptide Sequence Number=SeqID_182044
atggagtaccatgcccttatcacttgtcttttacaagccaatcaactggcttatcgagcttccgctaagcgcaacactcatgggctaagcgcgaggaagactctggaagaagatgagttgtataggttttgcttaagcccccccctttag

SEQ ID NO: 90360 - DNA, 405 bp, Glycine max
  Peptide Sequence Number=SeqID_182045
atggcaagagctggtgacaatggtggtgtatatcatcaactggatgaatctcaacgcttatttctggacgcgtggactacacaaatgcaacgtttgttgaccaaatcttccttgtttactcttaaacctctatcccctagagaagtgtgtgatgaccaaatcagaatgagagaaaagagagaacaagagaaggaaaatagtgaggcaccacaaaggaatatgaaaaagagtgatacacccgaggaaaagagtgatacacatgagagaaaatttaattattttgcagaggcgagtgaagcgaggaaagtgttacctgctcatgaaccactcaatctacagtattgcaaagacagaaaaatttctactgataattctaatgagtttactatttctatttctcactag

SEQ ID NO: 90361 - DNA, 518 bp, Glycine max
  Peptide Sequence Number=SeqID_182046
atgacggagaccctcaacaagctccctcaacatttacaagcggtaagtccctctcactcttcactcatgcaaataaggggatgccacatctgcgatggagcacatgaaccagggaaatcaatagcccaagtagattcttatagggaggtgaactacatgggagctcagaaaccgccacagattccaaggctacaaccaaggaggaccgctgggattcaatcaagggaggaatttcacacagggctaaagctggaggaatcattcggggaaccaaccaacaagcttgaggggacactgaatcagttcatgcatatattcatgtccaaatataggagcacagagttatccatcaagaagctagagatacaagtgggacaattagccaaacaaatggctgaaagacccactagtagctttggagccaacacagagaagaacccgaaggaggaatgcatggcggtgttgactaaaagtcagaggaaagcacaaggagaagaagagaaagctgaaggagacca

SEQ ID NO: 90362 - DNA, 198 bp, Glycine max
  Peptide Sequence Number=SeqID_182047
atggaatacgaaactactaatattaaaaacgggttgtttcctctgattcagaagccactctcttatcctggggaaactgccaggaaaccacattacaagcgaaacctcaaagagagttgggcttcatcctcaaaaggaaacaacaccagaaaatctagccttccatggattcaaacagaaaacgcaaatgaaacatga

SEQ ID NO: 90363 - DNA, 432 bp, Glycine max
  Peptide Sequence Number=SeqID_182048
atgtaccctccactagaactgatccacaagagatgtaccctctcttgttctcagtcaaacccaagtagatgtaccctctacttgtaccacaaaggattaccctccaatgtgttaagacaaagatctcaggctgttaaacctttgatactttgtgaatggggattcaaaagaattctcaggcgggagaagggagacacaaaagaattcaggcggttagtcctttgttcatttggaaaagggagaacagagacacaaaaagaaatcagacggttagtccttggcgaattttttttggcagagggagaagagaatgaaaagatgaatagcacaagttttcaaggtttagaaaaccagaaaacttcagaaagcttttggtacaaagaagaagaagttcaaagagattcaaggcttgtaaaggattgtatgaaataa

SEQ ID NO: 90364 - DNA, 63 bp, Glycine max
  Peptide Sequence Number=SeqID_182049
atgactgtgaaaaagaggctaagtcataaagtgccaaaagtgacagttgagcttagcccatca

SEQ ID NO: 90365 - DNA, 329 bp, Glycine max
  Peptide Sequence Number=SeqID_182050
ggatcgcacccacaaagacacccagtgaacctgaagaagtccaacagggccctggggtttccagctctggttacgggcctctatcagtcctacagggtgcccgtacccccccggcaaggtcacgtcatcatagggatcgcgactgcaagacacctagtggacccgaagaagtccaacaggggcttggaattttctacggaagtacctgtcacctccagcaagggcatcaggcccctactaatcgagctttcatcaagaagtactgcgccccagacaggcgcagggcgaaacaccacagcagcattgggatggccggtagcgggcaatag

SEQ ID NO: 90366 - DNA, 465 bp, Glycine max
  Peptide Sequence Number=SeqID_182051
atggccaatcaaggagattgggtcccgtttatggatgtgttagctttgctaatttttggggttgtcctctttccaaacgtagatggtttggtggacctagcagcaatcgacgctttccttgcataccaccatagcaaggaaagtccggtggtagctgtcttggctgatttatttgacacatttaaccgaaggcatccatgtccgctccagagccatcgctcgtgtactgaaaagaggagaatagattgggaccagcttttggccgggataggaggtagaacaatcaattggttcccccgatggaaggaaggaaaagaaggagtccttttctcatgtggaggatacccaaacattccgctgataggaacgaggggttgtattaactacaatcccgcgctcgctataagacaactagggtaccccatgaggggagcaccgacggaagaaggcatgtctcctttcctt

SEQ ID NO: 90367 - DNA, 414 bp, Glycine max
  Peptide Sequence Number=SeqID_182052
atgcagagttcaaaatgcaatgtctatcttggagcctacatgaatggcggacactggcagatggtggtcattgtgcccaacgaacacctagttgtctggttttgttcattgcataacagaccagacaactaccttaaggggataattaacattgctttaaaaggtcttgatgatgctccacaacctaaatcaaaggatcctgctaggtggattgtcgtcaagtgtaatagacaaaaaggaagtactgagtgcggctactatgtcatgcactggatgtccaccatcattttaggaagttttaggaataactgtgaagcgtattttaacgatcctagaccattggagccagagagattaaaggcggtgcggatccagtgggcacaatattatctccgagttagagatcagacctag

SEQ ID NO: 90368 - DNA, 678 bp, Glycine max
  Peptide Sequence Number=SeqID_182053
atggagcaaagcatgctagctataatagggcagtacaaagaggagttaaaccagtctttggctcatgagcaaaagctagtagaagacttcgcacaagcatatgccgagaaggaggcaagaggaagggtgattgatgcattgcatcaagaagcgaccatgtggatggataggttcgccttgaccttaaatggaagtcaagacctcccacgactactagccaaagcaaaggccatggccgaaggtctggaggtggatctaagtgcttctataacggaagtcatgctaaaaattcaaaaatcaattgaagacaatactacggcagccgcttccaacacaactagggaagcgaaaccggtgctacagcccgcaatgaactcaggctgggacagaagcacgacgggtttcaatcggaggtatagtcctcaagcctacccttatggcttgcctccagacttcattccccgtaccgctccagacgatttaagccaagcccctaccttcgaggggcaactccctcctcatggcaactatcctctgcaggaagatgatgaaggagatgcccatttaggccctctacttcccccaagggaaccggccccccatgagttaccccaaccaaacataatctgccatgccccgtctcaatccgcacccattaaagaacccgttcccatttga

SEQ ID NO: 90369 - DNA, 519 bp, Glycine max
  Peptide Sequence Number=SeqID_182054
atgacattgctacttagcaacattctgcccagcgaccgcaatgccaatctccccctgcaaaagtatcagttggtctatgtcgtcccgacatggggatcgcacccacaaagacacccagtggacctgaagaagtccaacagggccctggggttttccagctttggttacgggcctctgtcggccctacagggcgcccgttcccccccagcaagttcatgtcgtcgtggcatagggatcgtgcctgcaagacacctagtggacccaaagaaggccaataggggagtgctgtcgcccccagcaaggtcatcaggcccccctaccaatcgagctttcatcaagaagttctgcgtctctaggcaggcgcagggcgaaacaccacagcagcctggggatggccggcagcgggcaacagacgcaccgccatcacctctagagttcacctctgctcatccacaaaaaggtttgagtattgcctacaccacatggccgaccaataggcgaccaagtccaaagccaaag

SEQ ID NO: 90370 - DNA, 879 bp, Glycine max
  Peptide Sequence Number=SeqID_182055
gcgcggcatcggcgccggcgcccaggccaccaggccgtccagcatgtgatccacgccgaagttgcccaatgcggtaccgaagaacaccggggtcagctcgccgctcaggaaagcctcctgatcgaactcgtgggaagcgccctgcaccagctccagctcatcgcgcaactgcgccgccagatcttcacccaccgccgcatccagctccgggttgttcaggcctttgacgatgcgcacttcctgaatggtgtggcctttaccggtctgcttgccacagccgatcggccaggtgatgggcgagcaggcgatcttcagttcgcgctcgacttcatccatcacttccatcggatcgcggatatcgcggtccagtttgttcatgaaggtcaggatcggcgtgtcgcgcagacgggtaacctccatcagcttgcgggtgcgatcctcaacgcccttggcggcgtcgatcaccatcagacagcagtcgacggcggtcagagtacggtaagtatcttcggagaagtcttcgtgccccggggtatccagcaggttgaccaggctgtcgcggtacgggaactgcatcaccgaggtggtgatcgagatcccacgctgcttttccatttccatccagtcggatttggcgtgctggctggagccgcggccttttaccgtaccggcggtctggatcgcctgtccgaacagcagtactttttcggtaatggtggttttaccggcatcggggtgcgagatgatggcgaaagttcttcttttggagacttcgcgggcaaattcactaggagacatggttttcaggttctacggttagtccgccctgcgacatcatcagaacgcgccgatcgcggcgccgggcaaagcggtgaataa

SEQ ID NO: 90371 - DNA, 975 bp, Glycine max
  Peptide Sequence Number=SeqID_182056
atggccaagttcgacccagacatagtcctcgaattttatgccaatgcttggcctacggaggagggcgtgcgagatatgagatcctgggtgaggggtcagtggatcccgttcgatgcggatgctatcagccagttcctggaatatcctttagtgctggaagagggccaggagtacgagtatagccagaggaggaaccggtccgatggttttgatgaggaggccatcgcccagttactgtgtataccggggcaggattttgcccggaatgctgcagggaggcgagtgcgaatcatgcgcaccaacatgaccaccctgacccagatatggatgacgttgctgctcagcaacatcctgcccagcgatcataattccgacctccctctgccgaagtatcagctggtgtacgccatcctgacacggatgagtgttcatgtggctcagttgatcgctgatgccatctatctatttgcaggtatggcgccgactaggcaccctttggacccagataagtccaacagggccctgggatttcccgcactgatcacaggactctgccagtcgtttggagtccccgttgcacctaccaagtattgcagccagagacaggctcaggggaatgctccacaagctgcgggcgtgccaccaccacctcatcaggctggcccggctgggtcatttgacatggagcagtatttacggcatttggttcaccagcaggcggccaaccaccgggcacatgtacagacccatgattgtctgtaccagctgagcctcagcatgcagagccagggcttcgcttctttttcatgccctactccagaccagttcagggcagaggtcgcatggcccggggattggcccgaggcccaagcaggagaggcgcccccagaagctcccggcgatggagaggaggcccacgaggacgaggagatggccgatttgcttgacttcttgggagggagtggagctacatga

SEQ ID NO: 90372 - DNA, 955 bp, Glycine max
  Peptide Sequence Number=SeqID_182057
gcagcggtgtctctggcaaaaccacctcagaagcccgatccggaggttgatgatccgctttatctgatgacattgaccatcccagagcttttcttgaggccttatcaagttacatgggatgccaccgtgtttggggtctttaatctagactttccgttctacataaagcacgaagacctctcggaaatctcacgtggtggtcaatgtctcaacatatcagtgttacagttatggattctgccagacaactaccttaaagggataattaacagtgctttaaaaggtcttgatgatgctccacagcttaaatcaaaggctcctactaggtggattatcgccaagtgtaatagacaaaaaggaaatactgagtgcagctactatgtcatgcactggatgtccaccatcattttaggaagttttaggaataattgggaagcgtattttaacgatcctagaccattggagccagagagattaaaggaggaaagatgcgcggagtcgccaccaacatttatttgtggaaaacgtcggaaaaaccgaaggaaaccggtcaaaatgaaaattctaagttcgggagttgtatttacgcttgaggaaggtattagcacctctcacgtcgacaaaagcggggcttttgctcctacgtaccctcctttggagaggaaatcagacctacgtagttctttctttaaaggtgaatcaagtgattctttttacttgaaaggtgatcattttaaggcgttggaccttaaaaaggatccattttacttgcaaaataggggaggagcttgccacccagctcgcccaggcgagcaaggttgcttcctccagaagcaacagccttctggaggaaggatctggaaggcccaactttcgaagaagttacggaaactcacggattacgcaaaaacacctcttttcgatttccgccacattacggaatttcacggatcgc

SEQ ID NO: 90373 - DNA, 291 bp, Glycine max
  Peptide Sequence Number=SeqID_182058
atgatggaaagagttttgggacctatccctgagcacatgattcacagcaagcgtgcagaaaaatatttcaagcgtggatcgcatctaaaatggcctgaaggaggtgtttcaagggagaggattagtgcagtgaagaagcttggtcatcttaaggatattgtatcacgaaatgtggactcttcaatgtcctccttgactgacttgttacatggcttattaacatatgatccgaccaaacgccttacagcttgccaagccctcgatcatcccttctttaggaatcctacttaa

SEQ ID NO: 90374 - DNA, 225 bp, Glycine max
  Peptide Sequence Number=SeqID_182059
atgaaatcatggtcgttgaagatgtttattggccatggttacagcaaagggtgtcgcaacatgcccttttgcgggcgagcgaaggcgaggctcacgggtgcgctttccaaaggaggaaagatgcgcggagtcgccaccaacgtttatttgtggaaaacatcggaaaaaccgaaggaaaccggtcgaaacgaaaattctaagttcgggagttgtatttacgtttga

SEQ ID NO: 90375 - DNA, 429 bp, Glycine max
  Peptide Sequence Number=SeqID_182060
atggcacgcaaaccgaggcaggattttagcgtttcaaagatcagatttttcctcacttttgtggctgagtatgggtcacagtcaaaaagggaaagtgggccctttttgctccactcaaatggagacatgtggcattgcttaaataaaataatagaaaaagagaaaacccttttatttaagaccaaaaagcttttcagacagctctctctctccctcacgttgccattttcttcttcttcattttccattgaagctccaagcaaagcttcaacctttggccatcatttctgccccaaatcgcgaaaggagggcattttcggggtcgtgaagtgcatggctacgagtgggacttcgaaatttcagacatttgttgaaagcttgttgaaattgccatgtttggatgagttagacatacccattctgttttag

SEQ ID NO: 90376 - DNA, 186 bp, Glycine max
  Peptide Sequence Number=SeqID_182061
atgcgcggagttgccaccaacgtttatttgtggaaaacgtcggaaaaaccgaaggaaactggtcgaaacgaaaattctaagtttgggagttgtatttacgtcgacaaaagcggggctcttgctcctacgtaccctccatcgaagaggaaatcagacctacgtagttctttcttatgcgtgaatcaa

SEQ ID NO: 90377 - DNA, 583 bp, Glycine max
  Peptide Sequence Number=SeqID_182062
atggggacaaatcaaaacggaaaaagattttatcaagtcaagattaagggtctagatgtcaccagcctcaaggagttgggacgattgatgggacctttccaaaggcaagccttccgcaaagtgtatggaaagattttagatttgaccgcagcggaggtatttacggaagctgttgtatccctcgcccaatactatgaccagccgttgagatgcttcacgtttggggacttccaaatggtaccgactgtcaaagagtttgaggagatattaggatgccctcttgggggaagaaaaccgtatcttttctccgggtttcttccctccttgagtaagattgcagttgtggtcggagatttggcaaaagagttggatcgcatgaagcaaactcggaacggcgtagtgggcctgccacggaaatacttggaaggcaaggcaagggatatggcaagccaagagaagtgggtcccgtttatggatgtactagctttgctgatctttggggttgtcctctttctgaacgtggatggtttggtggacctagccgcaattgatgctttccttgcatatcaccatagcaagaaga

SEQ ID NO: 90378 - DNA, 231 bp, Glycine max
  Peptide Sequence Number=SeqID_182063
atgtcagtctctgcgtgctatcatgctctgagtcttcgagatagcaaaagaaagtttaaaagtgcgggaccaaatggttcccgcatgtcatcgggcccgccgcctttgaatgacaaaaggcgcagaagacaacatagcaaaagaaagtttaaaagtgcgggaccaaatggttcccgcatgtcatcgggcccaccgcctctggatgaccaaaggcgcagaagacaacgttag

SEQ ID NO: 90379 - DNA, 135 bp, Glycine max
  Peptide Sequence Number=SeqID_182064
atggaagcaaggcgtattctcttagaaaggccatggcaatttgataagaagatcatttgcaatggcctaactaatgagattaccctcacccatcttggcactaaatttgtgttgcatcctcaaacaccttcacag

SEQ ID NO: 90380 - DNA, 471 bp, Glycine max
  Peptide Sequence Number=SeqID_182065
atgcagccaggcggcggcttgctgttccggctttttccgcagccagtcgcgttgaaccgcgtcgaaacgcggatgctgctgcaggcgattttgccaggcgtagtagagcaggtaatgctgcaggaattggcggtcgcgcgcatcgaagtggcggctgagcagcggctcgcaggcgtcgatcgcctctgtcagcgcagacgccggggaggcatcggtcgccagcgcttgccgcaggcgcggggcgaaatcgccttcgacaaaccgcgggctgcagcgcagggcccgccgcagccagtggatgaggcacaggcgttggtcgagcacgctgccccgcagttggtagccatggtcgggatcgacggcgatctccaggtgatggaaacgctggatttcactggccacctcggctatatcttgccgggttatcgggggggcgacgccgttgattccgctccgggtctccagctgtaa

SEQ ID NO: 90381 - DNA, 270 bp, Glycine max
  Peptide Sequence Number=SeqID_182066
atgtgccgccgtgctttgtcagttccgttccagtatgtgccgtgcttttcactagttccttcccgtgcgcatctccgaagcttgtaccttcctttatcattatcagcggaaagagcctacgaggcaggagaggagctaatggcgtacgcggaccttgcccttgatcctacggaagtgaagaataggctcgaccgtaagatcgagggagttggttcagagccagaccgagcacaactagctgcttcaggacgggacgttcccacgatttag

SEQ ID NO: 90382 - DNA, 333 bp, Glycine max
  Peptide Sequence Number=SeqID_182067
atgttcatgaccgctaggctatgcatttcagctgttgtgggtgaaaaaatgtgtttccgtgaagaaaatccaagtcgaggtgctgccgtaaagcttccgagacatttccatgagcaaatccgtgaagattttccaccgttcttcgtccctttttcgttcgttcttcagtcttcaaccgttaacatggaccgttcaaaagcacaaaatcaatccataactttaccgcttttgcaagaactacttttgaaagaactacgtaggtctgatttcctcatcgcaattgaggaatacgtaggagcaagggaaatacccttgttgaccacaaaaagataa

SEQ ID NO: 90383 - DNA, 685 bp, Glycine max
  Peptide Sequence Number=SeqID_182068
cttgtcgaagaagatttcgcccttctgcttggggctggccaggttgaagggctggcccgcgatgtcgtaggcctcctgctccagctgcacgatgcgctggcccaggtcgttgctctgcttggccagcgtggcggcatcgatgagcacgccgttgcgctctatgcggaacagggcctcgctggtggcgatctccagctcgtagacgccgcgcaggccgtcgttggcctgcagctgcggccacagtacgcggtgcacgtccagggtctggtcggcatcctcgcaggcataggcggcagccttgtccacgggcacctgggcgaacgggatctggtgggcgcccttgccgcacaggtcttcatagctgatgcccgtgcggttggtgtggcgcagcgccaggctggccaggccgtgcgggcggtgcacttccagcacatagctttgcagcatggtgtcgtgcacatagccgtgcacctcgatgccggcattggcgaagacatggcggcagttgctctggcgcgtcggggccggcatggcgcaggggatgtaggcagcggcgccgggctccacgctcagcgagatgcccacgatctcggcacgcatctcgtccagcgaggtggtttcggtatccagggccgtgagttcggcggcgttgatcttgggcagccactggtcgaacgcttcccag

SEQ ID NO: 90384 - DNA, 380 bp, Glycine max
  Peptide Sequence Number=SeqID_182069
gttcctatggggtggtggccttgatcaaaagaaaattgcatgggttaaatgggactactggctcatggaacaggaacctttaagggagaaatatcccagattgtataacatatcctgtcaacagcagaagcttattcaggatatgggatgtcagtctgcaaatgtttgggaatggaagcttgaatggagaagccggagcatcactacatccaacagatgggaagtcacaaagacaatgggtgggagtggagctttatttggagaaggccattgttttgacaatgaaattgatacggctggtgtttttctcaatgaggttcaggatatggccattcaacaacatggacctgatgtgtgggaatggactgctgaccctacag

SEQ ID NO: 90385 - DNA, 393 bp, Glycine max
  Peptide Sequence Number=SeqID_182070
atgcaagaagaagaagaagaagaagaagaagaagaagaagaagaagaatctgatgatgaagaggacttctcactctttgtgaagaggtttcataaatttgtcaaaaatagaagaatggagagaagccacaacttcaataatgggaagagatcccaagaagtttctcctacacttaaatgctataagtgtaatcaacccgatcacataaaagcaaactgccccacaaatgagtcatggcccgagaagaatgagaagaaaagttataaagaaagaagatccaagaaggcatatattgcttgggatgacaatgactcatccgatggttcagagaaggagataaaccttctatccaaggactatgaaagtgatgaaaacatctctcaagaagtttaa

SEQ ID NO: 90386 - DNA, 432 bp, Glycine max
  Peptide Sequence Number=SeqID_182071
atggcggcgcagctaatccatgatcgagtagagatggagtgcctagagggagcctgggagaccctcgaaggcaacacgaggtgccgattttggggcactattcgatttacggcgacttctttggtgcatccagatgaacccgtgcgcacgcttcagcacattgtggagtggatactacccacgcctacaccataccttctagcgaagccagtccaagtgatcgaggtgacgtcatctgaggaagaccctaaggaggatcccgaggagctacctcctcagcctgctgtggatgctcttgactttctagagggtgatgaggacccacttcttgaggtggattctcccgaggaagtcatgtcggcatctgaggcagactctacggaggatagtggcccgagagagatggcgaccagtggaggcccttcatcatag

SEQ ID NO: 90387 - DNA, 504 bp, Glycine max
  Peptide Sequence Number=SeqID_182072
atggatcagaaaggcctgcgtcagcagtcgctggaagagatcaaaggcgtgcagtggatcccggattggggccaggcgcgcatcgaaatgatggtggccaaccgcccggactggtgcatctcgcgtcagcgcacctggggcgtgccgatgtcgctgttcgtgcataaagaaaccgagcagctgcacccgcgcagcgttgagctgatggaagaagtggccaagcgcgtcgagcaagacggcattcaggcctggtgggatctggacgcggccgacatcctcggcgcggacgccgccgactacgtgaaagtgccggatacgctggacgtgtggttcgactccggttccacccacgcttcggtggtcgacgtgcgtcctgagttccacggccacagcgccgacatgtatctggaaggctccgaccaacaccgcggctggttcatgtcatcgctgatgatctccaccgcgatgaaaggcaaggcgcagtactgtataaagaagtgctga

SEQ ID NO: 90388 - DNA, 369 bp, Glycine max
  Peptide Sequence Number=SeqID_182073
atgaagagagactttcaagggcagatccgggttggtccggaaagtcatgggagaggcgggctaagtgaaagaaaaaaagaaaagataaatggagctatgttgacttatgtacgtctcattgaccaaacgatcaggctacctctcctatccacttctctacaaggtctactttcttcttccttcagaccgggccaagcctttagtttaagtaggtttgggctaggtcgttgcgctcctgccacgtcttggcaaaaaagtaggctgatgggcaagcctcctcctgccgcaatggtgtggggcgtcagaggctgttgccccgtggccaactcgaaggggctgaagttcgacgcagagctttttggttgttaa

SEQ ID NO: 90389 - DNA, 216 bp, Glycine max
  Peptide Sequence Number=SeqID_182074
ggatcgcacctgcaagacacccagtggacccgaagaagtccaacagagtcttggaattgtcaagctctaaatacgggtctctatcagttcaagggagtgcctgttgcccccagcagggtcatcaggccccctactgatcgagctttcatcaagaagtactgcgtccctaggcaggcgcagggcgaaacaccacagcagcattgggatggccggtag

SEQ ID NO: 90390 - DNA, 192 bp, Glycine max
  Peptide Sequence Number=SeqID_182075
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggcgctatcaaaagattagtggttccttactttacgtggattaa

SEQ ID NO: 90391 - DNA, 375 bp, Glycine max
  Peptide Sequence Number=SeqID_182076
atggtgagggcaagtagccctctgaaggcgaggacgtgtagtcctctaaaggcgaggaggtgtagtcctctgaaggcgtggacgtgtagtcctctaaaggcgagggcgtgcagccctatgaaggcgaggacgtgtagccctctgaagctgaaggacgcgagggcatgtagccctttgaaggtgagggcgtggagccctctaaaggtgaggacgtctagtcctctgaaggcaagggcgtgtagtcctctgaatgtgaggacgtgtagtcctatgaaggcaagggcgtgtagccctcggaagaaggcgaggacgtgtagtcctttgagggcgagggcgtgcagccctatgaaggcgaggacgtgtagtcctctgtag

SEQ ID NO: 90392 - DNA, 246 bp, Glycine max
  misc_feature (33)..(33): n is a, c, g, or t
  Peptide Sequence Number=SeqID_182077
acaagcccgtcagggcgcgtcaccgggtgttgncgggtgtcggggctggctaaactatgcggcatcagagcagattgtactgagagtgcaccatatgcggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 90393 - DNA, 60 bp, Glycine max
  Peptide Sequence Number=SeqID_182078
gtggacttggaaactgtggagcctcaggctcaacaaagtgaacaaacaagtgggttctaa

SEQ ID NO: 90394 - DNA, 79 bp, Glycine max
  Peptide Sequence Number=SeqID_182079
tgcttgtaatatgagacaagcagcaatggaggacttggctgagatgctagagaagcaattggcttcagagttattctaa

SEQ ID NO: 90395 - DNA, 336 bp, Glycine max
  Peptide Sequence Number=SeqID_182080
atggagcaaggtaataaagtcaatcctttgccactccctctaaagaatgatgaaaagccttcagaaatatgtgatcctcctggacatctgggggtttcatggtggagcaaacaatatggaattctttcagatgcttgtgtgggttttcacctgcaaggccatgaaactttggaagcaaatggatcagtccagttttttaagaacatatgggacatcctcatcagggtattggatgcacaagctttcgtaggatcaaaggattgtaagtcagatggattgcctctagtcatacactatattcagcatgcacaactagttgccttcttatgcaagtaa

SEQ ID NO: 90396 - DNA, 924 bp, Glycine max
  Peptide Sequence Number=SeqID_182081
atggaaaaaaatggtctcttcagtcagcgcattcgcttgcgccatttacatactttcgtcgccgtcgcacagcagggaaccctggggcgggcggcagaaaccctgaatcttagccaacctgcgctatcaaaaacgctcaacgagctggagcagttgaccggtacccgtctctttgagcgcgggcggcttggcgcgcagttgacgctggttggcgaacagtttcttacccacgcggttaaggtgctggatgccctcaataccgcaggccaggctctcaatcgtaaagaaggcatgaatagcgatgtggtgcggattggcgccctgccaaccgcggcgctcggtattttacctacggtgattggtcaatttcataaacagcaaaaagacatcaccttacaggtcgccaccatgaataacaccatgctgctggcggggctaaaatccggcgatgtcgatattggtattgggcgcatgtctgatccggaactgatgagcggcctcaactatgaactgctgtttcttgaatcgctaaagctggtcgtccgccccggccacccgctgctgcaggagacggtaacgctcagccgggtgatggaatggccggtggtggtctcaccgaaagggacaattccgcggcagaacgcggaaacgctactgcaaagccagggttgtaaaattccccccggctgtattgaaacgctgtcggcctcgctttcacgccagctcaccgtcgattacgactatgtctggttcgtcccttccggcgcggtgaaagacgacctgcgtcgcggtttgttaacctcattacctatcgccaccgaaggcgccggcgagccgatcggtattcttacccgggtggacgccagcctgtcgcagggggcgcaaactctactgagcgcgatacgcaaatccatgcctggctga

SEQ ID NO: 90397 - DNA, 741 bp, Glycine max
  Peptide Sequence Number=SeqID_182082
gtgacctcattgacctggaagaagtcgaatctgatgaagaacccattgccaacaggttggcacctggcattgcggaaagacttcaaaacagaaagggaaaaaccccccttaagaggtctggacgaatcaagactatggcacagaagaagagtactccaatcactcctgccacatccagaagaagcaaggttgctatcccctccaagaaaaggaaagaaatttcctcatccgattctgatgatgatgtcgaactagatgtctcgacatctaagagggccaagaaatctggaagaaaggtgcctggtaatgtccctgatgcaccattggacaacatctctttccactccattggcaatgttgaaaagtggaaatatgtgtatcaacgcagacttgcggttgaaagagaactgggaagagatgccttggattgcaaggagaccatggacctcatcaagggctgctggactactgaaagacagtcaccaatgtttgtcagaggaaagtgtgttagattctcccctgctgtgatcaacaaatatctgggcagacctactgatggagtgatagatattgatgtttatgagcatcaaattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacag

SEQ ID NO: 90398 - DNA, 146 bp, Glycine max
  Peptide Sequence Number=SeqID_182083
ggagcagaatcatcttaggccatggtcagaagtcaagacaagtcaatggcggaagtcaaccaaggcaaatggaggatagggtcacggccgaccgtcgtctcttcccggcactagacaagcagagaaggtcgctgcaagacagccca

SEQ ID NO: 90399 - DNA, 401 bp, Glycine max
  Peptide Sequence Number=SeqID_182084
gtctcttccgatacggcactcacccaaccaagggtgcccacacccccacaagggggagctctccggactccagctccgactcgacctcaaccggccaacaacgctcactttggcacaaacacggcaaggaacttttcgccaaggcaggcacaaatctttgccccgatcccaatgacatatggggaactcttgccatctctcatcaccaaccaattggccatggtggtcccaggaaagatcttttagtccccgttcccaaagtgcaaggtccaaagcttgatagaggccgggtggttgacttttcaagaggacaggcccaacataaaaacaaaccggaggctaaggagattggcgaccagtttcttcttgagcggaagcatactatacaagataaactatga

SEQ ID NO: 90400 - DNA, 199 bp, Glycine max
  Peptide Sequence Number=SeqID_182085
cctcgatcaccagggtttcgcttcttttgcgtgccctactccagatcagtttagggctgaggtcgcatggcccggagattggcctgaggcccatgcaagggaggcgcccgcagaggctcccggcgatggagaggaggcccgcatggacgaggagatgacggatttgctcgatttcttgggagggagtggagccacgtga

SEQ ID NO: 90401 - DNA, 226 bp, Glycine max
  Peptide Sequence Number=SeqID_182086
atgactaggggcaatccaggtgatttacaacccgttgatcctgaaatagatagaacctttcatagattagttaggcatagtgtgcatcctggtcattctgtgcattttgagcattttgagcatcccgatcattttgagcattctgttgttggtgattctgaatattctgattttgagcattcgactgttaattttcacactaagaacatggctcaacctccacctc

SEQ ID NO: 90402 - DNA, 384 bp, Glycine max
  Peptide Sequence Number=SeqID_182087
atggtggtcacagctcgaccggagagagtgctacggcagtttggttacattcagagcatccctccgccgcctgttagtgcttcattgtcacatgatgatatagatgacaggtggatgcatttcgcgaaccacgtactagctgtgggtgagctttgtctagtgcctggacgggtatctacggattacatggagtggtttttccggatatctcacccattcatgataccgactcaggcaggtgaccagcccagagatgcacctgccgcagaccttgaggagtacatgcaaccgcccatcccccaggattgtctcacgatcgccagagagggtgtcagtgcagatggaagtgtcagggctcgacagagacggtgcacagagcattga

SEQ ID NO: 90403 - DNA, 609 bp, Glycine max
  Peptide Sequence Number=SeqID_182088
atggaagaaatcgcgattgagcacatcgtgcaacaactggccagcatacgcgaaagcgcattgcggcagcgacaacgcttgtctcaaccgcccaagctgcctgcgcgcaaggcactggggaaatgcgtggaatggttggcggcatcgctgtttcctaaccgtcttggcgactctgatattcaggcgcaggccattaacttttatgtaggcacgacgctggataaagccttacgtgaattacagcaacaagtccgcctggagctggcatttaaagccccaggcacacctgccagccagtttaatacccaagcgcatgccatctcgcatgcctttgccgagcaactgccgcatatccgcatacaactggatactgacctggaagccgcttatcagggcgacccggccgcagacagcgtggatgaaatcctggtcagttatcctggcattctggcgctgattcattaccgcatcgcccacgtgttgcatggcttgggcctgaccattattgcgcgcttgatcactgaaatcgcccattcgcaaaccgggattgatattcacccaggggcacgtattggcgattacttttttatcgaccatggcaccggcgtg

SEQ ID NO: 90404 - DNA, 228 bp, Glycine max
  Peptide Sequence Number=SeqID_182089
atggactccttgaagcaaagttggtacattgatagtggttgctccatggctggagatgcatcaaagtctattcatatttctcccaaaaatagtgaacatgtgatctatggagacaacaacaaaggttttgatgatgccaaaaagaattcacttgataatgattgtcatcatcaaaaagggggagaatgtaaatgtattaatataggttttgatgatgccaaggtataa

SEQ ID NO: 90405 - DNA, 620 bp, Glycine max
  Peptide Sequence Number=SeqID_182090
gggcagacgcaagcgcacaggctgttgaggatgagcctgagggatttccgggtggtccgagtgacccatccgtgctgaccgagtatacgaatcacgttgcaagcagcgtatggactggagaggagcgtcctgagttgaagttatcctttcatgggagaaaggtgcataatttaggtaggcttgtccctgtcattgaggggctagttgttgggacaggactaagtcctctgatcgcgtgttcgataaacactggtgatcggggacttttgtcttcgtttgtcgagcggtggcaccgagagacttctattttccatctccctgtgggagaggtgacgatcatgctggacgatgtcgcgtctcttctgtatctgcccgtgatgctgatggagttattgatggtcacttcagaggctgccagggctgagacagggcagtatcgtggaccatacgtacgcctgcaatgggtatgtgatatctatgaacgccgatgccgggcaggacattggacagttgcggcttgcacatttcttcttcatcttctgggttgcactcttttcgctaacaagagtgcaacccatattcatgttgtatttttggaggcacttcatgacctcagttag

SEQ ID NO: 90406 - DNA, 459 bp, Glycine max
  Peptide Sequence Number=SeqID_182091
atggacgaagatcagtggatgtatgaaagtataatgtctgaagaagcggatatggattatcaaaatgatgaagcatgtggtgcgaatgaagcacatgttgattgttccgatgcgttcaatacttctcaggtgtttgatagccgagaggatgttttgcggtgggctcgatccgttgctcatgaaacggatttgtggtggagtgacgagtataggcgtaggaaaaaagaatttattagaagagacattaggactaggaaatgtgggtgtcccttcaagcttcgttgcaagccagtggttagaggagaaggctggatggtgaagttgatttgtggagtgcataatcatgaattgaccaactcattagttggacatccatatgcggaacgattgactaaagctgaaaaaacagttattgctgatatgacgaagtctatggtgaagccaagaacattctactaa

SEQ ID NO: 90407 - DNA, 735 bp, Glycine max
  Peptide Sequence Number=SeqID_182092
atgtcggtggcttcttccttccttttgcttggaggcgcatacctccatggagctacgtggctatttcggtatggaaatagaataggtttaatttccgaggggtatcggggtgttcggggagctgtgtctctggtgaaatataccaccaaaggcttaggccttccaaaacttctctcatctgtggactgcatacatatatgctgctcctcactcccctcatcgccgacttccagtcagcctcgatctatcatctgttgcaacaggcttagacctgcgcagcctacccgactcgatgacattaactactccccctccatgattggtgagcgggtttgttttcacgttgggccgatcctcttgaaacgtcagccatccgacatctatcaaatgttggaccatgtatttaagggccaggcacttttcgatggcgtggcccggggttttcccatggtatgtgcaggctgcgtcaaggtcataccactttgggaaaagaggttgatagatcttctcgggagatatcacaaccatctggttggcgatgagggatggcaagaggtcttcgtacgtcattgggatcggggtgaattctggagttggccttgggggaaagttcgtcattgcgttggaaatggtgccaaagtgggcgttgccgaccgggcgagtcggggttggagccggagctttgggagccttcctctggatgggcgtgggcgctctaggctatacggatgctaa

SEQ ID NO: 90408 - DNA, 151 bp, Glycine max
  Peptide Sequence Number=SeqID_182093
atgccttccaagattattttgatgatgccaaagaatcaagagttaagcaagttccaaagaatcaagtttcaaaattcaatcaagtttcaagaatcaagattcaagaataatgaagatcaagattcaagaatcaagagaagactcaataaag

SEQ ID NO: 90409 - DNA, 180 bp, Glycine max
  Peptide Sequence Number=SeqID_182094
atgaaaaaagataaaggttcgagcatcaggcccagcccaagacgcgctcagtgcacgctaagcgcgaaaactggtacctacgctaagcagagcgcgctaagcgcgaaaacaggcacttgtgctaagcgagcagagcgcgcaaagcgcaatgtaaggccctcaatggccatgagaggctaa

SEQ ID NO: 90410 - DNA, 1105 bp, Glycine max
  Peptide Sequence Number=SeqID_182095
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccaaatgggtaccgagactttaagtattaaaaatatcgagaagcttccggttttattcggtgaaaaggatgttatgaaaaccattcagttgttgccggggatcaaaagtaatggtgagggaagcagtggattcagtgttagaggtggagctaccgatcaaaacttaattttactggatgaagcacctgtttataatgcttctcacctgttgggttttttcagcacatttaacagtgatgccttaaaggatgccagtatcatcaaaggaaacagccccgcacaatacggtggtcgcctttcttctgtcatggacgtgaaaatgaaggatggaaataataaagattataatatcaatggaggaattggtttgatcagcagcagattaagtgtggaaggtcctattcaaaaagaaaaatcatcgtttatagtttccggaagaagaacgtatgcggatttatttctaaaaggaagtgaagattttaaggacagtaagctgtatttctatgatctgaacttaaaggccaattatcagatcaatgataataaccgactgtatttatccggatattttggaagagacgttttgggaatcgggaagacctttgcgacagattggggaaatacaaccgctactttgcgatggaacagcatcatcagcatccatttaccataccctgacaccgagcagtgcttcaggaacaagtgtcagcagctttccaagaaatccacg

SEQ ID NO: 90411 - DNA, 318 bp, Glycine max
  Peptide Sequence Number=SeqID_182096
atggcttctaggaagagaaaaagcattggtacaaggcccacatctcagtatggcacaaggagattctcttcattagatgcttggactagatacactgataatgttctgggaagaaacattttacctgagaggaaagtagagttatatcacattgagctagatgactttaaggtcgagctagagagacgtaatttccataaatgcctcaccaatttagccgatgggagcatagacctagctttggtgaatgagttctatgcaaatttatacagttctgaggagcgtccaccaaagaagtccagagtcagagttcattag

SEQ ID NO: 90412 - DNA, 201 bp, Glycine max
  Peptide Sequence Number=SeqID_182097
atgggcttttcaagattaaattcaagacaatacttcaagattacaagtcacaagatcaagatgatcactagtatattaggaagggaattcctaattgaattagcaaaaggtttggccaagaatttacacgatagtggaactctcaagcgggttgcttggggactggacgtaggcaccaagggtgtggccgaaccacgataa

SEQ ID NO: 90413 - DNA, 680 bp, Glycine max
  Peptide Sequence Number=SeqID_182098
cactattgatattcaaagtcatcctctttccaaatgtggatgggctagtggacctagcagcgattgatgccttccttgcttatcaccatagcaaggaaagtccggtcacagctattttagtcgatctctatgacacgttcgaccgaagatgcgaaaagagcgacacacgaatcgtctattgtacaccaactctctatgtgtggttagtctcgcacctctttcgccacgagagtagacctgtttgtcccatgcaaggtcactacatatgcgccgagaaaggagaggtaaactgggagcaactcttggctagtgtggtaggggcatccattaattggttcccctggtggaagaaagggggagttggggttttgtcctcatgtaaaggattcccaaacattcccttaatgggaatgaggggttgtatcaattataatcccgtcctcgccataagacaacttggctaccccatgagaggagcaccatcagaggaaagcatcatgcctttgatcgcacggggtttcagtgaccacaatgcgaggatacttcaaggagtccacaaggcatggggtgcagtgcaaaggaaagataaagagcttaggggaagcgccaatggtatcatcgacgactatcataagtggctgaagactcagacgcaagagttggattggatcaaaagctaa

SEQ ID NO: 90414 - DNA, 583 bp, Glycine max
  Peptide Sequence Number=SeqID_182099
atgactagtggcaatccatctgacttacgaccctttgatcctgagatagataggacatttcatggattagttaggcatcattttataccttttgagcatcctgatcattctgttattggtgagtctgagcattctattaattttgaacattttgattttgaacatcctgattttgagcattataattttgaacattttgattttgaacattctgagaacatggcacaacctccaccctgtgagaggactctaaggaaaatggctgcacctgatttcacctacgaaagcttgtgcatccaataccctgatgaggatgtcccatatgttcttaaaactggactgatccatttgcttccaaagtttaatggccttgcaggactcagtaacatggagaaaagtatgattgatgctgccaggggtggagcccttggagacatgacccctgcggaagccaggaatttaattaagaagatggcttccaactcccagcaatttagtgccagaaatgatgctattgtcattagaggagtgcatgaagtagccacgaattcatcttcatcagctgaaactaagaagcttgaag

SEQ ID NO: 90415 - DNA, 342 bp, Glycine max
  Peptide Sequence Number=SeqID_182100
atgtcaatccttaccctcggaagtaaaaaaaaaggggaaagaaggaaaatttccaatcaaagagaaagcaaaaagaaaagaaaggaagttcccaatcaaagagtgggagaaagcaaaaagaaaagaaaggaaatccccaatcaaataatgggagaaggtagaaaaaaaaaagaagaagaagaaggaaagaaagctcctgatcaaggatcgaaagaaaacagaagaaatgtgcagaaaggtctttggattggacaatatctgagcaatacaggattgtcaccaaatgaacaaaaaagaaggaaaggaaaccacgacctaaaatggtcttctccctttaattga

SEQ ID NO: 90416 - DNA, 288 bp, Glycine max
  Peptide Sequence Number=SeqID_182101
atggaccaattgagtcaaagagatggtgtaggatcggtgtatggattccttgagccgcaggctatactgaatgcaaacgataagcgtggacaatgtcaagaatacattgaaaaatggcttaaggaatcaaaccgagatgtctatctaggcgcttatttgaatcatgcatttaagactttggaaaccaagagtgaggggaaatttggtcacagtacactgcggtggattgaagtgaagagtcacgttcaaagcggaacctatgagtgtggctattatgtcatgcactag

SEQ ID NO: 90417 - DNA, 1315 bp, Glycine max
  Peptide Sequence Number=SeqID_182102
atggccgacctgttgaacagcacgcacggcttcgagtggaccgataacgccgaagaggcggacgtgctgctgctgaacacctgctcgatccgtgaaaaggcgcaggagaaagttttcgccatgctggggcgctggcgcttgctgaaagaaaagaacccgtcggtgatcatccgcgtccgtggttgcgtggcctcgcaagaaggtgaactgatccgcagccgcgcgccctgcgttgacgtggtattcggcccgcagaacctgcaccggctgccggaaatgatcaatcacgttcagggcacccgcagcccggtggtcgacatcagcttcccggaaatcgaaaaattcgatcgcctgccggaaccgcgcgccgaggggccgaccgccttcgtttccattatggaaggctgcaacaaatactgcacttactgcgtggtgccctatacccgcggtgaagaagtgagccgtccgtgcgacgatattctgtttgaaatcgctcaactggcggcgcaaggggtgcgtgaagtcaacctgctcgggcagaacgttaacgcctggcgcggcgaaaactacgatggcacgaccggcaactttgccgatctactgcgtctggtcgccgccatcgacggcatcgaccgtattcgcttcaccaccagccacccgattgagtttactgacgatatcatcgaggtctatcgcgatacccctgagctggtgagcttcctgcatttaccggtgcaggccggttccgatcgcgtactgaacctgatgggccgtacccacaccgtgctggaatataaagcgattatccgcaagctgcgcgaagcgcgcccggatattcagattagctccgactttatcgtcggtttccctggcgaaacgacggaagacttcgaaaaaaccatgaagctgattgccgaggttaactttgatgtcagctacagctttatcttctctgcccgcccgggcaccccggcggcggatatggtcgacgatgttcctgaagccgataaaaaacagcgcctgtacattctgcaggagcgtattaatcagcaggcgatggcatggagccgccgcatgctcggcaccacccagcgtattctggtagaaggcacgtcgcgtaagagcctgatggagctctccgggcgcaccgagaacaaccgcgtggtgaacttcgaaggcacgccggatatggtcggtaaattcgtcgacgtagaaatcgtcgatgtctacactaactcattacgcggcaaaattgtccgcacagaagatgagatgggactgcgcgtcgtggaatcgccggaatcggtcattgcgc

SEQ ID NO: 90418 - DNA, 951 bp, Glycine max
  Peptide Sequence Number=SeqID_182103
gagcaggccacacagggatcgttcgtcccccatggacgtcaggatgttctggccgctgctattggacgtccagagcaccctggatgtgtccgtgctgttggagccggtgtcaccatcaagcaatactttggatcggctccatggacgtcccacagtgcttcctccctgcctcctgacgaattacaacagctgactcagcagatcagggaccagctagaggagtccatcacaaagaaagtgacgaggcagggacctcctgagcctctggttggtcctggtccctctggtccttgggtgagcacaaaggggagttgtgttgatccctcaggaaacgatcctgagacgggtgactctgacaggtgcggcttgtacatagaagcagatcctgcccgcctggttgccatggagagagtttatgagggatccactcttattcataacactcctttgttgcctagccaagtaaaggtgagtgtggacgaggttaaagatgcacatgctgcagttcctgtacccactgctgaggtttccttagtggggcagacacttcacatcttccttgctttgccgacacatctaatcaagtctttatcaaaccaggtagttgtgtcttcgccaaaaccacctccgaagcccgatccggaggtcgatcatccactttatctgatgaccatcccagagcttttcttgaggccttatcagcacgaagacctctccgaaatcgcacacggtggtcaatgtctcagcatatcagtgttacagttgtggattctgcatctcactgaaacatgtatgcgagcggggaattctgatatctatggattcctcgagcctcagtccattcagaggccagacaactaccttaaggggattattaatagtgctatcaagggtcttgatgatgctccacagcctaaatcaaaggctcatgctaggtggattgtcgtcaag

SEQ ID NO: 90419 - DNA, 516 bp, Glycine max
  Peptide Sequence Number=SeqID_182104
atgacagaaaccgtttgtacggataaccgcttgggtatctccgcacgccacctgacttcacgggtcaggatgatagaaaccgtttgtacggataaccgcttgggtatctccgtacgttacctgacttcacgggtcaggatgacagaaaccgtttgcacagataaccgcttgggtatctccgtacgtcacctgacttcacgggtcaggatgacagaaaatgcggaagacgacgtcacgattgcagaaggtggggtggtcgacaaaagcgaggcttttgctcctacgtatccttcatttgtgatgaccacattggcctctgcttgtcaatcgaacttggggtctctgaataacgaggtgcggataaccggaaggtgtttccgcatgctaccagagtcttgggtcttgatagaaaaaggtggggtggttgacaaaagtgaggcttttgctcctacgtatcctccatttgtgatgaggaactcagacctacgtagttctttcttttgtgagactaaatag

SEQ ID NO: 90420 - DNA, 935 bp, Glycine max
  Peptide Sequence Number=SeqID_182105
gaggagttagctgcttgctcaagatccaagaggagtttggcccaacacttagaagccacggagcaaagcatgctagctataatagggaagtacaaagaagagttaaaccagtctttgacccatgaacaaaaactagtagaggacttcgcgcaagcgtacgccgagaaggaagcaagagggagggtgattgatgcattgcatcaagaggcggccatgtggatggataggttcgccttgaccctaaatggaagtcaagacctcccgcgactactagccaaagcaaaggccatcgctgaagtgaaggccgacctatcggccttaaaagatcaaatggataatgaagagggagtgcaagaacagatgaaggccgacctatcggccttaaaagatcaaatggcttctatcacggaggccatgctaaagcttcagaaaactatagaagataatgctacggcggccgcttccaatacagctagggaagcggaaccggtactacagcccgcaataaacttgggccgagacagaaacacgacggttttcggtcggaggtatagtcctcaagcctacccttatggtttgcctctggacttcactccccataccgctccagacaatttgagccaagcccctaccttcgaggggcaactccctccttatgccaactatcctctgcaagaagatgatgaaggagatgcccatctaggccctctacttcccctcaaagatccggccccccatgaattgccccaaccaaacatagtccgccatgtcccgtctccacccgcacccgttaaagaatttgttccctttgcaaaagataagggaaagattgatttacttgaagagaggctgagagcggtggaaggcctcgacaactacccgttcttggatttagcagaactgtgtctggtacctgacatcgtcatccctcccaa

SEQ ID NO: 90421 - DNA, 402 bp, Glycine max
  Peptide Sequence Number=SeqID_182106
atgatggtggcctgggtgatgttggggtacggctacgagcccataataggaagaacaaaggccaaggcccgcggtcaggacagcaagccaaaagaggccccaccctgccacatcagtagaagctttataagtgcgggtttaagacgcgaaggccaagttgccgcgatatgcgaggatgactccccgaggagattggatttgatacggccatgtcctcccgatccgacgacgagtccctcaaaggtactaatacccgggacccgaccgtcaattttgagcaagaagcgggtcggacgaggatgtggggcttcccccagagctggagaggataatcgctcaggaagaccgagagatgaggcctcatcaagaagagacagagctcatagacttaggaacctgtag

SEQ ID NO: 90422 - DNA, 321 bp, Glycine max
  Peptide Sequence Number=SeqID_182107
atgtgtctatcggggaaaggagaaggaagcactgggttcaacaaaaatagaagaaaatcactcaaagtgtatcaatctcacacattgcgtggcgagaaagtcgctagcggacaggattttgtcggcaatcaaagggagaggaccactttaggtcgtgggcaaggattcacattctcaccctgggtcaaggtttatgataagttgggattttggctcaaggcttgtagaacgggtggtcatgatatatgtcagggtttggctagcggttcagggataaaggggatgtcctacattatttccatgatacacatgcaacaatga

SEQ ID NO: 90423 - DNA, 222 bp, Glycine max
  Peptide Sequence Number=SeqID_182108
atgcgtgtatgtagcttagggggtcatatgcccttcttgtttgaccttgctcgtgagatggcatttctttttgaactatcaaactccagtgccgccttggagtttgatagtcaccggttccagagtgccgagcaccagcagcgctttgagaccatcaagggatggtcattccacagggagaggcatgtccagctcagggaagacgagtaccctgacatctag

SEQ ID NO: 90424 - DNA, 543 bp, Glycine max
  Peptide Sequence Number=SeqID_182109
atggagtataacatcatgaatacactccaacatatgaccatggtagctacagcctaccaaacctcccatgaatgttcggaagaaaccattatagacattttagtggcaggattttccgaacaattaaaagctcaacacttcattggagacccatctatgtggaaagataggtctgcagaattgttgtcaaaccttaagtgtagaaccttagcagactttaggtggtacagagataccttcctaactagggtttacacaagagaaaatagtcaacaacctttttggaaagagaaatttctagtcggtcttcccagatcattaggagacaaggttagggataaaattcgtagtcaatctgccaatggagacattccatatgaaagcttaagctatggtcaattaatttcttatgtccaaaaggtagtcttaaaaatttgtcaggatgacaaaattcagaggcaattagccaaagaaaaggcccaaacaaagaaagatttaggttctttctgcaaacaatttggtctaccggcctgtccaaaatag

SEQ ID NO: 90425 - DNA, 237 bp, Glycine max
  Peptide Sequence Number=SeqID_182110
atggggacaaatcaaaacggaaaaagattttatcaagtcaagattaaaggtctagatgtcaccagccttaaagagttgggacgattgatgggacctctccaaaggcaagccttccgcaaagtgtacggaaagattttggatttgaccgcagtggaggtatttacggaagctattgtatccctcgccgaatactatgaccagccgttgagatgcttcacgtttggggacttccaaatg

SEQ ID NO: 90426 - DNA, 336 bp, Glycine max
  Peptide Sequence Number=SeqID_182111
atgtccaatcataagagtactgagtcagccttgaaaaaccttgagattcaggtgggtcaattggccaagcaattagttgagaagtcatcaaacagctttagggaaaatactgagaagaatcccaaagagtgtaaagttgttgtaacaagaagtagaaagcttgtggcggctgaggatgaggatgttgttgctttgaaggagcaagttcctttaaaggacactactgttaaaaagaagaatgaggaaactggaaataactatgccctttggagaagctttgcagcagatgccactctactcaaagtttttgaaagatatgttgacaaggaagcataa

SEQ ID NO: 90427 - DNA, 290 bp, Glycine max
  Peptide Sequence Number=SeqID_182112
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccgttttcttctcaatagcaagagatataaaacaaaggctggctgacactgacaccaaggcagag

SEQ ID NO: 90428 - DNA, 75 bp, Glycine max
  Peptide Sequence Number=SeqID_182113
atggacaaagagcaatttcagtcaatgaatttactgccacaagatggatgcagtgctggtgttcttggtgtgaag

SEQ ID NO: 90429 - DNA, 972 bp, Glycine max
  Peptide Sequence Number=SeqID_182114
atgagtatagatgagaatggaacgtccctattccatatgctggagaagtggaatccgagcttgtggactggctacagattggtctgcatcctttgctggggaatcctattacacacatgggacctggagaacattaagagtatctcgtcggcggtaggggaagtggtggagctggatgataatgctgaagaacttaagcgtttggacagggcaagggtgttaatcaaaacaccatggcatcctacaattcaacatgcggtagcagttacaattaatggggaggagtacatggttcatatagtagaggagacatgctacaacccctgcagatactctccgatgagagtgaaattaatggctggatatgctttgtcggaaggtgaatttctgacgagagctaagacagcagacgcagaaggacagcagaatggggctggttgcgagatgcaattgtctgatggacaatatctcttgtcaggacttgtgggtattacccttgggttattgacacgaggaccaaatcatctcaggtacagagatgaaagttatggccaaagcaaaatagacaagacagttttaggtggaaaacacaggcttacccaacagagacagggtggtgaaaattttgaaataaaggggagggggtcacgtaagtactttgacgatgagaaaggtgacaattctttgttgggttttgctaaacacacctgtgctgaaataaaagaaggggaaaataatagtttgaaatccaaactaaatgggccaacccacatttggaaggtttactcacgaaataaatggtgcaaaaaacacatcggccataacaaaatagatgagtccaatgttggtaaattaacaaaatcaaatagcaatgaacaaaagcaggccaacagtgtttcaggtaaacatgacatctctccaccagtgatgaggggcagtagactgaaggaagtttctggttgggaggaatag

SEQ ID NO: 90430 - DNA, 153 bp, Glycine max
  Peptide Sequence Number=SeqID_182115
atgaccaagaaagagttgactgcagccataccaggagtgtttgatcttggacctcctaggcttcataatcaagatagttggaatcatcaagtttttcaaccacagagttgggaaatgattgaggaactgaattggaaggagcggaagccatga

SEQ ID NO: 90431 - DNA, 303 bp, Glycine max
  Peptide Sequence Number=SeqID_182116
atggggatcaatagagcttatgatccttgccatgacttgggcgttcctgacttcccacacaacatattctttcggctggttttctttgttaggagcagaattggtgtcgtcaacatgacctcaaaggttgaaggtgattcgggttctttgataccgggggtctcagggctgcagtatcgcattaccaaagaagccattggaaaattcatttcattccagtgtactccaggattgatcttgaagggatgggttgaagcacatgagtgggttgttggaggagagattggtattgccattgtctag

SEQ ID NO: 90432 - DNA, 285 bp, Glycine max
  Peptide Sequence Number=SeqID_182117
atgtctcaagaagttgatatggattatgaaaatgaacaagaatgtggtgtgaatcaaccacatgttgattgttcagatgtttataatactttggaggtctttggtacccgagatgatgttttgcatagaggaagaagttcatttgtgttaattggctatgaaaggagcggtcagtataagtgtaggaagaaagaattttttagaagagacactgagagtaggaaatgtggttgttccttcaagcttcgtgggaaaccagagactggaggtcccgttggatggtga

SEQ ID NO: 90433 - DNA, 183 bp, Glycine max
  Peptide Sequence Number=SeqID_182118
atgctaatagagctccatgtggagcttgtaggccttggatcttcttcatcaatggattcctttgcctcttggaagatgaatggcagcaaaatggagaaggaagatgattggagacgccacttcaaggagaagataagtcaagaagaagctcaccaccatagaaaaccatggataagagcttga

SEQ ID NO: 90434 - DNA, 128 bp, Glycine max
  Peptide Sequence Number=SeqID_182119
atgaagcagctcgacgaagacaaccacagtagagaacaaatccagtctcgtatgcaatggtggcggcgagaaacaccaggaactcagggcaaaggtggacacaagacaatgagcttacagtcgcaaag

SEQ ID NO: 90435 - DNA, 405 bp, Glycine max
  Peptide Sequence Number=SeqID_182120
atggaaatggtggtgtgtggcactgacgtggaccatttggaagcaaagaaacgacattatattctcaaatgcaagatacaacccatttggtgggacactctgacatggctgcacattaaaggtgctttcccattaagcccaaagcagcatttccttcaacatttgggtgttcaacttgatggagtaaggatgaacagatggcaatactggtggttagccttaacgtggtccatttggaagcttaaaaacagtatagtgttctctaatgccactttcaatgctaatgcactgtttgaagaggcgacattcctactgtggtcttggctaaggggttttgagaaaggtttcacagtccatttcaatcaatgggcaagcagttttacacaaagctttttgtatcagtag

SEQ ID NO: 90436 - DNA, 255 bp, Glycine max
  Peptide Sequence Number=SeqID_182121
atggctgaggcacactctatctctactcctatggttacaaactgtaaattgtccaaacatggagctgatttatttcatgatccaactctctataggtcagtagtgggtgccctgcagtatgctacccttactagacctgagattagttatgttgttaataagacgttccacatcaagagcagctatctttcttggctcaaacttgatatcctggtggtccaggaagcagaaagtcatggcatggtccagcactga

SEQ ID NO: 90437 - DNA, 936 bp, Glycine max
  Peptide Sequence Number=SeqID_182122
atggcttctgcaaacaacaattcttctccgtcaccacctatgccgcctgtttcgacaccggcactgtgctcccctgccttgttctcgcatgatgtaacggcgaaactcatggattccaattaccttttatggtgttctcaggttcaacctgtaatcatcggccatgatcacgagaacaacatcgttagtgctgcctatcgtttctgggagcaagaggatcaatttttcctctcttggcttcaatcgactatttcagaagcagttcttccttgcatcatcaattgcgcaacctcgtggcatctgtgggatcaattgcatgagcactttcaatccattgcaagtgcaaagaagaagcaatcacatagtgattttctaagtttggacgatgtcacttccatgccactggctgaggaatctagcattgaaaagtctcgcaagaagaatttgggctcattgaatcttgtcgagggttcgaattccaattctacttctgaagctcaagttcatctaactcagggtaacacacactcctcctcaaactatgattttgtgtctgagggaggggtgatggtggccattcgtacggtcgaggtggagctcgtgggagagggcgtggcagagcatggcagatttgctcatctactcctccaagccctcttaaccaattcccaaaccaattaccaatccaattaccctaaacaaaatcccaattcaccctatccttactcaccttatcccttttacccatacttccctttcatgccaccatttggcttcccatctccaccgcaagatcactctcctaaacccaattgtaactcacctcctcaagtcaatgtagccaatgcttctaacacctcatcaaacagctggtatccagattctggagcatctcaccatgtctcccaaaaatattcagcaagtcactccttttga

SEQ ID NO: 90438 - DNA, 147 bp, Glycine max
  Peptide Sequence Number=SeqID_182123
atggttttgagagcaactggaggaggagttctagggagcaccaaaaacaccatcattgctaatggagaacgcttgaatgactaccttgaggtaagggatgagttactacacttgggaattagaatgaacacgtgtagggatcactag

SEQ ID NO: 90439 - DNA, 246 bp, Glycine max
  Peptide Sequence Number=SeqID_182124
atgaagaagtatgataaaggcaaagggtcactaaagatcaatgacgactctttgcaaatccagaagaagggattccttaccatccaaatcataagctcaaatgagaagttcatcttcatggaaaatagagtgaaagctccagtggaagcagtcgagacttattgtttaaaactcaacatggaacatcatttagatttactgaaaactctttatgtcgcatttctagagaaaggatggaaagattaa

SEQ ID NO: 90440 - DNA, 336 bp, Glycine max
  Peptide Sequence Number=SeqID_182125
atgacagtgactgggtttggctccatcttaggaaggataaattccctactaaaaggaaattcgagcttagccctagaggggatggacctttttaggttttggagaggatcaatagcaatgcctataggttggacctcccagaagagtggagctgatattgaggaggaggaattaacagatttgaggtcaaatcctcttcaaggggaaggggatgatgcaatcctccctaggaaaggaccagtcactagagccatgagcaagaggctccaagaggattgggctagagctgttgaagaaggccctaaggttctcatgaaccttagggtagatttctga

SEQ ID NO: 90441 - DNA, 420 bp, Glycine max
  Peptide Sequence Number=SeqID_182126
atggtggaggtatttgaggtggcggtcgatggtgcattcgacggtggtggcacgatgtggtcgacgatggtagcatggtggtggtggtttccgtcggagaaggggagaaggagaagaaagggaagggaaataaggtttgatgacgtgacactctgtctatcacgtcattacttaatagaaatgactatggctctagcatcagatggagatggtgcagcaacattcatgtctgaattgggaaagaatggtaattcacatgcaaaatgggataagatctgtgacaaattcgaaacctattgcgaccgaggtgttgttgctcttattgtctctttcgttggcttcattctcctcctcattatttcagtcatgtccatcatcaagctgctcaagccaaatcgcatcaaccacgcttctccataa

SEQ ID NO: 90442 - DNA, 636 bp, Glycine max
  Peptide Sequence Number=SeqID_182127
atgggggtttgggagggtgatgtttgggtttggaggtgggagtggaggagggaatggttcatgtgggaaagggacatggtgaataggtggtcgatgatgctaaatggagtgagcttaaggaggtattcagaggatgagtgggtgcggaagcttaagatccctcccaaggctgcatttatgatatggaggctgcttcaaaataaactgcctacagctgataacttgggcaaaaggaatgtgatacactatggaaatggagtttcatatgattgggtttggaagtggctcttcaatccaatcctagcacattttcttcaacatgattttcgtgatgcatatggaatggatagaaatgcttggtcggtgatcctggtatattctttaagagaattggctttgcagggtaatacctggagggaaagtggtattagtggagggtacgaagttgatgcatgggttcgcatgctgttgcagggggcagcaaaagtcttgggagttagtttgtttgttatgatatttgagcacatagtaatctgtaatatgcagctacacgacatgtgtattagtattggtcgaatgggatctgtaatatgcaagtggttagatgatacttatgcagatttggtgcataaataa

SEQ ID NO: 90443 - DNA, 156 bp, Glycine max
  Peptide Sequence Number=SeqID_182128
atgaagtccaaaggcgcacttagcacgaaagcccgtgctaaacgtgaagtcaggggaccaatcactagagccatgagcaagaggctccaaaaggattgggctagagctgttgaagaaggacctatgattctcatgaacctcagggtagatttatga

SEQ ID NO: 90444 - DNA, 816 bp, Glycine max
  Peptide Sequence Number=SeqID_182129
atggacaagcgctcctgggtacggggccaatggatcccatatgacacagatgctatcaaccaattcttggggcatccattggtcttagaagagggacaacgatgcaagtacgctgagagaagaagtaagttttcaggttttgatgaagaggccatatgtcagctacttttctccacgagacatgattttgcacggagcgtagcagggaggtgggtgcgaatcatgtgcactagcatgaccactctgactcaaatttggatgacactcctgctcagtaacatctttcccagtgaccataactctgatatcctgctacccaaatgtcagttggtctacagcatcatggcccagatcagtgttcatgtggcgcagcttatctcagatgtcatccaccagttcgtaggtattgcatctctgagacacctagtggacccagagaattccaataaggcactgggatttctggcattgatcgcaagtctctgccaattctacgtggtatcggtcgcgctgacaaagctcatccagcctcccattaacatgtcctttattgagaaatattgcatgccaaggcaagcacagcagtcggccgcagacgcaccagcaccacctccgcatcaaccaccatctctagagtccatcttagctcacatgcagaggatggagcttcagatgcacgcatacatgcaacatttggcttatcaacaagcagccaatcataggggccagatgcaattgaatgacagtttctatcagtatacattgcaccaacatcgcgaggaccctaacccttacccgtggcctactctcgagtag

SEQ ID NO: 90445 - DNA, 426 bp, Glycine max
  Peptide Sequence Number=SeqID_182130
atgtgcttgatgtatctaggggcgttgcacgatgtagaaagatgcccaataattgaggagttgctgcagggactgataagtagggatattaccactcagatacctcaaggtttccagccctatgtagcaaagacgccaacacccttcccttataaaagtgacaacgcagtaccgtggaggtatgacatgcaaggatccgacggaaggcaagatgcgtctgtcatgcatgttgggactgggatgtcggctgctaagatcatgaatattttcagtatgagcagcatgactcatagtggatgtgttttcgctcctcccaaactaccagcaaggtcgaaggacaaggggaaggcaaaggcaactatgggcaagaggcagaaaatgggcctgaccgcgaataacgaggcctatatcggaaagtttgcatag

SEQ ID NO: 90446 - DNA, 1196 bp, Glycine max
  Peptide Sequence Number=SeqID_182131
atggggtcggaccaagggtcgtcttttaagaaaaggttctatcatgtcaaagtcaaaaatctagaagtagccagcttgcgaaaactgggtcagcagatgggtcaagttcaacgtcaggcttttagcaaggactttcaattagccccaaccatagaggagttcgaagggatcttaggatgcccgaaaggaggaaggaaaccatacctttttctggcgggaataccaaggaagtgcttggagaagacgaaaactctggcaagccaaggggagtgggtatcattcatcaacatattagcactgctagtgtttgggacagttctatttccaaatgtagacgggctggtggatctagcagcgattgacgcttttcttgcttatcaccacagcaaggaaagctcggtcattgctattttagcagatgcgcatgatacattcaacttgagatgtgagaagagcagtgcgaggattgtttgttgcatgacgggagtgtccattagttggtttccacggtggaaagaaggaagggcaaaagtgttatgctcatgtgaaggacttccaaatgtccctttgatagggacgaggggtttcaatgaagctaatacgaagatgcttcagaggatccgtaaggcatggaataaagtggaaagaaaagataaagaacttaagggaagtagcaatggtatcataggcgactattacaagtggttgaaatctagaatgaaagggatgatttggctccaaaagataaagggtctgaataggaagaggctgaaatgcctgaggagaatgaagaggaaagaatgtgatgagctgaaagatatcaacatgatcgcggatgaaacgctagagcgggaaactaatgagctcaaacttagaaaggttgagagggacaaatcaaggatggaaagcacgatgttagaggataagttaaagagttatcagaggttgaagagaagtttgatagagcagttgagcaagatggaagagaatatgttgataatcattggtcaatataaagagaaagtgaacctagctgccaatcacgggcagatgctggaagaagaacaagcgaaggtgttggccttgtggattgaaagggaagcaagagaaggggtgatagagttattgcataaagaagccatgaaattgatggatagatttgctctcactttgaatgagagtcaagagcttccaag

SEQ ID NO: 90447 - DNA, 478 bp, Glycine max
  Peptide Sequence Number=SeqID_182132
atggacaagcgctcctgggtacggggccaatggatcccatatgacacagatgctatcaaccaattcttggggcatccattggtcttagaagagggacaacgatgcaagtacgctgagagaagaagtaagttttcaggttttgatgaagaggccatatgtcagctacttttctccacgagacatgattttgcacggagcgtagcagggaggtgggtgcgaatcatgtgcactagcatgaccactctgactcaaatttggatgacactcctgctcagtaacatctttcccagtgaccataactctgatatcctgctacccaaatgtcagttggtctacagcatcatggcccagatcagtgttcatgtggcgcagcttatctcagatgtcatccaccagttcgtaggtattgcatctctgagacacctagtggacccagagaattccattaaggcactgggatttctggcattgatcgcaa

SEQ ID NO: 90448 - DNA, 331 bp, Glycine max
  Peptide Sequence Number=SeqID_182133
atggctaacgatagaaacaaatctgattccaatagctcttactctcttcaccattccgatcatcctggaatgggcaatgaagcatctctatcagctgctcccaaggcaaataatgtcaatttttcttcaggtttgtccgcacccaagttgataattgatagtggtgcaacaaaccacataacttctccatctctacttgtcaacagtgaagaaaacacttctttaccaccagttattatgccaaatggagatcaagctccaattatttctactggaaatttacctttgagtcctattatttgtttgaagaatgtacctggggtaccatctt

SEQ ID NO: 90449 - DNA, 311 bp, Glycine max
  Peptide Sequence Number=SeqID_182134
cttgcgcttatctgctgcaccttgtcggttgtactctttttgctaataagagtgcaacatacgtgcatgtggttcaccttgacgctttccgggacctcactcacagtggtggttacgcttggggagttgccgcactggttcatatgtatgaccagttagatgaggcttgtaggacccccacccgacagcttgcggggtacttgacgctacttcagtgctggatctatgagcactgcctgacgatcgcgagagggggactcattgctgatgggactgtcagggctcgtcagagacgccgcacggaccattga

SEQ ID NO: 90450 - DNA, 453 bp, Glycine max
  Peptide Sequence Number=SeqID_182135
atgaacaaacagcaccacgcttggagatgtggtcccacaaggatgcgtagacctaggcaagactcatggggtgcggttgcacttgagaagcgagatcatagcaggaagtgtggcaggaaaggatggcgcatgtgctgccacgcaccagcaaagggtgctgtttggcgcatcaaaggggccacacatgggggctcctacgccaacatggctcgttggaagatgggtgacgagcagacaggtccaccgggacaatggatcaccgaaaaagtgacgatagccgatgatgaccggaaaactttccaggaaaggagaaaagggtcgtggcaaagcggaagcaagtgtggcgagtataaagatctatcgaggacagctggtcctcgatgggctgtcctcagtgggggacggttttctttactccctcaacctggctctgataccatgttaagaaaatga

SEQ ID NO: 90451 - DNA, 852 bp, Glycine max
  Peptide Sequence Number=SeqID_182136
atgcgtttacaagccaatgcccaatcagttgataatcaagaaactgctagatttgcaaagtggattctagatattggagatggagttattgggaatgaaaatgatgaatatgctacagttgaaattcctgagtacctactgattactgaatataatgacccaattgatgctatagttaggtcaacattcccaaatttatatcaacaccacagtaatcctgaattcttcaaatgtagagcaatattggcttccaccaatgaaacagttgaagagatgaaaaatcccattatcgggccgccgttgatcatccaatttatcgctgccttcaacaacgacaaaaacatcatacaacttccagcgttctaccatacacaatgggcaccacaggatcccgagtctgttcacctgagatatgatggagccatctacgaaatacaagtcagacgacacaaagaaagagtctatttggcaaatggactcgaaaacttcaggaaagaattgaaaatctacgagtcaaccaccattaacttttttgcctatgaccatcagtgcgtgtttgacatacacttcataccaccactggagtggcaaacttgtggcaggcagaggtattcatccagaaagcatatgtggactgtttggtttactcaggaaatgctcgatgctcctgaacccctgaaactcccgctttgtacacaagttcctcttaatgcttgtggtcaccacatgacagtcttaaggcgatttggtcctccattgcaatggaaagttgaaaccctgaatcctggtattggtggaaaatgcgttgttcaaccatggcagaatgattgggacgatagtaacactgattaa

SEQ ID NO: 90452 - DNA, 417 bp, Glycine max
  Peptide Sequence Number=SeqID_182137
atggcacgtgttcgtgataagattaagtcgatagatggatcaagggaaactcttaagctttctgtaaggatcactgatctttggttcattgggatccttgaaaagtctgaacaagccaaaatggttattgttgattctgatgtgctatcctgcacactctgggaaaattactgcttacagtttttatcttacttgaatgaggttgaagatgaaaggcccatcattattcttttgacacatgtcaggctcaaggaaggccaaggatcatatccaccctcagttagtaattctttgaaggtgtctaaactaatgatcaacgagcttgtgttggaaattcaagaattcagagagaggctttcagatttagggattaaggtcagatcagttttgatgcctattggacaagggagttcatag

SEQ ID NO: 90453 - DNA, 252 bp, Glycine max
  Peptide Sequence Number=SeqID_182138
atggatccaaaagcttggtggctaattcatggcattaatgctccaatacttcaaaaggttgcccttaagctacttgcgcaaccttgttcatcttcatgttgtgaaaggaattggaatgattttggatcacttgatgattgtggtattcttgaaattgctagtttgtctttagatgaaccagagttagagggtgtctttttcaatgatgatgatcacctaggggtgaaaggccttagattatggaattcttga

SEQ ID NO: 90454 - DNA, 2550 bp, Glycine max
  Peptide Sequence Number=SeqID_182139
atggggaacatttatgtggcacatttggtggtggtggtggtggtgttttgctttttgccatgcttgtgtcaaggtgattcagatgatgctactacctctgatgtgtatgttgttactctgagacatgctcctgtttctcattactatggtgggttgagaagagaggttaatggcttcaaagatgctgctgctgcacctggcagaactcaatttaacaaaccaagaaggtatggcaatattactaagacagataagagatatggctcttacatttctcgggttcatgattctttgttgaagaaagtgttaaatggagagaaatatctgaagctctatagctaccattacctgataaatggattcgcggtgctggttacccaacaacaggcagagaaactatcaaggagtagtgaagtgtccaatgtggttttggatttttctgtaaggactgcgactacgcatacaccacagtttttgggtctgccacagggagcatggtttcaagatggtgggtttgagactgctggagaaggagttgttatagggttcgttgacaccggcatagatccaacacatcctagttttgatgataacaaatatgaaaagccgtatcccgttcctgctcatttttctggcatctgtgaggttactcgcgactttccatctggttcttgcaataggaagcttgttggggcccgtcattttgcagcttctgccataaccagaggaatatttaattcgactcaggactatgcttctccctttgatggtgatggccatggaacgcacacagcatctgttgcagcaggaaaccatgggattccagtgattgttgctggacatcactttgggaatgctagcgggatggctcctcgttcacacattgctgtttacaaggcactatacaaaagctttggaggatttgctgcagatgttgttgcagctattgaccaggcagctcaggatggggttgacataataagcttgtctattactcccaatagacgtcctcctggtgttgcaaccttcttcaacccaatagacatggctttgctgtcagctgtgaagcaaggtatttttgtagttcaagcagcaggaaatactggaccatcaccaacaagcatgttctccttcagtccatggatctatactgttggtgctgcctctcatgaccgggtttatagcaactccatatttcttggaaataatgtgaccatacctggagttggtcttgcacctggcacagatgaaagcaaactttataaactgattcatgcacatcatgctttgagcaatgacaccacagttgctgatgatatgtatgttggtgagtgccaagatgcatataagttcaataagagtttgatcaagggaaacctcttgatgtgcagctattcaattcgatttgtgctgggactctccaccatcaaacgggcctcagaaacagccaaaaacctgagtgcagctggtgttgtgttctatatggatccctttgtgattggttttcagcttaaccctgttccaatgaaaatgcctggcataataattgcttccacaaatgattccaaggttttaacgcaatactacaattcttcgttggaaatagatgcagtttcaaagaaaattgttaaatttggggctgttgccactatctgcggtggactgaaaccaaactacagcaatgttgccccaaaggttatgtattactctgccagaggaccagatccagaggacagtcttcctcacgaagctgacattttgaaacctaacctgttagctccgggaaattttatatgggctgcttggagttctgttggcactgattcagttgaattcctaggtgagaattttgcattgatgtctggcacaagcatggctgcaccacatgttgctggtcttgctgcactaattaggcaaaagttccccaatttcagtcctgcagctattggatctgctctttctactacagcctctctgtatgacaagagtggtgggccaataatggctcagcgatcatatgcctctccagatcaaaaccagcctccggcaactccttttgacatgggaagtggttttgtgaatgcaagtggagcactgaatccgggtttggtttttgattctggttatgatgattacatgtcatttctatgtggaatcaacggttcagctcccgtggtgctaaactacacgggccaaaattgcgcgctctataacttgactgtctatggtcctgatctgaacctgccctcaatcactatatcaaagctgaaccaatccagaatagtgcagaggacagtccaaaacattgctcaaaatgaatcttacagtgttggttggactgctcctaatggggtttcagtgaaagtgtctccaactcacttctgtattggcagtggtgagaggcaggtcttgtctgtgctcttgaatgcaacccttagcagctctgtggccagctttgggagaattgggctgtttgggaatcaaggtcatgtggtcaacattccactttcagtcatggttaaaatctcatctaacactactactagctaa

SEQ ID NO: 90455 - DNA, 636 bp, Glycine max
  Peptide Sequence Number=SeqID_182140
atgcaaaacagtggggttagtcttatgaccgaatcccaacactttgctactgtacatgatgacaatctcaatttgacgtccatgccttactttggacatcaggatgtgcagactattgccattgggcgaccaaagcactttggtcgtgttcatgctgctggagtcgccagatgcagttgtagatacaatcccaagggctcgtgttgcttactgagcctgagttgtgtcgatccctcagggcaggacccagacatgggtgaatcagacaaatgtgggttgtatgttgatgacaatcctccccgcctggttgcccttggaagagtttatgaggagtccacaaccgtccacaatgtccctttaggcaataatcaagtgaaggttgttgttgaggaagttcaagatgctaatgcctacatccttgtacacactcaagaggataaacagggagctgagggactggcaaaacctgtagataggtcggaacctgatgacgatcccctataccagatggcattgacaatcttgcagcttttcctcaagactttgcaagtgtcatgggatgcaactatgtttggggtgtataatgataacttcccattgtacataaagcatgaagatctttttactttattttaa

SEQ ID NO: 90456 - DNA, 309 bp, Glycine max
  Peptide Sequence Number=SeqID_182141
atgctggctattggtaatcgattactaccttctggtaatcgattaccagagagtaaaactctttggctaacggcggtcctgaaggtgacgacgctttgcccatgcaagggttgcaacaataggattcacagggcgttgttgaagaataaagatatcgtgagcaatttgcagaactgcagctatgagcctcaatttgtagatccttttgttgatgcaaatactgatgactcaggtgttgggtcaaaggagcatatgcatcagcgaattggtaggaaaagcttgacaaccattcagattatgagattatga

SEQ ID NO: 90457 - DNA, 123 bp, Glycine max
  Peptide Sequence Number=SeqID_182142
atggcggaagacgaagctaagatggtttgtctaggtaaagagagggcaagagacagagctgagatggagaggaagagagcgcaagagagttcaacatctgttttcactaaaaaccaatgttaa

SEQ ID NO: 90458 - DNA, 693 bp, Glycine max
  Peptide Sequence Number=SeqID_182143
atggcaagtagaaacgaaaatgtccctactgtagtctactacgatgcctatgtagctgactgtgacgatggcgtagaatttaagggcgaaaataatgctattaccatcactgacgatgaggatattgatggcatgtttgatgtctataaccgacatcaatgcttaagtggatttcagttgctcatacaatatgaacaacaaccttcttctaccaccaatgttgaaacaaccattcaatcatcacaaattcacgaaacaccatacactaactaccatactcaaacctatcatgaaggcccatcttcttacacatcaatcccatacatgccacaaatgattattacatccctcattttgaacccactgaatttgatacccatattagcttatacacacaactgtttattggatcgtcaaactacttctcaaagcaacgaaatttcacatgactatcatgctcaaaatgggttgccagatgaagtagttggtgactttagtgacgacaaagatgaaattttgttatacaacaacaacatcaacgacaacgatgataatgacatatacttccttttccaaccaacatcaattgaaaatgtctatcatccatatccaaatagcgctgatgttggtgacaaccaagtggctgacaaccccaactataggcatttttttggaccaacaacaacaatttga

SEQ ID NO: 90459 - DNA, 579 bp, Glycine max
  Peptide Sequence Number=SeqID_182144
atgcccacacagtccaccatacatgttttgctttcttacagagagagaatgagaggtgagaaaggaggggaaaggggaaggggggagtataagaacctaaacagagttaggaacgaacacagggaccatactagctattacttcacaaatttcccagagagccacaatgaggaagatttctggaagacttttatgagatggggtaagcctagattttcaagaccaacaacatatggtaaaatcagaactatcgagagcgataaaaagaagaattgggctgagtataatattgaacttttacagaaaattttggtgggaagattgaagaaaccaaaggagatttacaacaataatgagatattacttatggaaggggtgtgttcactcaagatgagatatataggtgacaacctggttctgcttactgcgatggatcgagaagacattgtagacgtcattaagaaacctgaagaatggttgacagatttgtttgaaatcattggcccatgggacgtaaaggccactccggctaatcgcttgacatggctaagaatctctggagagcaaggagtgctttga

SEQ ID NO: 90460 - DNA, 267 bp, Glycine max
  Peptide Sequence Number=SeqID_182145
atgatttttcactctcctcctctccaaacgcccacccaaaccctaacaccttcttctccaccactgatgagcatcggtggtcaccataagtcaccattgcttgctgccgaaccaccacaccaagaggaacgttttaatcagagcagaatccttaaaatccaattcaaggattcgatggagaaaaatcccttaaatcctttctttcatagcttctctgagggtgcttttatagttcctttgaaaacccttgaaaatgagacgttgtaa

SEQ ID NO: 90461 - DNA, 105 bp, Glycine max
  Peptide Sequence Number=SeqID_182146
atggtgaaggtggtggtgacaaccatggaggagatggttttcaaagtggttagtaagagatggaagtctcgtgcacctgagattgggccatgtgggcttgtgtag

SEQ ID NO: 90462 - DNA, 3408 bp, Glycine max
  Peptide Sequence Number=SeqID_182147
atggagtctcaattagaggggaaaaaccagtatttgtatggacctgtggtgcctgagatgaagagtgttgggaagagaagtttggagtgggatttgaatgattggaagtgggatggggatctttttactgctaggcaactgaattcagtgccatcagattgtaggagccgcgagttatttcctactgatcctgaaattcttgcaaccggcggtgcttctaacagtttgtcttctgcatatgatgatgctaacctcggggaaggaaagagagaattggagaagaggaggaggggtgttaatgacgatggaggggtggagatgaatgatggagctggttctcttaatttgaaccttgggggtcaagtataccctatcatggaaggggaggagaaaagtggaaagaagacaaagatgaccgcgagtacttcgagccgggctgtttgtcaggtggaagattgtagggctgatcttagtaatgcgaaggattaccatcgccgccacaaagtttgtgatatgcattctaaggctacccaggcactagttggaaatgttatgcagagattctgtcaacagtgtagcaggtttcatgttcttcaagaatttgatgaagggaagagaagctgtcgtaggcgtctggcaggccacaataaaaggaggaggaaaacacttcctgatgcaactgtagttaatggaggctctctgaatgaagaaaagggcagtagctatctgttaatgagtttgctaaggatactgtccaatatgcattcaaatggctcggataatatgaggaaccaggatgttctatcacatcttttgaggaacctggcaagtctggctggtacaattaatggaagaaatatagtgtctttattagagggatctcaaggtttggtaaaagctgggacatctggagctgcgcagaatgttcctaacacaaattctgatggccctgaaccatccagacctttcgattcttttatcaaaatggatgatggtctaatccatcgggaccctccagagtctatggtacaacgtgagacgactcctgctaatgatatggctaaaaaatgtatagcttcaggcagtgatggagtaggaagtttaaaatctccttcagtaccgcagtcctcaaatgtacttctgtcaagggatggccttccaccccaatcagttgcagcacagactacagttggaagaattgggttaagtaatattgacctgaataatgtatatgatgatgtacaggattatgttgagaacacgaggaattcttgtcctcctctgccttcagggaatgggtctcttgatcatcctttatggatccaatgtgactctctcaagtcaagtccaccacagacaagtagaaactcagattcaacctctacccagtcaccatctagttctagtggagaagctcagagtcgtacagatcgaattgttttcaaactatttggcaaggctccaaatgatttcccccatgctctccgatcacagatccttaactggttatcccacagtcccacagagatagagagctatataaggccaggctgtatcatattgactatatatctccgtctagaaaattccgcttgggaagagctatgctacaatctagaatccagcttgagaaagcttgctgcgccaaatgattctttctggagaacaggatggatatatacaagagtgcagcactctgtagcttttctgtataatggtcaggtggtcttagatgcaccattgcgcctcaaaagtccgcaaaattgtcaaattttatgcgttaaaccacttgctgtttctgcaagttcaagtgctcaatttgttgtgaaaggattcaattttttgctgtctaacacgaggaacaagtacatctttaacaacaaggaatttcgaggggaaacagtcctggataatgcgatgttcgtcatttggtcgtggctgaaggcactggaaaagggttttaatgtcccattccaaggtgaagagagggagggagggataggtcgtgggtttgaatcctcccgctcttcgctatgcgaaggtatgggggagggatgttgtacgcagccttacccttgcatatgcaaagaggctgtttccggattcgaacccatgaccaacaagtcaccaaggcacaactttaccgctgcaccagggttcgccctcaaaaacttgctatgcgaagggaagtatctggtacaagatagttgttatgatttgattgacagtgctgatgcagtcaatggacatcaagagcttcagcatctcagtttctcttgtcatgtaccgaatgtgactggaagagggtttattgaggtggtggaagacaatggtcttagcagctgttcctttccattcatagtggcagagcaagaaatttgtttagagatctgtacgctagacaatgtcattgaggcagcagagatggctgatgacaaccagataaaaactaacctaatggaagaaaagactcaagcattgtatttcatacaagaaatgggttggctccttcatagaagtcgtgtgaaagttaggctaggtcccatggcacctgtccaagatcgcttccattttaatcggttcatatggcttgttggcttctctatggaccatgactggtgtgctgtgatgaaaaagctcttgaacattatctttgagggcactgttgatactggagatcatgcctctgttgagttagctttgttagagatgggtcttctacacaaagctgtaaaaagaaattgtcggcctatggtggaaatactattaaaatttgtgccagttaaagcttcagatggtggagacagtaatgagaagcaagtcaacaagtcccctgacagattcatattcagacctgatactgttgggcctgttgggttgactccccttcatgttgcagcaagtatgcatggttcggagaatgtattggatgcattaactgatgatccaggaatggtgggaactgaggcatggaaaagtgctcaggatgctacaggtttgaccccctatgactatgcatccatgcggggctactactcttacattcaacttgtccagagtaaaacaagcaacacatgcaaaagccaacacgtgcttgatatcccaggcacccttgtagatagtaacacaaagcagaagcaatcagataggcacagatcatcaaaagtttcaagtttgcagactgagaagattgaaacaacagcaatgccacgtcgttgtgggctatgccagcaaaagctggcgtacggtggcatgagaagggcactggtttataggccagcaatgctgtcaatggtggccattgcagccgtgtgtgtctgtgtggctttgctcttcaaaagttcacccaaagtttactatgtattccagccattcagctgggaatcattggagtatgggtcaatctaa

SEQ ID NO: 90463 - DNA, 315 bp, Glycine max
  Peptide Sequence Number=SeqID_182148
atggctataatggacaaacgtgtgaaacgtttatgtcctaaggatgttgtatcagtaaaagtggcttggagaggaccagctggtgaggagatgacttgggaactagaaaccattatgcgtgagaagtaccctcacttgtttgagactcaagtaactcacccctctctaaaaccctatctcatcttcccccaaaatttcatctcccaatctttcagtcatctccttccattgttccgaaaagctttcgcatccttgggtctttccaagtacaagaaggtgaccggagaaaaagcggaacactactcatttccttag

SEQ ID NO: 90464 - DNA, 459 bp, Glycine max
  Peptide Sequence Number=SeqID_182149
atggcggaggttccattaagtgcattcacaaagcttaatccaccgactttcagaggctcaaacattcatgaggaccctcagacctttgtagatgaggtgttgtggatatgtccaggtttaggttgttcccctacttggatggtccagtttgcagcttttcgtttgcgtgatgtaacgaggggatggtatgagactatgcttcttgcaagactagcaggatcacctcctttagcatgggatgagtgttcggcttccggcaagtgcaccggatcacacaagactttagagttagaccagtttccactgttgaatgaccctaacaaagcatgcatctacgtgatcaaggatctcacaatcactaacaaactcatctcaagctctcaaaccggctcctgcttcaagctctggtctttgcagatcttcacacaacaaaatctctcaaaactctctagaacttag

SEQ ID NO: 90465 - DNA, 117 bp, Glycine max
  Peptide Sequence Number=SeqID_182150
atggcactaaccaggccctgttgtggtgcagttggagggaagtggagaacacaagatgaggcacatgaaattctgagaggcaagtggtgggtttatctgaaagtcatccttaattaa

SEQ ID NO: 90466 - DNA, 888 bp, Glycine max
  Peptide Sequence Number=SeqID_182151
atggcattgcgttccgctatcaccctaataatcatcttcatactttcttccttccatgtcgttggaattcaaatcatctccaaatcgaagctggagaagtgcgagaagaactccaattccgaggacaatctcaattgtactaccaaaatcgtactcaacatggctgttcccagtggctcgagtggtggagaggcgtcaattgttgcggaattggtggaagtggaggaaaattcaagcaggaaaatgcagacattgcgtattcctcctgtcataacggtcaacaaaacttctgcatatgccttgtatcagttaacatacatacgagatgttccttataaacctgaagagtattatgttaagacacgcaaatgcgagccagatgctggtgcaaatgtcgtgaagatatgtgaaaggcaagccatactgcgggatgaagagggtcatattatcgagtacactcagccaatatgttgtccatgtggaccccagaggcggatgccttcatcatgtggaaacttctgtaagtgctttgatgttgcaacattctttgacaaattgacaaaaggaaaggccaacactgcacattgtgtgcgtttccctggtgattggtttcatgtttttggcattgggcggcgaacattgggatttagtgttcgaatacaggtgaagagtggaactaaagtttcggaagtgtttgtgggtcctgaaaacagaacagtgatctctgatgataaatttttgagggttaatcttattggagattttgttgggtatacaaatataccatcttttgaggatttctatctggtcgtaccaaggcagcttggagggcagccctgggcaaccacaggatttggggagaaacatttctatgtggatgctgcttga

SEQ ID NO: 90467 - DNA, 570 bp, Glycine max
  Peptide Sequence Number=SeqID_182152
atggcaaagctgctggagaaagaccctccactcacatatgaaagcaataaattgtggaaccaaattgttgaaaaaaggtatatctttgacttgtcaaagaaggaagcagaagaattgaagaacataagtaagcatgatgttgttgaatggtacaagacttacttaaaatcatcatctccaaagtgtcaacaactacttattcgactatggggttgcaacacagacttgaaagaagttgaagcgctacccaaatctgtgcagcttgaaagatatcattggagagtgaggagagatgagatagcaagggaagatggacagagattaggagtgatagagaaaagagtagaaatagatggtcaagtcaaatttccaccagattctgtagcagaaattccaggagctaactctgactactatgaaacattttttggccaattccaaaatcaaggacctctaggtgatttggaatgggtacgagtagtgttgatagtcgatcttagggttagattagaagatattcaggatcaagcaccgcatcggaggaacgaacatcgctgtgttggagagtga

SEQ ID NO: 90468 - DNA, 657 bp, Glycine max
  Peptide Sequence Number=SeqID_182153
atgatttttaacaagcacgacataagagtatgttactacaaacattgcaatgaaattattaccaatgcatatgaaaaatgggatacattgtacatgtgcacaggcttcaataagaagtctccctatccacttgttgtgcttcaaacagaaaaaagtttggtcttcaacagaatagtgatgaacctgatttggcagaagcagaactggatgacagtctttgtctccttgctttatcagctttttgcaagtaatgttgatgagattggtgtttggtccttgcaaggaggtcccactggtgtggaacttgctggagcaaggcttctggaattcgtaggggcaaaagccggggataacactctaaattggttgaaatcaaagaatgttgtggtcaaactagagcaatcagttgacttgaacgcattcacagatggacagaagatatatcaaacttcaaatggagagaccattgaggcagattgtcatttcttatgtgtagggaaaccacttgcttcagcatggcttaaggaaactgtgttgaagaatgacttggatggtcaacgtaggatcaaggtagatgaaagattgagggtcaagggctggaacaacatttttgcaattggagatgttacagacattccagtaagtgcttgccattag

SEQ ID NO: 90469 - DNA, 1446 bp, Glycine max
  Peptide Sequence Number=SeqID_182154
atggagttgatataccttttgagggattgggtgcaaagacattggaggaaattaaaagatctaaacatattggccattgacttagaaaagatttatgatagggagtcttgtggaaggcatgggagaataggggagttcgtgttgcttacattcaggccatatgttgccaatgatatgtatgatgaggacttgtccaaagagccggttcagaatctggtttcagctttagcaggactccaaaggcgggttgacaaggctgatgcaattgtggagcaattaggaaccaatgatattgtttggtacaaagagaccaaatgggcagcagaatgtgcaaaagctcaagcagaagctgagctttccaatgctaaacagacagtgaaagatcttttctctatgattggggaatctatgtacaaggcaaaagccgaaatgcgagacatggcaccactaaagaagtatgtcaaaccgagaaacgatgataatcagtattcacaagttatgacagaattggaacatgctaagcgggaatttttccaacttaagcttcatgtgggttctgttttggaggagaaattgcaagcggagaacgaagtcaaagcatcgagatccagcatgttgtccttctcaagagtagcacaaaaactgacgaacgagattgaggaagccagtgaagaacaattggtggttcaattggacagaatggatgctttgaatgaacttagagacattgaacaacttcaaaacacaaggaacaaattgaaagaggccattcaagcgatagatgagacaaaagagctcgaaatgaaattggccacaacattgtctgatattgatatgttgaagaatgagttcaagtttgttaagaaaacggggaaaaggttacttcaaagaggtgtgttagagcctacaaaagaagaaatagaggcagcaaagaaagacttggcttccattacaaaacaagtttttaagtttatggcctctatggatgtcacaagaaatcaactgaagcatgtgagtgcagccacgattaatttaaagaacaaggaatcgaaaattggtgcaaaagttcgaaacctcagttacaagctcttgagagcaaaatctaaattagaagtcgtgtctgcagcagaggaaaaggccaaatcaatagtgagtaacttgacacaaactcttgataagctcaagtccaaaacagaagcagcaaaaaaagaaaaagaccttataataaatggagaggttgcagaaaccaaagaagagattataaaggccttgttggagataaagctacaagcagtgaaatcatcagaagctttagccttggagaagctcaagattcttagggagaatgccatgaaagacaaaattagtaatttccgtgactgcatcaaaaggctagacaagttccaaggcatgctgcccactgaatggcagaccttgtgcttctga

SEQ ID NO: 90470 - DNA, 528 bp, Glycine max
  Peptide Sequence Number=SeqID_182155
atggctctggatcgaagggttatagttggagcagctgaagctttacagaaggctcagctacaaaagtatgatgcagcaattcacttttgtgaacaaagtcagcatcttgcagaaacgaattttgtcttggcaaacaatacagcgaattctgatagttccttatgtgatagttactcaagtgtaaaattgtggaggcttgaagcatcacttaatgttcttgagaaattacagcaagttgtgtctgtcactgacaaacttgctgacattagcttctacaatacgggaacttctaaaggacaagggtctcactgggaaaaaaggcttcttatgaatgagattatgactggttctgtggatacaagatctgttgtttcaaaaatgacattaggtatattagaagatagtgggtggtacaaggtcaattgtagtatggcagatcatcttgattggggtcgcaaccaagggaaatacatttatgaagtgttcatgcttttcccaggtgtagaggctttgtacgaggttctatga

SEQ ID NO: 90471 - DNA, 225 bp, Glycine max
  Peptide Sequence Number=SeqID_182156
atggagtttaaagctgaaatattgcgagtatttgaaatgacagaccttggcctggtgtctttctttttggtaagtatgctttcaagatttatgcattgtgctagtgaagtgcaccttcaagctgtcaaacggattgtaagatatgtcaaggggactatagactatggtgtcaagtacacttactctcagaattttcagtttcatggttattctgacaatgattag

SEQ ID NO: 90472 - DNA, 297 bp, Glycine max
  Peptide Sequence Number=SeqID_182157
atggcgagtttagtggaggataagatgaagagtttggcaatggtggaggaggaggaagatgggtttgttttctgtactcaagccatgaaagctcatatggcagcgatttggaagccatgggaaggtgtgacgatcaaggatgtagaaagggtcaacttcctatttcaatttttccccaagttggacatgcaaagtatcaccaatggagtaccttggtatttcgataatcaactattgattctagataaacttaaacctaatgatgttcctgatcaagttaaactggggatcctctag

SEQ ID NO: 90473 - DNA, 264 bp, Glycine max
  Peptide Sequence Number=SeqID_182158
atggcagaacaaactaaacaagtattttatgttcaagatccttgtgatgaaaggtggccagtggttctatacagaaaaatcattggtgttaatcttaaagatgatgattcaacccttgattctcgtcacactcctttctccacacacatgcctaacaccaatgaagaagaagttgatgacgtccatgcaaatcataatgatcatgatgaaggagaattaattaacatcgcacgtggctacaccaccgagctcccctcctcctga

SEQ ID NO: 90474 - DNA, 375 bp, Glycine max
  Peptide Sequence Number=SeqID_182159
atggggggggggggggggcatagcttgcgggaaggggaaattgttgctgatggggaagaggaggatactggagctatggtgaagtcaacaactccccatatgttctgcaagactctcacaacttcaaacactagcactcatggtggattcttagttccctatcgagcagctgaagattgctttcctcccctgtatgtctcatgtggacttgagaatctaagacggttattggcagaaccgtcttacctaaaacactggagtttctcacaattcgtacacgcttgcaatgggagggtgctagactggcacattgcttcagcagtagagttgcttccaaagcaattgttaccatgcttattcgcttggccttattaa

SEQ ID NO: 90475 - DNA, 622 bp, Glycine max
  Peptide Sequence Number=SeqID_182160
tttcaccgatgcggggatcggagtcgccgaggacttggatttggatctagaggccttggtcgtagcaggagatggatctattgacctggccgagcacggaaaaggtgtcgccaagctgcatgtagccagagaaggcagcgagggcgtgatcggcatcgcgttcgacgtcgaggacttcaatagcgcattcgaggacggggacgactacttcaaagcgtccgaggctgcagtagatggcagcgaggacgtggaggctcatggcgaggtcgaggctgggctctccctcgacggtgcaacgctcgaaggacttggagacccggatggccaagtcaagggccttggagggcccatcgcccgaggcaatggtgtcgcaggccaacttaaggaggaatgggccgagatccgagttgttgagagaggcatcagagagaagcataggggtttctggagttttcttttaagaggagcgagaaggagatggggtgggtggttttttgggattggctgggtgtgtccgggacggagattcggaggggttgggagttcgatacgagatctggcaatggagggagtgggactagaaattagggtggagggaagctaccgtcaatggggaggatga

SEQ ID NO: 90476 - DNA, 360 bp, Glycine max
  Peptide Sequence Number=SeqID_182161
atggctattgaagaagaatataaagggatagagttttgtaatgatgaagtagtggcttgttgtcacaacattgttttaaggaatacagacccaactgctcatgcagaagtcactgctataagaaagcagttgaatgtttatgtgcaaattgcaattctttattcttgtactgttatgagaggttggtttatggagcgaaggcagaggcagcaattgctattggattcgatgactatgatttcagatgcattgcgaggtactggattctatcagaaagcacaattggagattaaaagggttgacagatgcattgctgaagaacttttccagaaaacaaaggaaaaattccgaatgttttga

SEQ ID NO: 90477 - DNA, 153 bp, Glycine max
  Peptide Sequence Number=SeqID_182162
atgaagttggatattccatcttcgctcaatgatttcgaacacacaagtatcatggttaggaccagaggattaggtcgtgccttaggtcacgttactggcagaggtgtgggccgaggagatcatgatgattccgatgatgctccgcagtgttga

SEQ ID NO: 90478 - DNA, 231 bp, Glycine max
  Peptide Sequence Number=SeqID_182163
atggtagctgtagttcaaacctacactgtgttgggttacaagtgtgaggtctccttatgtggtggctcgtggtccacaggtgtacccctcgaatctccccaacaattggtatcagagccgatggttcaagttggtgaccggctcagacgagtatgcaagtaccgcaggtggcccgaatggctagcggcacagcgtgccccgcaggtggagcggggtggccaaaatggctag

SEQ ID NO: 90479 - DNA, 660 bp, Glycine max
  Peptide Sequence Number=SeqID_182164
atgggttcatttttaactcagattaaaggcattttgttctacacagatgctaatggagcagttgttgataccgctgcaaagtcttcgacatatttgataattgtgagatttcaagttttacccaaacctgttccgtatgaaaaatacaattttcactcttattctctccaaacacccacccaaaccctaacaccttcttctccaccacccacgaccactagtggtcaccacaagccgcccttgcttgccatcggaccactacacagagaggaatgctttaactggatcagaattcttagaatctacctcaaggattcaatagagaaacaagctctcaatcctttctttcatagtttctctgaggggtatttgaccctgattgttgatattaaccttgtttttcatgagggaaaatacttgtacttgggagcatgtcactcggtttggaactcccttatgactcgggctgatcaccaagggcggggagggggggggatgggtggagtttcctatgcacgacagggtgacctcaacacttgctacctagttttcctgagtatgagtgtcgtgtggacacgctcaggctatttcctgacgagtggtactacattgcatttgagagttgaggtcaggtgcatgtatcatactgagcatgattga

SEQ ID NO: 90480 - DNA, 351 bp, Glycine max
  Peptide Sequence Number=SeqID_182165
atgaatgctaaccgaaatagaaattctatcaggggtgtattcattgatggttcatggactgacgacccacacaaggtgaaggaagaggtgaaatcctttttcttccataggttccaagaaccaattggtcagcaacccaagattgatggaatcaggtttcaaactgttaatctacaacagaataacgagcttctggcacctttcatggacgaagaaattcagaaggcaatttttaaagctgcaacgaagttttttatgaaggaaggcaattcacaaaaggattgcatggatttaatggaaatcgatatgcttaccaaaagaaaaggctggcttgggcatcaaggatattga

SEQ ID NO: 90481 - DNA, 822 bp, Glycine max
  Peptide Sequence Number=SeqID_182166
atgacggcgcgcaactctcccaaatcttcaaatcatcacatcttcctcatttctttaccaaatcgcttcaagcaaagctcaatcttcatccttttcaattctttacaaaacccaccaattaaaatcagcttaaacaacttccaatggcagaatcatcaaagaaaagaaaaggatcttcctccaccaccactgtcgccatggaaccttcggagacccaccagcaccagttcctcacactctttcatctcccagtcatccaccttattttccttcgatgatcagcatcagagtcaaggtgttccttttgagggcactcttgttgatgactgtaaatttgattattcaagtcatgatactcgaaaaatggtctgcaatgaccatgctgacatgacctacagatcgcttacggggtcatttactttcgattgtcgcatcatgcacttcattattgtttgcattttgcttcctcggtctactaatcctgcccaagcctctgaggaagatttcattctattgtgggcccttcaaactggtcgtcaaatcgactgggcccatcttgtttggtatcggatgcataaggcattacgggctaatgcacctctgccatatccccaccttattaccctatttcttcatcatttcaatgttcctttggatgatgaaccctttgtcaaggttaaaagggacttggatggtcagtgggtccacaagcaagatttgccactgcctattcccgacgagcgtacatcatctcctccaccacaaagggacatttcctcttctctactgactgaagtcctcacagagctccacgatctttga

SEQ ID NO: 90482 - DNA, 711 bp, Glycine max
  Peptide Sequence Number=SeqID_182167
atggggacaaatcaaaacagaaaaatattctatcaagtcaagattaagggcctagatgtcaccagccttaaggagttgggacagttgatgggacccctccaaaggcaagccttccgcaaagtgtacggaaagattttagatttgaccacaacggaggtatttacggaagtcgttgtctccctcgcccaatactatgaccagccgttgagatgtttcacgtttgggtacttccaaatagtatcgactgttgaagaatttgaggagatattaggatgccctcttgggggaagaaaaccgtatcttttctccgggtttcttccctccttgagcaagattgcagctgtggtcggggattcggcaagagagttggatcgtatgaagcaaactcgaaacggcgtagtgggcctaccacgcaaatacttggaaggcaaggcaagggatatggcgagtcaagaagagtggatcccgtttgcgaatatactagctttgctaatctttggggttgtcctctttccgaatgtggacggtttggtggacctagccgcaattgatgctttccttgcatatcaccatagcaaggagagcccggtggtagctatcttggcggacttatttgatacatttgagcgaaggtgcgagaagaacagcgcacggatcatctgctgcttacccgctctttgtgtgtggttggtttcgcacctattccaataa

SEQ ID NO: 90483 - DNA, 363 bp, Glycine max
  Peptide Sequence Number=SeqID_182168
atggagtggttctacatgatttcgcatccgtttataactctggcacagccaggggatactcctagtgttccgccggttcaacaatatgacacatttgttgaaccagatgtgcatcagcaactggtggcggcagtggcacctgatgaagcagacgttaatgtgcatcgtcctggacatgcagtggtaatatatttttttgcaattgctgataagttggagaggctattaaacctgaggatcttgaccaaaggaacagaagcttataccgttgctaaagaatgtttgagcatcgcaagaagctatattggtcaatcaactataggtcacagatcgaggcataggcgtcgtacggacgatcgttga

SEQ ID NO: 90484 - DNA, 841 bp, Glycine max
  Peptide Sequence Number=SeqID_182169
ggatattattgaccctaaataccttgactctgaattctttgagggagaaaactttgattgctatcaagtgtttcaaaattctgaactagtggatttcatgactaagaaattgccctattaccctgaattggttcgagtgttttataacaaattggaaattcatgaaggagtgatattttctgaagtgaacaaaataccaattgttgttgatcaatccttgttttactccctaaccaaactgagcaatcaaggcgtgccttttgaaggaactttagtcgatgattggaaaccaatttattctagtcttgatgcttgtaaaatggtttatgttgcaaatgctgatacatctggtcacttacttgttggatcctttacttttgaatgttgtatcatgcattatattctctattgtgtgttgcttcctcgttctactaaccttgctcaagccactaaggaagacttaattttgatgtgggcactgcaaactggatgccaaattgactgggcacatcttgttcattaccgtatgcacaaggcattacgtgtaaatgcccctctaccatatccccatctgattactctatttttgaagcacttcaaagtccctcttactaatgaaccatctatcaaggattaccaggcaaattctccctacaaacgcactccatctccaccacctagggatccctcctctgctttactgaataatgttctcaatgagattcgggatcttcacgctttttttggtgaaaggtttgattccatggattctcgcatcactcatcttgaggatgacatgggatttatctgttgttgctttgatcctccaaccgatccttag

SEQ ID NO: 90485 - DNA, 651 bp, Glycine max
  Peptide Sequence Number=SeqID_182170
atggcccattggcagctggttgttttgtgtcctatgaaggatgttgtcatttggttcagctcgttgcgtaagaaggctgatattcatatcaaagatgcagttaacaatgcaatgaaaacattaaagagtagtttggatggtcatattgataaagttgcaatgcagtggattgaaataaagagtcatgttcaaaccggtgggtatgagtgtggctattttgtcatgcattggatgtggaacatagtaagagaggggttgaagaatgattggagcatgtggttaggtgatggcacaccattagacatcaagaacacaacaacaattccaaagcccttggacaatgcattgctatcacaattggtaggtcattgtgtagttgaggatgtcgatagtgccgatgatagcccaattgacatcaacaaatatgaggttccacaactacattcatttgtttcttacacaagtgtgttgaataggaacatggttgcgaagcttcatcacgaccttatctttgttgttgaaggcttccctgatgcaggatttgcattaatggagtgggataagttccattttggcacttgttggtgtagtgaatatttgaaaggatctttgatagtggagcataatgttccctttaggagaaacatctga

SEQ ID NO: 90486 - DNA, 192 bp, Glycine max
  Peptide Sequence Number=SeqID_182171
atggagaactcagtcctcaagaagataagacaattaaagcaatcgttgatgcaagtgcatatcccttgcgaagacatgagaaagtttgatgacaggataccggaacgtgatatgacaattttcagggtcttgctaggagtcttggagctgctgttatctacaaccaagataagccatgggatgaccatgtga

SEQ ID NO: 90487 - DNA, 210 bp, Glycine max
  Peptide Sequence Number=SeqID_182172
atgtgggtgtcgagggagcggtttccggcagatttcaggcaggaggatgacaaagagaagagggagggcaagaaggtggtgagaaataaaagaagaagaatcgtcatcgttggagcaacgacagccgaagatggcatggagctcgtcgcggaagtgggtgatgttggtggccaaggcaagaggaagcgcaagaggttgaaggggctatag

SEQ ID NO: 90488 - DNA, 504 bp, Glycine max
  Peptide Sequence Number=SeqID_182173
atgcgtctggaaagaaggaaggtgcaactcatgattgaagaacccattagactgattattctctttcaaagaaatgatcgtcgtttgatgaagcaagatccagaccaaggcactccatggcctcttccttcaagaattctacctccatcccctccacctattgcacttgtggaacctgatgttaatacttgcaacaaagttttgaaaaagaaaggagagttaggtaaccacatctttcatccagaaatgcagaaaaaggaattagacaagcttaacttcacaaagctttggatggatggcttcccaggtattgatccctttcattatcctgtttgggacactttacccgaagaagaggaggattcttgtagaaattatggaggacaggaactagtgctcgaagaatttccagatgcatatccttttgagatgcccttttccactccaccggaccttcaacaactcctcggtctgatccatgctttgaatgtggttctcccttga

SEQ ID NO: 90489 - DNA, 579 bp, Glycine max
  Peptide Sequence Number=SeqID_182174
atggatgaattcctttctagcatttggaactctgatgataacaaccaagttaacccaccactacccacccttgatgaagctgcaaagggtaaaagtgtagtagcaactaaatccaccaccatttcccagccattatctatccctcccccaatttgcaagaaaattatggatgaaatttggtctcagatccacaaaagccaaccacactacaatgaagctaacaatagccttgttaggaatgagccactactcaaaaggcagcaaacacttggggaaatgactttggaggacttcctagtaaaagctggggtggtacaagaatcatcatcactattcaagtcttcattattatatcaaaatcagattggtaacattgcaattataaaggatgtcactacaaatggcactgtggggaaatgtccaagcttaggagaatcaagtgggaagggtaataggaagaggatcattgatggccctcctaaagtggtagtagagagaaggcagcgcagaatgttgaagaatcgagaatcggcgacacattatatagtgtttaaagattggttagaaagacaattatga

SEQ ID NO: 90490 - DNA, 1836 bp, Glycine max
  Peptide Sequence Number=SeqID_182175
atgaagagcctccatttaaagagccgcttcagcatcttcacctccacggtggttccctcccgcaccgaatcccagatactccaccactgcaaactcggcgcgctccccaaagccctaatcctcctcaaagcccaggctcaagcccaagccctcaagcccgtcgtctacgcctccctcctccaagcctgcaggaaagcccactccttccccctcggcacccacctccacgcccacgtcctcaagtcgggcttcctcgccgaccgcttcgtcgccaacagcctcctcagcctatactccaaactctccccacacttctcccaggcccgcgccctcttcgacgcgcttccattcaaagacgtcattgcatggacttcaatcatctccggccacgtccagaaagcccagcccaagaccgccgtacacctcttcctccaaatgctgggccaagccatcgagcccaacgccttcactctctcatccatcctcaaagcctgctctcagctcgaaaacttacaccttggtaaaaccctccacgccgtcgttttcatacgcggcttccactcgaataataatgttgtagcgtgtgcgttgatcgacatgtacgggaggtcgcgcgtggttgacgacgcgcggaaggtgtttgacgaattgcccgaaccggattacgtgtgctggacggcggttatctcgacgttggcgcgcaatgacaggtttagggaggctgtgcgggtgttttttgcaatgcatgacgggggtttggggttggaggttgacgggttcacgtttgggacgttgttgaatgcttgtgggaacttggggtggttgaggatggggagggaggtgcatgggaaggttgtgacattggggatgaaggggaatgtgtttgtggagagtagtttgttggatatgtatgggaagtgtggtgaggttgggtgtgcgagggttgtgtttgatgggttggaggagaagaatgaggtggcgttgacggctatgcttggggtgtattgtcacaatggggagtgtgggagtgtgcttgggttagttagggagtggcggtcgatggtggatgtttatagtttcgggacgattattcgtgcgtgctcggggctggctgcggtgaggcaggggaatgaggtgcattgccagtatgtgaggaggggtgggtggagggatgtggtggtggagtcggctttggttgatttgtacgccaagtgtgggagtgtggatttcgcatataggttgttttcgaggatggaggcgaggaatttgatcacgtggaacgcaatgattggggggtttgcacagaacgggagaggacaagagggggtggagttgtttgaggagatggtgaaggagggggtgaggccggactggatcagttttgtgaatgttctttttgcgtgtagtcataatggtttggttgatcaggggaggaggtattttgatttgatgaggagggagtatgggattagacctggggtggtgcattacacttgcatgattgatattctgggaagggctgagttgatagaggaggctgagagtttgttggagagtgctgattgcaggtatgatcattcgcgttgggcggttctgcttggagcctgcactaagtgttcagactatgtcacagctgaacgcattgcgaaaaagatgattcagttggagcccgacttccacctgagttatgttctgcttggtaacatttatagagcggttggcaagtggaatgaggctctggagatcaggaagttgatggaggaaagaggggttaagaaggtgccgggcaagagctggattgagagtgagaagcaaaagggttctcctggattttga

SEQ ID NO: 90491 - DNA, 207 bp, Glycine max
  Peptide Sequence Number=SeqID_182176
atgatttgcaaggttctcgaactccaagaggtaagaattgatagacccgtgctagtcgaaaaactacgatatcttgaaaatccaagacgtcgcgttggtcccgtcgaagcgagggatgttgagcttcatcctgggggtggaaagggagaggggacggacaagggatctggattcgagggtgtgaaggcgggagagaacatcgtctaa

SEQ ID NO: 90492 - DNA, 201 bp, Glycine max
  Peptide Sequence Number=SeqID_182177
atgttatctatcttacaagataacaacaacaatagtcagttcattatcgagggagcatccatcacgatgccactaggcttcataggagaggactacccatattggatagatagaatagagatgtacatcaagtccatgcagtatagactttggtttatcatcgtgaatgatgatattcccattcttagacctgaagcataa

SEQ ID NO: 90493 - DNA, 645 bp, Glycine max
  Peptide Sequence Number=SeqID_182178
atgattccaacaatcaacaatgtagaagacgtgaagagggtgtttctagaagactgcttggaagatgagggggtccttatcaaggacctttttttatcgtgttggttggatgccatttctagagaagttcagttcttgacattacgacccttatgcttttttctggggaactgcgaggatgagaagacactaggggaacaagctcaagctagacttaaaaccaaactttcctatgaaaccaaacctagccaacctagatcccaacttaccaccaaaagaaaagacccaccttcgccaacatttgaccttaagccctcaaacccagtcaagaaaccacctccatctgaccccaaaccttcagatcctagaatagcccaaaaggggaaggctatagattctcagtccgaacctaaatatcaacctccaccaaaaagagcaaccattaagatcaaacatcttcaaccccaatctcatcctacacctatctctcgacacatacaacaagaatctaactctgggattcttgtaacctcaccatctaagcgaacctcaccacctaaagcccaagagtcttatgttgagattcgtgacactcgaactcctcaagcttcaccctttctgaccgttccaccacataattcctaa

SEQ ID NO: 90494 - DNA, 291 bp, Glycine max
  Peptide Sequence Number=SeqID_182179
atggagaaccaactgaatcataatactggaagacattatggtggtaacagagtgggcaatgttggacctaggcaacacagaatagaggggcagaacaaaattgatggagtaaaactcaatgtacctcctttcaagggcaggagtgacccagatgtctaccttgactgggagatgaaagttgagcatgtattctcttgcaatgattatactgaagagcagaagagagatgacgagatagaaggggtgggagatagatacatggacagagatgagaagggtgatgcaaaagcg

SEQ ID NO: 90495 - DNA, 279 bp, Glycine max
  Peptide Sequence Number=SeqID_182180
atggcgaggagtaggaccaaacagtcagtggataccctccaacaaatggtagcagacatacttaataaggcccaagtggagaaggataaaggtcctgaaaggaacttttggcatttgatagaatttggtgagagcttctctctgggttccttgttgaaccaatctcagacttatcaagatattccttgtggcgtctaccctgacttatcttccttcactggaagtggcgtctaccctgacttatcttccttcactagaagtgatgtctaccctgactaa

SEQ ID NO: 90496 - DNA, 837 bp, Glycine max
  Peptide Sequence Number=SeqID_182181
atggcaaagtgccaatgggagcttaggctgtggagattgttaggaggggtgtgcaaaatgtcagcgatttactggcattctttgcacctctttgtgaagtcgaggcgtcttctagatgatagtcttaaggtgcctagtcttttaggtgttggcctgcttagagagaaagtctgctctggtgttgctctccctgggtatgtagtaaatctcaaagcatttgaagttgtcaatgaaagttttggcaatgtgagtgacattgtcaggaccttcaaggatgatttcgactcaagttccctttatgttggatgcaccgtcaatgtgaaggctccaccaggttcatactggatatcgaactctaaaagttctacgaaccattccaccatcctcccttgccaccttctctatcatttggtagcgtttatcagcgtcatggagtatgcgactggtgaagtagatgagaagggtactcctagcctgattcgactcaggactagaggtgtgacaatggtcttcttgaaggccaaaaaggcttgttcacaggcctcgtcccataggaatggctcaactttcttgagcagcttgactatccatctccagtatgggtatgccttttttggggttggcttctattccccgatgtgtgatcataaagcccaagaacttgcctttgccgaccctgaaagtacatttttccgggttaaggagcacatcgtgtttgcagatttctttaaacacttcttcaaggtatgccatgtgttgggctatgctatggaatttgatgaccatgttgtcgatgtggaccttgacatttcgtccaatctgctatttgaaaatctg

SEQ ID NO: 90497 - DNA, 624 bp, Glycine max
  Peptide Sequence Number=SeqID_182182
atgcatttgcttccccaattcttatacttcagttgtgtgactaaacaaattacaaggattgcagtgaacaagtcgggtctaaaacctgatctaaccatacaatatacaagttctaaggattccttggggcacccattccccgcatatgttgaaatcattatgttccagactacaagttcctcatcagacattttctcaaacaacatccttgcatcctctagactacccaactttgcatacattgacaatagtgtagtattcacaattagttcttcacacaagttgcttagaataataacaacgtggagtgatgagaatcctaaaactgtccaaatacaaggacctatgaccaggagtaggaccaaacagtcagtgaataccctccaacaaatgatatcagccatacttaacaaggcccaaagatccaatatagaagaggaagtggtgaaaatttttgtttggaattggaagagtggtgatgttggagattttgggaatgttaaagagatgaaacaaatggtggtgaatgtgcaacatgtctggttgaacctaacaacatcctacattagtttcttgatagtagacctagagaatttgaggaaggaatattgtactgtcaaatga

SEQ ID NO: 90498 - DNA, 570 bp, Glycine max
  Peptide Sequence Number=SeqID_182183
atgaagtccaagagatggccagaatcaaagaagaagctaccgagctccgagcatcaagaagttctaatacaaaagttcaaccacgagcctttcaacccgatgaccttgtatggcgagtctgagacgaagctagaaaagatccccgagcaggaaagcttggacctaactgtgaaggaccatttaggcgtgcttagcttgtcccaggcgctcaatgcgaggcataggcttagtaggaacaacacgcttagcaccagtaggataattcaggaaagaaggctaattcaagaaagagtcccgcttagctcaagttatgtgctaagcgcgaggcgtactgccatacttgctaagcacaacaagcgtgctcagtgcaaaggttgcgtgaaaactaagctgatctgcacctataaaagagggagagagaagaaggaaaaaacacaaaaaattcaagagagtacaattccttatagaaggcaaaggctagaagaaggagaaacaatcattaagagccattccttcccttcattccctttcttatctattccccctttactaaatattctcttcttgtaa

SEQ ID NO: 90499 - DNA, 339 bp, Glycine max
  Peptide Sequence Number=SeqID_182184
atgtattgtactccttcacttgttcatcaaatttttggccagattggcgagtcagtcaatgcaaccagccatgaatggatgaccaatttatttagcgtcgatttgaatacaccaaattcaacgacatcatatttaacttctttacaacagttcgatgcaccacattcgtttggagaacaaggacaaagttctttagctgcagcaacccacattgaatatactgacatagaacaacaacatcatcatgacgtgggagaaccagtcatacatgaaagaagaaattcgcgatgtaatcggcgtccaccgccctgtgggattggtcatcgtcttggtcattga

SEQ ID NO: 90500 - DNA, 1998 bp, Glycine max
  Peptide Sequence Number=SeqID_182185
atgggtgctgctcttcagagcctgactggtgccccacgtctgcttgcagcaatagccaatgatgatattttacctattttgaactactttaaagttggagatgccagtgaaccacatgttgctaccttttttactgctttcttatgcattgggtgtgtcgttattgggaatctggatcttatcactccaactgtaactatgtttttccttctatgttacactggtgtcaacttatcctgcttccttctcgatcttctagatgcccctagttggcgtcctcggtggaaatttcaccattggagtctgtcccttgtgggagcattactttgcataggagcagtggtcgcagccgcaattgcagtgatgtggcgcgattgtggtccccgttgtgtgatcatgttcctaatctcttggtcattcactgtggtgtctttgctccttgcaagcctcatatataagtacgtgagcattcaaggaaaggctggggactggggagatggtttcaaaagtgcttatttccaactagcacttcgtagccttcggtccctaggagcaagccaagtgcacccgaagaattggtatccaattccacttgtattttgccgaccctggggcaaactgccagaaaatgttccctgtcatcccaaacttgcagattttgctaactgtatgaagaagaaaggtcgaggaatgtccatatttgtctctatactagatggggattaccatgaatgtgctgaagatgccaagactgcttgcaaacaacttagcacctacatagattacaaaaattgtgaaggtgtggctgagatagttgttgcccctaacatgtctgaaggcttccgtggcataattcagacaatgggccttggcaatctcaagccgaacattgtggtgatgcgttacccagaaatttggcggagggaaaacttgatagaaatccctgctacctttgttgggataattaatgattgcattgttgcaaacaaggctgtggttatagttaagggtcttgatgagtggccaaatgagtaccagaggcagtatggcacaattgatttgtattggattgtaagagatggtggtctcatgctgcttctttctcagctccttcttaccaaggagagctttgagaattgcaagattcaggtcttttgtatcgcagaagacgatgcagatgctgaggggctgaaagctgatgtgaaaaaattcctttacgatcttcggatgcaagcggaagtctttgtcataacaatgaaatgggatgcacagatggatggtggtggcgggtccccggcacaagatgagtcaatggatgcatttactagtgctcaacaaagaattgataattacttaacccaaatgaaggcgacagcagagagagaaggtactcctctaatggcagatggcaagcccgtggttgtgaatgagaagcaggttgagaagtttctttatacgacgcttaagctcaattcgacaattttgagatactcgagaatggctgctgttgtgttggtgagtcttcctccacctccagtgagccacccagcatatttctatatggagtacatggatctgttgctggagaaaataccaaggattttgattgtaagaggatatcagcgggttccggccatcaccgtctgccgccacctctggccaccgtctgccactgccgaccgccgcactccggccgccggaatctcgccggaatttttttttggggtcaaaatggctacttttgttgagttgtggtttcttggtcaagggtaccatgaccacctagagaaaaatgtcaatgctgttccaaatgacaagaaacctgaatgggagaaggcccaagagatcttcgccaacgattttcaaagactatttgatgcgattgtgaaagttacagctctcaagcaatctaaccatgacatgattgcacatatgggtaaagctcaggcagcagtagaagagctaagaaggttttttgtggctgattcgttggaagag

SEQ ID NO: 90501 - DNA, 2262 bp, Glycine max
  Peptide Sequence Number=SeqID_182186
atggagaacatggacttcttgacacaaaatacttcaaaccataaagaaaaagtatccttttctgttgttaggaggattcctgatcttcctattcagtttttctcagggaggggtagacaaagagaacgtgaggcagtgagaaaggatcccagaacaagctacaccgacaccagaatcggaaattggcgggacaaagctgatatcacaacgttttacttcacaagattcacggagcacacaacagagcaggagctatggtcccacttcaagaaatggggggacgttagggagattttcatccccaaacatagaaacaaacgtggcagacgttacggttttgtaaggtttaaaggggtatctgacgaacgtaagctagagagtcagctagacaacatcgtggtaggaggactgaagatgcatgtcaatgccccaaagtatgggagaagaagaatcacatccgaggagcacacagccaaaaccaggactcaaatggatggccaaaatactcaaatggcagctgcgcgatatacggcaacgcactacaggaacttgcctatgtcatatgcgaaggcggtttccaataccaaaatggccgacggacacaagaggcgcctacaacccccacaatccagtttcgacgagtcccaatcctcactccacctcaaagtgccaacaacggagcgtaaatggtacacaggcgcttgggtgggccgtttaaaaaaattgggggctttagaaagaattgaggaggacttaccatgggaactagggatcgacgttgcgccgaaatacatcggtgatgacatgatcctcctcctcgagctctcggactctaaagcagaggagattattacagaggaattccaaaatgggttgatatgggcacaatgctggggtatacctttagaagtgtgggacattgagaatatccgaaaaatcgtggccacagtcgaagacctcatcgaagtagatgacgacgtggacgagcggagaaggctagacagagccagaatccttatcaaaactccaaggagacctatgatccaccactcagtcgcagttcatatcggtggggagatacacaaagtgtacatcgtcgaggaagggtgcactgatatcaggatgaggaccttgccaggccgcagtgctacggactcatcggaagagattgagtccgaggatagtgacatcagaacaatgtttgaagtgccggagacagcccctgatttccagaccgggagagtcagcctcggcgggaagcaaaacgctgttgacgatagccaccagacgtcgcttttacccgacgatcatagggccatggaaaacccgctaggtattacaccatatgcacagactcacctacccagtactgacaagtgtgtgcaaacaaacgccgaaagaggaaagcagcagaactcgaagaagagagatacagagccctgtatcggtgaggatggtacatgcgaagcaacaaagaagagtaggggagcagagagaagagttggcattactatccacaccaccccgttcatgccacataactcctttgacagcccaacccatcccgaaattcccagcgtgctccctctgactccaactgcgacttgtgacaaaccttttactaaagctgggtcaaggactgatgtgggcccctcaaaaaacaactcagccattaacccagaacttgacaagcctagtacatcataccaaacagccgtgaatggaaatgggctacatgtatttgatacacccaaggggtgcacacaaaaaacagcccaacaaagtgacaagcaacaaactttcaatgatatcatccctcttaattatctggaacccatatcgggcacagctacaccaacagcagcttctgaacagaacacgatcactagcccaaaactgaacaaggctagctcatcatatcaaacaactcagattgaaagtgagtggaaggtctatgtgagatcgagggggtgcagacaaaagaaagatcacctaaatggaaaacaagacagtatgggagacatcaatccacatacacatacacacctggaatccacatcgggcacggctacaccgacagcaattactcatggatccaacagaggccagtatgaagaggctgcagcacaatgggaactagcaaaaattatgggggtgactagcgattcagatcagagtataatcatcaacaaactcatcgatatggaggacaaggacagcaaggagactaaggatttgggagacagcaacacctcatcatga

SEQ ID NO: 90502 - DNA, 600 bp, Glycine max
  Peptide Sequence Number=SeqID_182187
atgaggcttgaaactgtgcagattgttggtatggctggcataggagagacattgctgcttgtttctttatgtggcacttgtacattccttacttcaatatcattgagtgctattgcaaccaatggagccatgaagggtgggggaccttactatctcataggccgtgcccttggtcctgaagttggagttagcattggtctatgctttttcctgggaaatgctgttgccggagcactttatatattgggagctgtagaaacatttttgaaagcagttccttctgctgggatttttagagagactatcactcaagttaatggtactgcaattgcacgaccaatacagagtccaagttcacatgacctgcagatatatgggattgttttgactattctgttatgctttattgtatttggaggagtgaagatgataaatcgggttgcacctgcttttctcatacctgttttattctcagtcgtctgcatatttttgggaatatttttggcagggaaggatcatccttcagggatttgcatatctataggtcgactttgtgaacctgaagaacccaaaccaatccaacctctaaaaattgattag

SEQ ID NO: 90503 - DNA, 90 bp, Glycine max
  Peptide Sequence Number=SeqID_182188
atggaaagggagaataaaggaggagaaacaaaagcggagaagaaaaaaggagaagttgaggaagagaaggaaggggaaactgaatattga

SEQ ID NO: 90504 - DNA, 249 bp, Glycine max
  Peptide Sequence Number=SeqID_182189
atgtggacatctcatcagcatcaggaacagaagcatttttcagatgctactcacatactgcggatcttctatccatctccgggtctgctccctaggacttgttgcaaggctaggtttctcaggaacaggggcttgaccgggatcatttgtatgggtggatatggaattcaggttgttcctggtttgatcgtgctttggtggatgatggagatgatggtacagagggtgaagtatcttttggtgaagtag

SEQ ID NO: 90505 - DNA, 187 bp, Glycine max
  Peptide Sequence Number=SeqID_182190
atggctttaattataactggatgcctcacgagtttgcaccgttactgcctaacaccaggtggaccagcattattgcttatgcacccagcaatttctggtgtcgcttgggtagaggtgaaagtgttaccggccaatggtgattgttgcagtggttggttcgatagcaacatcgtcggaggtatgccag

SEQ ID NO: 90506 - DNA, 579 bp, Glycine max
  Peptide Sequence Number=SeqID_182191
atgcaagaatctaatggattcgacaactctaatggatctactgatgatgaagtagccctcatatatgaaaaagaagatccaaactataaaaagagtctgagcctgacttgtaagactaatgaaactgccactattgaaaaactaagggaagaagtagcatgggctactaatgaatttgggaagttcttggaaattccaaagattctcaccactattttgaaattccatcaacatcgcatgacaagtctagcctgggttttgaaaaggaaacaacatcctccaagtcacagtctgtttcagacaaatgtgacttttgtgatatgggtaccaaaatctcaaatagtgtctgttgcatgtatccttcataggaaaaggccgagtttaagctattgcctggatagtggatgcttaggacacatggctgggaaaaggtttatgttcctagacctaaagccagatgaagaaataacagtttcctttgtaggcataagtaagggaaaaatctctagtataggtaaaattggtattccctctttaacctccatagacaacgtcttatatgttgaaggtctgaagtaa

SEQ ID NO: 90507 - DNA, 237 bp, Glycine max
  Peptide Sequence Number=SeqID_182192
atggaggcttcatctcttctccttctctctaacgtttgggaacccgatcaaagcaatcagaggaaaaaattgaggaatctcaggaaattgctagagatgccgccatcgctgttggaagacacacatagtctatgtgctaaaatattttctgggttggacctgaatcaggagggagaggccctgacggactcttcggagtataggccttgggggtcacccggtttggggatcctctag

SEQ ID NO: 90508 - DNA, 423 bp, Glycine max
  Peptide Sequence Number=SeqID_182193
atggaagaagaaatctctcttcaagagaagaatattacaatgaagatcatattttctgaaaactttccactggtaatcgattacagacatatggtaatcgattacatgttgaaaattcaaattcaaaacctttttcaacagctatttctataccttgtcttctggaaatgcttatcatttgaagcagccttgttagattcttctttgacatcatcaaaatcatgtgtcgcggtggtcttccggggaggagtcgcggtcaaggtggaggacatagcggttgcgagggtggtagagggcgaaaagtgtgcggaggatggcggcagtgtcggcggaggagttggggatgaggtaggcgaggcgcggcgagaaaggggagggggtgggattgggagaggaaaaagcttggactcgacgaaggggtaa

SEQ ID NO: 90509 - DNA, 855 bp, Glycine max
  Peptide Sequence Number=SeqID_182194
atgaaagttcagtaccctattcttaagataatgtattttattgctaagcctcatccgtatattgtaggagtcaatcacagaaaaagtgactcgaaagatgatgacatccttcagccagatacagtcctagtttcagtctcagatgcaattacagggacttgcactacctccagagccagagggaacgatccagggacgggtgactcagacaaatgcgggctatacattgaagaaaatccttcccgcctggttgccctaggaagactttatgagggatccacaacagttcacaacatccctttgttgcatggccaagtcaaggttggtgttgaggaggttaaagatgcagaggctctcgttcctgtacccactgacgagacagctgtgtctccagcaaaacctccagaaagcccggatgaagaggtcgatgatcccttgtacctgatgacattgatcatcccacaactgtttttgaagcctctccaggttatgtgggatgctaccatattcgaggtgtttaatcaaaacttcccgttgtatataaagtacgaagatctctctgaaattgcacacggtggtcaatgtcttagcatatctgttatacagttgtggattctccatctgactgagacaagtgtgcgagcggggaattctgatgtgtatggattcctcgagccacacggacactggcaaatggtcgtcattctgtctaaggaaaacctagttgtctggttttgttctttacataacaggcctgacaactaccttaagggaataattaacagtgctttgaaaggacttgatgatactccacaaccgaaatccaaggctgctgctaggtggattgttgttaag

SEQ ID NO: 90510 - DNA, 1044 bp, Glycine max
  Peptide Sequence Number=SeqID_182195
atggccctccttggcaaatggatgtggaaccttatgtaccaacaaggggctctatgggttgcagttttggaagctaaatatgggggctggagaggtctagttggagaaggaaactcaagctgtcagtcaatttggtggagggacttaaaaaaagctatgcatatgccctacaatggaaagactctttatcaacaaattaagtggaaggtagaagctggaaataaggttctgacacttgggtatggacagcagaagcatcagggtatcttctctactcgtagtgcttactcatcgatttgggaggaggcagctgttgacaaccttcatgagtgttttgaggacctttggaagatcaagatcccgagaaccaattatatggacttttattttgtaatagtacctctggtgatgtttttcttagaggtcaaaactcaatcatatgatagactggtcatggtggggcatttgcgagtggaggagaatcctatacttaagatgcctcatttggaagcttcctcaatattgctagttggacctactttgaaaaaattcaatgatagagatctctctcgtgaggaagtggcactagcaaatcgttatcctgcacatacagctttgtgcattagagatggttgggagtttagtcgccctgagcaagctgcagagtcaactttctgctttttagttgagaagtggaaggaccatattcctccggggttttttctcaaagaagcatccatagataaacctgtggaagaagatatgtgtcgttgtcatttcacaattattcatgatggtgcagctagtacagacccaccattatttttaaaatatcaatggttttgtggtgatatatcactttcaaattttatccctattccagatgctactgatgaggtttactggccaaagcataatgacattggaaaagttctgaaagtggaatgctctcttactttaggagaaatggtgtatcctcctatatttgccatctcttctcgtatttcacgagatgaacagctaaattttttagatcctgattaa

SEQ ID NO: 90511 - DNA, 558 bp, Glycine max
  Peptide Sequence Number=SeqID_182196
atggcaatatatgaactggatcccgatgttgtttgctggggtcttcatctcctagatgattgcacactttcccaccattattcgcctagtattgtaactcaatatgatcctgatttaagtcaagttgaatatgttacagaaggcttttgtcagcatcagtatgtggatagtgacgaggctgttgcacaagcttatcaagaagaattatggcaacttgtttctatggtagcttctgggaatgataactttggtgagtcccataatatgaaagaagtggggaattatggtccaactccaagtgaaagaaaaaatggtgtgcatgaaaataatgtttgtggttcgtcttctggatcagtagaggtacctactacttctactagtgatgacttctgggattcattggaaatatcggatgaatctctagatggtgaagttggcaaaagattaaaccaaatggttcccattcctcgcgctaaagttgcgcttagcaatggatgcacgttgagcccaaatggtccgcttagcgcgactgttccttttagcacttcaagattttag

SEQ ID NO: 90512 - DNA, 183 bp, Glycine max
  Peptide Sequence Number=SeqID_182197
atggtagctcatggcggtcaccggtggtcgtgggtggtggagaaggacgtttggcgtgttaggctcaagatgttatttctgaaatcccaacagccaaaacctgacgactgggtccatagcctacagtccaaatttgaaggcgatacaatagttaacaaatttgagatcatgctttcaccataa

SEQ ID NO: 90513 - DNA, 336 bp, Glycine max
  Peptide Sequence Number=SeqID_182198
atggccacaccttctgaagtccctagagctggagaagaaaggatcaaggcttctccaccggcctcgcctcctccttctcctcctcctcctcctcctcctcctatttccgatgcatcagcttcaccgtctgctgtgaagcggacacgcaaagcctcacgtctacgatccttgtctgctagaccagctggtgttgagagaccagtggtccacattgatcctgctaccggcaaggctgacggtccccataagaagaaattaagaacttatttggggattgtggcgcgtgataaggtgaacatcacgtacgagaactggaaggaggtccctactgcttag

SEQ ID NO: 90514 - DNA, 837 bp, Glycine max
  Peptide Sequence Number=SeqID_182199
atgggtgaatcagagccgttgcttatgaggatcggagggctagaagggagaccagacatgtcggtgtcagcggaagctatgactacaagacacaccaacacttgtttcccctatcaccattatattcagaatggttgttatgtgggtttggaacttgatgttgagcattatgttgtcccaactcccgcaactgctgcaaattcagcacatgtatatgccgctaacatgatagagaatccaagagaaacacgaggaactggaaccagagaaacgacatgcaaaccgaggcaagattttagcatttcaaaggtcagatttttctcactttttgtggctgagtatgggtcaccatcaaaagagaaacaaaacagaaaaattcagaagctctccctctctctcacgcagccttcttcttcttttcttcctccaccattgttgcccaacaaagcttcaacctttggtgcccatttccgctccaaattgcaaaaggagggcatttccggagtcgtgaagcgcgtctctacgtgtgggacttcgaaatttcagcttgtgctgtttgaatgttgtattactttgatgttggggaagcttgggaggattgatggggacccggtgttgagagaaacgaggatatgggctacgtgggagtacgtgagctcagttggaggtgggcaacaggggaggggtgaaacttcctgcttttactcgttgaccacagagtggtacctggagatatgtcgcgggggtcaggagaccttggggacgtcaggtggggtgctattgtccaaaaccaagcttgaccaatcccgacccaacccgggcatagtcagtcagtga

SEQ ID NO: 90515 - DNA, 729 bp, Glycine max
  Peptide Sequence Number=SeqID_182200
atgcaggttattatgcttgatccatctaagatgtttcaaagttctggaatggtcgaatccaagtcagttggaaaattttcacctctgcaaaagcaagagagtcagaggggactttttgttgatagaggtgttggatctcctagacttgtaaaatcttctagttcaaatattttctctactgatctcaatttggataacgaaaccaagaatttaatgccagctgctactggagctgtcgttgctgcagttgttgctgatcagatgctgggtcccaaggaagatagacatttggcaattatcctggacatgatcagcattcacaacctgcaagaaaacatggcacttaggtgggaaactgaatggaggctgggctatggtgacaagtgtcaattctgggaggactgctgggttgacaatgatgtaccattgaagctaaaatacccacggttataccagatttcatctcaacagcagcagactattatgcagatggggagtttttcaggtgcaggtggtgtggtgctggcttcgttcctaccaataatcataggatgggaatggaattttagttggaggagatctctatttgataatgaaattgggatggctgctgaatttctagaggagttagctcaagttacaattcatcaagatagaccagatttatgggtttggaaggctgacccgagtgggtttggtcaagctagtagaagaaaaacgagattctaa

SEQ ID NO: 90516 - DNA, 309 bp, Glycine max
  Peptide Sequence Number=SeqID_182201
atggcttgctggagaagctgggagaggtcccacaacctagaaccatctcatggatttccaccacaggcctattatccttttacagttgaaaaagagatgacccacctcctcctgctcttgaccacaaagaggacaaacatcctcctggatgagcatacttcttcttatgagattatccctagtagggagcctgtctttaagaagcctccaagtgaagactgcagcccttgggggattttcagcttccaaattaatcttgaagttctcacatcagaagctggagtagagggattcatcattaatctgtaa

SEQ ID NO: 90517 - DNA, 345 bp, Glycine max
  Peptide Sequence Number=SeqID_182202
atggggacagatcaaactggcaaaaggttttatcaagtcaagattaagggcctagatatcaccagcattaaggagttggggcggttgatgggacctctccaaatgcaagtcttccgcaaggcgtacggaaagatcttagatttgaccatagcagagatatccacagaagccagtgcatcactcacccaatactatgaccagcccttgagatgcttcacgtttggagacttccaattagtaccctcttgggggaaggaaaccatatcttttctccaggtttcttccctccttgagcaaaattgcaattgtggtcagggattcggcaagaggatcggaccgcgtaaa

SEQ ID NO: 90518 - DNA, 769 bp, Glycine max
  Peptide Sequence Number=SeqID_182203
agaactacacgtcctcaccgttggagggctacacgccgtcgcctttagaggactacacgtcctcgccattagagggctacacgccctcgcctttgtagggctacacgccctcaccttcagagggttacacaccctcatcttcagaggactatacgtcctccccttgagaggactacacgtcctcgcctttggagggttacacgccctcaccttcagagggctgcacgccctcaccttcagagcactacacgtcctcgccatcagaggactacacgtcctcgccatcagaggactacacgtcctcgccttcagagggctacatgccctcgtcctcagaggactacacgtcctcgccaacagaggactacatgtcctcaccttcagagggccacacgtcctcacttttagaggactagacgtcctcgccgtcgaagggctacacgccctagtcctcagaggactacacgtcctcgccaacagaggactagatgtcctcaccttcagagggccacacgtcctcacctttagaggactagacgtcatcgccttcagaaggctgcacgccctaagcttcagagggctggacaccctcgccacccttggaaacaacaagttgggtggtaaacgcgcagagacagattctgtgccctttatcattcaggagcagcgagtcgagtggaacaacaagttgggtggtaaacgtgcagagatagattctgcaccctttatcattgaagagcagcaagctgagtggataaacgcgcattga

SEQ ID NO: 90519 - DNA, 840 bp, Glycine max
  Peptide Sequence Number=SeqID_182204
atggatgaggggtgcgatgtgatcgtgttgggcacgggtctcaaggagtgcattctcagcggtcttctctctgtcgatggcctcaaggttctgaacatggacaagaatgactattacggaggagaatccacttcactcaatgttattcagagattcaggggagatgacaagcctccttcacatttgggcgctagcaaggactataacatcgatatgaaccctaagtttattatggctaatggcaatttggtgtgggttctcatacataccaatgttactaagtatctctctttcaaagctatgcatgggagctttgtgtttaataaaggaaagatgttagatgtcttaattaattgttttgcttgtgcgttggtgcaagttcataaggtgcccacaaacaacatggaggccttgaagtctccacttatggggctatttgaaaaatgccgagcacgcaagtttttcatttatgtgcaaaattacaatgagagtgatcccaagacccatgaagggatggacttgacaagaattttaatgtctcaagctcagcatttgcgttgccttcatacactgcgtaaatattttgaaactggtttaggagtaattactatggccttttccatgtccttatcgataagtttgatgcaatcctatcccgcaagggcattgggtagaagactccaagtagattgggctagagatccaagggaaggccctagggttctcatgagccttaggcttctcaaggaagttttctcaaagaagcttctcaaggaagttttctcaaagaagcttctcaaggaagttttctcaagaaagcttctcaaggaagctacctag

SEQ ID NO: 90520 - DNA, 605 bp, Glycine max
  Peptide Sequence Number=SeqID_182205
gggctacgtgcgagtacgtgagctcagtggaaggtgggcaactggggatgttggatttatgtgtgatttgtggatgtggagagtcgacttgcaccatcgcccgatcgccacctagtaccacatatgacggggtggtacctggagatatgttgcgggggtcaggagaccttggggacgtcaggcgagctcttggcagtcaaccgataaaaaaacaaagaccccaaagcaaggaggcttgtgtggtggctggccagctatggatcttgagtaatatttggaatatgacctctggcaatcgattaccaaggcttggagggattgatgggaacccggtgttgagaggaacgaggataaggggctacgtgggagtacgtgagctcagtggaaggtgggcaactgaggatggagaccttggggatgtcaggtggggtgctattgcccaaaaccaagattggccaatcccgacccaacctgggcatagtcagtcagtgagaacctgtgacgtacctaaaaaggcgagctcctggcagtcaaccgataaaagaacaaagaccacaaagcaaggaggcttgtgtggtggctggccagctatggatcttgagtga

SEQ ID NO: 90521 - DNA, 258 bp, Glycine max
  misc_feature (240)..(240): n is a, c, g, or t
  Peptide Sequence Number=SeqID_182206
atgcatgcaaacataaagaatagctccattggagcttgtaggcctaggatcttcttcatcaatggattcatttgcttcttggaagatgaatggcagcggaatggagaaagggaaagagagaggagacgccacttcaaggagaagatgagtctagaagaagctcaccaccataggaggccatggataagagcttggaggaagaaggagatgaatgaagggagagggagagaagagcacganattttgtgctctaaatga

SEQ ID NO: 90522 - DNA, 813 bp, Glycine max
  Peptide Sequence Number=SeqID_182207
atgcaatctcagggactcgcattgcctccagagcctctggttggtcactcaggtcctcgagtaaacacaaagaagagttgtgttgatctctcaggaaatgattctgagacgcatgactcagataggtgcggcttgtacatcgaagcaaatcctgcccgcctggttgccctggagccattgtttcatgaacaacctgttgtgtctccagcaaaaccacctcaaaagccagattcggaggttgatgatccactttatttgatgacaatgaccatcccagagcttttcttgaggccttaccaggttacatgggatgccaccatttttggggtctttaatccaaacttcccgctctacataaagcacgaagacctctccaaaattgcacacggttgtcaatgtctcagcatattagtgcatctgacggaaagaagtatgcgagtggggaattctgatatctatggattcctcgagccacagtccattcagaggtttgggcaatcgcagtttgagactaaaagttacataaagagttggatgcagagttcaaaatgcgatgtctaccttggagcctacctgaatggtggacactggcagatggtggtcatcttgcccaaggaacacctagttgtctggttttgttcattgcataacaggccaaacaactaccttaaggggatcaataacagacaaaaaggaagtactgagtgcggcttttatgtcatgcactggatgtccatcatcattttaggaagtttcaggaataactggaagcgtattttaacgatcctagaccattggagtcagagagattaa

SEQ ID NO: 90523 - DNA, 655 bp, Glycine max
  Peptide Sequence Number=SeqID_182208
atgggatcaagtcaaaaggcttcgcttaaaaagaggttctatcaagtcaaaatcaagagcttggaggtcactagtttaggaaagttggggcaattaatgggtcaacttcaacggcaagccttccgcaaagcctatggtaagatttgggacttagctagggtagaagtctccatggaaccgattgcatccctttcccagtattatgaccagcccctaaggtgcttcacatttgaggacttccagctagtgccgactgtgaaagagtttgaagaaatcctgagatgcccactgggaggaaggaagccatatcttttctctgggttctatccctccacgacaagagttgccaaggtagtgaaaatctcagcacaagagttggaccgtgtaaagcaaaacaggaatggggtagtcggagtaccaaggaagtgtttggaggaaagggcaaaggccttggcaaatcaaggcgaaggggctttcttttattggcatcttggcgctttccacgcctttcatcatggcaaggaaagcccggtcgacgccattttggccatgtatgacacgttcgaccagagatatgaaaagagcggcgcaagaattgtttgttgtacaccggctctctatgtgtggctggtttcacacctttttccccaagaag

SEQ ID NO: 90524 - DNA, 1086 bp, Glycine max
  Peptide Sequence Number=SeqID_182209
atgataagtactgttgctttatttgatgcatttcagcaaacggtaagcgctcctttcagggttgtcccgttttttgatcccggcccatggggaggccagtggctaaaagaggtgtgtgatctggacagaagtcttccgaattacgcctggggatttgattgtgtccctgaagagaatagtctcttattgggtttcggaaaccaggttgtagaaataccttcttccaatcttgtttttttccagccagaagctttgctgggaaaagaagtatatgagggatttggggatgagtttcctatccgttttgactttctggacactatggaaggtggtaatctgagtctacaggtacatccacttaaggaatacattaaagaaaagttcgggatgtcctatacacaggatgaaagttactatatgctggatgctaaagaagatgcttttgtctatttggggttaaaagaaaatattgaccctcagcttatgatgaaggagctggaagctgcgcaacatgatcaggtcccttttgacgcagagaagtatgtacaaaaatggccggtccgcaaacatgaccatgtatctattccttcgggcactgtacattgttcgggagcgaattctgtggtattggaaatcagtgcaactccttatatttttacttttaaattatgggattgggggcgtatgggactggatggcaaaccgcgtcccatatcattggcacatggtaaaaatgttatacaatgggatcgaaccacttcatggaccaaagaaaatatactaaaccttacagaacctattgctgaaggagatggctggcgggaagaacgtacaggtttagatgcattatcatttattgaaacaagaagacattggttcactaaaaaagtagttcatcataccggaggtgtggtaaatgtactcaaccttgttgatggaagggaaattattgtggaaagcccagaacatttttttgagccttatgttattcattatgctgaaacatttatcgttccggctcatgtaggactgtataccataagcccatatggagagagtgaaggaaaagaatgggggatcctctag

SEQ ID NO: 90525 - DNA, 438 bp, Glycine max
  Peptide Sequence Number=SeqID_182210
atgtcatcaactgaagacaacaggaacatggaaaaccatagatttataagcaagtctgattcagcaaaagtcaggagcaacagaaagcgtattagacaacaaaaagtccatcttgatgttcagcatagtgtccatgcaattaatatctgcgattcatctgagaatgagacttctggatcagcagaagctggaattgctgcacatgatgtccaacgttatgtcaaggaatcagattgggctgcacaatgcacaaggcaagataaaatgtcaaatgaagaattgaagctgcaggatccacgatgtcggatacaatgtccaggacatcctgcccgaaaatactggacacataaatctgttatatctttaacagattgtgcaggatccacgatgtcggatacaatgtccaggacatcctgcccgaaaatactggacacataa

SEQ ID NO: 90526 - DNA, 330 bp, Glycine max
  Peptide Sequence Number=SeqID_182211
atgcaggggaatgacactattgagtgggagctagagatgaaaaatgagatgacatcccttcagaagagtaagacgtggtctttaactaaattgctagaaggaaagaaagcgttacagaataggtggatctataggctaaaggaagaatctaacggtagaagaagatacaaggcgagacttgtggtgaaaggaggaagacatctatatgtgatgcaatcctaccccgcaagggcattggatagaaaactccaagtagattgggccagagatgcaagagaaggccctagggttcttatgagccttagggtagatttcgggcccatgggctaa

SEQ ID NO: 90527 - DNA, 661 bp, Glycine max
  Peptide Sequence Number=SeqID_182212
atggagtggtggtagattagaatatagggccacactttatggtgacttggtcggatataggtctcgtatagatcatatggagagccatgagtttggactacaagaagatatccctgttgatcccatgaatcttgatctacttcaccaaattgacatgcgagacaatcattacattgattggatggagtaccatgcggggaaaaacactactttgttcttgtatgttgtacaacaactacatgatccatgcacaacaattacccataatgttgcagggccaggtgttgaacaaacacattttgaaatttcacatcctcagtcaatgtattctactccttcacctgttcatcaaacttttggccacactggcgagtcagtcaccgcaaccacccatgaatggatgaccgatttatttggcgtcgatttcaatacaccaaatttagcggcatcatatttatctactttacaacagttcgatgcaccacattcgtttggagaacatggtcaaagttcttcagctgcaacaaccaacattgcaaatactaacatagaacaacaacatcatcatgacatgggagaaccggtcatactggaaagaagaaattcgcgacgtaatcggcgtccaccaccttgtgggactggtcatcatcttggtcattga

SEQ ID NO: 90528 - DNA, 717 bp, Glycine max
  Peptide Sequence Number=SeqID_182213
atggcgaacacaccagtccaaactcacgctgaatcgctggcctgcgctactggcgtatatggcacggatcaatgcgcgcccagctgtgcaggcggcgttgctgcagaggcgtctgaatgtcagtgttattgtgacaacggcgcgcagaaagttatgctgtgcgcgccaggctatgaagcccgctattgggcccgcgtggcaacatcaacatcgaacctgtgctgttttgaggacactgacatgccccctttttatcagttttcggctaccagcctgaccggtcaacctatctctatggccgactacgctggcaaagtggttctggtggtgaataccgccagtcattgcggcttcacgccccagtacgccggccttgaagcgctctatcagaaatatgccgcacagggtctggtggtgcttggctatccctgcaatcaattcggtaagcaggaaccgggaaacgctgatgacatctcacaaacctgtcatgttaattacggggtaagcttcccgatgttcggcaaagtcgaggttaacggcagcgcagcgcacccaatatttcgctatctgaaagcggaactacccggcgtgctgggcggacggattaagtggaatttcaccaagtttctcatcggacgcgacggccagccgctgaaacgctttgcaccgctcacgcccccggaaaaaatggaagccgcgataatcgctgcactttaa

SEQ ID NO: 90529 - DNA, 195 bp, Glycine max
  Peptide Sequence Number=SeqID_182214
atggagtcaccaactgtcacaacctatccttcggtgcgagggcgacgcggggctcacgggtgtgtcttccatgggaggaaaatgcgtggagtcgccaccaacgtttattcgaggaaaacgtcgaaaaaattggaaagggtgtttccctcgctcctacgtatcctcaattgcgatgaggaaatcagacctacgtag

SEQ ID NO: 90530 - DNA, 495 bp, Glycine max
  Peptide Sequence Number=SeqID_182215
atgatggaccaaggccggttcgaaattgttgatgcaaacaagggggagcaacacgtgtacatgcaatcggctaacaagagccctagcaagcctaaacccttggtgatacacttcaccagagatgttgctgcatgcaatccccgtggttaccagcctatcccgggtaagaagcatgtccctttcccttacaagagtgacaagacagtcccatggaagtatgctcctcaaaagcctgatggaaagaaggacgagttcatcggagatgacctatcctctgccaaagttactaacatctctggcatgagtggcgtaacccgtagtgggcgaatcttcgtggaaccagacccattggtacgtcccaaggacacgaaaggaaaggcgaaggtgggaacaaaagaaggcgataaggcaagctcgattctcgatgaggagatcccgtctgggagatttgctaagggagaggaagactttggtagaaagaagatatccgcctag

SEQ ID NO: 90531 - DNA, 276 bp, Glycine max
  Peptide Sequence Number=SeqID_182216
atgaagaagaaagaactcctaatcttaaaagtgtgtgttgaagaattcatggcataccatgctagctcaaaagctaatcaaaattcaatgaaaaatcatgaaattcattttgaaatccaggtaggtgaccgggcagaagcagtgattcaatttatgtccagacgagaaaaatactttgtagaggttgaagctcaagagaaaagccttgtaaaagagcaagagtcaagagaaaaagatgaggagaaagatgagctctgtgtgactttcatgaaatga

SEQ ID NO: 90532 - DNA, 792 bp, Glycine max
  Peptide Sequence Number=SeqID_182217
atgttcttatgcatacctggccgagggttcatcttgaactcagagggccatcctggtaagattcttaggaaggatatgactacactagctcaggtgtggagtgtcctctcatactccaacttggcccctacatcacatacttctgaattgacagtggatagagctaggctgatctttggcctagtctcttgcttggatatgaacataggagcactgatctctagccagatgacctctatagcccagtctaacacttctagacttgggttccctgctctaatcatcgcattatgtagagccacaggggttgtctctgataacctcacttttgagcgcttgagcctggtggtggcacctccaggatctattccttcagttgagcagttcagggagatggtagtctggcccgggacccaaccttctcttcacagggaagatgaaggtcccacagcccaggtacctcagcatgtggaggatgagtcgtctgaggccaccatcccagagccatttgttataggagaagaggctaaggagacacatatgagacaggtagctgctgccacacttgagcgatcccttgaggctactttagagccttctgcacaaggggaggacataccctcacctcagcctgcagcagacccctccactcctattctagagatgccagaggacttgactacaccggtcctggctatggacacttctcctccagctactctagtattgcatctgatagatgaggaggatgttcagacacaggacacccaggaccagtcacaggaattttga

SEQ ID NO: 90533 - DNA, 229 bp, Glycine max
  Peptide Sequence Number=SeqID_182218
atggttgatgaatgccagcaaagggttacccttgaggactactcaagcagttcagtaccacaattctttaccagtgtcgcacgtccaaaagtccaagctcacaacataaactaccctcattctttaattcatttaatacaggggaacttattccaaggattaccaaatgatgacccctatgcacatttggcaacactcattgaaatttgtaacactgtgaagattgcag

SEQ ID NO: 90534 - DNA, 699 bp, Glycine max
  Peptide Sequence Number=SeqID_182219
atgaacgttgaaagcaagaggaaagatgaacaagaggtgaaagggtggagaaaagctttaaaaagtgtagggaattggctggcacataaggataaggatgaatggttgaaggacatgaggggaatgttgattttgttgtctacggtgatcgcaacaatgacctttcaaagtgctttaaatccaccaggtggagttagacccggaaacgagagtggagttgttcaatgtccagtaaacaaagcagataataatccatgtcctggagaatctatcctagttgttgtttaccctgatgaatatggaaaattcctcatttggaacacaacatctttcatttcatctttagcagtgtgtctcttacttgtaggtgggactcgtcgcatttgtcctttgcctacgcctaattgtttgaattgtctttgcctacaggctgagtgggagcagagagaggttcaactagtcagctgcatgaagaaaaatgaagaagagaaggtgtccttggaaaaagaaataaaaatattgctttatttgcttaaagaaactgagcaagaagctaatgccaaaagggaggaaaaagctcagttgaaggaaaaactgaaggaagttgcagctgaggcaatccaaatgcaggaagctcttaaggaaacaactactcacaacatgaaattaaaggagaacttattggataaagaaaattag

SEQ ID NO: 90535 - DNA, 213 bp, Glycine max
  Peptide Sequence Number=SeqID_182220
atgggtcgcttagcgggtttcacagaaaacaacactgggcttagcggcacaggagtgccgcttagcggaaattgctatgccaagggtaggctgtgcttagcggcactaaactgggcaaaaatttcactaagttatggaggcttagcgaacaggaatgctcaaatcagcaaatgccacaaagaatttcccttggcacaggagattctagcttag

SEQ ID NO: 90536 - DNA, 204 bp, Glycine max
  Peptide Sequence Number=SeqID_182221
atgtggctgaaaggggtgaagacccctgtgtttctgttggaaatcgcaatgaacgcgctaagcgcacctgctgcgcatagcctgttcatcacaactgttaaatttttggatttgcagatgatcgcgctaacgctaagcctggcctgtcaggctaagcgccactatgcttctgctaagcgcgagtctgctgcgcttagcccatga

SEQ ID NO: 90537 - DNA, 423 bp, Glycine max
  Peptide Sequence Number=SeqID_182222
atgggctgttccaaagatccctcatccccttggctatgcatttcagctgctttgggtgaaaaaaattatttccgtgaagaaaatccgagccgaggtgcttctgtaacgctttcgagacgtttccgtgggcgaatccgtgaaggttttccgtcgttcttcatcgttcttcatccgttcttcgttcgttcttcgttcttcaacggacgcttttctttggaagtttccttggatcaattggctaataaccaaagtgaaactaaagctaaaatcaactcacaaatcaagaactacgtaggtctgatttcctcatcgcaattgaggatacataggagcaaaagccccgcttttgtcgaccaccccaagagatcgttaatggtccaacgccttaacgtttctctcctttcaaaaacaagagatcgttaa

SEQ ID NO: 90538 - DNA, 258 bp, Glycine max
  Peptide Sequence Number=SeqID_182223
atgacaatgatgagcaaagatgagagggtaagatcatctaattattctcatggagaagatgacaagtatgaagaggatgggggaggatggaggaatgagaggtatagggagagaagaagtcatagaagatatggaggtaggcaaagagaggaagggattgatggagtaaaggtgaagatccctacttttaaaggcactcgtgatccgaaagtgtatcttgagtgggagatcaaggttgagcaagtctttgcttgctag

SEQ ID NO: 90539 - DNA, 639 bp, Glycine max
  Peptide Sequence Number=SeqID_182224
atgaaagcatttactactttaaatggcctggtgtgtccactggatcgtgccaatgtcgacacggacgcgattattccgaaacagtttttgaagtcgatcaagcgctctggctttggtccttacctgtttgatgaatggcgctacaccaactatggtgagccaggcatggattgcagcacgcgtccgctaaacccggattttgtgttgaatcagccacgctaccagggggcacaagtcctgctggcacgtgataacttcggctgtggttcctcacgagagcacgcgccatgggcgattgaagatcagggttttcgcgtgattattgcgcctagtttcgctgatattttctttaataactgctataagaacggtattttgccgattgtggcttctgccgagcaggtcgatagcctgtttaaagaatgttttgcaaatgagggatataagctcagtgttgatctggaagcgcaaacagtgaccacgccttctggtcagtccttcagtttcgagattacacctacccgcaagcacaacctgctcaacggtttggatgaaattggcctgaccttgcaacatgcggatgagattcgtacttttgaagaaaagcataaacaaagccagccttggttatttgcttaa

SEQ ID NO: 90540 - DNA, 954 bp, Glycine max
  Peptide Sequence Number=SeqID_182225
gggcgccttggccgcctgcggcaatatcccggctacggaaatcgcctactacggtgattcccgttaattctaccaggcgcgcatggttgcctaattgcaagccaattgcagtcacctcgctagcgcggagtgaagactcggcgagtaagccttttactgcttgtgcgtatagctcagccaggcggttggagatcacagctgcctggtgtatttcatccagcgctgggacgatcactgcatctaccccatccaggctggtgccggacatcagaccaataaacagccgtgttgaagtaggtaaagcaggggagttcataaggcataagtttaacactgctgataaaattcttatgacagacgtaacccaactctcagcagcggccgaagttttaagtccggaaatcgtaaatgcgctggcgattatcaagcgcggtgcagacgaactgctgattgaacaagagctggtggaaaagctgaaaacaggcaagccactgcgcgtcaaggcaggttttgacccgaccgcaccagacttgcacttggggcacacggtgttgattaacaagttgcgccagttgcaggatctcggccaccagattttattcctgattggcgattttaccggcatgattggggaccctaccggcaaaagcactacacggccgccattaacggtggaacaggtcaagctcaatgcggatacatatgccgaacaggtatttaaaatcctggatccggccaaaaccgagattgtgtttaactccaagtggttaagcgagttaggtgctgctggcatgatcaagcttgccgccagccacacagtggcacgtatgctggagcgtgatgatttctccaaacgctttaagggcaaccagccgattgcgattcatgagttcttgtatcctctgttgcaaggctatgactcggtcgcattgcaggcagatttggagctgggcg

SEQ ID NO: 90541 - DNA, 522 bp, Glycine max
  Peptide Sequence Number=SeqID_182226
atgtatgcctctatagcaggaggatttatcgataaatctttaggtgaaaaattattcttaaaactccccggtaaattaggacaaaaaattagagacaattggaatgatgaccaaactgacccagtcatgaataatctgactgttggaatccaacacaaaatgaaagtaatggaagatacatgtaccaacatagccattaacaaacaaataaaaatggctgatttagagatttgtaaacagatttatactcctcaacaataccataaagaaattaggagaaaaagaccccagtacagacctcccaacaaacaaccctctaagaaaaagaatccaactagtaggtattcaattagagcctttaattctagaaaacctactcttaacaaagaaagacatgttggaaaacttagagataacaaacatatacaaagaaacaagaatgttatgcttgccatcaaccaggacattactccagagattgtccaaacaaaaccaatctatttacaagaaaagcagaattga

SEQ ID NO: 90542 - DNA, 327 bp, Glycine max
  Peptide Sequence Number=SeqID_182227
atgaagtatctaggaagtgatcctaggtcgtctcccaacgagcaatggttacaaggatttatccctaatcagttcaaccactttgtcgcaacctaccctttggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 90543 - DNA, 908 bp, Glycine max
  Peptide Sequence Number=SeqID_182228
tttgcaagagcttaggcaaacaaaagggtcaactccaacgtcaagctttccacaagacatatggaatgatcttggatttggctatgataaaagtttctattatagccattgcatccctcgctcaatattacgaccagccgctaaggtgcttcacgtttggggactttcagttagtaccggtcgtagaagaatttgaagggatcttaggatgcccgctaggaggaaggaagtcgtatctgttctctgggaagcacttggaaaagaaagcaaaggctttggctggtcaaggagagtgggcttcattcattgatgttttagcgctattggtgttcagggtcgtcctctttccaaatgtggatgggctggtggatctagtggtgattgacgctaacccgtctgtcccttacaaggtcatcgcatgtgtgccgagaaagggaaaggttcccaaatgttcccttgatgggaacgaggggaaggataaggagcttagaggaagcaacaatggtgtaattggtggatatcataaatggttgagggcttggacgcaagggataacttggctcccgaagctaaagatttacaatgaggaagaggctgaaatccttgaggagagcgatgaggtgcaagccttgaaagtggaacttcaaagaatgcgagtggtcaaggaaaagttcaagacaacagccattagagtcaggaaggaatgtgacaagctgagggttgtcaacgtggccacagccgaaggacaagtcgagagtggaaagtatgatattagaggacaagttgaaggcttgtcaaaggtcgaagaggagcttgaccgaatagttgagaaggatggaagagaacatggaagcaagggagagtgtgatatattcattacacagagaagctatgatgtggatggatag

SEQ ID NO: 90544 - DNA, 717 bp, Glycine max
  Peptide Sequence Number=SeqID_182229
atgcgcgagtaccgcatcggcgacagcctgcgccagctcgactggaaggccaccgcgcgtgcacgcaagctgatctcgcgcgagtaccaggacgagaagaaccagcagctgctgctgatgctcgacagtggccggcgcatgctggccagcgaaggcggactctcgcacttcgaccacgcattgaacgcctcgctggtggtggcttacctggcgctgcgccagggtgacgccgccggcctgttcgctgccggtggtgaacgccgctgggtggcgccgcagcgtggcatgggcacggtcgagcacctgctgcgtgccagctacgacctgcagccgcgtgcggtggccaccgattacctggccgccgccaccgaggtgtcgctgcgccagcgccggcgcgcactggtgatgctggtcagcaacgtgcgcgacgaagacatcgaggatctgctggcggcggtgcgcctgctgcagaaacgccacctggtgtgcgtggccagcctgcgtgagcgcgagctggacggcgcactggagggcgaagtgcagacactggaagacgccacccaggccggtgccgccgcactctacctgcagcagcgcgcgaaggcgcacgaggcactgcgcagcgagaaggtgatggtgctggacgtgaccgccgatgccctgcccgcagcgctggtggagcgctacctggcagtgaagcgcgaaggattgctctga

SEQ ID NO: 90545 - DNA, 906 bp, Glycine max
  Peptide Sequence Number=SeqID_182230
atggtctttggcgatggggacggggaaatctttaaccgctttaccatcgccattgacgtggtggcgcacgagctgagccacggcgtcaccgagaccgaagccgggcttatctattttgaacagtcgggagcgctgaacgagtcgctgtcagatgtgtttggttcgctggttaaacagtaccatctgaagcaaaccgccgataaagcagactggctgattggcgaaggtctgctggcaaaaggtatcaacggcaaagggctgcgctcgatgtctgaaccgggtaccgcctacgacgatccgctgctcggcaaagacccgcagcccgctcacatgaaagatttcatcaaaacgcgcgaggataacggcggcgtgcacctgaactccggcatccccaaccgggcgttttacctggccgcgacggcgatcggcggctacgcctgggaaaaagcgggttatgcctggtacgacacagtttgcgatcgtaatctggcgcaggatgcggattttgaggccttcgcaaaactgacgatagcgcacggagagaaacgctccggtagcgatgttggggcggccataaaacaagcctgggaacagctggcccgggaaggcggcgtcgcttttattcctaagctgagcggccagcgtaccatcgcgctttcgtccctcaacgaggcccagcgccagcgtctggtgagcatccttgagcaggcctttccgcgcggccagccgccgggacaggcctcgtcacccggcagcggtgaccagcgctatttccgcatccagattatctggaccgggcaaaatcaggcgcactacaccgatatcatcgtgctggtgccggagcaggaagcgcccgagtcgctggtcgagctgtggaagaaaggcgaaggctgcgtgtgtgattaa

SEQ ID NO: 90546 - DNA, 530 bp, Glycine max
  Peptide Sequence Number=SeqID_182231
gtctgagttcctcattggaggatacgtaggagcaagagcctcgcttttgtcgaccacaccgccttttgtcgccataactcaagagctggtagcccgcggagacaccttacggttatccgcacctcgtcattcagtgaccccaagtgtgattgatgagcagaggccaatgtggtcatctggccttttccggagatgtcagcattttccgatggagacttttcaagtctcacaagttatccagaactacgtaggtctgagttcctcattggaggatacaggcggcgggcccgatgacaagcagagaccaaagaccaagtttggtcattctgcacacatgatacgcggagataccttacggttatccgcacccctttgctatttagacacagttgtgtccgatggcaagcagagaccaagttctgagaccaagtttggtcattctgcacacatgatacgcggagataccttacggttatccgcacccctttgccattcagacacagtcgtgtccaatggcacgcagagaccaa

SEQ ID NO: 90547 - DNA, 390 bp, Glycine max
  Peptide Sequence Number=SeqID_182232
atggtggtgagcttcttcttgactcatcttctccttgaagtggcgtctcctctctctcttcctttctccattccgctgccattcatcttccaagaagcaaaggaatccattgatgaagaagatcctaggcctgcaagctccaatggagcttacatcagatcaccatatatttcacctaatccaccgtcgtcaatggtggttcaatattctcctcagcagctagtaaaccctcctacactagtgcatgagataccagcagacccatcaactccattactggagattccagaggaccctgccacaccagttctgggactgactaccactcctccagacactcctttgatatatttttcagatgaggagggcactcaagatcaggacacctag

SEQ ID NO: 90548 - DNA, 132 bp, Glycine max
  Peptide Sequence Number=SeqID_182233
atggctcatggcggccaaacgcttaccttcaatgaggttaagttggtcgtagcgtgcttgagcctgtcataccctaatttcgtccggggacctttgctcgatgacgtgcgaccattctttggtcctcgtgag

SEQ ID NO: 90549 - DNA, 602 bp, Glycine max
  Peptide Sequence Number=SeqID_182234
atggtcagagattcggcaagagagttcgatcgtatgaagcaaactcgaaacggcgtagtgggcctaccgcggaaatacttggaaggcaaggcaagagatatggcaagtcaagaaaagtgggtcccgtttgcggatatactagctttgctgatctttggggttgtcctctttctgaacgtggacggtttggtggacctagccgcaattgatgctttccttgcatatcaccatagcaagcagagcccagtggtggctatcttggcgaacttatttgatacatttgaccgaaggtgcgagaagaacagcgcacgcatcgtctgctgcttacccgctctttgtgtgtggttggtttcacacctattccaacaagacataagacacccgtgtctgcttcaaagttatcgctcatgcatcgaaaagagaagagttgattgggaccaacacttggctgggataggaggcagcacaatcaattggtttcctcgatggaaggaaggaaaggagggagttcttttctcatgtggggactaccctaacgttccgttgatagggacgagaggttgtattagctataatcccgcacttgccataagacaactggg

SEQ ID NO: 90550 - DNA, 626 bp, Glycine max
  Peptide Sequence Number=SeqID_182235
cagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggagtgatagagcatctgtggtgggagatgcaattaactacatcagagagcttaagaggacagtggaagaactcaaattactggtggagaagaagaggctcgagaaacaaagggtgatgatgaggcacaaggttgaaactgaaggtgaatcctccaacctggaccctgcagagtacagtgaaagcttaagaagttcttggatacagagaaaaaccaaagacaccgaggttgatgtgcgcattgttgacaacgaggtcacaattaagcttgttcagaggaagaagatcgattgcttggtgcatgtgtctcaccttctcgatcaacttaacctcgatctccaacatgttgctggtggccacattggcgatttctgcagctatctcttcaataccaaggtcggtgtatatatgcagaaaaatgcgacatcgtgtgtatgttaa

SEQ ID NO: 90551 - DNA, 597 bp, Glycine max
  Peptide Sequence Number=SeqID_182236
cctgagcctcgcgcagatccagcgcctgggttgaacattgggagcatcagtatggaaatgcagttacgatcggccacgttagcgctgctgatttgcagctgttccgccgccgcggcagaactcagcagtccttcgccaggccagcttatcaacacgcgtttgtcttccatgaaggatgtggcgggctataaagcgcagcatcatcagccgattgaagatttgggtcaggagcgcaaggtgctggacaaagccctggcggaagcgcgtcagctgggtatggatgatgccacggtgcagccgtttattcaggcacagatggatgtggcgaaagcggtgcagtatcgctatcgcgccgactggctggcaacgccggagccgcactggcagccgcgtccgctggatgaggtgcgcaaaagcattggtcattacagcgacgcgattctgacgcagcttgccgcgcagttgaaacagggcgcgacgctgcaggcaccacagaaggccgaatttatgcgcgacattcagcagcgcaacgtgtcatcgcaggataaagagctattgtggcgcacgctcagcgcggtaacgttacggcagccgtga

SEQ ID NO: 90552 - DNA, 198 bp, Glycine max
  Peptide Sequence Number=SeqID_182237
atgacaaaatctgatgagaacaacaaagaagattctgtaaggaagaagtggtacatcgacagtggatgttccaagcatatgacgggagatgtatccaaattcaaaaccatttcccccaagaaaagtggacatgttacatacaacgacaacaatatcagtaaaatctcaaaagagaaaataattgttgaaattggttga

SEQ ID NO: 90553 - DNA, 396 bp, Glycine max
  Peptide Sequence Number=SeqID_182238
atggcgaggacgtgtagtcctctgaaggcgaggacgtgtagttctctgaaggcgaggacgtgtagtcttctgaaggcgaggatgtgtagtcctctgaaggcgaggacgtgtagccctctgaaggtgaggacgtgtagtcctctaaaggcgataggggtgatagtccatgcaaccttgtcgcaacccacccttttgcgggcgagcgaggcgaggctcacatgtgcgtcttccaaaggaggaaaatgcgcggagtcgccaccaacgtttatttgtggaaaacgtcagaaaaaccgaaggaaaccggtcatgaagaattttccagattcgggagttgtatttacgtttgaggaaggtattagcacctctcacgtttgtcccaaaggacaacagccttaa

SEQ ID NO: 90554 - DNA, 544 bp, Glycine max
  Peptide Sequence Number=SeqID_182239
aaaggacagagagcttaggggaagcagtaatgggatcatcggcggctatcataagtggctgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaaggcagcaatagtgagctcaagctccgaagagggaatatgtgggccattcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttccccgattgctagccaaggccaaagcaatggcggacacctactctgcccccgaggagatccacggacttctcagctattgtcagcatatgatagacttaatggacatatga

SEQ ID NO: 90555 - DNA, 168 bp, Glycine max
  Peptide Sequence Number=SeqID_182240
atgactaaagcacgtcaaaagggggtacggaaattcgatttcgggaacttaccggttgaagaccgaagaacgacaaagaacgaacgaagaacggttgaaaatcatcgcgaaatcactcatgaaaacgtcacggaagcgcctcggcttggattttcttcacagaaataa

SEQ ID NO: 90556 - DNA, 291 bp, Glycine max
  Peptide Sequence Number=SeqID_182241
atgactaaagcacgtcaaaagggggtacggaaagggaaaagagggaggtggttgccacccagctcgcccaggcgagctaggttgcttccactagaagacaccgccttctcctggaaggcccaaaactttacagattgcgcattaacacttcctttcatctcccgacatgttgtgaaacttcacggattgcctaacgatgggtgtcaagtacctcaaagtggtcaagcgagggtcgcatcccaacaaacagatggtccccagacgaaattagggtatgacagtaggaaatag

SEQ ID NO: 90557 - DNA, 382 bp, Glycine max
  Peptide Sequence Number=SeqID_182242
gtttttactctcgtcgtccagaaacattcaagcccaatgacgcgcaggattcttctctactcggcagggacgatcgagtgcaatggcatagggaagtgtcgtggttgtccaactttgtcactttcaagacactgaaggttgcttctggaggaagcaacccagctcgcctaggcgagctgggcagcaacctcctcccccattttcctacaaataggcgaaggggggctgttccaaaaatccctaacccccttggctatgcatttcagctccgaggtgcttccgtaacacttccgagacgtttccgtgagcaaatccgtgaaggttttccgtcgttcttcaccgttcttaatccgttcatcgttcgttcttcgtttttcaacgg

SEQ ID NO: 90558 - DNA, 408 bp, Glycine max
  Peptide Sequence Number=SeqID_182243
atggcgcttcctctcacctcttctcctttgtcttccgctgcatctccatggtgcctatgtgaggaacaaacatgggcattaagagtcatttttgccaaattcattgatctagatcacttttggaatttctctacacctccacctgcacaacctgtgcaaaatagccgttctgagccttccttggaggatttgatgaagcaaatagccactagcaacattctgtttcaacaaaatcaacaaggttctggcaatattcccgcacaactaattatcagtccaaaggggaatatgaatgctatcacgttgaggagtggcagagagcttccaaagccaatagatgatagtgccaaaacagattttgcaccaaaacagattcctctaccgtttccttctagactattcctataa

SEQ ID NO: 90559 - DNA, 258 bp, Glycine max
  Peptide Sequence Number=SeqID_182244
atggtgattgatgcagcagtttggaaagtagtagcaagaatagatatgggtggagtccgcaagtttgaagaatctacagatggctacaacaaaatggccacatacagaggtatgcttcttgacctggcaagagttctaaggaacaaattgggtgttggtggtctaacaatggaagatagaatgttggtctatatcattacgtatattttggcaccaagatccaacaatcattctcaagtcactgacgatgatttgtag

SEQ ID NO: 90560 - DNA, 504 bp, Glycine max
  Peptide Sequence Number=SeqID_182245
atggaaaataatgtctccaaagtgaatgaggagggtcctgtaagaggagctgatagtgatggagctggtaagggagtgggagccgaagttggtgctggtaaagatgaagctggagcagatggagatggggcagaagaatttggtaaagtggatgaagaaggagcagaagcatctggtgttgctaaagtagggggagcctcagatctcttacctctagccttccttggccctctgaatgtcactgttggatcatctagattccaacagttcttctttatatatgccaagttaatggcagggctaaggctctcaaacgatctggaatctgatgtgactcctctagctttacacaaagttgtgattaagtgtgatgtcagaagtgtgggaggtggggaccaagttggagtaagaaagaacactctaagtctgagcgagtgtggtcatgttctttttgaggatcttcagaggctaaccatcaacattaagctcaaatcccctccctag

SEQ ID NO: 90561 - DNA, 3093 bp, Glycine max
  Peptide Sequence Number=SeqID_182246
atggctgagaaaatgatcaatgttgttgcttcttcctctggatctgcttctaaggtattccctaaaaaatatgacgtttttctaagctttcgaggtgaggacacccgaaggaacttcacatgccatctttacgaagctttgatgcaaaagaaaattaaaacctatatagatgaacaacttgaaaagggagatcaaatcgcactagcactcaccaaagccatcgaagattcttgtatatctattgtcatcttctcagataactatgcttcctcaaagtggtgcttgggtgaactcttcaagatcttggaatgcaagaaagaaaaaggacagattgtgataccagtgttttacaatatagatccatcccatgtgaggaagcaaattgggagctataagcaagcctttgcaaaacttgagggagagcctgaatgcaacaaatggaaagatgctcttactgaagcagcaaatttagttgggaatgatgttgaattgcttaaggacattgttagagctgtttcggaaaaattgcctcgcagataccaaaaccaaagtaaaggattggttggaattgaggaacattataaacggattgaatcatttctaaataatgggtctagtgaagttagaacccttggaatatggggcatgggtggcataggtaaaagcacccttgctactgctttatataatgaattgtctcctgagtttgaaggtcattgcttcttcataaatgtttttgataagtctgaaatgagtaatctccagggtaaaagagttttcattgtcttggatgacgtggctacctctgagcaattagaaaagctaattggagaatatgattttttgggactaggaagtagggtcattgttacgagtagaaataagcaaatgcttagcctagttgatgaaatatattcagtcgaggaattgagctctcatcactcccttcagcttttctgtttgactgtttttggagaagaacaacctaaagatggatatgaagatctatcaagaagagtaattttctattgcaaaggtattcctttggctttaaaaattttgggtaaaagtcttcgtcaaaaatgtaaagacgcatgggaaagtgaattgagaaaaattcaaaagattctaaatgtggaaattcataatgaattaaaattgagttattatgacttagattgttcacaaaaagagatctttttagaccttgcatgcttcttcaaaggaggaaaaagagattgggtagcaggattattggaagcttttggtttctttccagcatctgagatagaagtacttttagataaatctctcataagaatttcaaaatacaatgagatagaaatgcatgacttgacacaagaaatgggtcgagaaattattcgtcaacaatctatcaaagatcctggaagacgaagtcgattgtgcaaacacgaggaagttgttgatggaactgatgttgttgaaggcataattttaaatctgcataaattaactggggatctatttttgagctccgattcccttgcaaagatgactaacctgagatttcttcgaatccacaaagggtggcggagtaacaaccaatttaatgtgttccttagtaatggtcttgagtcattgtctaacaaattgaggtaccttcattgggatgaatgttgtcttgagtctttgccgtctaacttttgcgctgaacaacttgtagagatttccatgcctcgtagcaagctcaaaaagctctgggatggggttcagaacctcgtgagtttaaagaccattgaccttcaagagtctcgagacttgattgagatcccagacttatttatggccaaaaaacttgaaagagaattcacggtgacatcagaggaaatgatagatttgatgttatctcacactgctatatgtacattgtcatcaccaattgatcacttattgtctttagaagtgttagacctaagtggaactaatgttgagatcttgcctgcaaacataaaaaacctttcaatgatgagaaagctaaaattagatgatttctgtacgaaactcatgtatctgccggagcttccaccatccctaacagagcttcatttaaataattgtcagagactcatgtctctaccgaagcttccatcatccctgagagagcttcatttaaataattgttggagacttgtgtccttgccgaaacttccaccatccctaagagagcttcacttaaataatttttggagactcatgtctttgccgaagattccaccatccctaagagagcttcatttaaataattgtcggagactggtatccctgccgaagcttccaccaggggtgaaagaggtgagtgccatcaactgcatttctcttaagacagatataactcaacggctagtgttacaacacatgtatcagagtcgcataccctacttaaacaaagaccctacataccgtgaggatgaatacttcttcttccctggagatcatgtcacaaacagcaagtatggatttcatacagaagagagttcaataactattccttatcttccaaaatctcatttatgtggtttcatttattgcatcattcttttggagggatcagtcttaaaagataaccggttttcttgcgctatctatcgagatgatatgctgatcagtttggaccatcgcaggattataggctgcgaaaaattgatttcagatcaccaagactcagaggattctgtaacagtaacggtggtggtcgttgatcagcgaatcatcagccaggagtgtgtcgatcaccttcaggaggtgcttctaagccttgtaagttcagtccgactcgcaggtacggatcgcaaacaaaagcgccccgtgcagatcatgcgcactcaggatctggttagcggaatgtgtgcgtgtggtaacaagggcataatgacgttgttgagggaccaaacgattaggttgtggtctgatcagaacaacaaccacaagtttgtgagttcaaagattctgctaggttacacgagctttgtaggacctttggagtggattcccccgaacacatcattcctgcaaggacactctggtctttgtctgggacttaaacacgggtga

SEQ ID NO: 90562 - DNA, 126 bp, Glycine max
  Peptide Sequence Number=SeqID_182247
atggcggattcagcaatgatgaataatgaggttgctaaagctatgagaggaaaaggaataggaatgaatggggactgttggaatgaatggcgagatgcacgccttggcggtggtggcgatgagtag

SEQ ID NO: 90563 - DNA, 601 bp, Glycine max
  Peptide Sequence Number=SeqID_182248
tcgaagagtcatgaagaagagcatcgcacatgcgcgtggaaaccctgacggtgaaggagaacacggcgtgcacgctgctaagactcttgtaggtggaggagagcaaggcggcgatcgggcggttcagctttccactgctagtcagcctcctgcggagtgggaggttccgcacaaagaaggacgcatcgaaagcgctgtaatcactgtgcatggtgaaggagaacaagatcagggtggtgaaggtggggatcatgaaggtgctggtggagctgatggaggacttcgagtcgaacatggtggacaagcgagggtggcgctggtggaggaaggaggcatgccggtgctggtggagatcatcgaggttgggacacagcggcaaaaggaaatcacggtggttattctcttacaggttagcgatgactttgatggagaagagcatcaccgtgaagatgccgccaactctgacgtcggcagccaagtcgaagtagtctgcgatggtggcgttctggttgtcggatttcttcttcgacggcatatctttccgtgttggttcttgactgcggagacgcagtccatggcgacggtagccgccggagtctaa

SEQ ID NO: 90564 - DNA, 213 bp, Glycine max
  Peptide Sequence Number=SeqID_182249
atgacagatgtcgtaccggatgtcacgacatcacgcttcagaacatgcagattatatttgacaaggccaagccctagtgcaacactaaagttgtgccttggtgaccggtttggtcatgggttcaaattcggaaacagtctctttgcatatgcaaagggtaaggctgcatacaaccaccctacctcataccttcgcatagcgaaagccttctag

SEQ ID NO: 90565 - DNA, 318 bp, Glycine max
  Peptide Sequence Number=SeqID_182250
atgtccttgtggggtaggattgcatcatttgcgcatgaccccaaagtcctacattgcaaagtaaggctcatgagaaccctagggccttctcctgcatctctggcccaatcttcttggagtcttttatccaatgcctttggggtttgggattgcatcaagcctcatcatgacttggagttcagctaccacgtggtgccaatggacatggctaaagttatcaaggatagaggagaccattctaatatgaagtctgaggagattgaggagtacaaaaaaactattgtggcagttagagccttcaaccgagaaggagtatga

SEQ ID NO: 90566 - DNA, 201 bp, Glycine max
  Peptide Sequence Number=SeqID_182251
atggcaaaggtgcagaagacgatgttagtctctgcgtgccatcggacacaattgtgtctggatggcaaaagtgcagaagacgacgttagtctctgcgtgccatcggacacgattgtgtctggatggcaaaagggtcagtatgacagagattgtggggcggccgacaaaagcgaggctcttgctcttacgtatcctcaatga

SEQ ID NO: 90567 - DNA, 207 bp, Glycine max
  Peptide Sequence Number=SeqID_182252
atggcaaatcaagaggagtgggtcccatttatggacgtattagtgttgctaatcattggggttgtcctctttccaaacatggatggtttggtagacctagccgcaattgatgctttccttgcatatcaccatagaaaagagagcccggtggtagctgtcttggcggacttattagacacatttgaccgaaggtgcgagaagagttga

SEQ ID NO: 90568 - DNA, 168 bp, Glycine max
  Peptide Sequence Number=SeqID_182253
atgataataataggtgaagatgggggagctgcttcaagtttgggagaagatggatctgccactggagaatatggatctgctggcactgattcaacttgtaataagctttgcagcatagtggttgtgatttgggagctctgggcatctggtcctgctgatgcagattga

SEQ ID NO: 90569 - DNA, 396 bp, Glycine max
  Peptide Sequence Number=SeqID_182254
ggccctggggtttccggctcttatcacgggcctctgccagtcctacggagttcttgtcaccccaacaaggtaatccgactgccgatcacccgagccttcattgagaagtactgcacgcctaggcaggcgcagggtgacgcacatcaggatgcgggcacaccgccgccacctcggccggccgatttggctgggccactaggcgtggagcattatctacagcatttggttcgccagcaggtggccaaccactgtggacaggtcgcatggcctggagactggcccaatgcccaggcaggggaggagcctgcaggatcccccggtgaggcagatgaatcctgtatggatgaggatatgactgacctactcggtttcttgggagggaccggagccatatga

SEQ ID NO: 90570 - DNA, 84 bp, Glycine max
  Peptide Sequence Number=SeqID_182255
atgttggcgcccatggctcatggccgtcaagcgcttaccttcaataaggttgatttggtcatagcgtgtttgagcccactctga

SEQ ID NO: 90571 - DNA, 844 bp, Glycine max
  Peptide Sequence Number=SeqID_182256
atggggacgaggggttgcatcaactacaatcccgttcttgctataaggaaacttggctaccctatgagaagggcgctactagaggatgagctcgcacctgtcatttcacgaggcttcaataagaccaacgtggagacgcttcagaaggtccgcaaggcatgggaggtgttgcaaaggaaggacaaagaactaaggggaagtaacaatgggcccatcggtggctaccgtaagtggttgaaagcccacgtgcaaggtttggattggctcccgagtttgagaaccgctaaaagggaggaagttgaggcatcagaagaagacgaagaggtgcaggcccttagggcagaactcgagcaagcccaaacagtcaaagaaaggttcaaatcagcagctcttaagatccgaaaggagaatgccgaactaagagatataaatatagctaccaccaaggccttggaacaagaaaccaagagggctcgcaaggaaaagcatggccatgaaaaatttcgtggagctttatggggcagcaactgtgagctcaagcttcgaagggaagagagagaccaatctcgagcacttagcatggtcttgaaagagtaccaagaagaactaaatctagccacggcccacgagcatagagtggcagacgagtatgcccaagtgcacacagaaaaggaggctagaggaagggtgatcgacgcgttacatcaagaggcaacaatgtggatggaccggtttgctcttaccttgaatgggagtcaagagcttccccgattgctagccaaggccaaagcaatggcggacacctactccgcccccgaggagatccacagacttctcagctatt

SEQ ID NO: 90572 - DNA, 300 bp, Glycine max
  Peptide Sequence Number=SeqID_182257
atgattatgaggggccaagacatttatagtagccaagatgaggctactaattcgccttcctttagtgaaagtgaagaagtaaaaggggaagaatctagtgaagaaatctacccccaagaagaaggacaatgtttaatggttaagaaggagtgtaagaagataagtgtctcctccaagaaacttccccttttagacaacctccacatcttctccttttgtaaaaagacacttgttagcactgccacaccttttgggcttgaaattattcctcaagtaaaggagttgttggatgagggtttg

SEQ ID NO: 90573 - DNA, 267 bp, Glycine max
  Peptide Sequence Number=SeqID_182258
atgggtagtgggagatcgaggcgacggttaccagtaaacgtgccatcgtgtcgtcgtttcaggaaagctgcgtattacagagcaagagtctggttaggacctgctcgaatcgaaaagaggggagagtctttgagaaggaattcccaggttcaaagaagtatttacgaagtacaaagcttagacaagaaagaggacttcgagccattgggcaattcgaactggtgtatggacgagtcgaagtcgaggcaacaagagttctggacttag

SEQ ID NO: 90574 - DNA, 228 bp, Glycine max
  Peptide Sequence Number=SeqID_182259
atgaagggactaggaatgaagatgaatccgtggaagaggattgactcccaaagattgtcttcttctcctaactcaagctctaaggttctgttcttgtctaaacacgaacaccctttcttctttatgtttttttcacttaaaaaccattacgagctgagattctacgctgagggtgtctgcacgctaagtgtgagtaagtggctgggcgctaagcgcaccttcacatga

SEQ ID NO: 90575 - DNA, 192 bp, Glycine max
  Peptide Sequence Number=SeqID_182260
atgtggcgaaagtcgaaaagaggagtttttgcgcaatccatggttcctccagaaggctgttgcttctggaggaagcaacctggctcgcctgggcgagctgggcggcaagcatctccccttaggaagaaaagggttcagccccttaggcacttccctctctttcgaatttgcttggaaaaattgtttttgtga

SEQ ID NO: 90576 - DNA, 735 bp, Glycine max
  Peptide Sequence Number=SeqID_182261
atgaagaggggtgctggcggtcgtcggcaacagcttatcgctgtcggcgtagacgaaaaaggtttcgccgctgtttttattcacgatcagctgatcgccattgcggaaacgggtgatggcgaccttatcgccgtcctgcagacgcgtgcgctgctgcccggcggcaatctggaaatgccgggttggccacatcagcgtgctgagcccgtaggcggcacgcgataccgtcatggtggggcggcccgggcaggtgatctggaattcgctttcgctccacgcgggggcaatctggcaggccatcaggagcgcggcaagggttatcgccttcatggggggttctccactgaggtcagccactgcgggcaggaagaacgtctccacaccactgattttgcattattcgcgcggctggcgcaatcgccgtttcgccgccgcttccatttaggcgcgaaagagcgacagtactgtattgagaaaggcccggcggtgatcgaccaacacgcggccgattttatccagcaaagactggctgcagccgaaccaaagaatgatggcaaacagacgccaatgcgcggccatccggtatttatcgcccagcacgccacggcaacctgctgccgcggctgtctggcaaaatggcatggcattgctgcgcatcagccgttaacggcagagcagcagcaatatatggtgcgggtgattcaccgctggctggtgggtgaaataaatggttaa

SEQ ID NO: 90577 - DNA, 195 bp, Glycine max
  Peptide Sequence Number=SeqID_182262
atgacgaaatgcgttaccgaagtcacggtagcacaagcttgcgccaatcttatagcggaaccgaaaatcagtgaaaattcgactacttatgctgtctgctttgctgctggctggctgtgccagcgagccggaaaaaccggtgacgccggagagaaatacgccattaacccaggcgccgccgtcgaaagtgaatga

SEQ ID NO: 90578 - DNA, 243 bp, Glycine max
  Peptide Sequence Number=SeqID_182263
atgaagaacacaatcagtctaatggagaaacttatgaagaacaatagcaaagcaaagaaggaagtgcagttgtgcactctcggagctccagcttttataatggaagaaccaaaattttcaagcaaaggcaacccgccagccatgctggcgatccgactagccctgcgctctgcaccctcagttattggaactcgccagtttgactggcggttccctacgctttctgcatatcgccagctttaa

SEQ ID NO: 90579 - DNA, 234 bp, Glycine max
  Peptide Sequence Number=SeqID_182264
atggcttttattccaagaggatacaacaagatgaagccttgtaaggtctcttaccaaaatataaaacaaaaaatgaaatttggcaatcaagaattgcatgtacttacaaatgagtttcactactgtcacaacctacccttttgcgggcgagcgaggcgaggctcacggatgcgtcttccatgggaggaaaatgcgcaaagtcgccagcaatgtttattgaaaggaaaacgttag

SEQ ID NO: 90580 - DNA, 450 bp, Glycine max
  Peptide Sequence Number=SeqID_182265
atgagtcatcattcatctaatgttaatggtgagggtactagtcataagaaccctctatctagaatcttagatgagttgagttccctgaagttatggaaagcaaaactagaaagaaaagaaaaaggaaaagagagggtagaaataaatcaagatgagagggaacaaataaaggaagaagaaataaggaaaatactaaaaaagttaagaaaagcaaaacatgcctcctatagtagtcatgacttttgcaagagcctaagtgaagaacttcgtgactattatgaaggaaggcataggtcacatcttagacctcgcttccataggagagaaaaggaaagaaagcctcaagaggctaacattaacctcccatacttccatgggaagaacaatgtagaggtttacttcgattgggaaataagggtagagcaacaacttaaaagaaagtctacttga

SEQ ID NO: 90581 - DNA, 330 bp, Glycine max
  Peptide Sequence Number=SeqID_182266
atgggggagacacatgaagcaccccaagaccacaatctagctgactttgagcctcacctcgaatatgctgctgaggggcagacgttttgtggcgtacccctgtcaaacacttttggaggccctcagtattgcccacaaccacaacccttgcattttgcagtgggaagagtccctcctgctatggtggaaataaagaaatttgatcatataaaggaaaggctaagggtcattgagggaggcgaaaattatgcctttgcagacatggcagagttgtgccttgtgcccgatgtggtcattcctccgaagtttttggtcgacgggtatcgataa

SEQ ID NO: 90582 - DNA, 828 bp, Glycine max
  Peptide Sequence Number=SeqID_182267
atgacatcaaagaagagaaaggaacctgctacaccttcccaggtctgttatgaccaatccaggttcacttctcctaaggcctgggaaaggtacactaatattgtggtacccagaaaattactccctaagcgaaatgtggtaatctaccacactgagtttgatgagttcaaggaagaactggagagaagaaaatgggatgaggaattgactagttttgatgaaggcagcattgatgttgccattatgaaagaattctatgctaacctctatgaccccgaggataaatcacctaagcaagtgagggtgagaggtcatttagtgaaatttgatgcagacaccttgaatactttcctgaagacccctgtgataattgaagaggaggaagagttatctgcttattccaggttttcactcctaaggcctgaccctcaggaattggtagccaagctctgcatcccagggaggggatttgagcttaatgctgacggcttgccactgaagatcctcaggaagaacctgacgacccttgctcagacatggagcgttctctctttctccaacttgatccctacctcacacacatcagatatcactatggatagggccaagttgatttatggtataattcagaagatggacatgaatcacgaatcctctaggcttgggtttccagccttaatcactgctttatgcaaagctagaggagtcacttctgattccaggaccttggagagtctcatccctgccattaatgtggcatatgtaaagaagaactattggaatctggatgatccaacagtgactttcagagggtcccagagaccaagg

SEQ ID NO: 90583 - DNA, 201 bp, Glycine max
  Peptide Sequence Number=SeqID_182268
atgtgtggctttaaccacacatggatgcggttttttagcaagagttttataaaactcttggagctcccgaatttggagtatcctactttcatggaacgtgagaagcagatgaataatcatctgcttccgcaagcaatcgaagatatttcttgggacgatcaagagtactcgtctctttgtagatcggtcagacttatctga

SEQ ID NO: 90584 - DNA, 760 bp, Glycine max
  Peptide Sequence Number=SeqID_182269
atgacccgcatcaagaaaactggccaaatgacctctgaggcaacaaaggaaattgctgacaagattgtaagattccttggaggagcaggcctcacagggttcctttgcacccatggacgtcaggatgtactgactgctgccattgggcgaccagatcaccttggtcgtgtgcgtactgctggagtcagtgtcatgattgaacaattctttagactggctccaaggacctcccgcacgtcttcgtccatggctcctgaagacctggagcagctgaaggagtcaatcatagaaaaagaacttgcactaccttctgagcctgaggttggtccttcagctgctcgtgttagcacaaaggagagttgtgttgatccctcaaggaatgatccagacatgggtgactcagagaaatgtgggtcgtacatcgaagaaaatcttccccacctggttgccctaggaagactttatgaggggtcaacatccgttcacaacatccctttgtgccattctcaagtcaaggttggtgttgaggaagttagagatgtagatgtttccattcctatacccattcaaaaggttcagttagtggggcaggtacttaacaccttcgttgctgggccgacacatcttgtcaagcgtttatcagaacagggagctgtgggactaacaaaacctgttatgtgggatgctaacatgtttggggtgtttaatgacaacttccccttgtacataaagcatgaagatctgtctgaaatagcatatg

SEQ ID NO: 90585 - DNA, 72 bp, Glycine max
  Peptide Sequence Number=SeqID_182270
atgtctcgggcttcatcctcctcagtttttgttttaccggggaacactcaggatttagaggggatcctctag

SEQ ID NO: 90586 - DNA, 432 bp, Glycine max
  Peptide Sequence Number=SeqID_182271
atggcggcgcagctaatccatgatcgagtagagatggagtgcctagagggagcctgggagaccctcgaaggcaatacgaggtgccgatttcggggcactattcgatttacggcgacttctttggtgcatcgagatgagcccgtgcgcacgcttcagcgcactgtggagaggatactacccacgcctacaccataccgtctagtggagccaatccaagtgatcgaggtgatgtcatccgaggaagaccctgaggaggatcccgaggagctacctgctgagcctgctgtggatgctcttgattttctagagggcgatgaggacccacttcctgaggtggattctcccaaggaagtcatgtcggcatctgaggcagactctacggaggatagtggcccgagagagatggcgaccagtggaggctcttcatcatag

SEQ ID NO: 90587 - DNA, 629 bp, Glycine max
  Peptide Sequence Number=SeqID_182272
caacgggcccatcggcgattaccataggtggttgaaagcctatgcacaaggtctggattggctcctgaatttgagaactactcaagaggtggagggtgaagctccggaagaagacgaagaggtacaagccctcaaaacagagcttgagaaagcccaaacagccaaagaaaagttcaagtcagcagctgttaggatccgaaaagagaacaccgaattgagagacgtcaacatagccaccatcaaggccttggagcaagagactaagagggccagcaaggaagaacatggccggaacaagttccgaggggctttgtggggcagtaacagggaacttaagcttttgaagagaggaaagggaccaatcgcgagtagatggcataattctaaaggacaaattgaagacttgcctaaggtcaaagaggagtttgtctcagcggtccgagtgtacacgaaaaaggaggctagaggaagggtgattgattcattacatcaagaagcgatgatgtggatggaccggtttgctcttactttgaacgggagtcaagaacttccccgattactggtaaaggccaaagcaatggcggacacgtactctgccctcgagcaaatccacgggctcttcagctatt

SEQ ID NO: 90588 - DNA, 231 bp, Glycine max
  Peptide Sequence Number=SeqID_182273
atggtgtttgatggtcttggagtgagtaaggatatgatgtttatctctgccaaccaagttgtgacatctttgaaagaatatgctcaagtgtacatgatcttgtctaacctagaaatagagacaaaggtttccatgtgtgacctccctgttgtcagagagtttcctgaagtgttccctgaggatatatccggtctaccactcgagagagagatagagttttccatagacctg

SEQ ID NO: 90589 - DNA, 120 bp, Glycine max
  Peptide Sequence Number=SeqID_182274
atggtccccccccccttttacagcgacatgctctgcttgtccagcaccgggaagggacgacgatcggtcggtcgtgaccctatcctccatttgcattcgtccctaagtacctgcaagtag

SEQ ID NO: 90590 - DNA, 193 bp, Glycine max
  Peptide Sequence Number=SeqID_182275
atgacacaaccgccaacaaatatgagcaatttacatgttgacgaagatgatgatgatgatgatgattatcttgtgtctaacttatacgttgaagagtctttagacgaagatgacagtgttgacggtatatctaatatagacgatgaagtcaccgacatgattcaaccactaaaaattgttcacccagttgaag

SEQ ID NO: 90591 - DNA, 417 bp, Glycine max
  Peptide Sequence Number=SeqID_182276
atggctttgacaagatctttcttcttagggaccctcttaatgtcaatcttaatgtcgtgtttatttctttttggcccagagtattgtaacctcagatggtccagccctcagcaacaacaacagcagcctgctccttccttccaaaatgctgctggcccaagcagaccatacattcctccaccaatccaacaacaacaacaaccccagaaacagccaacaattgaggcccctccacaaccttccctcgaagaacttgtgaggcaaatgactatgcagaacatgcagtttcagcaagagaccagagcctccattcagagcttaaccaatcagatgggacaattggctacccaattgaatcaacaacagtcccagaattctgacaagctgccttctcaagctgtccaaaatcccaaaaat

SEQ ID NO: 90592 - DNA, 648 bp, Glycine max
  Peptide Sequence Number=SeqID_182277
atgtggctgaaaggggtgaaaacccctttggcttctaggaaaagaaaggcaccctttacacctacccaagccagatttgatagatccagattcacttcccaagaggcttgggagagatacactgacattatggtgcctcgtaagcttttaccagaaagaaatgtggtagtctactatacagagtttgatgagttcaaggaggaacttgagagacgccattgggatgagcagttgactgacttcctggacgacaacattgatgtttccattgtaaaagaattttatgcaaacctctatgaccccgaggacaaatcaccaaagcaggtgagaggtcatttgattaagtttgatgaggatactcttaacacatttttgaagacccatgttgttgtggaagaggggaaaacactttgtgcttattccagatttgcactcctgaggcctgatccgttggctgctaagctttgtatcccagggaggggattcgagcttaatgttgatgggcagcctttaaagattttgaggaagaacatgagaccacgcttgcttagacttggagcattctttccttttctaaccacatccccacttcccacacttctgatgtcactcatgacagagccaaactcatttatggcatcatcatga

SEQ ID NO: 90593 - DNA, 225 bp, Glycine max
  Peptide Sequence Number=SeqID_182278
atggctactccacctgcctcgcctcctcctccttctcctcctgctcttcctcctcctccagacgcatcagcgtctccgtctaccgtgaagcagacatgcaaagcgacgcggctaagattgttggccactagatcacctggtgcagagagacaaatggtcaacattgatcctgctactgttggatcaagtggcctcggaataattaagaagggggggttgaactaa

SEQ ID NO: 90594 - DNA, 466 bp, Glycine max
  Peptide Sequence Number=SeqID_182279
atggagttttttcaaactatagggtatgccatgactcaaccagagttttttcgccactaccggaagttacaagaagacaacccacacgacactgctaatgcaatgatcacctccggacaagtttacacagttattgcagccaatttcatcaccaaaaaagaaaccaagtccaacactcacttcgttcaacagtttgaccaccaaagatttcaatttcaagttgaggaaagagtgaatacaagagataggcatcgaatacaagaaaccctagtagctactgaaaccgacaatgcgtttcgctctctcgatacaatgaatcagaattcaatgccccagggaagggaaactatggaaagtgatttacgcgggagcaaaatggaaggagagggggcaaaggtttgcaaactctcccctgctttgggaggcttgattgagaggattgaagggatttttgtggagattagag

SEQ ID NO: 90595 - DNA, 255 bp, Glycine max
  Peptide Sequence Number=SeqID_182280
atggaggttgagaaatctttgctaggcttatggctaccattgcattatggagcagataagggagggtggtgtttggtcttaaatgtgccgccggtggatgttgtggccgatttaggggtggcctttgtggctgacatggtgtttttggccttggatcttcttcatcaatggagtcctttgcttcttgaagatgaatggcagtggaatggagatggaagaaagatgattggagacgacacttcaaggagaagatga

SEQ ID NO: 90596 - DNA, 180 bp, Glycine max
  Peptide Sequence Number=SeqID_182281
gtacctcagggaaactctgctactgcttttgttaacaaagaggacacctcctatgaatctaaggattcatgcacaggtatcccatcttcaatatccagtaaaacccagattgtcgaagaagaggaacaatttcctatggtatttgttcttcaccttgatacgtggggacaactcgtctga

SEQ ID NO: 90597 - DNA, 681 bp, Glycine max
  Peptide Sequence Number=SeqID_182282
atgaccgtgcctctcaatgagtcaatctcttgctttctcataagggtgaacccttgggtactagtatctattgcctttagagggctacactccctcgccttcagagggttgcacacccctgccttcagagggctggatgccctcgactttagaggacaacacatcctcgactttagagggctatacgccctcgccttcagagggctacaggttctcaccttcagagggctacatgtcctcgccttcagaggactacacgtcctcgtctttagagggctacacgccctcgcctttagaggactacacgtccttaccttcagaggactacacgtcctcaccttcagagggctacacgcccttgcctttaaaggactacacgtcctccccttcaaaggactacatgtcctcgccttcagtggactacacgtccttgcctttagagggctacacgccctcgccttcagaggactacacgtcctcgccttcagaggactacacgtcctcgccttcagagggctgcacgccctctacttcagaggactacacgccctcaccgtcaaaggactacacgtcctcgcctttagaggactacacctcctcgcctttagagggctgcatgtcttcgcttttagagggctccacatctgcaccttcagagaactcaaggtcctccacccttaa

SEQ ID NO: 90598 - DNA, 458 bp, Glycine max
  Peptide Sequence Number=SeqID_182283
ataagtccaacagggccctgggatttcccgcactgatcacaggactctgccagtcgttcggagtccccgttgcacctaccaagagacaggctcagggtgatgctccacaggccgcaggcgcgccaccaccacctcatcaggatggccaggctggggcatttgacatggagcagtatttaccgcatttggttcgccagcaggcatccaaccaccgggcacatgtgcagacccatgattgtctgtaccagatgagcctcagcatgcagagccagggcttcgcttctttttcatgccctactccagaccagttcagggcaaaggtcgcatggcccggagattggcctgaggcccaagcaggagaggcacccccagaagctcccggcggtggagaagaggcccacgaggacgaggagatggccgatttgcttgacttcttgggagggagtggagatacatga

SEQ ID NO: 90599 - DNA, 678 bp, Glycine max
  Peptide Sequence Number=SeqID_182284
atgtgtgccgagaaagggaaagcaaattgggagcatctcttggctggtatggtaggggcatctgttaattggtttccccgatggaaggaagtaggggccggagttttgtcctcatgtgaagggttccctaacgtccccatgatgggaacgaggggttgtatcaattataattttgtacttgccataagacaacttggctaccccatgagaagagcgccatcagaagagagtatcgcaccattcatcgcacgtggcttcagtgaccccaatgcaagaatgcttcaaagagtccgaaaagcatggaatgtggtgcaaagaaaggataaggagcttagaggaagcagcaatgggatcgtcggtggctatcacaagtggctaaaggctcggacgcaagagatagactggctcccaaagctaaaggtttcaagtgaggaagaggtgcaagccttgaaggcaaaacttgaaagaacccaggtggtcaaggaaaagttcaagacgacgaccatcaaggtctggaaagagtgcgacgagctgaaggacgtcaacatggccacaatcgaggcattagaatgggaaatgaaaagggctcgaaaacaagaatggggtctaaacaagttccaaggggctttatggggcaacaacaataaactcaagcttcaaagggctaagagagactag

SEQ ID NO: 90600 - DNA, 390 bp, Glycine max
  Peptide Sequence Number=SeqID_182285
atgtacgcctttgttgtatgtttatttgtggatgttgccatactctgtacatccccgtgtagtgcttttgcgtgtctgcatcatgtcgtcatgcatgtgtggtatattggtcttgtcttttgtcacgggaagctggaaggtccatatcaccttcttaactgcacacatggggcactgtgcccccaaatgcgcaattgccattccttggattataaggttgaaccaagctcatgctttctagaaaaggttcatcaagtcaagttgaagtatggaagtaaccatcttgcaaaaaattggggcaaaagatggatcgagttacatcgctacttcgtctactgccaaacacatttaggactgttgatgtccttattacttccagtttcactttga

SEQ ID NO: 90601 - DNA, 171 bp, Glycine max
  Peptide Sequence Number=SeqID_182286
atggagaattggcgaacagcgctaagcaatgacattcgcggggatccagactcaaagctaggcaatgacattcatggggctccgaatgaaagtggaggaatggagaattggcgaacagcgctaggcgatgacattcgtggggctccagactcgaaggtggaggacacatga

SEQ ID NO: 90602 - DNA, 537 bp, Glycine max
  Peptide Sequence Number=SeqID_182287
atggcgaatcaagaggagtgggttccgtttgcggacgtattagctttgctaatctttggggttgtcctctttccaaacgtggacggtttggtggacctagctgcgattgatgctttccttgcatatcaccatagcaaagagagcccgatggtagctatcttgggggacttatttgatacatttgaccgaaggtgcgagaagagtagcgcacagatcatctgctgcttacccgctctttatagaatagtagattgggaccaatacttggctgggataggaggcagaacaatcaactggtttcctcgatggaaggaaggaaaggagggagttctcttctcatgtggggactacctaaacattccgttgatagggacaaggggttgtattaactacaatcccgtacttgctataagacagttagggagcaccgacggaagagagcctctctcctttccttgtgagatatttcggcgcgcaaagtttcaagattttacaaagagtccacaaggcgtgggaaagcccgttaaggaaagataa

SEQ ID NO: 90603 - DNA, 814 bp, Glycine max
  Peptide Sequence Number=SeqID_182288
gtcgactctagaggatcccccacagataatgtcctggggagaaacatcttaccagagaggaaggtggagctctaccacaccgagttggatgattttaagactgagttggagaggtgtaatttccataaacgcctcaccaatttggtcaatgggagcatagatttggctttggtgaaagagttttatgcaaacttatacagctctgagtgcccttcaccaaagcaagccagagtcagaggccatctagtgaagatagacgctaatagcctcaacacattcttggagacacctgtggtgttggcagagggtgagacgttgcccacatactccagatactgcaggctgcccacagattacagagagattgaggttgccttctgcataccaggccgagggttcatcttgaacactgagggccatcctgggaggattctcaggaaagatttgactactttagcccaggtgtggagtgttctctcatactgcaacctggaccccacatcacatgccgctgatctgacagtggacagagctaggttgatctttggcctagtctctcgcatggacatgaacgtaggagctctcatttctggccagatgacttctataacccagtctaactcttctagacttgggtttcctgctctgatcaccgccctatgtagagccagaggggttgtctctgacagccttacttttaagcgccttagcccggtcattaacttggcgatggcgaggccagctgagcttccttccacatcttcagctcctactccagcatccacttcagtagctccttcagtcccagctcaga

SEQ ID NO: 90604 - DNA, 213 bp, Glycine max
  Peptide Sequence Number=SeqID_182289
atggggaaatggctccgaagaaactctccacgaagaggtctagaagagacgccatgggagaagggtccaatgccgccctcgagtttgatagtcatcgtttctagagtgccaagcaccagcaacgcttcgaggccatcagaggatggtcgttccacagggagaggcgtgtccagctcagggaggatgagtatacgaactttcaggaggagatag

SEQ ID NO: 90605 - DNA, 285 bp, Glycine max
  Peptide Sequence Number=SeqID_182290
atggataatgaagagggcatgcaagagcagatgaaggccgatctatcggccttaaaagatcaaatggcttctatcaagcaggccatgctaaaactccataaaactctagaggataatgccacggcaaccgcctccaatgcagttagggaagcggaaccagtgctgcagcccacgataaacttaggccgagatagaaacccgacggtgttcggtcggaggtacagtccacaagcttacccttatggcttgcctccggacttcactccccgtgccgctccggaagat

SEQ ID NO: 90606 - DNA, 253 bp, Glycine max
  Peptide Sequence Number=SeqID_182291
aagcagcactgcaggagttgtcagaaaatggaactgatagagctaagataaaagctggaagcatattggaactcttgcagcgaatggaagggggacctgctatcaagtcagcagcaacagcagaaccaggtagtcaaaacggaaagaaattggaaggggggaggacaactctttttgatagtgaaattcaaatggcagataatttccttggagaactatcacagcagcagattcagccaaatagggaggatag

SEQ ID NO: 90607 - DNA, 633 bp, Glycine max
  Peptide Sequence Number=SeqID_182292
atggagggaagcagtgttgcgaagcccaaacccttggtgatatacttcactaaaagtcagcttcgcaaatgcccggacacccagcttaatatgccaaacctgttcctttcccgtaccaaaatacgccacgcggtcccgtggagatatacacctccgagggagaaggaagaagaagccactgacgtcagctcgctgtcagctaaatggtcgtgtgttcgcacctccggacctaccagtccaacccgtggacatcaaaggaaaaggaaaagtggtggaggaacaagatggtcgattagccgtttcctccacaagtgcgaatgccaaaagatatttcggctaaagggccggaaaaaaggaagacacctcatggtacccatcagtacgcgcaacatcaaccctgagcttgctcggttcataccgggaatcgcagttctatcccccgatcctggaagggccggcacccagcacgttgcctcaacccaatctatcgcgacacaaccaatagttttgtcccggaagccgcccccgacaactgaagaaaagaggaagcttgatctccttgaggaaagaattgagagccgtggaaggatttggggactattcgttccagacatgacggacctctttgcttag

SEQ ID NO: 90608 - DNA, 132 bp, Glycine max
  Peptide Sequence Number=SeqID_182293
atggtgggaatagatgtgattcgggaacctaccagccaaggatatactcgtgaagatgctgatgagttcattttttgtagctacaatggacacaactgggtatcttccaaggtagaatggtttcatgagtaa

SEQ ID NO: 90609 - DNA, 246 bp, Glycine max
  Peptide Sequence Number=SeqID_182294
atgtaccctccacttgaactaatccacaagagatgtaccctctcttattctcagtataacaacccaagtagatgtaccctctacttgtgccacaaaggattctcaggtggggaagggaagaatcaaaagaattctcaggcggttagtcctttgaattctcttggaaagagagaaaggagacacaaaagaattcaggcggttagtccttctattcttttggcaaagggagaagagaagaaaagatag

SEQ ID NO: 90610 - DNA, 477 bp, Glycine max
  Peptide Sequence Number=SeqID_182295
ggatcgcgcccacaagatgcccagtgggcccgaagaagtccaacagggccctggggtttccagctctggaatcgcacccacaaagacacccagtggacccggagaagtccaatagggccttggggtttccaactctggttacgagcctctgtagtcctacagggtgtccgttccacccggcaaggtcacgtcatcataggatcgcgcctgcaagacacccagtggacccgaagaagtccaacagggtcttggagttgtcaagctctaattacaaatctctgtcagttctacggagtgcctgtcacctccagcaagggcatcaggccccttactaatcgagcattcatcaagaagtactgcatccccaggcaggcgcagggtgaaacaccacagcagcctggggatggccgacagcgggcaacagacacaccgccatcacctctagagtttacctcagctcatccacaaaaaggttag

SEQ ID NO: 90611 - DNA, 231 bp, Glycine max
  Peptide Sequence Number=SeqID_182296
atggatgaattcattgaactgatgaaagaacataacttggaaacgttgggatgcttgagtgcccatctggctgtagccatgactaattttgcacgttgttttcaaatcatcattgtcacccgtgccttatggaacaatatggaagctcatcctgaaatcgacaccttgacacccaaatttgtttctccccagatatcaagattgggttcacacgataaaagaccccattga

SEQ ID NO: 90612 - DNA, 367 bp, Glycine max
  Peptide Sequence Number=SeqID_182297
atggaccaaagagtaactgcaggggaaatccaacaaagtatttatggcatcgttgatttagaagcagcaccaactccagaagaagaacctcgatcttccgaggcatcttctagttttcctattgcagggcattctcatatagaacctgttgaagatacaatcatggttgaagaggattattcaagttctaatgtgccacaattttttaccagcattgcacaaccagaagttcaagcacaaaccattacatatccaccatcattgattcagctaattcagaataatctgtttcatggtttacaaaatggagacccatatgcgcacctagccatttacattgaaatatgcaatactattaggctagctg

SEQ ID NO: 90613 - DNA, 168 bp, Glycine max
  Peptide Sequence Number=SeqID_182298
atggaggattgccttgagggtcctctcttaggcaatcatggaacacagctccaaactcgaaatgcaatcatggaaacacagctcccaactcaaaatggaggacacatgaatgacaacgcaattcattcatggggctccgaaaaggatgagaatggaggattgccttga

SEQ ID NO: 90614 - DNA, 380 bp, Glycine max
  Peptide Sequence Number=SeqID_182299
atgatagaagtgtgtgttgaagccattgcatccctcactcagtactatgatcaacccctgaggtgctttacatttgaggatttccagctagtaccgactgtggaagagtttggagaaatcctgggatgtccgctcggagagagaaaaccatatctctttttgcggttctatccctccatggcaagagtagcaaaggtagttaaaatctcggtgcaagagctagaccgtgtgaagcaaaataggaacggggtagtcggaataccaaggacacatttggaggaaaaggcaaaggcctgggcaaatcaaggcgaatgggcttcttttattgacgtcttggcgctgttgatctttggagtcgtcctctttccgaatctggaagg

SEQ ID NO: 90615 - DNA, 336 bp, Glycine max
  Peptide Sequence Number=SeqID_182300
atggaaagggagatgataacaatgatagtagacacattacttgtgttctactatgagaagatggtgggatacatgccttcaagctttgtagatttagtgtttgttggcgaaaggatcgaagtgggtctaagaagaggaaaatttgattatcctgctttgataaatgggaagccttcggcaaatggagagaataagaaggagggaggaacccatgctgtaactgtcattcctacatggccaaatttcccaccagctcaacaatatcaatactcaaccaatatcacccattctcattcccgaccaccctatcagccaagaacacccaatcatccataa

SEQ ID NO: 90616 - DNA, 1128 bp, Glycine max
  Peptide Sequence Number=SeqID_182301
atgcaaaaattgaacaattcgctgcaaaattatgcatggggcagcaaaaccgcgctgaccgaactctacggcatcgaaaacccgcagggattgccgatggcggaattatggatgggcgcgcaccccaaaagcccctctaccgttgaagtgaatggcatcacccgttcgctgcgtgacgtgatcaatgacgatccgctcgcgacgctgggcgccgcggtagcgcagcgttttggtgagctgccgtttctgtttaaagtgctgtgcgccgatcagccgttatcgattcaggtgcatcccagtaaaactgccgcagaagccggtttcgcgcgtgaaaacgcggcgggcattccgctcagcgccgccgagcgcaactataaagatgctaaccacaagcccgagctggtctatgccctgacgccattccaggcgatgaacggctttcgcgaactgcctgagattgtctcgctgctggagccggtcgcgggcgcgcatccgcagatcgcccatttcctcgaaaacgccagcgaagccgcgttggctaaactgttcgctaccctgctgtcgctgaaagacgagagcaaaacccacgcgctcggcgtgctgaaatccgcgctgaacgcgcgcgaaggcgaaccgtggcagaccatcaaaaccatcgccagcgactatccggacgataatggcctgttctcaccgctgctgctgaatgtcatcaccctgcaaccgggtgaggcgatgttcctgttcgccgaaacgccgcatgcctatctgaaaggcgtggcgctggaagtgatggcgaattcggataacgtgctgcgcgccggcctgacgccgaaattcattgatatcccggaactgctggccaacctgaagttcgaggccaaaccggcggcgacgctgctcacgcagccgcagacgcagggcgacagcctgattttcccgatcccggttgaagattttgccttcgccatccatacgctttcagccacgccgcaaacgctggcgcagcacagtgccgccctgctgttctgcattgaaggccaggcggtgattgaaaaggcccgggcagcagctggtactgcaaccgggcgaatcctgctttatcggcagccagcgagtcgccggtga

SEQ ID NO: 90617 - DNA, 543 bp, Glycine max
  Peptide Sequence Number=SeqID_182302
atgacttctatagcccagtctaactcttctagacttgggtttcctgctctaatcatcgccctatgtagagccaaaggggttgtctctaacagcctcacttttgagcgcctgagcccggtcattaacttggcctacatcaggaagaactgttggagtcctgatgatctgacagtttctatccgaggagctaggagggcgagggcgaggctagctaagcttccttccacatctacagctccaactccaacatccacttcagcagctccttcaatcgtagctcagagtgattctcagcgctttgaagccatgcttcagagcattcatcagggacaaattattttacttcagaatgaaggtcccacagcccaggtaccacagcatgtagaggatgagtcatccgaggccaccattccagagccattcattgtagaggaggagacaggtgaaacacaggttagacagaaagttgttgctactcctaagagatctcttgagggcacttcaaagcctcctgcactagtggtggacctatcctcgccttag

SEQ ID NO: 90618 - DNA, 201 bp, Glycine max
  Peptide Sequence Number=SeqID_182303
atggcgagttacctgctgatggagcgaactcggcagcgacatcgaaaacaacaacaaagaggaggcaaagaggaagttaatgcaatcctccctaggaagggactagtcaccagagccatgagcaaaaggctccaagaggattgggctagagctgctgaagaagggcttaggattctcatgaaccgcaggatagatttctga

SEQ ID NO: 90619 - DNA, 780 bp, Glycine max
  Peptide Sequence Number=SeqID_182304
atggcccgcacgaagaaaactggtcaaatgacttctgaggcagcaaaggaaattgcaaacaagattgcctcacagggaagctttgtcgcctgtggacgtcaggatgtattgattgctgccattgggggaccggaacaccctagtcttgtccgtgctgctggagctggtgtcacgatcaaacaatactttggaccggttccaagaagttcccgcacgtctttgtccataggtcccaaagacttagagcagctaacacaaaaaattaaggaccaactggaggagtcgatcacagaaaaacctgaggttggtccttctgctgctcatatcagcagaaaggagagttgtgttgatccctctgggcacgacctagacacaggggggttgacaaccattcacaacatccctttgggcaatcatcaagtaaaggttggtgttgaggaagttcaggatgctaatgctcacattcttgtacccactcaagaggttcaattagtggggcaggaaaaacaaggagctcagggaccggtgaaacttgtagataggccagatcctaatgttgatcccatatatctaatgacattgactatcccacagctttttttgaagatgttacaggttatgtgggatgctattgtgtttgggggaatgccaatgtctatggattcctcgagccacagttcatacagagatctgggcaatcacaatttgaatcagaaagttatattaagaactggatgcagaattcaaagaagatgtgtacctaagagcctacttggatga

SEQ ID NO: 90620 - DNA, 222 bp, Glycine max
  Peptide Sequence Number=SeqID_182305
atgagagtgtgtgtggtgattgttcgatggcgagggagtgccgaattacagtgttcgacaccagttaccgcacaaagcaaaggatcacacagtgttttgatcaagaatacaaaaggataccaaggaaaggggcaaaatggtctttttcttgttttttctagaccccagctcgtccaggctagcatctggctcgcttgtgccatggaattacctcttggttaa

SEQ ID NO: 90621 - DNA, 747 bp, Glycine max
  Peptide Sequence Number=SeqID_182306
atggacagagctaggttggtttatggcttagtcacaaggatggacatgaacattggcggcaagatctctggacagataaccattatggctcagtccaactcttctctcctaggcttccgaactttaatcacagccttgtgcaggtcgaggggagttggatctgatgctcttacttcttacaagagcctgaggccggtcattaacttggcctatattaaaaggaaatgttgggatgtgaatgaccaagcagttaattttccaagggcaaggaaaactaggtccagagcagctggtgttgcctcttcttctgcaccagcagttgacatcccttcatattctactccagctccacctccaacatcaacaaccccatctgcccaaagctcccagacttcggatgctaagttgcagagtttgtttgagggacagattctcattatgcagagcttgcaagaattggcccaccaaaggccaatcatgagtgtcgagcagttcattaagcaggctgcttatcctgagccaataccagtaccagctgatccaccatctcctatggtggatccatcttctcccgcaccagaagcagctctcccatctacacctattattatatctgatgaccctacagtgcaagcacctggattagctcctactcttccagccacacctgagcttaaattttcagataaggaggggggacggattactactcctccggggacgccaatgttacatttcgatgattag

SEQ ID NO: 90622 - DNA, 357 bp, Glycine max
  Peptide Sequence Number=SeqID_182307
atgtgtgtggcccaaagcaaagtgcccaaaagaccccgggagggtcagtgcactttcgccctccacgaacatacacaacatccaacgtatgaacgtggcccaaagcaagtgccaaagaccctggaagagaacaatggcggtttgtggtggctaatggtggctgtgggtgatggagaaagagcttggaatgttggaaatggttttggaagaaagaaaggagaagaaatggcgtttttccaaagctatttggactacaaggctcaaaacgcacaaatgagcaatgctctcggaaacggaaacggaaacatcgcgcatactccagacatcttctcaaagatcccaacggtcagatcatga

SEQ ID NO: 90623 - DNA, 399 bp, Glycine max
  Peptide Sequence Number=SeqID_182308
atgactagtagttgtaggagagcatcattcatgaaaggaaaaatttggttcaaagcaatttgccccaaatttgggggagtttattgggtgaaagcttccaacggtgaaaaagtaattatgtcatgtgctgacagtaatgggcaaattacaatgtcaagagaagaaacaacaaactggtttggaagctatacaatgaggtctgccaatggaggaagaattgcagtggtctgccggtgtcctgcatgtttggaagtggtggaggtgttgctattgatggcggcttcaagtcgtggtgtcgatggaagttggaagaatggaatgagagaggagtacatagactttagtgccacgttggatagtttacgtggcactataattgccaacaatgcacctcactag

SEQ ID NO: 90624 - DNA, 1299 bp, Glycine max
  Peptide Sequence Number=SeqID_182309
gttgctagacaacatcttggagctgattcctttctactaagccgtgaccaacatcagatgcaggctgcaatgggtgctttcgatggtattattgacacagtttttgcggttcatcctctcttacctctcattggtttgctcaagtctcatggaaagattgtaatggtgggtgcaccagagaagcctctggaacttccagtctttcttttacttgctgaggcctttaagaggtttggaaagaatcttgaagagattgaaaacaagcttatagagaagaacaatgatgagacattgagaaaccgctatgggctagctaaaatgccttacactttgctctatccttctagtgatgagggattgactttcagaggaattccaaacaatcctcattccacaaggcacttctttgatgaaacaagcttggacctcaaatcggtctcatccatactcccttcaagcaacaactaccaaagtgtgtgcacccataacaaggttaagtcagcactagagagggcagagaaagagcctattgttaggaaaagaacctcattcttgaagtcacctcaacgtgagatcaattacatggacctagcagcgatcgacgctttccttgcttatcaccatagcaaggaaagtccggtcgtggctgttttggccaatgcctacaacacatttgaccggagatgggagaagagcggcgcaaagattgtttggtgcacaccagctctttatgtatggctggtctcttacctctttcatcatgaaggtagacccgtctgtcccctacaaggtcatcgcatgtgtgccgagaaagggaaggcaaattgggaacaactcttggctgatatggtaggggcatccgttaattggttcccccgatggaaggaaggagaagctagagttttgtcctcatgtgagggcttctcaaacgtccctttgatgggaatgagagtttgtatcaattataatctcgtccttgccataagaaaacttggctatcccatgagaggagcactgtcggaagaaagtatcgcgtctttcatcgcacggggttttagtgaccccaatgcaaggatgtttcaaagagtcctaaaagcctggagtgcagtgcaaagaaaggataaagagcttaggggaagcagcaatgggatcgttggcggctatcacaagtggctgaaggctagaacgcaagaaataacttggctctcgaagctaaagctctcaattgaggaagaggctgaaacccctgagaagatagaagaggtgcaagccttgaaggcagaacttgaaagggcataa

SEQ ID NO: 90625 - DNA, 399 bp, Glycine max
  Peptide Sequence Number=SeqID_182310
atggactcctctagctcaagccacactgtagtttacaaaacaaaagttgaaaggaaagatattgagctggtagaggaggaagaaccacggattggcgctgattgttctagtgcaacctttaataaatctgagatttataaggaggaagcagggaatgcagcacaaaagcataaagcaaagagggtggcgagtgtcaatgttgatgcagaagcctttggtgatcactgggaaagttcagtttgctctatgcattctgaagctgaagcactagaacatatgaagaaaagagatacaggccatcaaagtgagtcattggagaataagacaggagattcaactgtgctgaagataggagattcgactaaagttgtgataaaacaatacatgaagggaggatag

SEQ ID NO: 90626 - DNA, 248 bp, Glycine max
  Peptide Sequence Number=SeqID_182311
gtgatttgattcccattgatttggaaattaatgccacttgtagaaggcgtaatgaagagagaattagaaattttttgcaggacttaggggaagcagcaattccagaggaagaacctcaatcttctgaggcatcttctagttttcctattgcagaacattctcatttatatcctagtgaagactacatcatggctgaagagccaagaagagttactctggaagattattcaagttctaatgtgccataa

SEQ ID NO: 90627 - DNA, 582 bp, Glycine max
  Peptide Sequence Number=SeqID_182312
atggcagaaccatcgaagaaggggaaaggcacttcaagttggagtcagcggcattctgggtcacaggaaaccccaattcctccctccattccctctggatcattgttctcatcagaggaacagcgtatacgtgaaggtgtgccttttgagggtgcactgattgatgattggaaattcgatttttctgtgcatgatgccctctggttggtttgcaccaaccaagcggatatgacgggaaggcttcttgttggatcattggcttttgaaagccgcatcctccattaccttattgttcgcattttgcttcctagatcttcaaaccttgcccaggtttctgaagaagatctcattgtcatgtgggcatttcataaaggtttacaaattgattgggcacaccttgttagatatcgcatgcataaggcattgcgattgaattcccctttgccttatcctcatcttattaccctttccttcaacacttcaacatccctcttgattatgaaccctatgttccaatcaaagagatcattccttataggcgcttcagtcatagcatcctttggttatattaagggagcatga

SEQ ID NO: 90628 - DNA, 218 bp, Glycine max
  Peptide Sequence Number=SeqID_182313
gtcatcacatgtgtgccgagaaaggaaaagcaaattgggagaaactcttggcagggttcctgaacgtccctttgatgggaacaaggggttgtattaattgtaatctcatactggccataagacaactaggctaccctatgagaggggcgccatcggaagagatcatcgtgcctttcatcgcatggggtttcagtgaaggcaatgcaaaaatgctttag

SEQ ID NO: 90629 - DNA, 387 bp, Glycine max
  Peptide Sequence Number=SeqID_182314
atgaattttgcagtgaaaaagcctgtagaattcaccccaattccagtgtcctatgctaacttgctcccatatctacttgataattcaatggtagccataaccccagccaaggttcatcaatctccattttttcgaggatacgactcgaacgcaacgtgtgctcgtcatggagaagccccggggcgttccattgagcattgtggggctctgaagcgtaaggtgcaaggtctaattgatgcgggctggctgaaatttgaggagaatcacatgattttcaagtgcaagccattggtcagtttgctcaagcgacctgtgctcctgagtttggacttccaagaccgttcaatcatagattactcgtcttgcacgttggtggggctgccgtaa

SEQ ID NO: 90630 - DNA, 426 bp, Glycine max
  Peptide Sequence Number=SeqID_182315
atggcttctccacctgcctcgcctcttcctcttccttctcctccttcagacgcatcaacttcgtcgtttgcagtgaagcggacatgcaaagcctcacatcaacgatccttgtctactagaccacctggtgctgagagaccagtggtccacgttgatcctgctatcggcaagactgatggtccccacaggaagaaattaagaacatatttggggattatggcgcgtgataagatggacgtcacatatgagaactggaaggaggtccctactactcaaaaagacttgatttgggaggatcaggcggaatttgaaatcccagaggcttctgacagtaggacgaaaaataagttacttcatactgtcgacaagagatggaggcagtttaaattagacctcatgaggaaatgggcccttgtagctgattag

SEQ ID NO: 90631 - DNA, 414 bp, Glycine max
  Peptide Sequence Number=SeqID_182316
atggaacatttattggctgatggactgagagatcaaaggaatttgggcaacaagggtgacggggcttggaaaagagccattggtcatggaactgaaattgctatggatgttcatgaagcgatgagtagagaaacaaatgaagtggaattcatgggtttaggtgctactactactatagacttagaagaaccaagctctaatacaaaaggaaaaagacaaggtttaacttcttctagcacagattctcacaggagaaagattggagaaaaagaaggaataacaatctctttagataaaatggtcaactcttttgaccgaatggtagaaaaaatggatggtaaaatcgatgatgaagatagtcaagaaatgttacgtgaggtagctttgataccagatcttagtagacaacaatga

SEQ ID NO: 90632 - DNA, 875 bp, Glycine max
  Peptide Sequence Number=SeqID_182317
gattcattggaggagcaggcctcacaaggttcgtttgtcgcccatggacgttaggatgtattgactgctgccattgggcgaccagaacaccctggtcgtgtgtgtgctactggagctggtgtcacaatcaagcaatactttggaccgactccaaggacctctcgcacgtcttcctccgtgactcccaaagacctgtagcagctgacgcaacaaatcagggactagctggaagagtcgatcacagaaaaagtgattcgacagctaatatgcaatcacagggactcgtactatctcttgagcttgaggttgatccttcagctgctcgtgtcagtacaaatgagagttgtgttgatcccttagggaataatccagacacgggtgactcagacaaatgcgggttatacatcgaaaaaaatcctcaccgcctggttgccctaggaagactttatgagggatccacaaccgttcacaacattcctctactgcatgatcaagtcaaggttggtgttgaggaggttagagatgcaaatgctcccattcctgtacctactgaagaggttaagttagtggggcaaacacttaacaccttccttgcttgggcgacacatcttgtcaatcgtttatcagaacagggagttgtgggacccgtaaaacctgcagataggctagatcatgatgtcgatgatcccatatatttgatgacattgaccatcccacagttttttctgaagttgttgcaggttatgtgggatgttgtcgtgtttagggtgtataatgacaacttccccttgtacataaaacatgaagatttatctgaaattgcacatggtggtcaatgtctcagcatctatgttatacagttgtggattctataa

SEQ ID NO: 90633 - DNA, 159 bp, Glycine max
  Peptide Sequence Number=SeqID_182318
atggccagcaacaggcaacaaatgcaccgccaccacctccagagcccctcagctcatccactaaagggttggagtattgcctacgacacatggcggaccaataggcgaccaagtccaaagccaaaggtagcaagataccttggatatccatctatatag

SEQ ID NO: 90634 - DNA, 318 bp, Glycine max
  Peptide Sequence Number=SeqID_182319
atgatacgcggagataccttacggttattcgcacccttttgtcatccagaggcggcgggcccgatgacaagcagagaccaagtttggtcattctgcacccttgtatcatccagaggcggcgggcccgatgatacgcggaaatacccgagtggttatccgtataaacattcttttgctatctcacccaggcccatttgggccctccagaaggttcctccagaaggcggttgcttctggaggaagcaaccctgctcgcctgggcgagctgagctcgcctgggcgagctgggcggcaagcatctcccctattttgctataa

SEQ ID NO: 90635 - DNA, 133 bp, Glycine max
  Peptide Sequence Number=SeqID_182320
atgacttcctggcgctcgttacggcgcaacacagaattggccatggcctcattcatggcgcgcatgcctgcaatcgcacaaacgcgcaaagctgctattactgtgcgcaatcagtttgggcagctcataaatg

SEQ ID NO: 90636 - DNA, 315 bp, Glycine max
  Peptide Sequence Number=SeqID_182321
ttgattgtgctttacgtggttttcaagcttcacgagagttacacaccgaacaaagtttccatccgtgctggtgatggttttcacaacttgaaggagattaagactgtggaactcgtgaagccaactgggtgggtttatctatccttgtctggagctgatcctagattgtcatatctttgtcttccagtgtctaaaattaagtggttacaggacttgggctcttgtcattgccacattcccaaacagcattctgaatttcaatctcctgaaaaggcgccacaagcatggaattctgctgttggtctatggttttga

SEQ ID NO: 90637 - DNA, 291 bp, Glycine max
  Peptide Sequence Number=SeqID_182322
atgaattgtttgcagcccagcctcattacaagcctagaaagtcctttggattcaaattatgaaaagataaagaataagaaggttgcagtagctggtgtctcgctaagcgaggcatatgcgcttagcgagcaacatccgctaagtgagacatcagctcgcttagcgagtcaggagaatttggaagagaatttgccacacatgcacgcgctagcacaccatcagctcgcccagcgagtcatttgtctcttttggcgcctaacgcgcctgactcgctcagccaaaaatcactaa

SEQ ID NO: 90638 - DNA, 252 bp, Glycine max
  Peptide Sequence Number=SeqID_182323
atgaaggggggtgtcgagcctgcaacgaaggcttcaaagggtgcttttgggtgctgtttggaatcaacatcaaggaaaggagattcggctaaagttgtgataaaacaagacttgaagggaagaaagcataaatatgggtttaacaacaataaatgtgagaagccagagaaggtaagggtggtggatgatgaaactggcgacaaacatcagctggatgaagtcctaaggatgccatctaaaacaaaatactga

SEQ ID NO: 90639 - DNA, 556 bp, Glycine max
  Peptide Sequence Number=SeqID_182324
caaagacgctagcacgcttcccttataagagtgataaggcagtaccatggaaatatggcgtacaagggcccgatggaaggcgggacgcgtccgtcatacgtgttgggaatggcatgtcggctgctaagatcacaaatatttccgatacgagcggcatgactcgtagtgaacttatttttgctcctcctgaactaccgacaaggtcaaaagacaaggggaaggcaaaggcgaatataggtgagagggagaagacagacccgatcgagaatgacgaggcccctattggaaagattgcagaggaaggggacgactttagtaagagagagatatcagctgaggaggcgactgaatttctgagaatcattcaacagagtgaattcaaagtaattgaacaaaactccagccaagatctctctattagggctactcatgaattccgagcctcatcgggcattgttgtcaacaacatcattgcaaacaattacctgacttttgccgatgaggagatgccagttaagggcaggggacacaacaaggatttgcacgtgtccgtcaa

SEQ ID NO: 90640 - DNA, 398 bp, Glycine max
  Peptide Sequence Number=SeqID_182325
atgggttgcattaactacaatcccgcacttgctataagacagttagggtaccccatgaggggagcaccggcaaaagagagcctttctcctttccttgtgagagatttcggcgcacaaggtttcaaggttatacaaagagtccataaggtgtgggaaggcccgttaaggaaagataaagaacttaggggcatccgtaatggcatcatcgatggttatcatgaatggctgaaagttcgtacacgagggttagattggctcttcaagttgaaaattatcaatgaggagaactttgaagctccgaaagaggatgaagaagtccgagctctaaaaaccgaactaggaaaagcaagacttgcccaagaaaaattcaagttggttgctacagacatccggaaaga

SEQ ID NO: 90641 - DNA, 660 bp, Glycine max
  Peptide Sequence Number=SeqID_182326
atggtaaccctcaccattgaaaatgggtggtctgtgaataggaatttccttcaggaaacaagggatttgaggaggccatcctacaagaaacctactctgatactacttgttggatcgagtggcctcagaataattaagaagaggggggttgaattaattattcctagaactttaccaattaaaaattactcttttaaggcttttactaaattgttaagagaaagaggagtagaagagaaacttaaaagaaacacaaacccgggcctacctccagtccccaagcgacctgcggtccttgagatttctttcaacattgtaaaaaaccatttacaagcaatgatccacaagggatggaatgggaagaatcaaaaaaattctcagactgtgtcgtttgaattcttgacaagggagaagggagacacaaaagaattcaggcggttagtcctttgttcttttggaaaagggagaagagagacacaaaaagaattcaggcggttagtccttagcgaattctttttggaaaagggagaagagaatgaaaagatgaatagcacaagttttcaaggtttggaaaaccagaaaacttcagaaagcttttggtacaaagaagaagaagaagttcaaagagattcaaggcttgtaaaggattgtatgaaataa

SEQ ID NO: 90642 - DNA, 760 bp, Glycine max
  Peptide Sequence Number=SeqID_182327
aggactgcacgtactcgccttcagagggctacatgtcctcgaattcagaggactgcacatcttcgccttcagaaggctacacgtcctcgccttcagaggactgcaagtcctcacatttagagggctacaagtcctcgccttcaaaggactacacgtcctaacctttagagggctacacgccctcaccttcagcggattacacgtcctcgccttcagaggactacatgtcctcacctttagagggctacacaacttctccttcagagggctacacgtcctcgccttcaaagggctacacgtcctcaccttcagaggactacacgtcttcgccttcagagggctacacgtcctcgccttcagagtgctacacgccctcaccttcaaaggaccacacgtcctcaacttcaaaggactacacgtcctcgccttcagaggactgcacgtcctcgccttcatagggctacacgtcctcgccttcagaggaccacacgtcctcatcttcagaggagtacacaccctcgcctttagaggactgcacgtcatcgccttcagagggctacatgtccttgccttcagaggactacacatcctcgccttcagaggactacacgtcctcaccttcagagggctacacgccctcgcctttagaggactacaggtcctcgccttcagagggctacacgtcctctccttcagaggacttcacatcctcaccttgtgtttaggtagcagaatgcctcacgaaaaaaaacacaaataa

SEQ ID NO: 90643 - DNA, 402 bp, Glycine max
  Peptide Sequence Number=SeqID_182328
atggcgggggtcccgaaagaactacgtaggtctgatttcctcatccccaaaattgaggaatacgtaggagcaaaggggaaaacaccccttgtcgaccacaaaaaagaaaaaaatataaaaaagggtataaaggatataaagaacataaaagggaacataaaaatcaaagtcatgtttgcacattcgattaaaggctgccgtcccttgggacggacgtgtggggtgctaataccttccccatcgcgtcttttccggtttttccgacgttttcctcaaataaacgttggtggcgactccgcgcgcattcctttcgtggaacacgcatcccgcgagtcacgcgtcgccctcccgccgaagggtaggttgcgacagttggcgactccactggggactattttttag

SEQ ID NO: 90644 - DNA, 501 bp, Glycine max
  Peptide Sequence Number=SeqID_182329
atgatctctgcatatggattacatgggagaggtgaggaggctattattacgtattacaaaatgcttcaacaagggttcaaaccagacatgataacagtggttggtgttctttctgcttatagcaaggcaggattggtagatgaaggcattagtatatacaagtcactcatgactaagtataaaataaaaccaacagttgaaatttgtgcttgtgttgtggatatgctaggtcgatcagcccagcttgatcaagccttggaattcatcaaagaaatgcctttagatcctagtccaattcttaacaagaagatcttctacaatgatggaagcgaatgtagtgtaacatctggccatgcatcaaggatagtcataccatataaaggttcagcattggatcatgagccaaactatgagcttcttccattggctagaggagatttttctttggatcaagaggctgagattccaattgagattccaaaaaggatgaatattgaatag

SEQ ID NO: 90645 - DNA, 300 bp, Glycine max
  Peptide Sequence Number=SeqID_182330
atggttatgctccaagatttgcctcataatccatgcctcattaaaacccgattggagtcagagggaaggttggttatgggatttagaaaggcttcaagtgtcatgtcatctgatcaggtttctttgaagaagagttggtacatagttaggggatggtctaaacacatgacgggagatgcatcaaagttcactcatatttctcccaagaaaagtggacatatcatacaccaaatcatgatcaatgttttcttagtaaagatgatgatccttggttatggcatagaagaattgcccatataa

SEQ ID NO: 90646 - DNA, 234 bp, Glycine max
  Peptide Sequence Number=SeqID_182331
atggcagtgagatctaaaacaatggcgcagagacttgaagctttcctcgtacctcaatcagtgagcacaagttccccaaacaaagaaacaaagaagaagaagaagaagaagaagcagaagaagacaacaaagactaaggtccttgcggttacaaagaagaagaaaaagaagaagttgtacctaggtagcgtggctatgtgtcacggtcgcaaagaagttgtacaaagaacctga

SEQ ID NO: 90647 - DNA, 333 bp, Glycine max
  Peptide Sequence Number=SeqID_182332
atgaacaacataatcactctgcaagacactaaaattaaggtcttccatgtgcatgtagctagatatgttgttggtagcataccacttgacatagtccatatgttttggcaaaagctaagtttttcagaccaaggtttatctgagtccaacgtctgcataactgaagagatggaagtcatatccaagtggtttgaagatcttgatgcatgtgagaaagtgactctaaagagtaaacttcaggaaattgcctaccctgatctaaattcgatgtgtgctcctcctaaaaaggtatgggtgaaggttcatggtctttggcttggaatcattagctga

SEQ ID NO: 90648 - DNA, 489 bp, Glycine max
  Peptide Sequence Number=SeqID_182333
atgggtagtggtggtgattcaaagtgggtgattgtggactggtgcttcgttcatagattcaagggagagagaagcatgctttcaacccggagtgactcggccagaaaccctgatttgtcgtcttctcattctcgcttcgtcgtagcttctagatttcttcctctcatagcttctctcgtggcgccatcatccacgctttttcatacagcatctgtcgtctcaaagatgtcgtaccggatgtcacgacatcacgcttcagaacatgcagattatttatgtgtccagtattttcgggccggatgtcaggacatcgtgtccgacatcgtggatcctgcacactctgttaaagatataacagatttatgtgtccagtattttcgagccggatgtcaggacatcgtatccgacatcgtggatcctgcagcttcaattcttcatttgacattttatcttgccttgtgcattgtgcagcccgatctgattccttga

SEQ ID NO: 90649 - DNA, 405 bp, Glycine max
  Peptide Sequence Number=SeqID_182334
atggatcgaagttggatgcaagcatcacacatcagtgacgagtatgagaatggagttgaacaattcctccaatttactgaactcaatccaccatctttgtgggacaacccatcagtctctcagactaagtcagtcgatgtagacatgggataccatatagaagagatgattcacgatctggggcaagacggatttcaacaagcacatgcccctttgtatgacaaaatagaaaatgattcgaagatgccttttgtggaagcaatgacttccaagattattttgatgatgccaaagaatcaagagttaagcaaattcaagaacaatcaagatcaagattcaagagaagttgatttcaagattcaagagatgaaatcaagaagcaacagtcaagacttcacaagggaa

SEQ ID NO: 90650 - DNA, 990 bp, Glycine max
  Peptide Sequence Number=SeqID_182335
agcgtcgagcaccagcagcgtttcgaggccattaaaggatggtcgttccacagagagaaacgcgtccagctcagggatgatgagtacacagattttcaggaggagatagctcgccgacattggacgtcactggtcactcccttggctaagtttgacccagatatagtcctagagttttgtgctaatgtttggcccacagaagaggaagtgcgagacctgcggtcatgggtgaggggtcagtggattccctttgacgcagatgccctcagccagttcctggatgacccactagtgctggaggaaggccaggagtgcgagttttgtcagaggaggaacagggtcgatgggttcgacgaggaggccattgcccagctattatgcacaccgggtcaggatttcccccggaccgttgaagggaggcgggtgcggatcaagcgcaccagcatgaccactttgacccagatgtggatgacattgctgctcagcaatgtcttgcctagtgatcataactccgaccttcctctgccaaagtgtcagctagtgtatgccatctcgacacggatgagcgtctatatggctcagttgatagctgacgccatctatttatttgcaggtatgccacccaccaggcaccctctagacccggataagtctaacagggccctggagtttccggcattgatcacaggcctctgccagtcattcggggttcccgtcactcctagcaaggtgatccaaccgccgatcacccgggccttcattgagaagtattgcacgcctaggcaggcgcagggaaatgcacctcaggccacagacgcactgccaccacctcatcaggctaatcccgctgggtcattaaacatggagcggtatctacagcacttgctcagcctcagtcagcagggacagggtttcgctccttttgcgtgccctgctccagatcaatttagggctgaggtcgcatggcccggagattggcccgaggcctag

SEQ ID NO: 90651 - DNA, 588 bp, Glycine max
  Peptide Sequence Number=SeqID_182336
atggtttggtgtatggaatcccaacgtgaggtctacctaggagcttacttgaatcaggcccattggcagctgcttgttttgtgccctacgaaggatgttgtcgtttggttctgttcgttgcataagaagcctgataatcatatcaaagctgtagctaacaatgcaatgaagacattaaagagcagtttggatggccatattgataaagttgcaacgcagtggattgaaataaaaagtcatgttcaaaccggtaggtatgagtgtggttattatgtcatgcactggatgtggaacatagataagttattgttgcacgaccaaactgcccattttacaagtcattgtgtagctgaggatgtcgatagtgttgatgatagcccaatcaacctaaacaaatatgagcattgtgtacgcgtttctaagttcaacaagtgccacgttattggaaagaggggtgactttcccaggttgtgtcatggtgatcatagtcacttgctttctgatcatgtcgttaaagatttaacatacaaacgtcatacaacaaattggctgtggggacaatcattacctggcacttactatggatag

SEQ ID NO: 90652 - DNA, 441 bp, Glycine max
  Peptide Sequence Number=SeqID_182337
atgccatgcactcgtgaccggtctctttcctctcttcggagcttgagctcattgttgctaccccacaatgctccccaaaatttctctcggccatattcctccttgcgggcccttttagtttcttgttcaagggctcttgcagtggccgcgttttcctcttgtaactcggtgcactctttccggatgtgtgtagcagctgatttgaacttctccttggcgagtcttgccttccctagctccaattttagagctcggtggagtcgcgaactgtcgcaacgtgcccttcgcgggcgagcgagggcgaggctcacaggtgcgctttccaaaggaggaaaggtgtgcggagtcgccaccaacgtttatttgtggaaaacgtcggaaaaatcgaaggaaaccggtcaaaatgaaaattctaagttcgggagttgtatttacgcttga

SEQ ID NO: 90653 - DNA, 189 bp, Glycine max
  Peptide Sequence Number=SeqID_182338
atgacctctccagcaacagatacaatcccggatggaggaatcaccctaatctcaaatggcgaattttctactggtaattctgacttacagcagcaacatatccctctctcattccctcaaagagcaatttccaacaaaaaaatggaagaggtagagaaggagatcttggaaacatttagaagagtagag

SEQ ID NO: 90654 - DNA, 171 bp, Glycine max
  Peptide Sequence Number=SeqID_182339
atggaggatagggtcacgaccgaccgatcgtcatcccttcccggcgctggacaagcagagaacgtcgctgcaaagcagcccatgtcataccctaatttcgtccggggacctttgcttgatgacatacgccttttctttggtccttgtgaggtgcttggcacccatcattag

SEQ ID NO: 90655 - DNA, 216 bp, Glycine max
  Peptide Sequence Number=SeqID_182340
atgttggctacccattcagggtatcgagccacaaccaagaaacccacatcaaactactttctcacttcttctttaattttcaaagacatttcgggtctcatccttcgtaatttttgcttaaccggggaacacccaggattcaatggcaacctatgctgcacaatgtcgaggtccagacctggcatgtcttggtacgaccatgcaaagatgtcttga

SEQ ID NO: 90656 - DNA, 159 bp, Glycine max
  Peptide Sequence Number=SeqID_182341
gaggaagctatgcagggtgatatgctgatggtgagaaggctgttgggaaatcaaatgcagccactggatgacaatcaaagagaaaatattttccacaccaggaagttgtaccaatgttgcaagttccagattagtgaccaaactgaatttggaaactaa

SEQ ID NO: 90657 - DNA, 376 bp, Glycine max
  Peptide Sequence Number=SeqID_182342
ccctcagaagccaatccttttcccgaggttacggatccatttgcgacttcctgcctacatgtccatcgaccagaggctgttcaccttggagactgatgcggttatgagtacgaccgggcgtgggaggcactcggtcctccggattttcaagggccgccgggggcgcaccggacaccacgcgacgtgcggtgctcttccagccgctggaccctacctccggctgagccgtttccaggctcatctagcgttatcttttaacagatgtgccgcccgccaaactccccacctgacaatgtcttccgcccggatcgaccggccgaagccgaccttgggtccaaaaagaggggcagtgccccgcttccgattcacggaataa

SEQ ID NO: 90658 - DNA, 533 bp, Glycine max
  Peptide Sequence Number=SeqID_182343
aaaacaacgagactttttcaagtctcacaagttatccagaactacgtaggtctgaattcctcattggaggatacgtaggagcaagagcctcgcttttgtcgaccataccgccttttgttgccatgactcaagagctggtagcccgcggagacaccttacggttatccgcacctcgtcattcagtgaccccaagtgtgattgacgagcagagaccaaagaccaagtttggtcattctgcacccatgatacgcggagataccttatggttattcgcacccttttgtcatccagaggcggcgggcccgatgacaagcagagacccaaagaccaagtttggtcattctgcacccttgtatcatccagaggcggcgggcccgatggctgacatagtcttctgcaccttttgttcctccgggaacaacaagtcatttacatgcggaaatttcatggtcacccgcgactctcgtcagccgagaggagcggaattagtgtcatacactgattttcggggacctttgcttgatgacatgtga

SEQ ID NO: 90659 - DNA, 363 bp, Glycine max
  Peptide Sequence Number=SeqID_182344
atgagtcatcattcatctagtggtaatggtgagggtactagtcataaggaccctcaatctagaatcttagatgtgttgagttccctcaatagtcatgacccttgcaagagcctaagtgaagaacttcgtgactattatgaaggaaggcataggtcacatcttagacctcactctaaaaggagagaaaaggaaagaaagcctcaagaggctaacattaacctcttatactctcatgggaagaacaatgtagaggcttacttagattgggaaataagggtagagcaaaaacttaaaaggaagtctacttcaaaatcttatggccctcactcttatccaaagatggccaaggtcaaggcatcttag

SEQ ID NO: 90660 - DNA, 291 bp, Glycine max
  Peptide Sequence Number=SeqID_182345
atggcagaaccatcaaaaaagagaaagggatcatcctccaccgccgctgctgctgcccatcgccaccacggaccatccgaagcacccacaacacctattcatccctctttgtcatctccaagatcatccacattgttttcatccgatgatcagcgtctacgatacctttctcaattttcttctagaatcatcttagaccctaagtacctagacatagatttctttaatgatgaacacttgattgctatcaagtgtttcaaaattctggtctggttgatttcatgtcattaa

SEQ ID NO: 90661 - DNA, 366 bp, Glycine max
  Peptide Sequence Number=SeqID_182346
atggcttctaggaaacgtaaaagtattggttcaagacccacagcacaatataacacaaggagattctctttcttagatgcttggaccagatacacagataatgttctggggagaaatattttaccagagaggaaagtagagatatatcattctgagctagatgaatttaaggctgaattggagaggcataatttctataaacgcctcaccaatttggtcgatgggagcatagacctagctttggtgaaagaattctatgcagatttatacagttctgaggatcatccaccaaagcaatccagagtcagaggtcatttgatgaagattgatgctgacagtctcaacacattcttagagacacctgtg

SEQ ID NO: 90662 - DNA, 432 bp, Glycine max
  Peptide Sequence Number=SeqID_182347
atggcagcacagttgatccatgatcgtgttgtgatggagtgcctagagggtatttgggagacccttaaaggcaatgagaggtgccgattccgtggcacaattcaactcactgctacttcgctagtacatccggagcaacccgcacgcacacttcagaaacctgtgaagtggatactacctacacccactccatatcgactagttgagccggttcaagtgatagaggtgtcatcctctgaagaggatcttgaagaggacccagaagagttacctcctgaacctgctatggatgcccctgacttaccagaggatgacgaggacccgctccctgatgttgattctccagaggatattatgtcagcatctgaggcagactctacagaggagagcggccctggagggacagtgaatagtgacgactcttcatcatag

SEQ ID NO: 90663 - DNA, 267 bp, Glycine max
  Peptide Sequence Number=SeqID_182348
atgatgggatcttcgtcaatcaagcaaagtattgcaaagaactcattaagagatttggaatggaaaactcaaaacacttgggctactcctatgaatacaagttgttatcttgataaagatgaatctggacaacctgttgatccgaagcaatacagagatactaaaaatcaacttgcagacattttcacaaaaccactaagtaaagataccttctacaacattagaagagaattaggactgttagatgctagtgacttatccaaataa

SEQ ID NO: 90664 - DNA, 437 bp, Glycine max
  Peptide Sequence Number=SeqID_182349
atgggtgatcaagaggagacgcaggaacagatgaaagccgacatgtcggctctgaaagaacaaatggcctccatgatggaggccatccctcacctgggatacaaccgagtggcttacccttatggattgccgcccaactattcaccacccgtcttgcaagaagatgcgggccacattgcttctcttgtccatgaaagagagcctcctcagcagcccgacgaagtccacaaggaccctcaagattatgctcgaagggatgtcgagttctatcccccgatccccgaagggccggcaccaggcacgttgcctcaacccaacatcgcagcatcgccaatagtcttgtccatggaagggccgcccctagcaactgaagaaaggaggaagctcgatctccttgaggaaagattgagggctgtggaaggatttggggactatcc

SEQ ID NO: 90665 - DNA, 723 bp, Glycine max
  Peptide Sequence Number=SeqID_182350
atgagaggccctctcaaagagtcaacctcttgctttcttgtaaggttaaagtcctttggtacttgtacctattggctcgccttcagaggactgcatgtcctcaccttcagagggctacatgccctcgccatcagaggactgcatgtcctcaccttcagagggctacacgccctcgccttcagaggactgcatgtcctcacctttagaggactgcatgtcctcaccttcgtagggctacacgccctcacctttagaggactgcatgtcctcaccttcaaagggctacacaccctcgccatccgaggactgcatgtcctcaccttcagagggctacacgccctcgccatcagaggactgcatgtcctcaccttcaaagggctacacgccctcgccatcagaggactgcatgtcctcaccttcgagggctacacgccctcacctttagaggaccatcctcaccttcagagggctacatgccctcgccatcaaaggactgcatgtcctcaccttcgagggctacacaccctcacctttagaggtacaccctcgccaacagaggtacacgccctcaccttgagaggactacacgtcctcgccaacagagggctgcacaccctcacctctagaggactacacatcctcaccttgagagggctgcacgccctcacctttagagggctacgtgtcctcaccttttcagtgtgctccacatctgcaccttaa

SEQ ID NO: 90666 - DNA, 682 bp, Glycine max
  Peptide Sequence Number=SeqID_182351
agggctgcacgccctcaccttcagaggactacatgtcctcgccttcagagggatacacgccatcaccttcagaggactacacatcctcaccttcagaggactacacgtcctcaccttcagaggactacacgtcctcaccttcatagggctacacaccctcgcctttagaggactacacttcctcgctttcagaggactacacgtcctcgccatcagaggactacacgttcttacctttagagggttgcacgccctcgccttcagaggactacacgacctcaccttaagaggactacacgtcctcgccttcagagggctacacgcccccttcttcaaaggactgcacatcctcgttttcagagggctacatgccctcgccttcagggagctacacgccctcaccttcaaaggactacacatcctcatcttcaaaggactacacatcctcacctttagagagctacaggccctcaactttggaggactacaaaggactacacgtcctcaccttcagagggctgcacgccctcaccttcagaggactacacgtcctcgccttgagagggttgcacgccctcgccttcagagggctacatgtcctcctcctcagaggactacacgtcctcgccttcagaggactacacgcccttaccttccgaggactactcgtcctcacctttag

SEQ ID NO: 90667 - DNA, 54 bp, Glycine max
  Peptide Sequence Number=SeqID_182352
atgaatgcagggatggaaaagccgtatgatcaatacgcagaaaatgcttgtacg

SEQ ID NO: 90668 - DNA, 604 bp, Glycine max
  Peptide Sequence Number=SeqID_182353
atgttgaaaggaagacgaatcacaagtttggcgatctggtcatccttgtccttctcagaggaggaaatccagcatgtctgccatgtcctgatcgtcctgggctttgtccccacctccaaaggtccccgcaggccctgccagcgtcttaaactcggcctcgtccacaggctaggccatcgtggcctcgaactgctcgggagtgggccaagggaaaggactgaggtcctgactttgctggtgcagagaaggacctcaaagatggtgcctcctctcgtggcggcagtggcgcatctgcccctggctgctgatcctcctcgagctactgcggtgcccggggatgcagtacttcttgatgaaggctctggtaatgggaggccaaatgaccttgctgggggcgacaggcactctgatgttgctgagcagcaacatcatccatatctgggtaaaggtggtcatgctgacctgactcttcctttggctgaatttgcactgctggccctcttccaagatcagcgggtggcccaagaattgactgagggcgtctgcatcaaaggggatccactggcccctcactcaggagcacatatctctagctccctcttcg

SEQ ID NO: 90669 - DNA, 91 bp, Glycine max
  Peptide Sequence Number=SeqID_182354
gataagatagaacctgtatcaagagccgaagctctgataccagatgatgcgaacctgactaggaacggatcacttgatacaggctacgaag

SEQ ID NO: 90670 - DNA, 366 bp, Glycine max
  Peptide Sequence Number=SeqID_182355
atgttcgatagaggtgacgaggtgcttaacgccttgcctcgtcaagaagtcctcttaggtttgagatttgaattgggttccattatcggtgacaatggtgtatgggaggccatgccttcatatgaggtgtttctaggtgaagtagtcgctagtaggtatttgactgcccctggggcctttgtcaatggtcctactccaggtagagcttgtaggccttggatcttcatcatcaatggagtccttttcttcttgaggtatgattgcaacagaatggagaaggagaaagatgattggagaagccacttcaaggagaagatgagtctaaaagaagctcaccaccataggaagccatggataagagtttga

SEQ ID NO: 90671 - DNA, 483 bp, Glycine max
  Peptide Sequence Number=SeqID_182356
atggggaatcaacaaaggcagggatacaatcaaggtggattctcaggtttccaacatggtccttacaaccaacaaggacagtggagatcacaccctggtaatcaattcaacaaagaccagagtggaccttccaacaggctacctcaacaagggcctaacatttttcagaggacaaccaagctagaggagactctaactcaattcatgcaggtaaccatgtcaaatcacaaaagcactgagtcaacattgaagaaccttgaggtccaggtgggccaactagccgaacaattagttgaaaagtcatccaatagctttggagcgaacacaaaaaagaatcccaaagaggaatgtagtgttgtgatgacaagaaacaagaagcgtttggtggttgaggatgaggatagggtggctttggagaaacaaattgttgtaaaggatggcactgagaaaaagaaagaggaggtaacagatctgacaaattag

SEQ ID NO: 90672 - DNA, 606 bp, Glycine max
  Peptide Sequence Number=SeqID_182357
atggttgttgagtattggacagcatggacagcaagtgcacacataataactgcggtgattggtgctggagttctgtctttagcctgggccatggcccaattgggatggataatcggcatagccttaatgttgctctttgccattgtcaatctctatacttcaaatcttctagcagattgttatagatcaccagatcctatcactggcaagaggaactatgcttacatggaagctgtgagaagcaacttaggtggtaaaatgcatatggtatgtgcattcgtccagtacagcaaccttgttggattagcaattggctacacaataaccactgccataagtgttgtattttttgagttcagaacctcagaagttgcttcagaacttctgtgctcttcacaacttctgaggcactgttcatcaggacttgaaaactgggataggtggagtgctttgatgaagtctctctttggtgcgcaagaagtgagtgatcttgtgcagaatggctatgaggatttgggtgcgaatcctactgaagcacaaagactgatgttcaaagaagcaaagaagaacgattgtaaggctctgtttacattcagcagaatgtag

SEQ ID NO: 90673 - DNA, 237 bp, Glycine max
  Peptide Sequence Number=SeqID_182358
atgaatgttgaagaacggcgagaatctcgccaaaataggggaggagcttgccacccagctcgcccaggcgacctcagctcgcccaggcgaggaaggttgcttcctccagaagcaacagccttctggaggaaggatctagaaggcccaactttcgaagaagttacggaaactcacagattgcgcaaaacacctcttttcgatttccgtcacattacggaattttcacaaatcgcgtaa

SEQ ID NO: 90674 - DNA, 369 bp, Glycine max
  Peptide Sequence Number=SeqID_182359
atggaggacaataatgatgattctaggaatgagccagtttcagatgatagcatattgaattggacaactgtttatcaggcttcaggggttggagagcctagaacctactggacggaaaatgtggaaaagaaaagacttctaagaaaggcccaggagcaacttcaacctcagaaaggaaagtggttgaagataatgaaaaaatggaatttgataattctaaagaatcccaagaagaattatttaactttgaaaatttggaagaggaagaagtcggcgacgacagtgaagtggtcgtgccagaggtcggaggtcgcagcaggtactgtacacccacgaagaacagcatgcccaaaggcagggaaaaagtag

SEQ ID NO: 90675 - DNA, 868 bp, Glycine max
  Peptide Sequence Number=SeqID_182360
gccacttgatccaacacctctggcatcaactgaagtttctactcctatcgttgctgcagttgttgtcgttcctactgatgttgttgttattacttctgctcctccacctccttctactatgcctattcaggaggccactcctactgttgtagttagtacgttgtctacttcggcttgttcaattgtggtgccttcgtccatcattgttgcacctttgctgagtatgggtgtggcgaccacaagtgctcatgtgttgccgcctctttcttctttagcaccaccagctctagcctctactctgttggtgatggcatcaccttccatgtcttattgtcctaatgtctctttcgatcacttgtacatctacaacgaaactaattcactgtggggtgcaaattacaagctagatttggtgattttggaggagaatgaaaagcagcatcaagaggctatgcgcaaggtggcatccttggaggtagaggtcgccaaatggagggctactgctcgcattgtttggagagtagagcgccctaaggtagccaatgccactgttgcctttattgaaactgtgaagtcgaatcaccaattctcttccaaggaagagaaaaaggatttggctggcaaggtggaaggcattgcagtggagagggatgagcttgctaaggtggtcgtgaaacaacacgaaaaaggatttaacaaggtcatcaggcaagccaggttctttgctaaggaccttgacttgggtctttttgaccctttgaaggacgtgaataacatggttatgcttgatgaggaagatattgtcgttcaagaggaggctggtgaggaggaggatgttgaagggcaaggcgatgatgccaatgtttag

SEQ ID NO: 90676 - DNA, 386 bp, Glycine max
  Peptide Sequence Number=SeqID_182361
atgcccttcaccttcgtcaaatttccattccacatcctcctcttcctcgtcctctcgctgccctccccggtaatttcgcaggaccagcaaacaaccctcctcggcatcaaacgacaattcggcgaccctcccgccctccgctcatggaaatcctcgtcgccgccgtgcgcatggccggaaatccgatgctccggcggcttcgtcacggagctccacctcgccgggaaaaacatctccgccgtccagctcccggcggcgatctgcgacctcgcgcacctcgctcacctcaacctctccgacaacaacatcgccggccagttcccggcgttcctctccaactgctctaacctcaacactcctcgacctctcccagaactacctcgctg

SEQ ID NO: 90677 - DNA, 338 bp, Glycine max
  Peptide Sequence Number=SeqID_182362
cattgatcacgggcctctgcgagttattcggggttcctgtcacacctagtaaggtgatccgaccaacgatcacccgggctttcattgagaagtactgcacacctaggcaggcacagggtgatgcaccacaggccgcagacgcaccgccaccacctcatcaggcaaatcctgctgggtcattaggcatggagcgggctgaggtcacatggcccggagattggcccgaggcccaggcaggggaggctcttgcaggagctcccggcgatgcagaggaggcccgcatggatgaggagatgacagacttgctcggcttcttgggaggaagcggagccacgtga

SEQ ID NO: 90678 - DNA, 426 bp, Glycine max
  Peptide Sequence Number=SeqID_182363
atgatgttgaatatcaatgcctcaacctcagatgtcagaattttcaaactaatatggaagatgaacatccccccaagggcagcaaccttcacttggaggctcctcaaggacagattacctactaagggtaaccttctaagaagaaatgtcattacccaagatgctgattgccctttatgtggtcaagttgtaggaccactcccacttgtcccagcaagtcatttagcacaattttgtgaaggattcagagttaatgtaaatcatagcagatggaataacctcatttttcaaggaaaccaattcgactcttcgaaagtcatggaagaggctatgttttcagcttggtcttggctaaaaactagggagaaaggattcaacactagctttaatcactggtcctctaatataaaggatcactttgtttaa

SEQ ID NO: 90679 - DNA, 484 bp, Glycine max
  Peptide Sequence Number=SeqID_182364
atggcagagccatcaaagaagagaaagggatcatcctccaccgctaccgctgctgcccatcgccgtcacggcccatccggagcacccacagcacctattcctccttctctgtcatctccaagatcatcaacactgttttcatccgatgatcaacgtctacgtcaaggtgcaccttttgagggcaccattgttgatgactggaaattcgattattcaagtcatgatgctcgtcgcatggtctgcaatgatcaagctgaaatgaccgcacaagcctctgaggaggatttgattcttatgtgggcttttcttaccggtcgtcagatcgactgggcccatttggttcggtaccgaatgcataaggcattacgggccaatgcacctcttccttatccacatttgattactctgtttttgcgtcattttcaaattccgcttgatgatgaaccctttgttcaagtcaagcgttgctttgcaattggtgctg

SEQ ID NO: 90680 - DNA, 211 bp, Glycine max
  Peptide Sequence Number=SeqID_182365
atgaaaaatcctacattactagggtaccctcctgtcgcaacgtgcccttttgcgggcgagcgaggcgaggctcacaggtgtgctttccaaatgaggaaagatgcgcggagtcgccaccaacgtttatttgtggaaaacgtcggaaaaaaccgaaggaaaccggtcaaaacaaaaattctaagttcgggagttgtatttacatttgaggaag

SEQ ID NO: 90681 - DNA, 234 bp, Glycine max
  Peptide Sequence Number=SeqID_182366
atgtgtgcacaagtttgttctaagtcgaaaagattagaaatggctccgaaaaagctttccgcgaacaggtctaggagagacgccgcggctgaagggtccagtgccacccccgagtttgatagccaccgtttccagagcgccgagcaccagcagcgctttgaggccatcaaaggatggtcgttccacagcgagaggcgcatccagcttagggaggatgagtatacagatttttag

SEQ ID NO: 90682 - DNA, 123 bp, Glycine max
  Peptide Sequence Number=SeqID_182367
atggctacaccacccagctctcctcctcctactcctcctacagtggatatgacatatgagaattggaaacaagtccctgttgctcagaaggatttgatatgggaggatattcaggaattttag

SEQ ID NO: 90683 - DNA, 361 bp, Glycine max
  Peptide Sequence Number=SeqID_182368
agaactcgagaggtgctgctggcacaaggcattgactaggaagttggatgggcatattgatgtggccctggtcaaggaattctacactaatctctatgatccggaggacaaatctccaaggcaggttagggtgaggggcaaattaattaagtttgatgctgagtctctcaacgcatttctggatacaccaccagtcttggagcctggggagcagtataccacctacaccagattctgtcattcgcgcccaaaccctcaggagtttactgccagactctgtattccagggcgcgactttgttcttaatactgaaggggcaccctggaagctcctaaggaaggacctcaccatgctagcgtag

SEQ ID NO: 90684 - DNA, 207 bp, Glycine max
  Peptide Sequence Number=SeqID_182369
atggtggggtatgcaccttcaagctttgcggatttggtcttcgtcggcgaaagatcgcagcaggaaaatgaagaggatgagaatgagggagaaacccttgctatgattgccattcctacacagtcaaatttcccatcagcccaacaatgtcattactcagccaataacagtccctctcacccaatcatccctaaagtccatccctaa

SEQ ID NO: 90685 - DNA, 390 bp, Glycine max
  Peptide Sequence Number=SeqID_182370
atgggtccgaaatctatcctaaggctcatgagaaccctagggccttctcttgcatctttggtccaatcttcttcgagtcttctatccaatgcccttggggggagtaatcaacataaaaatacaaaaaaaggggttcccacggaccctaagagaataaaggtcattcctaagtggcccactccaccaagtataaggaaaatttggggcttccatgacttaacaaacttttacaaaaggtttgtcccatatttttctatacttgtagcaccgctcattgagttggtgttgaggaaaaaaagcccagagtttcaagaacctagggatttgaggtcaaatccttttcaagggggagggaatgatgcaatcctatcccgcaagggcattggatag

SEQ ID NO: 90686 - DNA, 201 bp, Glycine max
  Peptide Sequence Number=SeqID_182371
atgaatatttatattgccatcacgttctggtattgggtgcgctattacgaaacggcaagtagcacgacatttgtcgccagaccgggagttaccgtccgtccacgccgccgcgatgctgttattggtcgcttttatcgtcatcagtctattactcaaaaaggccttttgctcatggttatgcccggttggtacgctttctga

SEQ ID NO: 90687 - DNA, 213 bp, Glycine max
  Peptide Sequence Number=SeqID_182372
atgatgcatgcacctgactcaacactcatatgcaatgtgggaactgtgctgagtttgtcgagaccacccggttgtgcacgtaacagcccccctcccataggtgatcagcatgggagcccaaaggtgttccctaccaggtcaaaagtaaatgccaaagaccatggaccaattaaagcacctaagcatcccctcaggaatgcttatattctctaa

SEQ ID NO: 90688 - DNA, 252 bp, Glycine max
  Peptide Sequence Number=SeqID_182373
atgtggctccgtatgccactggactcttgggtcacggtaacaaaaggtggggtggtcgacaaaagcagtgcttttgctcctaccatttcgtttctaaataaccatttagaggaagcactgggttcaacaaaaatagaagaaaatcactcaaagtgtatcaatctcacacaatgtgaggcgaacaagtcaccgatgcacaggattttggttggcaatcaaaggaagaggaccacttcaggggggatcctctag

SEQ ID NO: 90689 - DNA, 162 bp, Glycine max
  Peptide Sequence Number=SeqID_182374
atgtctgaaccacacatggacaatccttcccttgtgttcaggaatcctttacaacaagagaccctcggtctctcagtcctcactaaaagcatattggccactggtaatcgattacatcctttggtaatcgattaccagagagtaaatctcaatttaaaatga

SEQ ID NO: 90690 - DNA, 313 bp, Glycine max
  Peptide Sequence Number=SeqID_182375
atggaccatgacggaagggtgtggggaaggggttttgccttgcaaaccttcccggtgatgcttttaggtcttggcaagccgttggttgaaattttgccccccggtcaaacttcgtggtttttgcccgttgttggcttggctagggtcggcggtgctgggttatggccccgtgctaagtttcggattggttggccccctcctcccccccggtttgttggtgatttggaggggagggacgaatcaaagcgacaagggctgaatctcagtggatcgtggcagcaaggccactctgccacttacaataccccgtcgc

SEQ ID NO: 90691 - DNA, 327 bp, Glycine max
  Peptide Sequence Number=SeqID_182376
atggcaagacacaaggtcacacgcacacacacacacacacactcacgcaggcacaagggggaggaggggcttggtcggtttgttggtgatttggagggagcagaaaagataactctttccggggcccccgccgacgtctccggactccctaacgtgccgtcagccgccacgtcccggttcaggaattttaacccgattccctttcggagtacgcgcacagagcgctatcagacgggcttcccccgtcccttaggatcgactaacccatgtgcaagtgccgttcacatggaacctttcccctcttcggccttcaaagttctcatttga

SEQ ID NO: 90692 - DNA, 291 bp, Glycine max
  Peptide Sequence Number=SeqID_182377
atgtgctcagatgaaaccagtaccaaacatcaaagatcaacaaagcgtgatccatcttactgggagtatgttgatgccttacattccatgcaaaatattaattctccaatcaaacacagtgcatcatcatctgaccaagcaaaaccaagaaggaccatgccgatgttggatcaatttcatccatgcattcatgattccattgaaaacattgttgatgtcaaagctgatggtaagggtgaagattcatggtctttggtttgcaaccatttgcttaaagaacttgcaaaatga

SEQ ID NO: 90693 - DNA, 219 bp, Glycine max
  Peptide Sequence Number=SeqID_182378
atggtcaacctagtaactcagcttgccatgaatcagaaatctacatctgcccctgttgttggaggaatcatccaaaatatgagatggacaagtcctccacaacaacaacaacctatccctcctttccagaatattgttggtccaagcaagccatatgttcctcctccaatgcagcaacagcagcaacagtcacaacaaagacaacaagcaattagatga

SEQ ID NO: 90694 - DNA, 369 bp, Glycine max
  Peptide Sequence Number=SeqID_182379
atgtcccatctcttattctcagttacaacaacccaagtagatgtaccctctacttgtaccacaaaggatgtaccctccaatgtgttaagacaaagttctcaggcaggaaatggaagaatcaaaagaattctcagactgtgtcattttgaattctttgaaaagggagaagggagacacaaaagaattcaggcggttagtctttcgttcttttggaaaagggagaagagagacacaaaaagaattcaggcggttagtccttggcgaattctttttggcaaagggagaagagagacacaaaaagaattcaggcggttagtccttgtcgaattgtttttggcaaagggagaagagaatgaaaaagatgaatag

SEQ ID NO: 90695 - DNA, 183 bp, Glycine max
  Peptide Sequence Number=SeqID_182380
atggtgatttttcaccatggagatgtagcgcaagataaaggagaagagccatggaaggagaagcttcacccccaagagagtgtcttggataagaagcttagagaggaagcttcaatggaggaagagaatgagagagagagaaagtggcacggaaaattgaaggtagaaagggagagaagctga

SEQ ID NO: 90696 - DNA, 204 bp, Glycine max
  Peptide Sequence Number=SeqID_182381
atgatacaaacaaagatttgtatccatgagattgctcataaagtcttctctgctagtgctgaaaaactggggattgtacccataatcttcttgatgatgatgaggtggcgtgaattcatgcaagatggtggactttgttttggaggatgttgttcagtttccatgtctggagctgaacgagatgtggcagcaaggtttggataa

SEQ ID NO: 90697 - DNA, 201 bp, Glycine max
  Peptide Sequence Number=SeqID_182382
atgaaatatgacctttacacagaagtagtgaaatatgttggagtagggattcgcccaaaactcgcccaagcgagtctgaattgggtcagctcacccaggcgagcaaaatttcgctcgagagagtcttgcaggaaatcaaagtgcaccgaagagaagttcgaatggagaaaggtacaagtcttcctatggagaaagcagtaa

SEQ ID NO: 90698 - DNA, 1101 bp, Glycine max
  Peptide Sequence Number=SeqID_182383
atggctctaagctcgtcaagtgtcttcctgccaattaaggcaaagtatgatgtgtctacgtcaaccagcagatatcttatgaccggcataagggtggacagtgtcgggggagacctcgagtctcaggaaggttctccagtacaagatatctgtggaattgccctggtcgataaggaccctagacaccatgaagtttgcaatgatgatggagacaaccacggggtaatcttggttgatggggataacatgcagatgatgttttcaggactagctagactgccctccataggaaaagccgcctgtgatggtgttgattacacctctgatgtgttggacaagttcttgttcttctggaggttgtcgctcacgtcgttgctgttgttgtctttgtctgcctcgtatttggttgcgtctgaccccaacctaggaggtttcgtctggggtagccggatgggtacttctaggttgaaagcttcctccaaaattgtggtgcaattggtcgttaggatcgattttggtgcttcctttgcacttttcgcgtttatgtccgccttggagcatggaatgcaatgctacctcgggattaagattttggatctggatggttgtgcacccaaatatgtccatgaattttctaagggactcgtcgtttgcttgtcacagacttgccaaggcggccaaggtcatgcggtgagacctgctggtggcatactacgcactaaattgttcgacgagggtgtcgaagctgtctatgaacctgggtgggagtccaccgtcaagaaggcatctagatgctcgtttggatttgttgtcccattgtaccgctcgaggttgactggtttccacctgaaaggtatgtctgcctccatagtacggttggcaaaaggatgccgacgaaaggtccaccctgctggatggtgtatgtgggagagacttaagtcatttgcagtgttgcctatgtgttgggggtgtgattccccttgggtgcgctcaagcaaaatgtggacggagtgttcgtcgccttggggacgtctagcagtatttgtgtttgttatagctgtcggtgaggatgaaaatcttcaaggcgggtctcgcatctga

SEQ ID NO: 90699 - DNA, 306 bp, Glycine max
  Peptide Sequence Number=SeqID_182384
atggctaagtgcatagaagatcctggaacgaaccagaatgtggctgagcgaacgaccaaaaatcagcaacactatttaaagcctgaaatcagaaatggaaggggggttctcaatttttggcattttctctattcttggaagcattcatctgagtggctgaatgtcagagagaacttctggtgtgaagatcttgagggacagcagagattaaagaggaagttatcatgcgaagtattggatgagagtttgagtgattgtgaggtttctagaggtgaaggagacatcctcaccacttgtacttcctaa

SEQ ID NO: 90700 - DNA, 210 bp, Glycine max
  Peptide Sequence Number=SeqID_182385
atggcggtttccaaactcagaaatgatgcaaagggttcctcttggtgtggggtttcaacggagaacaatggaggtttgtggtggctacgggtggctgtggttgatgaagaaaaagcttggtacattggaaatggctttggaagaaggaaggagaagaaatggcatttttccaaagctacttggactacaaggctcaaaacgcaaaagtga

SEQ ID NO: 90701 - DNA, 246 bp, Glycine max
  Peptide Sequence Number=SeqID_182386
atggttgtcatcatcaaaaagggagagaatggggagaatgtgaatgtatggatacatgattttgatgatgccaaagaagaattaaacaaggttgcttcaaaggttaagcattgcttcaagattaatacaaggttatttcaacaaacaaagccttgcttcaagattaactcaagatcaagtcttgtctcaaaacaaagtgtttccaagacatccaaggctctggtaatcgattaccaggcagtgtaa

SEQ ID NO: 90702 - DNA, 300 bp, Glycine max
  Peptide Sequence Number=SeqID_182387
atggaaacccttatattggatgaccaagatacttcccaaaaatcgaaattcttgatcaatggaggaacaatatcaccatttttgttcaataagataccaaagtggatgattgactcattccatactagaaagaatcgcaggaaatcttttgataacacagattcctatttctcaatgatatcccacgatccagacaattggctgaatcccgtgaaaccatttcatagaaatatgaatatacctgattcagaagggaagaacttgcatcagtatctcaatttcaattcggggatcctctag

SEQ ID NO: 90703 - DNA, 420 bp, Glycine max
  Peptide Sequence Number=SeqID_182388
atggcatctagcagaggtatgttcacctctactttcctgaaggtctccaagatctccttttccgcttcttccatctttttgtttggaattgctctaggtgggaatggaaaagggataggaggctgcaactttgaatggaggctcttgtctcttgctgaaattgcctattctagatggtcatttgcctcactaattcttctaaggaaggttgagaaggagcctcagttgcttgttgtctttgttgtgactgctgttgtattggaggaggaacatatggcttgcttggaccaacaacattctggaaaggagggacaggctgttgttgttgatgcaagctccattggagcttgtaggcctaggatcttcttcatcaatggattcctttgcttcttggaagatgaatggcagcggaatggataa

SEQ ID NO: 90704 - DNA, 378 bp, Glycine max
  Peptide Sequence Number=SeqID_182389
atggtcacagctcgaccggagagggtgctacgacagtttggttacattcagagcatccctccaccgcttgttagcgcttcattgtcatataatgatatagatgacaggtggatgcatttcgcggaccacgtatctgcgtattacatggagtggttttttcggatatctcacccattcatgataccgacccaggcaggtgaccagcccagacatgcacctgccgcagaccctgaggagtacatgcagccgcccatcccacaggttccaatggcatttgacgcccctccacatgcagtggattgcctcacggtcgctagagggggtgccagtgcagatggaagtgtcagggctcgacagagacggcgcacagagcattga

SEQ ID NO: 90705 - DNA, 726 bp, Glycine max
  Peptide Sequence Number=SeqID_182390
atgcgtagtgattgcttagtgcaattctccatcctcaaccctttttcgaagcccatgaattgcgttttcattcaagtgtcctccaccttcgagtttggagccatgcgtagtgattgtttagtgcaattctccattcttaacctatttcggagccccatgaatttcgttttcgttcatgagtcctgcaccttcgagtttggagctctgcgtagtgattgcttagtgcaattctccattttcaacctttttcggagccccatgaattgcgttttcgttcatgtgtcctcctccttcgagtttggagctatgcgtactgattgcttagtgcaattctccattctctacctttttcggagccccatgaattgcgttttcgttcatgtgtcctcctccttcgagtttggagctatgcgtagtgattgcttagtgcaattctccatcctcaaccctttttcgaagcctatgaattgcgttttcattcatgagtcctccaccttcgagtttggagcaatgtgtagtgattgcttagtgcaattctccattctgaacctttttcggagccccatgaattttgttttcgttcatgagtcctccaccttcgagtttggagctctgcgtagtgattgcttagtgcaattctccattctcaacctttttcggagccccatgaatttgcgttttcgttcatgtgtcctccaccttcgagtttggagctatgcgtactga

SEQ ID NO: 90706 - DNA, 180 bp, Glycine max
  Peptide Sequence Number=SeqID_182391
atggaaggaaatgatggatttgagcagagagaatgtgagagtagggaagtgaatgaagcggtgattcttatgtcatcttataaatctttctcaaaatctatgaatatggagggttcgaaagagaacgttagagatggagaagggagaaatttagaagatgaagttgaaagagagatataa

SEQ ID NO: 90707 - DNA, 345 bp, Glycine max
  Peptide Sequence Number=SeqID_182392
atggcggcgcagctaatccgtgatcgagtagagatggagtgcctagagggagtttgggagaccctcgaaggcaacacaaggtgccgatttcgaggcaccattcgattcacggctacttctttgcgcacggtggagtggatactacccacgcctacaccatatcgtctagtggagcccgtccaagtgatcgaggtaacgtcatccgaggaagaccctgaggaggatcttgcggagctacctcttgagcctgctgtggatgctcttgactttctagagggtgatgaggatccacttcttgaggtggatccacttcagtgtttgggcaaagaattctcagacggatag

SEQ ID NO: 90708 - DNA, 181 bp, Glycine max
  Peptide Sequence Number=SeqID_182393
atgttgcgggggtcaggagaccttggggacgtcaggtggggtgctattgcccaaaaccaagcttggctaatcccgacccaacccgggcatagtcagtcagtgagaacctgtgacggtgataggggactggtaatcaattaccagttgggtgtaatcgattacacagtgttacctgctactg

SEQ ID NO: 90709 - DNA, 321 bp, Glycine max
  Peptide Sequence Number=SeqID_182394
atggagattgcactagaggatccctttacgcatagctccaaacccgaaggtggtggacacatgaacgaaaacgcaattcatggggctccgaaaagaatgagaatggagaattgcactaagcaatcactacgcatagctccaaactcgaagctccaaactcgaaggtggaggacacatgaatcgaaaacgcaattcatggggctccgaaaagtattgagaatggagaattgcactaagcaatcactacgcatgagctccaaactcgaaggtggaggacacatgaacgaaaacgcaattcatggggctccgaaaatgggttga

SEQ ID NO: 90710 - DNA, 288 bp, Glycine max
  Peptide Sequence Number=SeqID_182395
atgaggattcttttgatagtccaagggcaaaacaaatttgggtgtcaaggtgtcggtctcgggccaaactcccatattactccacaaggcacgcgtgacaatgatgatttgaaaacaacgtgcaaaattagtcatggctacagccaggtgggcactcaagcatcccgtttatggcattgtgatactacggttgggaatttacacaaacagacccaacgtttcccaattatgttcttttatcagttcaatgaattcatccatccttatctcggttattccggaaaataa

SEQ ID NO: 90711 - DNA, 558 bp, Glycine max
  Peptide Sequence Number=SeqID_182396
atgctcgaaagttttcaacaacaatatcaaatgtcagttctcgaattgtacgtaaaaaaggatgtggctggtggttctatgtttcattctgcaaattcacttacatcatgtggaaataatttatctaataatgaggcgcaaccgccaagaaatgtgagcaatttacatggtgatgatgatgatgattatcttgtgtttaactcatacgtggaagagtctttagacgaagatgatagtattgacagtatatctgatacagacgatgaagtcaccgacatgattcaaccagtaagaattgttcacccagcaaaaggtgtacaaggaattcaaaatccattttggaatgatgttttgcattataataatatcaactggagtcatcctgatgaggaggacatttgtggtttggagatgccatcgagttttaatgttggccaagaattatatgttggcatggattttgatagtaaagatgcggtcaagaatgcagtcaaacaatatgttatgaaggtgaatcaaagtttcaaagtggttgaaagcaaatggaacaagccatga

SEQ ID NO: 90712 - DNA, 525 bp, Glycine max
  Peptide Sequence Number=SeqID_182397
atggctagaacacgaggtttaggtcgtgccataggtagagttataggcagagatagacaggatgaccatgatgatgttcccgagaggcgtaggcctactgcatcagcccgtaggcaacgggttcatcagatgactcaggatgttcttgttgaggatgcccctgatatagctgaggatgcacctgagatgactgcggacgtacagggtgctgatggtgctgaggggtcacatgctgatgatgctgagggattcccaggtggaccacgtgacccgtcagtgctgacatcatttgcggaccatgttgcacacgccgtttggagtggacaggaacgtcctgatttgaagttagtgtcacatgggaagaaggtgacattgattgggaggccagtgcctgaaattgaaggactggtaggtgctataggattaagtccactgatcgattgttcagttgttactggcgatcctggacttgtatccgcatttgtggagaagtggcacagtgagaccaacaccttccaccttccg

SEQ ID NO: 90713 - DNA, 684 bp, Glycine max
  Peptide Sequence Number=SeqID_182398
atggcacaacctccaccccgtgagaagactctaagggaaatggttgcacctaatttcacctacgaaagcttgtgcatccaataccctcatgaggatgtcccatatgttcttaaaactggactgatccatttgcttccaaagtttcatggccttgcaggtgaagacccacacaagcatctgaaagaattccatattgtttgctccaccatgaaaccactagatgtccaggaggatcagatatttctgaaggcctttcctcattctttagagggagtggcaaagggctggttatattaccttgctccaagtgtagaaaatgatgctattgtcattagaggagtgcatgaagtagccacgaattcatcttcatcaggtgaaactaagaagcttgaaggtaaactagatgccttggttaacctgcctgaagcttatgctgcaaacatctacaatagacctcctcaacctcagcagcaaaatcagccacaacagaacaattatgacctctccagcaacaggtacaatcccgggtggaggaatcatcccaaccttagatggtcgaatccttcacaacagcaacaacaacaacaacaacaacaaccttattttcagaatgttgctggcccaagcagaccatacattcctccaccaatccaacaacaacaacagcaacagccccagaaatag

SEQ ID NO: 90714 - DNA, 84 bp, Glycine max
  Peptide Sequence Number=SeqID_182399
atgtcggccaggaaagatgaccgatccaggctacagaggttttggatgacgccacttccagtgaaggaagataagtcagggtag

SEQ ID NO: 90715 - DNA, 390 bp, Glycine max
  Peptide Sequence Number=SeqID_182400
atgcgtgccagagctagagtaatgagtgaaatagaggaggtgcaagagcagatgatgactgacatggaggccatgaaagagaaaatgaccacaatgatggaagccataatgagtatgagaaggatggtggaggtcaatgcggctacagttgttgccgcaagtaccgccacagaagtcgccccgactcacccacctggcttcaatcaagttcagaacaagcattctttcccaccatatggcttgcctcctaactatacaccacccaatgttgcacacactcccgatgagaatgtcgacaactccgctcccatacccattgagagccaacaaccccaatctgatcatgcacatgtctctcaatccatgggggagacacatgaagcaccctga

SEQ ID NO: 90716 - DNA, 236 bp, Glycine max
  Peptide Sequence Number=SeqID_182401
atggataaccactcgggtatctccgcatgtcacgtgactccagggtcagtatgtgtcgcaacctacccttcggcgggagggcgacgcgtgactcgcgggatgcgtgttccacgaaaggaatacgcgcggagtcgccaccaacgtttatttgaggaaaacgtcagaaaaaccagaaaagacgcgatctacgaacttttaagtgaaaggctcgggagttgtatttacgcacggggaag

SEQ ID NO: 90717 - DNA, 63 bp, Glycine max
  Peptide Sequence Number=SeqID_182402
atgaatcggtttttttggacgatggagacctcagccggcctatggcagcctgccatggcgtag

SEQ ID NO: 90718 - DNA, 460 bp, Glycine max
  Peptide Sequence Number=SeqID_182403
atggcatatccatggtgggatgataacaaggttaagagcaatgaagatcacaagggtaagatgaaggagcagaaccaaccaggaaaaagccataatgaacatggatatatcagtggctatgtaaagggctatgtcagttgttatgaacatgggtataagcatggtaagagtgaatgtggtgatgatctacttgagagtcacattggttatgagcttagccatggccacaacagtgatgatggctatgaatatgactattattctgattatagtgaagatgactatgaatatgactctgaatctgattacaatgaatctaatgaccttgaatctgattatggtggctctaacagcagtggtagtagcagtgaatgtgatgatgtagtacttgagagtcaccatggttatgagcatggacatggatatggctacaatgatgatctacttgagtatcacaatg

SEQ ID NO: 90719 - DNA, 570 bp, Glycine max
  Peptide Sequence Number=SeqID_182404
atgaaaatagacgaaagtgaaagagggaacacatcaaatgaaaaaggtttagttcaatttttctcagtagaaatgcccaacattgtgaaattaatgctagcagctggtgtctcgctaagcgaggcatgtgcgcttagcgagaatcatgcgctaagcaaggcactcaactcacttagtgagttgggagaatctggaggagaatctgagaagcatatgggcgcgctcagcgcgtcatcagcttgctcagcaagacgtttgtctcttcccacgctaagcgcgcctagctcgctcagcggatattcactaactcgcgctaagcatgaaaatggcgctaagcgagccttcaaggacagaaagccctttttaaggctgaagttggaaaaatcaagagaggaggttagcaaagagagcgtggattggaacgtagagagcataacagaggcaaaaaatagagcaaggaagccaaaaacctcagctttcaagaggatcttaggtttaggagtaatttctaggtttctagaggtggaggagacatccccaccactgtgtaatctgttattttcttcttaa

SEQ ID NO: 90720 - DNA, 600 bp, Glycine max
  Peptide Sequence Number=SeqID_182405
atggctctcctttgggagaaggatcttgatttggtaaataaattggcttttaaaggggagaagatcattcgtggaaatccctctggaattgacaacacattaccaccattatttggtaacgttatcatcttcaagtcgggtaacttgacacatctgaagtcaagtgtgtcgattaaaatcctcattactaacaccaaagtagggaggaacacaaaagcattcgtggctggtgttggagagaggatgctaaggcatctagatataatggcttttgtgtttagtgctattgattctattaacaatgaattgatttccattctcaagtcacctacaccaaatgacctattggtaattgagaaagaagagaagatagaagaactaatggatattgatcttaatgctaccctgagctgtgtcaatgattgcttaccaaataatgagaaaggaaagaaagctggagtcatacctaacagaataattgaccttgagattggcgtggaggataatctcaatcaccaagtaactagtgttccatcacctaaatattatctagacctcacaccagaagtgcacactattaagaaaagttggttcaactga

SEQ ID NO: 90721 - DNA, 438 bp, Glycine max
  Peptide Sequence Number=SeqID_182406
atgaagagcttaggttctacattacatgaagtatctacagaagctagagaagccaaagaaaatctactacacatccaacctgaaagtgaaagctatgatgcccatattgaagacttaaagttagtcttaaaatctactaatgaaaaatacaattccatgcttgatgaggctgagtgggagcagagagaggttcaactagtcagctgcataaagaaaaatgaagaagagaatgtgtccttggaaaaagaaataaaaatattgctttatttgcttaaagaaaccgaggaagaagctaatgccaaaagggaggaaaaagctcagttgaaggaaaaattgaaggaagttgaggctgaggcaatccaactgaaggaagctcttaaggaaacaacaactgacaacatggaattgaaggagaacttattggataaagaaaattag

SEQ ID NO: 90722 - DNA, 654 bp, Glycine max
  Peptide Sequence Number=SeqID_182407
gatcatggcttctccacctgcctcccctcctcctcctcctccttctgctccttcggacgcatcggcttcgccaccacttggtgctgagagaccagtggtccatgtagatcctgctaccggcaaggctgacggtccccacaggaagaaattaagaacatatttggggattgtgtcacgtgataaggtggacgtcacctacgagaactggaaggaggcagaatttgaaatcctagaggcttctgacagtaggatgaaaaggaagttacttcagaccgtgggggagagatggaggcagtttaaatcagacctcacgaggaaatgggcccttgcagccgatcaggatgacccttcttgggaggatgtgcgcaaaaaggcacaagccatccagaagcagaacattgccccccacgttctgtctcatgggggaagcgttgatggcgtcatcgaccctccatccccggtcagacgccacgtgacgtggaagatggcccgcacgaagaaaacaagggagatgacgactgaggccgcaaaggaaattgctgagaagatcgatgttctcaccgctgctattggacgtccagagcaccctggatgtgtatgtgctgctggagccggtgtcacgattaagcaatactttggatcagctccacggac

SEQ ID NO: 90723 - DNA, 117 bp, Glycine max
  Peptide Sequence Number=SeqID_182408
atggggaattgctcaatgaagggtaccactggagaatgtcaccactctattcgtgttatgtgtgacagtgggtcatgcttcagcacctttgccagagcaacagagtttaagctatga

SEQ ID NO: 90724 - DNA, 303 bp, Glycine max
  Peptide Sequence Number=SeqID_182409
atgcttgcgaacccaaagacttcctaccaagcagttgttagtttgcattttgtaccaccttggcagtgcttagtcttctcgtctatctatggtcaacaagaacaagctcaagaggttgctcctgtgtgtataaagaacaagctcaagagattgctcaagaggttggcattaacagatccagttaaactgttacaagaacacaataagggattagacgaaacatacctacgtgaggtggcgaaggagaaaaagtacagacttgtgacgatgctcgagtgcgacgaacacgatgctcgaccttag

SEQ ID NO: 90725 - DNA, 243 bp, Glycine max
  Peptide Sequence Number=SeqID_182410
atgagtcgttgctttacaacgagcgatgtcggctattgtattttctattctgatgaggacatgaccaagagcaagggcaaggatccacttgaaggacttgaaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggactaa

SEQ ID NO: 90726 - DNA, 318 bp, Glycine max
  Peptide Sequence Number=SeqID_182411
atgaaaccaccagatgtccaggaggatcacatatttctgaaggcctttcctcattctttagagggagtggcaaaggattggctatattaccttgccccaagttgccctcaccaccagatttcagagcagtttcttctccaatatttgtttgaaggactctgcaacatggagagaagtatgatagatgttgtcattggtggagcccttggagacatgacccctgttgaagccagaaatttaattgagaagatggcttcaaactcccagcaatttagtgccagaagtgatgctattgtcttagaggagtgcatgaagtag

SEQ ID NO: 90727 - DNA, 375 bp, Glycine max
  Peptide Sequence Number=SeqID_182412
atggaagagtatatgaagacaatgatgatatttttagtttcaggaaaatatgttgcgttgcaactttgtgatgacgaagatgttgaaactatgatcggaagttttcaacaacaacaacaaatgtcagttctagaattatacgtagaaaaggatgttgctggtggttctatatttcatgctgcaaattctgttacgtcatgtggacataatgtatctcatcatgagtcggaactgccaagaaatataagcaatttacatgatgatgaagatgatgatgatgatgattatcttgcgtctaactcatacgttgaagagtctttcgatgaaggtgatagtgttgatggaatatctgatacagacggtgggatcctctag

SEQ ID NO: 90728 - DNA, 348 bp, Glycine max
  Peptide Sequence Number=SeqID_182413
atggagtggttttttcggatatcgcacccattcgtcacgcggaccgaggagactgttgcgccgagacatccgcctccccctcatcatgaggagttcgtcgagccacccatccccgaggttttagtcgcgaccgatctctctacgcattcagtggttcactgtgaaggatgtcaggggatggctcaggatttaggagcgattgttgaggatttggagcgggtcatcaacctcaggatggtcactgagggcactgacttacatgacagcatgactcgttgtctgaggagagctagaggcgacaccgcagatggaagtcttaggccgcgccagagacgccgcatagattag

SEQ ID NO: 90729 - DNA, 414 bp, Glycine max
  Peptide Sequence Number=SeqID_182414
atggtgggtgtaagggaactggtcaaacagcgccagccgcgtgacggtatgcgtggcactcagtacgctgaggttgtcgcacagcgtctgcggattacaggaaatatagagaatacgcggataggcctgcaccatcttcaccgtctcgtcatccagcccgctgcgcggcggatcgacaaagatggtctcgcactgatagctattgagatcgatgccttccagacggttaaagctgcgcacgccgttcatcgcctgggtaaactcttcggctgccatacgaataatttgcacgttgtcgatgtggttggccgcgatgttgtactgcgccgaagccaccgacggtttggcgatttccgtcgccagtacgcggcggaagttacgcgccagcgccagcgaaaagttgccattgccaca

SEQ ID NO: 90730 - DNA, 651 bp, Glycine max
  Peptide Sequence Number=SeqID_182415
atggctcttcatttaagcgagatgtcaacgctattagaacagaagatcttaaagagctactcgaagctcaatattgatgaaataggtcgtgtcttgtctataggggatgggattgcccgtgtttatggccttaacaagatacaggcaggcgaaatggtagaatttgagagcggcgtaaagggcatggccctcaacctggagagcgacaatgttggtgtagttctgtttggcagtgacactgccatccaggaaggggacatagtgaagcggactggggcgattgtggacgtgccagtgggcaagggaaccctgggccgtgtggtagatgcattggggcaacccatagatgggaagggtccattgaccgacgtgaagcgtcagcgtgtcgaggtcaaggcacctgggatcattgcacgtaaatcagtcagtgagcctatgcaaactggcttgaaggcggtggatagccttgtgccaatcggccgtggccaacgagaattgatcattggtgaccgccaaaccggcaagaccgcaattgctatcgataccatattgaaccaaagggcagtgaacagtggggagaatggttcaggacaaaagctttattgtgtctatgtggctgtgggccagaaacgttcaacggttgctcaattg

SEQ ID NO: 90731 - DNA, 411 bp, Glycine max
  Peptide Sequence Number=SeqID_182416
atggtagccgcaaccaaagcaaacccgctggttttccttaagggaaggctttacacacacaggtttcataggtttcacagtgtttctaaggccttgcatcccataggcctcacgggcctcacaggcctcccaggggcaggcatcacaggcctcccaggggcaggcctcacaggcctcacaggggcaggcctcacaggcctcaaggggcagtcctcacaggacaggggcaggggcccacgcccaagggcgttctcgttgaacggccccacgcctaagggcgttcagtcagaggggcaggggccctgtcccgttcagcgaaacgccgaacccctgggaggcaagggcgttccgttggacgggcaggggcccatgcccaagggcgtttcgttgaacgggcctttcatcccgtag

SEQ ID NO: 90732 - DNA, 685 bp, Glycine max
  Peptide Sequence Number=SeqID_182417
cactcgtatcattcaggagcttgaaaaagatcatcagcttactcgaaccaaaggtccctctcctgttaaacagcttcagaagcaaaagaagctcactcgtaacgaaaagatgatgcaggacaggaccggagagaaaccttctaaaaaagtgatacaggaagctatagatgcgatcctcaccttcttcgataccatcacaatcgaagacttcatatacgaattaaaaaagcaaaacatatcagcttcagcaaacatcgcttctactggcaagatgaacggtttttcatttgagcatcggggagtcgcttttaaggcttcccagctcagtaaggcatacagttggtcaaacataagcaagcgaatcatcgtgactctaccaatggatgctgttgctcctgtatcgtttaccgccaatgaaaacgtttcaactcccattgaagttcaacccacagctacatcccacacagcacattccagcgatcatactcggcctcgctggttacagtggataccctaccttgatgagtttctaagcagcatgaaagctttaggctcaacaattctcaagccagctaagaaagctgccctcattaagaaaatcatggatgaaaatccaaaacctatgcaattttcggaagtgaattctcaggatttggtaagaaaatcgcactttaaacctgtttaa

SEQ ID NO: 90733 - DNA, 177 bp, Glycine max
  Peptide Sequence Number=SeqID_182418
atgggtgtcatcgttcttcgattcggttgctcagaggatgatgcagtacgcctcactgatgaattgctattttgcatagattcaaaggcatctacatactcccagttcctgttcataggtttcttcgatgccccctttgtgttaacctttgctagaggaggacacatcgaattctga

SEQ ID NO: 90734 - DNA, 252 bp, Glycine max
  Peptide Sequence Number=SeqID_182419
atgaaactggccaaatacaggctaaaggcccaagtggagaaggacgaaggcccaagtggagatggacaaagcccccgagtggagaaggatgaaggcccaagtaatccttgtggcgtctacccagacttatcttccttcaccggaagtggcgtctaccctgacttatcttccttcactggaagtggcgtcatccaaaccttcgtagcctgtatcaaacgatccgctcctactcaggaacttaagagggagtga

SEQ ID NO: 90735 - DNA, 573 bp, Glycine max
  Peptide Sequence Number=SeqID_182420
atgtttagaagctctgacactggtaatcgattactgccttctggtaatcgattaccagagagtataactctttggcaacaggaaactgcccctgttgctgaggatgatcctgtgctgactgaagatgtacatgcacatgctaaagaagttgttgataatgctgagggatttccaggtgggccacgtgacccatcagtgctaactgactatggtgaccatgttgcagtcatcgtatggaataaagaggaacgtcctgaattaaagttatcctcccatggaaggaaggttcagaaatttgagaggcctgctccagaaattgaagggctagtcgctgtaacaggattaagtcctttgatcgcatgttcagtagacactggcgatcggggacttatatctacttttatggagatgtggcataaggaaactagcagtttccatcttcctattggagagctgaccatcaccctggatgatgtggcatctctacttcatcttccaactataggcgcattctacagcttcgagcctctgcaagtcgatgaagcggtcttgatgttggtggagttacttgaa

SEQ ID NO: 90736 - DNA, 732 bp, Glycine max
  Peptide Sequence Number=SeqID_182421
agtttggataccgtagcgacgaggcgggtcgttacattacacgtcctcgccatcagaggactacacatccttgccttcagagggctacatgtcctcacctttagagagctacacgccctcaccggcagagaactgcgcgtcctcccattaatgtggcttcacgccctcgccttcagaggactacatgtcgtcgcctttagagggctacacgcccttgccttcagagggctacacgccctcagctttagaggactactcgtcctcacctttagagggctacacgccctcgccttcagaggactacacgtcctcaccatcagaggactatgcgtcctcactttcaaaggaccacacatcctcaccttcagaggactacacgtcctcgccttcagaggactacacgtcctagccatcagagggctgcacgccctcacctttaagggactacacgtcctcgccttcagagggctacatgcctcaccttcggctacacgccctcaccttaagaggagtacacatcctcaccttcagagggctacatgccctcgccttcaaaggattacacgtcctcaccttcagaaggctacacgtcctcgccttcagatcgctacacgtcctcaccttagaggactatacgtcctcaccttcagaggactacacatcctcaccttcagagggctacacgccctcgccttcaaaggactacacgtcctcaccttcagaaggctacac

SEQ ID NO: 90737 - DNA, 222 bp, Glycine max
  Peptide Sequence Number=SeqID_182422
atgacctccaagaaccttccccgttggtctgaatgtattttgccaaggtctcacctaaaaattgacgcgacagagcaaatgaatcgggttgatagcaagcggataagatcgagaggcttacctcgaatccgaaatgagaaatggcggaatcggcaagagagcgatgaaaaacctaaaaaagaggggaggaaattagggaatcggaatgaaattggggagtag

SEQ ID NO: 90738 - DNA, 489 bp, Glycine max
  Peptide Sequence Number=SeqID_182423
cctgggcatttcctatactatactggtagcaggatcggccaccccggccccagcattgctctaattggagctctgagctggagcagtcttgctttggctcccctgaccgacctcaggcctccagatcaagtgccacagcaggaagggggttggcggagccacgacagcgagattggcctccgcggctatatgcgaagatccttcagcaggagggtgtctggtcccttccgccgtagtctcgtgtttgccatgaagagtaccatccaaatggacctacggatgagatctcaaaccgctcttcctggactaactgccagaaaactacctgagaatgaacctggtcatgtccttccctgcattagtttagagcctcagaaggtctcccctaggtcatctctactctggctcaacacttccctgacttacgcgaaagaatcatcctcagaaaacaagcatcccggatggttgagctcaagcgaagcaccctga

SEQ ID NO: 90739 - DNA, 1164 bp, Glycine max
  Peptide Sequence Number=SeqID_182424
tgcttccagctgcggagtggcggcctccaccgcctcgcgcagcaccctcagtttggcctcgtcgccgctgatgtgctggcccagttcagccagcgcctgctgggtttcatcgcgcgccttgtgcaggcgctgcgacagctcgcgctggtgctggatctgctgttccaggcgcgccagcgtgctgccgacctggtagaccgccgcctgcgcggtgttgagcgcatcggcggcctcttcgcggcgtacccgcgaggtctcgatgcgggcctcggcgtcgcgttggtcggcgatcagctgctgcagcttggtctcttcctgcgagaggccttcgcgcagcttcgacaggcgtccgtcgagaccacggaattccagcgccttccactcggcatccttgacccggcgctcttcctgcagcgcctggtactgctcggcctgcttggcttggcgcttcaggtgttcgagctgcttgctgatctcgtcgcgcagatcacccagacggtccaggttttcgcgggtgtggcggatgcgggtctcggtctccttgcggcgctccttgtatttggagatgccggccgcctcttccaggtagacgcgcaggtcttccgggcgtgcctcgatgatctggctgatcatgccctgctcgatgatcgagtagctgcgcgggcccaggccggtgccgaggaacagatcggtgatgtcgcggcggcggcacttggtgccgttgaggtagtagttgctggtaccgtcgcggctgaccgtgcgcttgaccgagatttcgttgaacgcggcgtactcgcccgagatcgtgtggtcggagttgtcgaagatcagctcgaccgtggcctgcgagaccggcttgcgggcgttggaaccggaaaagatcacgtcggtcagcgagtcgccgcgcaggcggctggccgaactctcgcccatgacccagcgcacggcgtcgatgatgttcgacttgccgcagccattgggccccaccacgccggtcatgttggtcggcaggtgcagggtggtcggatcgacgaacgacttgaagccggacagcttgatcgtggaaagacgcataggggttccggactggggccggcaagcggcctgcgtttaccctccaagccattgatcctgttgggatcgatgcccgtggaacgggtgtga

SEQ ID NO: 90740 - DNA, 297 bp, Glycine max
  Peptide Sequence Number=SeqID_182425
atggccgtagaggaattgaatgaaaagcagctagaatcacctgttgaagaagtcgttactaatgttgatggtttttcaggcggaccccatgacacatcagttctcaaagattttgaaaatcacattgatttgagagaacatcctgagctgaagctatcttcccatggaaggcagatggctaagttcgggaggcttgcttcagagattgaaggccttgtggcagccagtggactaagtcctttgatcgcctattccctggatacaggtgtagaagcaaagcttcaagaattattttga

SEQ ID NO: 90741 - DNA, 237 bp, Glycine max
  Peptide Sequence Number=SeqID_182426
atgcatttggctgtggcaccactcgttagagcctctatcgtggtcgtgtcgacgtactacatgcaccacaagacacccgcgcaactgttggtgttcatgcacatggtcgagagggaggctgacggcggcaacggtgatcccaacgtcaaatcgcctacgacgtatttaaagaagctcttcgtaagttctggaatctacactgcccttaacctctacactccaaacttcgaaccctaa

SEQ ID NO: 90742 - DNA, 2169 bp, Glycine max
  Peptide Sequence Number=SeqID_182427
atggagtttggaagtggttctcctggtgatcaccatcatcaccatgatggttcttctgattcccagagaaggaagaagcgttaccaccgtcacacagctaaccagattcagaggcttgaatctatgttcaaggagtgtccgcacccagatgagaagcagaggttgcagttgagtagggagttaggcttggcgcctagacagatcaaattttggttccagaacaggaggacccagatgaaggctcagcatgagagagctgataattgtgcactccgggcagagaatgacaagatacgttgtgagaacatagccataagggaagccttgaaaaatgttatctgcccctcttgtggtggtcctcctatgaatgatgattgttattttgatgaacagaagttgagattggagaatgcccaactcaaagaggagcttgatagagtatctagcattgcagctaagtacattggaaggccaatttctcaactcccacctgttcagcctattcacatatcttctctggacctgtcaatggggacttttgcaagccaagggttgggtggcccttcacttgatcttgatcttctccctgggagttcttcatcacccatgctgaatgtgcctcctttccaaccagcatgtctctcggacatggataagtccctcatgtcagacattgcctcaaatgccatggaggaaatgatcaggctattgcaaacgaatgagcccttgtggatgaaaggtgctgatgggagggatgtccttgatcttgattcctatgagagaatgttccccaaggctaatagtcacttgaagaaccccaatgttcatgttgaagcttctagagattcaggagttgtaattatgaacggcttaactttggttgacatgtttatggacccgaacaagtggatggagctatttcccaccattgtcacaatggctagaacaattgaggttatatcttctggaatgatgggtagccatagtggttctttgcaattgatgtatgaagagttgcaagtactttctccacttgtttctactagagagttctactttctgcgttactgtcagcaaattgaacaaggcttatgggcaatagtagatgtttcatatgatttccctcaagataatcaatttgctcctcaatatcgatcccatcgtcttccttctggtgtctttatccaagatatgcctaatggatattccaaggttacttggattgaacatgtagagattgaagacaaaactccagttcataggctctatagaaaccttatttatagtggcattgcatttggagcacaaagatggctaactacacttcagaggatgtgtgaaaggattgcttgtctaatggtgacaggcaattcaacccgtgatcttggaggagtgattccctctcctgagggcaagaggagcatgatgaaacttgcacaaagaatggtcaccaatttttgtgcaagcattagtgcatcagctggtcatagatggaccacactctctgggagtggcatgaatgagattggagtcagagtcactgtgcataagagctcagaccctggccaacctaatggtgtggtgctaagtgcagccaccaccatttggctccccatccctccacaaactgtgttcaatttctttaaggatgaaaagaaaaggcctcagtgggatgttctttccaatggcaatgctgtgcaagaggttgctcatatagcaaatggtccacaccctggtaactgcatatctgtgcttcgagcattcaactcaagtcaaaacaacatgctgatcctccaggagagctgtgtggactcctcaggttccctagtggtgtactgtccagttgatctgccagccatcaacatagcaatgagtggtgaggacccttcctacatccccctcctcccctcaggcttcaccatttccccggacggccaagctgaccaagacggcggaggagcctcgaccagcacaagcacaggcagcagggtcatggggggtggttctggtcctggttctggtggctcactcatcactgttgcattccaaatcctagtgagtagcttgccatctgccaaactcaacatggagtcggtgaccactgttaatagcctcatcggcaacactgtccaacacattaaggctgctttgaattgtcctagttcctga

SEQ ID NO: 90743 - DNA, 204 bp, Glycine max
  Peptide Sequence Number=SeqID_182428
gaagaagaaatgcttgtaatggagatgggtgagagtgcattattgacaactgcctttgggaagaacaaaacaactaagtctcaagctaatcaaaaggggaatggtaaagtaccacctcaagctgatattaagaaggtgacgaagtgtttcttttgcaagaagaagagacacatgaagaagaattgccccagattccagaaatga

SEQ ID NO: 90744 - DNA, 1563 bp, Glycine max
  Peptide Sequence Number=SeqID_182429
atgcatggagttagggtatactatactgatgttaacaagaatgatctgtttctcagattcctaaatcaaggtttgttgaccattgtttctcagattcataaagatgagcaaatcatgattaggaccagaggattaggtcgtgccttaggtcagcgtcgacgacgtactgcatccacacggaggcagcgagtcactgtgactgcggatcacgtcgatgagccagtcatccctgacccagatattcaggatgacccgatggaggcaccagctgctgtggaggacattcctgcggacgcgggcgcagaggcggctaaggatcagcatcagggatttccgggtggtccgagcgactcatccgtgttgacagcgtatgcggatcacgttgcttgcagtgagcgtcctgaattaaagctatcctctcatgggaggaaggtccacagtttaggcaggcttgtccctgccattgagggacttattgctggtacaggactaagttctctgatcgcgtgttcggtaaacaccggcgatcggggacttttgtccgcgtttgtggagtggtggcaccgggaaacgtctagtttccatctcccggtgggagatctcaccatcacattggacgacatctcctctcttctccatcttctcgttattggcgacttatacgcatttcagcccttgcacgtggacgatgcggttcagatgctggtggacttgttggtggtctctccagagtctgctagggctgagacagtccagtgtcgcgaaccgtacgtacgcctgcaatgggtacatgatatatatcagcgccgatgccaggcaggtcattggacagctgcggcttgcgcatatcttcgtcacctactgggttgcactctgtttgctaacaagagtgcaaccaatgtccatgttgtctacttggaggcccttcgtgacctcagtatgacagagaggtacgcctggggagtggctcctttggttcatatgtacgaccagctgaacgatgtggattgcgacgaagaagaccgtgaagagaattcgcacgccgtcgtacagggagcgcctggatcgactccggattctggatgtctgttggatcccttatggggagcatcgggagagagggtcgtgcggcagtttggctacacgcagaccattcctgctcctcctatcgattcatgggtctcgtatgatgatatacacgataggtggatgcactacgaggatcatatcgtaccagcaggtgaggtgtgcgttgtgccaggggcgtgttccagtgactacatcgattggttcttctgcatctcccatcctttcatgacatcaggccacgcattagatcctctgcctcatggtcacgccccgcagccccgagtcgtccctgaggccccgcagacggatatccctcgcgtgccggagccaggagcatcgtcgacatctacggaggagcccagacattcagtgaaagtttgtgatgacattactgagaggttggagcgtcatctgagtccaggggtggtcacgcctggctcatcgacacatgaggtgatcgaagaatgcctctga

SEQ ID NO: 90745 - DNA, 258 bp, Glycine max
  Peptide Sequence Number=SeqID_182430
atggagggggaggcgaagggttgcgggtgctggaagggggaaggaaggttgctggtgtcggaagggagggggaaggccaccggtgccgggagggaagggggagaagggaggtcttgtgagggggagaaggaaggggaaaagtcttcgacaaaaaagaagcctagagtagcctttgcaatggaagaagatacacacatcattagttcatggctcgacagcttaaccgatcaaattgttggtgttggtcaaagaaaataa

SEQ ID NO: 90746 - DNA, 909 bp, Glycine max
  Peptide Sequence Number=SeqID_182431
atgcatagatctcccacaggaaatttagttcctctggacttagaaattgaagctacgttgagaaggaacagggccaagaggagaaggaaacttctgcaagacagaacaattgcatccattcttgaggaacaaactcatttttctgattcattatcacctggttcaccatcatcaagggaatccgctactcaattgcctgaaaccactatcatggcaaacgagcaacaccagaggatcacccttgaggattattcaagcagctcagtaccgcaattctttactagcattgcacatcctaaagtgcaagctcacaacatcaactacccgcattgtttaattcatttaatacaaaggaatttattccaaggattatctaatgaagacccctatgcacatttggcaatgttacaggttgttccatttgtggtaaggctcatgaaacaggccaatgtattcccattgaagaaaacactcaagaaattcattatatgggaaatcaacagcgacaagggtatactcaaggaggcttttcaggcttctaggccaatccaacaagggccttacatctttcagaggactactaagttagaggagactttgactcagtttatgcacgtaacgatgtcaaatcataaaagcactgagtcaacactgaagaaccttgaggtccaagtgggacaactggccaagcagatagctgacaagtcatccaacagttttgtggcaaatatagagaagaatcctaaggaggaatgcaaagctgtgatgacaaggagtaagaggtttgtggaggctgaggacgaggagactgttgtgcacaagaagaaagctgctgaaaagaaaggtactgatggcaagaaaaatgatgtgagaggtgaaagcaatcaggaaaaagagaaacaaataatg

SEQ ID NO: 90747 - DNA, 552 bp, Glycine max
  Peptide Sequence Number=SeqID_182432
atgtcctcatcttcagaggactacatgtcctcacctttagagggctacacgccctcggctccgaggactatacgtcctcatcttcagaggactacatattctcaccttcagagggctacacgccctcgccatcagaggaccacacgtcctcaccttaagagggctacacgccctcgccatcagaggactgcatgtcctcaccttcagagggctgcacgccctcgccatcagaggactgcatgtcctcaccttcagagggctacgcgccctcgccttcagggctacacgccctcggctccgaggactatacgtcctcatcttcagaggactacatgtcctcaccttcagagggctacgcgccctcgccttcatagggctacacgccctcaccttccgaggactacatgtcctcaccttcagagggctacgcgccctcgccttcgtagggctacacgccctcaccttccgaggactacatgtcctcaccttcagagggctacgcgccctcgccttcgtagggctacacgccctcaccttccgaggactacatga

SEQ ID NO: 90748 - DNA, 285 bp, Glycine max
  Peptide Sequence Number=SeqID_182433
atgctactgtggtgtctcgccctgcgcccgtctgggggcgcagtacttcttgatgaaagctcgattagtagggggcctgatgcccttgctggaggtgacagagtggttatgttggtgcgcatgatccacactcgtctctttgcaacggcccgggtgaaatcttgccccggtatgcatagtagctgcgtgatagcctccctctctggttgtgctcgcacagttggccctcctccaatatcagggggtggcccaggaaccgttaaaaggaaactactggtcccttaa

SEQ ID NO: 90749 - DNA, 288 bp, Glycine max
  Peptide Sequence Number=SeqID_182434
atgacattaacctataaaaataggcgtatcacgaggccctttcgtctcgcgcgtttcggtgatgacggtgaaacctctgacacatgcagctcccggagacgtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 90750 - DNA, 651 bp, Glycine max
  Peptide Sequence Number=SeqID_182435
atggttttaaaagaagagttagccgtttgctcaaggtccaaaaggaacttgtctcagcatttatgcgagacagagaccaacatgttagctatcatcaccaagtaccaagaagaactaagtctagccacgacacacgagcatagggtggcggacgagtttgcccaagtgtacgcggaaaaggaggctagaggaagggtgattgactcgttacaccaagcggcaaccatgtggatggaccgatttgctcttaccttgaatgggagccaagaacttccccgattgctagccaaggccaaagcaatggcggacacctactccgcccccgaggagatccacgaacttctcgactattggaaaaacaccataactaaacgcgccccaaggcatccctatcgcaccagatccaaatctagaacgatgggtgatcaagaggagacacgggaacagatgaaagccaacatgtcggctctgaaagaacaaatggcttccatgatggaggccatgttaggaatgaggcaactcatggagaaaaacgtggcaaccgctgctactgttagttcggctgccgaagcagacccaactcacctagctaccgcacaccatcctcccccaaatgcggtagtgttagtgcttagctttactgagctttaa

SEQ ID NO: 90751 - DNA, 1106 bp, Glycine max
  Peptide Sequence Number=SeqID_182436
atctcatcgaagaaaataatcgtcatgctatttttgatgacggcacgccgctcttaaacgatgaaaaagtctttttcgccgaacgttatggcggcggggctatttcgcgcaacggcggtggcgcacgctgtggctttgatgggcgatggcaggttaaaggcatcggagccaatgcgttagtcggtcaaggggcaaagcatgtcgatggcgagttgacaatgaccggcgcagtattggaggcattgtggggaaacgtcatggccaaactgctgccttacggcgccgtgcccaataaggcgatcttgctgaccgacaaccccatcgccaccctctctcctgcatcggcgggagatgtccataaccgcaaggcgttgctggtgcgcgaacccgtcgtgcgccctgcacatttttgccgcgcgccctactatcatcctcatgatgcgatgcaaaggcagccttcggatattgagcggaccgaaaagctcattgtcgccgcaccgtcctttctgcctcgtccctctgagtttgacgctgtgcgctggttggcattgccgcaggaagaacgagcattctacgggctctgcgagcttgcccggcgccttgcgacgcagatagcttactgccgtacccgccatttggtgatgatgacctcaccctccaattgcgatatggccggcaggctgctggactttcatggtgttcgcagcgtttttcccgcagaacgtcgagatcccggccgcagctacattcagcacaacaaactcaacgaagacgcccctttgttgctgagaggcatgcaagatctcgctttttatttagccaagcatcaatttggcccggcatttctcgcggcagcgcaccaaggcatcggcgcggcctttagtatggcctacaagcgagcctgcctgctggataatctcggtatggcgggttttgcccctgcatttttacaacgcctgcctctcaccgccgaatggttcgccttaggcgaacgcttgcaaaaaatgttcgatttggctcccggcgtctttagccgtcgacaaggtctgggccaggggaatgctcatccggcgattgccctgttgcatcggctcatcgactcgccc

SEQ ID NO: 90752 - DNA, 807 bp, Glycine max
  Peptide Sequence Number=SeqID_182437
gaaatcgtcgtaggcgcgttggatcgccggctcgtagcaggtgtgcagccactcggcgcgcagtcggcgctgctcttcgctccaggtcgggcagaaggcgcgcatctgctcggcgctcatgcccggcagcgactgccggatcgagtcggcgtaccacggccattggccgggataggcgcggcggccggggccggaaaccggcggatcgaccagcaccagccgccgcacgccggcgggctgcaaaacggtggcgcgcagggcgaagcgggcgcccatcgaatggccgagcagggcgtaactgtccaggctcagcgcggcggcgaaggcgttgacgtcctgcgcgcaggtctccgcgtcataagccagttccgggccgctggacgacagaccgcggccgcgcacgtcgagcacgtagacgtcgtattttttccccagccgctcggcgacgaaaccccaggatcagcgccgggccgtggccgccgtagcgcagcgcttgcgcgtacaggtcatagccgtagacccaggccggatcttcctgggtgcgcaggaaggtgttggcgttggacaccgcctgcaccctggatgcgcgttccttgcggttggcttcatacagctggaaggcggtgcggtagtcgccgaggccggtttcctgcaggcagcgggtcagcatggcggcgtcttcgatcgccatcgccgcgccctgcgccatatgcggcttcatcgggtggcaggcatcgccgagcagcaccaggcggccctcgctccacagcggcagcggtttgcggttcagcaatggccatttggtga

SEQ ID NO: 90753 - DNA, 801 bp, Glycine max
  Peptide Sequence Number=SeqID_182438
gagtgcgaatacggccagaggaggaaccaggccgatggatttgatgaggaggccatcgctcagctgctatgcataccaggtcaagattttgcctggaccgctgccgggagacgggtgctaatcatgcgcaccaacatgactaccttgacccagacatggatgacgttgctgctcagcaacatcctacccagcgatcataattccgacctccctctgccgaagtgtcagctggtgtatgccatcctgacacggatgaacattcatgtggctcaactgatcgctgatgccatttatttatttgtaggtatgccacctaccaggtaccttctagacccagataagtctaatagggccctgggtttttcgacattgatcacgggtctctgccagtcgttcagggttcctgtcacacctagtaaggtgattcgactgccgatcacccgggctttcatagagaagtattacacgcccagacaggcgcagggtggcgacccgcaggccccagatgcaccgccgccacctcctcaggctaacccagctgggcggccaaccacagggcgcacgttgcagacccatgactgcctctaccagctcaaccttagcctgcagagccaaggtttccctccttttccatgccctactccagatcagttcagggcagaggtcgcatggcccggggattggcctgaggcccaggcaggggaggcacctgcagaggctcccggcgatgcagatgaggcccgcatggacgaggagatgaccgatttgctcgatttcttgggagggagcaaagccacatga

SEQ ID NO: 90754 - DNA, 285 bp, Glycine max
  Peptide Sequence Number=SeqID_182439
atggacttcaaacctatgttggtgaaaggtttgatgctttggaacaacaagtggacatgcgatttgacaagatggactcaaggatcaccaaggattgtcatcatcaaaaaaggggagattgtagaagcaagcttcatgatgatgaatcaaaggattcaagattcaagaaaagttgatttcaagattcaagaaaagacatcaagaagaatcaagattcaagagaaaatgaattcaagagaagaaatcaagaagcaacaagtcaagacttcacatgggaagtattga

SEQ ID NO: 90755 - DNA, 210 bp, Glycine max
  Peptide Sequence Number=SeqID_182440
atggaccaattaaagcgcctaagcatcccctcagaaatgcttagattctctaaccacgcttgtcacccacgtctgggccatccgacaaggtcagtgcacttcgcccctcacaaacatacacaacatccaatgtatgaacgtggcccaaagcaagagccaaagaccgtggaaggtatgactaccttccgagcttgtgcttgttttatttaa

SEQ ID NO: 90756 - DNA, 978 bp, Glycine max
  Peptide Sequence Number=SeqID_182441
atggggatgaggggttacatcagctacaatcccgttcttgctataagacaacttggctatcctatgagaggagcaccattagaggaagagatcgtgcctgtcatttcacgaggtttcaataagaccaatgtggagacacttcagaaggttcgcaagccatgggaggtattgcaaaagaaggacaaggaactcagaggcagtaacaatgggcccatcggtggctatcgtgagtggttgaaagcccacgtgcaaggtttggattggctcccaagtctgagaaccactaaaagggaggaagataaggcaccggaggaagatgaagaagtgcaggcccttaggacagaactcaagcaagctaagacagtcaaagaaaggttcaaatcagcagctcttaaaattcgaaaggagaatgccgaactgagagatgtaaatatggctaccaccaaggcattggaacaagagaccaaaagggcccatagggaagaacatggccggaacaagttccgaggggctctgtgggacagtaacagcgagcttaaactccaaagagaagaaagggaccaatcacgagtagacagtttgatcttgaaagatgaattgaaggcttgctcgaggtccaagagaagtttgtctcagtggttgtgcgagacagagaccaacatgttaactatcatcaccaagtatcaagaagaactaagcctagccacagcccacgagcatagggtggcggatgattatgcccaggtgtacgcagaaaaggaggctagaggacgggtgatcgactcgttagaccaagaggcaaccatgtggatggaccgatttgcttttaccttgaacaggagtcaagaacttccccgattgctagccaaggccaaagcaatggcggacatctacttcgcctccgaggaaatccatggacttctcagctattgtcagcatatgatagacttaatggcccatataattaggaaccgctag

SEQ ID NO: 90757 - DNA, 141 bp, Glycine max
  Peptide Sequence Number=SeqID_182442
atgaagcatagctccaaactcgaaggtggaggacacatgaacagcgctaggcatgacattcatggggctccgaaaaagcaatcacgaagcatagcttccaaactcgagggtggaggacacatgaacagcgctaggcaatga

SEQ ID NO: 90758 - DNA, 300 bp, Glycine max
  Peptide Sequence Number=SeqID_182443
atggcattagaagaggggaagatagaggattatctgtatcagaagaagctgtatcaacccttatcaggggttaagccagacgacatgaagcaagaagaatggaacttgctagatcgacagactcttggcgtgattagatttacattagccaagaacgttgcgttcaacatcgtaaacgagaagactactgcaagcttaatgaagacgttatcagatatgtacgagaagccgtcagcaaccaacaaagtatacttgatgcgtcgattgttctgttggatcaagtggcctcggaataattaa

SEQ ID NO: 90759 - DNA, 300 bp, Glycine max
  Peptide Sequence Number=SeqID_182444
atgtcaatctccccctgcagatgtatcggtcctagggtctgttccggcagggatcgcgcctacaagacatccagtggacccgaagcagttcagcagggtcttagagttttctacggagtgcctgtcacctccagcaagggcatcaggccccctactaatcgagatttcatcaagaagtactgcgtccctaggcaggcacagggcgaaataccaccgcagcctggggatggccggcagcgggcaaccgacgcaccgccatcacctctagggttcacctcagctcatccacaaaaaggttag

SEQ ID NO: 90760 - DNA, 558 bp, Glycine max
  Peptide Sequence Number=SeqID_182445
atggagcatacatcagaaggtgcgagaagagtagtgcatggatcatcagctgcttacccgctctttgtgtatggaagcagaacaatcaactggtttcctcgatggaaggaaggaaataagggagttctcttctcatgtggggactacccaaacatctcgttgatagggatgaggggttgtattaactacaatctcgcacttgctataagacagttagggtaccccatgaggggagcaccagcggaagagagcctctctcctttccttgtgagagatttcggcgcgcaaagtttcaagattatacaaagagtccacaaggcatgggaaagcccgttaaggaaaggtaaagaacttatgggcatccgtaatggcatcatcggtggttatcatgaatggctgaaagtttgtacacgagggttagattggctctccaagttgaaaattatcaacgaggagaacttcgaagctccggaagaggatgaagaagtccgagctctaaaaacagaactaggaaaagcaagacttgccaaagaaaaattcaagttagtcgctacagag

SEQ ID NO: 90761 - DNA, 228 bp, Glycine max
  Peptide Sequence Number=SeqID_182446
atgaagtttgggtacctaagtcacaaacttgatcatgtaggtatctttgaagaagaaagcggatgttcaaaacatatgacaggagatgcatcgaagttcacacatatctctcccaagaaaaacgggcatgtaacttatggtgacaacaacaaaggtagaatccttggagttggtaaaatagcaaagatgatgatccatggttatggcataaaagaattgctcacataa

SEQ ID NO: 90762 - DNA, 300 bp, Glycine max
  Peptide Sequence Number=SeqID_182447
atgaagaacaccgaagaacggtcgaaaaccttcgcgaaatcactcacggaaacgttacggaaacgttacggaagcgcctcggcttggatcttcttcacggaaacaatttttctaagcaaattcgaaagagagagaaaaaattgggggagaagcttgccacccagctcgcccaggcgagcagggttgcttcctccagaagcaacagccttctggaggaatcttctagagggcccaagtgggcttgatttctatttgcacccccattttttactaagtacaccccctgccttttttttgtga

SEQ ID NO: 90763 - DNA, 518 bp, Glycine max
  Peptide Sequence Number=SeqID_182448
atgacgggagtgtcattagttggttcccacggtggaaagaaggaggggcaagagtgttatgctcataaaatccataaagcatggaatagagtgggaagaaaagataaggagcttaggggaagtagcaatggcgtcatcggcagctatcacaagtggtttaagtctaaaacgcgagggataacttggctcccaaagcaaaaaagtctaagtgggaaagaggttgaagttcttgaggaaagtgaagaagtgcatgctttgaaggtagaactcgaaaagacaagagtggtgaaagagaagttgaagacgacaatcactagggtcaagaaagagtgtgatgagatgaaagatgtcaacatgaccacgactgaagcgttagagcgggaaacaaaaagggcccaaaaggaagaatggagcaggaacaagtttcgaagggctctgtggggtagcagtaacgagctcaagcttagaaaggctgagagggacaaatcaaggatcgaaagcatggtgttagaggacaa

SEQ ID NO: 90764 - DNA, 1305 bp, Glycine max
  Peptide Sequence Number=SeqID_182449
atgaagctcttgacttcatcatcatcatcttattcatcaaccccatcatcttcatcctccctcagtttggacccatctttgtgcaactccaaaagtgtcactgcagggtgtctcacagccatcttgagaaggattctctgctctggaggccttccaacacacccatcagaccaaatcagagaacttgattcaatgtcaaagatgagtggcaaagttcaagaattgaagactaaacaaaacactgaatctaccaccaccgtcactttttctactactactactactactattactcgtgggatagtagaaaggttaatgggtttggaatcaatggtagagagagatacaaatacaaccaatgaagcaacatcaagttcttcacttccacgtagcaaatccatgaactctatggactacttgggggaatacaagcgaatggagggtctccataagcgtgctaagtcttcatcattccgtgaggttccaactttccacttgcatgaaaatgagaacttcttggtactcagcttcgaaagtggatgtgatggtggagaattcaggtcccaaaaagggataaaaaaagaaaaggcttcaaaagagagaagtgagttgaagaaaaacaagagagaaaaggtgcatgatgagaaggagaaggggaacttgtctgacatgtcttctgccaatgttggtaaacatggacttgaatttgccaacacttcagcactgttcatggcttgttctgaaaaggagtacgttggttctgaaactgagagattctcacaccccgtgaagcgcaaggaagtaaccaatgatgagaaagtgaagaggaaaaagaagggaacaacatgttatgctgaagagaaggtggacactgaatgcagctcagaagattcaagcccagtttctatctttgattttgagcgtcaagctcctggaacagaggtggattcttttggtgttgacacgagttggagaagaaaattgtcaccagagcttgaaaatgagcagcttgataacttgatgattgaggagatgaaggttaatacaattgaggacaacaaacatgaagggtcaaagaaaaatgagaagcaaagccaggagtgtgtagatatttggggagaaatttgtaggctagttgaaggtgaattgggatcaaataagttagaggaagggttgtggaaacaagacgatattgaaagtgtgtgtgcaggttttgaatcgcaaattttttatcatttgttatatgagcttatagatcaacttgttgggaatcccttgaaagcattgcaacttcaaaatttgtaa

SEQ ID NO: 90765 - DNA, 726 bp, Glycine max
  Peptide Sequence Number=SeqID_182450
atgttgtggaagcttgggaggattgatggggacccggtgttgagaaaaatgaggatatgggctacgtgggagtacgtgagctcagttggagagtggtacctgaagatatgtcacgggggtcaggagaccttggggacgtcaggtggggtgctattgcccaaaaccaagcttgaccaatcccgacccaacccgggcatagtcggtcagcttgaaaacgaggtcaggaagctaggggagcttttggtaatcgattaccaggcttcaaaagggaactggaacactgtggaggcctctggtaatcgattaccagactgtgtaatcgattacacagaggaatgggtcactggtaatcgattaccagatgaacttgcacggacgcttcagcgcactgtggagtggatactacccacgcctacaccatatcgtctagtggagcccgtccaagtgatcgaggtgacgtcatccgaggaagaccctgaggaggatcccaaggagctacctcctgagcctgccgcggatgctcttgactttctagagggtgatgaggatccacttcttgaggtggattctcccgaggaagtcatgtcggcatctaaggcagactctacggaggatagtggcctgggggagatggcgatcagcggaggctctttatcccagtggacagctctttggattagttttgtatacttttttagggtgggtgtatctaggactgactgttag

SEQ ID NO: 90766 - DNA, 3561 bp, Glycine max
  Peptide Sequence Number=SeqID_182451
atgccgacgccggtcagtgtagtgaggcaatgcttaaccgacgaggccgcgcgtgcactcgacgacgcagtcgccgtcgcgcgccgacgcagccacgctcagacgacgtcgctccacgccatctccgcgctcctggctctcccctcctccgccctgcgcgacgcgtgcggccgcgcgcgctccggcgccggcgccggcaccagcgccgcccgattctccgccgcatactccccgcgcctccagttccgcgccctggagctctccgtcggcgtgtccctcgaccggctcccttcgtcgaagtccacctccgccggcgaggaggagccgccggtgtcgaactctctcatggcggcgataaaacgctctcaggcgaaccagcggcggcacccggagagcttccacatgttccagcaaagccaacagggaacagcatcgacgtcgtttttgaaagtcgaactaaagcacttcgttttgtcgatcctcgatgaccctatcgtgagtcgcgtcttcgctgaagcagggtttcggagctgcgatataaaactcgccttgctccaaccgcctctgcctccggttcagcaccggttcaactggtcacctccggttttcctctgcaacctcgacccggcccagcccgacgaaaatattcgcaggatcatggaagttctcgcgagaaaaaacaagagaaaccctttacttatgggcgtttatgcaaagagtgctctaaagggtttcgttgagatggttcggaatggaaggggaggttcggcattaggttcggagttgagggtggttcgtttggagagggagattggggagtttgtgaaaaagggtgggagtggggaagagaaatttggtgttaggttgaaggaattggaacagcaatgtgagggttctggttctggggttgttgttagtttcggggagattgaggtttttgtaggggaagatgttgatgttgatgttgtaaggttcgttgtttcgggtttaacgaggttgttggagattcgtggtgagaaggtttcgttgctgggcgtggcggaaacttctcatgcttattccaagttcttgggattgtttcccaatgtagaaaatgattgggatcttcatttgctcactgtcacttctgccactccttccatggaaggactctactcaaaatccagggaaaatggggatgtgtactattcaggttcttgcacgttgattcgtgtaaataataatataaatgttacggagtttcgtgaagagcaatgcaaaattgtggcatggggttcacaagcgtggtggaggccatgcacaaataaatggtgggagtgtagatttgagtttaataaatgtatggacggccgcgatgagcagtattttgatgaatggtttgattccatttctgcattgcaggggctcttttcactcagcttgatggggtcctttgttccatttggagggttcttttctacacctgaaatcagaagtccggtaagctgtgcaaacgggtcttttacacgttgtgacacatgcaataaaaaatgtgaacaagaagttgcagatcttctgaaggtagatccttcatctagttattcaacaagctcacactggttacaaaaggttgttaacatggacgcgcatagagggtcggacgtggcaaagaaagagctccatcatccagtgcagactaatgaagaaaacacaagtttgaatgataaaatcttgggatttcaaaagaaatggagtgatatttgtcagcgtcttcatcacacaagttcactacctcaatttgatatttctcaaacaaggtcccaagctccaacagttgaggttttacggtttggtctggcttttaaggaaagcagcaataaagacccatcacacagtgaattccaatattctagtcaaatttcctgcatgcccaaagagttgcatagtatttttccttcgaagcagttatctgttccattaccttctgatacagtctgcattaatactggaaccgatcatgttccaaaagtttcagagacactgcaaattcacatgaacaccccttgggttgccccttcccttatggccaataagagtgcacttgaccacagatcatcttcattccgtactcctgtgaccacagatttaggattgggaacgttatatacatcaactgctcaggatccagataccccaaaactacaagatcaaagaaagcatcttcagcacctgtcagattctgtttcaactgattgtgatggtatgaatgaaaatacttctcaccgaattgctagattttcctgctctggttcaaatttggaaggtaaatttgatttagcagatttcaagtctcttgatcgacttctcactgaaaaggttggctggcaggatcaagccatatgtgctatcagtcaaactttgtccctttgtaaatctggtgcaggaaagcgtagaggctcaaatggtagagcagacatatggttggctttccttggacccgatagacttggaaaaaggaaaattgcttcagttcttgcagagactatatttggaaaccctgaaagcctaatctctgtggatcttggcttccaggacagcttttacccattgaactcggtttttgaataccaaaaatcacgttgttatgatgtgcttaggaggaagacaattttggattatattgctggggagttgagtaaaaagccacattctgttgtctttcttgaaaatgtagataaagccgatgttttggtgcagaatagtttgttgcaggcagtaagaacaggcaaattttcatattcgcatggaagggtgattagcatcaataacacaatctttcttgtaacctcaactgtctgtaaaggtaatggctcttttgttttggaagagtctaagatgttttctgaggaaagaatccttgaagccaaaagatgccaaatgcaattattacttggacatgcttctgaggatgccggaagaattggtagcacaaatgttaaggttgtacccggaaaagggttttccaaatcatcatctctgaacaaaagaaagcaggctgatattagtgactccaaggagggggcaacaagcaagatgcagaaacaagacagtgaggcatctcgatcctatcttgatctaaatatgcctgtagaggatggtgaagagggtgtcaatgatgaccacgaaagtgaatccataacagaaaacacagatgcctggttaagtgatttctttgatcaaattgatgagaaagtggtgtttaagtcattcaattttgatgagcttgctgaggaagtattaaaaagaattggcatgctatttcaaaggacatttggttcagagcttcagctggaaattgattatgaggtaataacacacatacttgctgctgcttggttatcagacaagaaaaatgcagttgaggattgggttgaacatgttcttggcaaaggctttgttgaagctcagcagaagtaccttcctgcagctcaatatgtagtaaaactggttaattgtgaatccatttttgtggaagagcaagctcctgatgtgtgccttccagctagaattaacacggactaa

SEQ ID NO: 90767 - DNA, 180 bp, Glycine max
  Peptide Sequence Number=SeqID_182452
atggtactcatgacagggaggcgagatgggatagaagatgaatccaggaagaataatggaggggaggggacagactcacaacacaatagggaaggaaagaaggcgttaatggtgttgtggtgcaacatgagggaaggaggcatgagtgaatggaagaataaccccaaagccttcatatga

SEQ ID NO: 90768 - DNA, 198 bp, Glycine max
  Peptide Sequence Number=SeqID_182453
atggtgcagcaagacaaagcaactggaagtacccacttctgcaggaagatgaaagctagaatccatggaaaggaagtgatacaggctatggatatagtggacatggtggttataacaggtatgggttttaaacagagtaatccagtgggaattgttatggatgtcatggaggagtttgttgtttactgtctctggtaa

SEQ ID NO: 90769 - DNA, 1038 bp, Glycine max
  Peptide Sequence Number=SeqID_182454
atgaggtttaatcctacaaatgattgtatggtctattctgcatcctctgatggaaccattagttgtactgacttggagactggaatatcatcttctccaatgaacctgaatcctgatggatggcagctgcttgactacttggatatggccaagggtccaaacacttggaaaatgctcaacggcatggatattaacagtgagaaaggtctcgttcttgttgctgatagctttggttttcttcacatggttgacatgcgctccaacaacaggagtggtgatgcaattttgatccacaaaaaaggaaaagttgttggtatccattgcaatccaattcaaccagatatctttttgacttgtggaaatgatcattttgctcgtatttgggacctgcgtcaaataaaagctggatcatccctttatgatctgaagcataagcgtgttgttaactctgcatatttctctccaatatctggaaccaaaattctcactacatcacaggacaaccgtcttcgtgtatgggattctatctttggtaatatggactctcccagccgagaaattgtacatagtcatgatttcaatcggcatttgacaccctttaaagctgaatgggatccaaaggatccatcagagtcccttgctgttgttggtcgttatataagtgaaaattataatggagctgccctccatcccattgattttatagatacaagtacagggcaattggtagctgaagtgatggacccaaacatcacaaccatcagtcctgtgaataagttgcatccccgagatgatatcctggcaactgggagttctagatctctgttcatttggaagcccaaggagaagtcagagcttgtagaggagaaggatgaacggaaaattgtggtttgtggaaaagctgagaagaaacgtggtaagaaaaatggaaatattagcgatgaatctgacgatgaaggattcatgtccaagtccaagaagtctaagaccaaaaagaccgagtcaaaattgtctcgcttcactaaggataattgctga

SEQ ID NO: 90770 - DNA, 954 bp, Glycine max
  Peptide Sequence Number=SeqID_182455
atgttgtccttaacactacctattcctctgctgaaaaccctaactcctccttctccaaacattaacaacccctctctctctccctattctcattatcaacctcgttcccgttccctaacacggggacttatagtccccaaacacagctccgccactgctcctccgagcgcgacgcttcgggacgacggaacctcactcgctggagattcaccggagccgcttccggaggagttagtggcggagctgatgccaaagcacgtggcggtgattatcgacggacatggtaggtgggccaagttgagagggctgccggcgtccgcggggcaccaagcgggtgtgcagccactgaggacggtggtgaggctgtgttgcagttggggaattcaggttctcacggttttcgtgttatccactgagaactggtttcgccccaaggtggaggttgactccttgatgaagctctttgagacaacaataaactcctcaattgcatgtatgaaaaaggaaggaattcaaatatacgtgattggggattcatcaaaacttcctgagtctctaaggagtactatagctaatgcagaaaagagtacaaaacataactcgagactccaacttattgtggcaatgaattacggtgggaaatacgatgttgttcaagcatgtaaaagtgtagcaaaaaaagtcaaagatggtcttcttcatttggacaacatcaatgaaaaaattattgaaaaagaattggaaactaaatgtactgagtttccttatccagatctactaatacgagctggtggtgagcttagattgagcaacttcttgttgtggcaattggcatacacagaattttattttaataaaacaccgtggccagattttggaaaggaagaatttgtagatgccttaagatcatttcagcaaagacaaagacactatggtggtgaacgacattcataa

SEQ ID NO: 90771 - DNA, 216 bp, Glycine max
  Peptide Sequence Number=SeqID_182456
atgaatagtctcggtgtcgaaagtagcatgatgtacttcttttgcggcttatttgtatttcaactcatgaagctcaagatatgggtaggcattgtcgcgggaggaatgtttagttcttggaatgacactaagaaatctcttattattctggttaatgagggaagaccattacgcgcagagactagtagagataagaaatgcttaacagtaatgtga

SEQ ID NO: 90772 - DNA, 1284 bp, Glycine max
  Peptide Sequence Number=SeqID_182457
atggaggcatttaacaaatttattggggatatggaggcatttaacaaatttattggggatatggaggtggaggacatacctatggtgggaaggaagttcacttggtataggctttacgaatcattgcccaccatgaaaagttctattatgggttgggggcaaagcctttcaatgtgttgcattgctggaaaggttgaaaggttgaaaaatgatttgaagaagtggaacgtggagagctttagagatgttaataagcaaatcaaggaggtagtaaaaaaactaaatgctttagacgtaattgatgaggcggaaggtctagatgaggtggagatgcaaaatagatggtcacttatgggtgagttttggagtgtgtctaggagaaatgaatcgcatcttcaccaaaaatctagggtggacgagagatgggaagacgaaccaataaagattgtgaagaaaaacttcatgagtatgatgaaggaattttgggagaatgctaggatgcctagaggcgcgaattcttcgtttattacatttattcccaagaaagaaaatgcccaaggtttggacgaagatagacctataacacttatctgttgtatttacaaggtcatctccaaggttttggcaaagcgagtgaagcgggggggtcatggttttcaaagtagacttccaaaagacatgactcagtgtcatgagattttcttgttatatgatgcagaggttgaggttggtcctttcaatgaattcatcctccaaagaggtctaggagtaaggagggtcgccacaaaggctttgaggtgttttgaaatggggtcaaggctaaagcatgctaaattgcaagttgacgatcatctcgcggctggggccaatcctagaagagttccaccgtgtgttgttaaaaggattattaagctccaaagaaactttctttggagaggtgaggagaataaaaggaagattgcttgggtcaaatgggaggagtggagacttgctttggatcaaagttctttgtgggcagtagtcctaaaatcaaaatatggaaaattcgggaatgctgaagttcaaaggtcatcaaggaatgattccttatggtggagagatttggttgaggtttgtcgtgtaggtaaaaataaagaatgttatgataagagtgtggcttggaaggagaaatgttcagatagtgagggtgcagtcgagatgcacattctgccaaacggaggaggaggatattacacatttgctattcaacacttagagagagtagagagagaagaggtaaaatga

SEQ ID NO: 90773 - DNA, 1392 bp, Glycine max
  Peptide Sequence Number=SeqID_182458
atgtcggcgttggagtatctctacctctctccgttaacgtacacaaaaatctacctcaattcccacacctggcgcagacgctcgccgctgcggcaaaacgcgtgtcgtttcgttcccaattcggcggtcgttagggttccggggcaatggagggatttttccgggagggtggatttgtggaggctgaggagggtccacggtggcgccgccagggcgagtggtggccaggagggggattccggcgagaagagcggcgagggacagggggtcaccgataagggttcgaccaggtccggttcgaaccggaggagggagaagcaagataaagggtggtggttcggttcgaagagtgggaagtggcggtggcaacccattgttcaagctcaagaggttggagtgttgcttttgcaattagggattgttgtgtttgtgatgaggttgctgaggcctgggattcccttacctggctccgaaccgagggctgcgacgtcgtttgtgagtgtgccttatagcgagttcttgagtaagattaatggggatcaggtgcagaaggtggaggttgatggggtccacatcatgttcaagttgaagtctgacgtggaggcttctgaagtggcttcttctgctgctactccttcggagtcagagtcgttggttaagagtgttgctcctaccaagaagattgtttacactaccactaggcctagtgatataaggactccctatgggaagatgatggaaaatgaggtggagttcgggtccccggataagaggtctggtggattcttcaactctgctttgttatgcccgactgcaatgccgcaaagcaagggacctctgtcattgggttatatagccttgttttattgtgctctgcttgcagggcttctccatcgattccctgttagtttttctcagcatacggctggtcagattaggaatcgtaaatcaggaacttctgctggcacaaagtcatctgatcaaggtgaatcaatcacatttgctgatgtcgctggtgttgacgaggctaaggaggaactagaagagattgtggaatttcttcgcaatccagacagatatataagacttggagctcgtcctccccgaggggttctcttggtgggtcttcctgggacaggtaagactttactggcaaaggctgtggcaggggaagctgatgtgccatttataagttgttctgctagtgagtttgtagagttatatgttggtatgggtgcttcccgtgtgagagatctctttgcaagggctaagaaagaagcaccatccataatatttattgatgagatagatgctgtggctaaaagtcgtgatggtaaatttcgcattgtcagcaatgatgaacgagaacaaaccttgaaccagctgctcact

SEQ ID NO: 90774 - DNA, 195 bp, Glycine max
  Peptide Sequence Number=SeqID_182459
atgaatggtgtgctacaacatggtgatggagaggcactacatgtgacgatgttaggggatgacgaggtggggttttgcacgaggatctggttgtctagggttgtttgcacacgcagagacctctgggtgggggcatacaactgtggagggtgcggtggtggtgttatgcacggatctgatgtgttgggtgtctag

SEQ ID NO: 90775 - DNA, 1459 bp, Glycine max
  Peptide Sequence Number=SeqID_182460
tgctccacacaatggacgttttgagaaggtactggtactgtcttctgattcggccgatatggtggatgggtttcagaagttggcacttgaatcacggttagccataccaatcatttatggggttgatgctattcatggtaatagtagtgtctatggtgctactagatttcctcacaatgttggtcttggagctaccaggaacaatgttgttgcatgtggcaagcattttgttggagatggaggtacagagaaaggtgtaaatgaggtggactgcatagctaagggagtttctacaatcatggtctcatattccaggtggaatggaaacaaactccatggtcaccattttcggcttaatgaagttttgaaagaaaagctgggcttcaagggatttgtgatttctgaatgggaggaaattgatgaatgccaaccttatgggtcagattatcgtcattgcatctccactgccattaatgctggaattgacatggtgatggttccttttagatttgaaatatttattgaagagttgatgtctctagttcaattaggggaaataccaatagcaggaactgatgatgctgttgagcgcattttgagggtgaagtttgctgctgaactttttgagtttcctttaactgacagatctttgctcgatgtagttggtggcaagtctgatcaaactgaattagtttcaacatcatcttggtgtctcaacaataatttgattcagtggcggatccagaaattttacttagtagagctacatagagatctagcacgtaaaacagttcaaaagtccttggttctgttgaaaaatggaaaggatcctagtaaaccctttcttccactgaacaggaatgctaagagagtccttgttgctggaactcatgctcatgatattgggtatcaatgtggaggatggataggtactaagtatgaatctagtggccagatcacaatcggcacaactatcttggatgctgttaaggaagctgtggggaatgaaacagaagttatttatgagcaatgtccatcaacagacatcatagaacgtagcgacgtttcttttgccatcgttgtggtcagagaaggtccctatgccgagtgtggaggtgacaattcagagcttgtaatcccatttaatggagatggaatcataaacttggttgctgataaaatcccaacacttgtgatccttatatctggaagaccttttctctcagaacagtgcctattggaaaagatagatgctcttgttgctgcatggttgccagttactgaagcacagcgaatcacagatgttatatttggagatcatgacttcaaaggtcaactaccaatgacttggttcagaagagttgaacaacttgatcaaccagttggagttagttcatgtgaccccttgttccctcttgattatggactaaaatatggtaaggagaatttacatgactaa

SEQ ID NO: 90776 - DNA, 75 bp, Glycine max
  Peptide Sequence Number=SeqID_182461
atggctttttacagcagttttgatataacaggcgtagaaccaaaactatcaaatgaaaatgatgcaagaaattaa

SEQ ID NO: 90777 - DNA, 2118 bp, Glycine max
  Peptide Sequence Number=SeqID_182462
atgaataacggatctgggcagtttgctttctcaggaaagtcagctactagtgttgatgagttatgcaagatcatttggactgtggaagcagatttagaagatggtcacctactgttcataactggtgatcctgctgtattaggctgctggaaaccaaacatggctgtactattgtctcctacagagcatgcaaacatatggaaagctgaatttcagggaaagtttgggtcctcaagtgatgttctttggaggcctggaccagctttttctctgtcagtacctcttatggtccttgaagacaataaaattgtggtcagggattcatggattaggtctgattcccagatgtcttcagctcatgcatggagccccttcacagaggaaacatatcttctagagcaaccctctatatctttcctgagcaaagatgatggaaggattgagagtccccttgaaaatgacgtcctaaagttcgagacactcctcttggaagatcaattactctacaacaatgatgacatggtgattgcgaatgacaaggatttccagtctactaatgttctttctgagaattaccagcctgttgaggaaccctggctatattcattctgttccgttgtctctaacaataaaatggaatcaaatgtttctgaaactggtgacactgcaaaagagaaggtgaagctggcagatagagaacagttgttacttgaagaaatactggaggatgaaaaattggttgaattattgttggaaccagtcaagagtaatgtgcaatgtgatagtgtatatgttggggtggtcacaaagcttgttcctcatatgggtggggcttttgtaagtattgggaattctagatctgcttttatggatattaagcaaaataaggagccatttatattccctccatttcgtcaaaggacaaagaaacaagaaatcgatctcgagggaaaaaatgatcacacgtctcatgttattgatgtatctgatggaacatcagacataaattctgaggatggttgtttaaaatctgtacacaatgactatgatgagcatgaaggagatgatgatttttatatttcagaagttcttaaggagaatgtgaatggtagcatggttgatgatgaagtggaagctgactttgaggatgatatagagggaagtgatgtccatatagaaggagaaacaaataacagttctcttcttcttggcatgaatgggtctgtcacctctcatattttgcaaacaaaagatacaaagaaagcaacccatgtgacttctggagaaaataaatggatccaagttcgcaagggaaccaaagtaattgtccaagttgtcaaagaggaccttggtacaaagggtcccactctgactgcttatcctaaactaaagagtagattctgggttctgattgcatgttgtgataaaattggagtctctaaaaagatttccggtgttgagcgcacgaggttgaaagttatagcgaagacattgcagcctgagggttttggcctaactgtaagaactgttgctgctggtcattcttttgaggaactgcagaaagacttggaaggcttgctttcaacatggaaaaatataatggaacatgcaaagtctgctgctcttgctgctgatgaaggggtggaaggagctgttcctgtaattttgcacagggcaatgggtcagactctctcagtggtccaggattatttcaatgaaaatgttaagaaaatggtggtcgactccccaaggacatttcatgaggtgaccaattaccttcaagaaattgcccctgatctttgtgatcgagttgaactatatgataaaaaagttcccttgttcgatgaattcaacattgaaggagagatagacaatatcctcagcaaaagggttccacttgctaatggaggttctttaatcattgaacaaactgaggcactagtttctattgatgtaaatggagggcacgggatgcttggtcatggaaattcccaacagcaagctattctagatgtcaatcttgccgctgcaaaacaaattgcaagggagttgcgactacgggatattggaggcatcattgtggtagatttcattgatatgacagatgagggtaagtag

SEQ ID NO: 90778 - DNA, 1878 bp, Glycine max
  Peptide Sequence Number=SeqID_182463
atggcagcgctgtcctccgccgtcactcttgccgccaaaccgctctcactaccccaaaatcaccgcgccagagtagcggcggcgttgcactctcccaagcgccacctcaagagaacggaattcaagttcttcgccaatggctcatccgcctctctccgctcccttccccgcctctacgtttcctccaacgacgcccgcttcaattccggtcccgaggagagccagcaacaacagtcgtcgagttttgcagagttcatcacttccgagagagtcaaagtggtggccatgctggctctcgctctcgctctctgcaacgccgatcgcgtcgtcatgtcggtggccatcgtgccgctgtccctcgccaacgggtggagccgagccttcgccggaatcgtccagtcatcgtttctgtgggggtatctggtttcccctatagctggaggggtgttggtggatcactatggtggcaaagtggtcatggcttggggagtggccttgtggtcacttgctacttttcttaccccttgggcttctcagacctctctcttagctctacttaccgtccgtgctttgcttggtgttgctgaaggagttgctcttccttccatgaataacatggtcgtcagatggtttccacaaactgaacgatcaagagctgtaggaatctcaatggctggatttatgcttggatgtgcaatagggctcacactttctcccattctcatgtcacaaggtggtatatttggtccctttgtgatttttggattgtctgggtttctttgggtgttggtgtggttgtctgcaacatcaagcactcctgaccagagtcctcagatatcaaaatatgagctggagtatatattgaatagaaggcaaaagtctttttcagtggagacagctaagcccaagaaagttaaagttatccctcctttcaggcgcttgctttcaaagctgccaacatggtctctaatcattgcaaatgccatgcacagttggggtttttttattgttctttcttggatgcccatatacttcagctcagtgtaccgtgtggatctcaggcatgcagcatggtttagtgcagttccatgggctttgatggctgtcatgggttactttgctggcttgtggtcggatatgatgatacaaagtggtactagtgtcactttgacgcgtaagattatgcagtgcattggttttgttggtcctggactctgcctcattggcttagcaacagctaaaaaccccgcgattggttctgcttggcttactttagcttttggcctgaaatccttcagtcactctggttttcttgtgaaccttcaggagattgcaccacggtattctggtgttttacatggaatatcaaatacggctggaacattggctgctataattggaacagtaggagctgggttttttgttgaactagttggttccttcccaggatttctgttgcttacatcgctcctttattttcttgctgctattttctattgcctattcgctactggagaaagagtaaattttgacgatcctggtgagcttaaatatataactttgtcctggcatactagtcttgcttttgtggatactggtatccttggtgttttgtgtgtggtcttgcaaacaccactacccactaaccaaatgtatggagcatatcaactggctgttacgaagtacgggtccctaggcgatagaaaatcccgatccgtggtttcttttcgacaaaccaatctaaaccgtcgaaatatttccatcaacgctccgcaacgtcctacactcctcaccacggatcgcgctcacaagccgtcgattaacaaacccccggacggccacgatgaaagtaacccactctcgaatctcgattcataa

SEQ ID NO: 90779 - DNA, 339 bp, Glycine max
  Peptide Sequence Number=SeqID_182464
atgggtttagatgacaaggctgctgaagatgaattggttttcgatgatgatcccttgacttggggagccgttgctgatgcaaccagggctaacacaaatttccaagtgtcacacatagcatcttgctctgttgagtccaaatgtaggagaggctccagtaactatttgtcaccctcttccaaccttgctcgggccttcaacgcttcattcggtattgcacccagctcagtacccttgtttcacatagtcatctccttcaacatagaatccttacacacagcacaaaacatggaaaagcaatgcaaaggctgtgaatttgcaacaagccaatggcattaa

SEQ ID NO: 90780 - DNA, 293 bp, Glycine max
  Peptide Sequence Number=SeqID_182465
ggggtctgttcttgggtgtaacccgccattgccactggcggcaaaggtggagagaggctggtatcgttactggtagtgacgatatagatagggcaagggcaatctcgccgttagcattggcgagatgctccctgttcatgactggtgccgctagcccttctggcgggattggcgctatgctctccttgttcatgatgagactaaacataaggtctgaaatagggttcaaagctagctgtagatgttcacaggttgcgcatgctctccttgttcatgatgagactaaacataag

SEQ ID NO: 90781 - DNA, 1518 bp, Glycine max
  Peptide Sequence Number=SeqID_182466
gaccggaagtatccaaacgggcacaggttgaaccgagctacgaatcatggctattggaaggcgacggggaaggatcgaaagattaagtctggctccaccttgattggaatgaagaagactcttgttttctataccggtcgtgctcccaaggggaagaggaccaattgggttatgcatgagtacaggcctaccttgaaggagcttgaaggaaccaatcctggacagaatccatatgtcctttgtcgattatttaagaaacaagatgagagtcttgaagcttcaaacggtgatgatgtggagcggactgcttcaactcctacaactgccaattactgtcccgacgaaatacaatctgattcagctctggttccagcatcttcctcacaggttactgaagatgataagcctctaccagttatttccgagaactccgaggaagcaatatccaacattataacccctggtgatattcatagtgacgaatgtgatgctcctgatgcacaatatcaaattgttgaaccagttgcagaggaggatcagctgttgagcgtggacatattttatgacccaacaaatcagcaattagacgacaaattgttctcccctgtccatgcacatttcccagcagatttttattatcaagctaacaatcaatcagaacttcagtatggtacaagtgagaatatttcagaattttttgactctgttgttaattgggattcattctcttatgctaccagcagtctagatctgggctcatccttccttaatcctaaggacaatggatcaggcagtgactcagatgtggaaatggccaatatgctgcatctgcaagcattacatgattatcctaaggaggcagttgaggagaagttcaatgtaggattatttcagaacaatccccagatggctttctcaaatgatggtcctatgggccaagtgcacaatgtggccaactattgtgagcaaccaagaaactttgatgcatttgttaatggtgatactggaatcagaataaggactcgtcatggaagaaatgaacagccaaacatgaacatgatgatacaatcacaaggtattgcaccaaggagaatacgattgggagttgttaggcgtccgcttggttctcaggagacagcaaaagatgggagttgtgcttgtgccccagaagaccataactcaaaaaccatcattagtgcggagaagaaagcttcagaaaaccatgctgctgatgagagttccactgtttctgatgagagttccactgttactgatgattctgatgaaccagaggaggcatctcccaagtcaactgacccgagaaagataagtcagcaacatgttgcaactgcagaatccatctcggggtcgaaagaccttctagtgagcagaaggggctgctacacctcaaaggtttcctctaattgcgccatgtggtcttatgttcttgcagtttctgcaactgtattggtctcagcaatactccttgttaatatatgggcatatgtcagatcttaa

SEQ ID NO: 90782 - DNA, 1038 bp, Glycine max
  Peptide Sequence Number=SeqID_182467
atggtgtgtggaacgggattggggatacccgatacccgtcggatacagggatgggaccataaactcaaacccgtcgggtatcgggtacggatatggggatatgttgaggagtcaggaggccgcacaaaggattttactccgaaggtttggttttggttgttcgttaacgcattgatggggatgactttggctcaaggattattctattatggtctcaaagacacttctgctacttatgctgtcaactttctcaacttggttcctatatgtactttctttacctctatcatattcagattggagaaattggggctgcatacttgggctggtagagctaagtgtggaggggcaattttgtgtgttggaggagcattagttaccagtatttacaaagggaagaaattttatcttggccatcagagtcatcatgttcaaactgttgccacagcacacgaaactcacatgcttcggggcacttttgttttgatttgtagctgcttctcatacacagcttggtttcttgttcaagtccagttgctcaaagtatttccactaaggtataccggaacaatgctagcatgcgttttggcagcaattcaaggaggaatcataggtgtttgcatagattccagtaaagctgcttggaaattagagtggaatctacaactggtcactatagtgtactcgggagcactggctacagctgctacattcactatattatcttgggcaattacaatcaaaggacctagttatcccccaatgttcaatcccctggctcttatttttgtggccttttcagaagctatcatacttggggaaccattaaccgttggaacgttgctaggcatggttttgatcatggtgggattatactcctttttgtggggcaaaaacaatgagacaatgcgtagggttcaacaactagcatctacaaaaatatcaaacattactaatttgtctattcggacagaatcaatgaccacaatagtgtcaagttcttcacctatgaattcagtaggtctagctagaacttga

SEQ ID NO: 90783 - DNA, 423 bp, Glycine max
  Peptide Sequence Number=SeqID_182468
atggtgaagaggtacatggataggtcagggatgaagggcatgtatgagacacggtacacgtctatgaataaagagatgaccatcatcgtcgatgatgtgtcacatcttctacatcttcttatcacaggtcgtttccttgatcacatgaactcaacctacacaaggaaggagatcaaagggatattgaggttagagcttggcattatgacagaccaagaggtagatgttacgatgtcatcaggcaacacgatggctctagctttgttagagaagttgtatcgcactatgttgcttatgagttgttcatctaggggtaccagcaaggttgatgggaccaaggcattgttggatcggctacagatgactgatgttgtttggtccccatatgcatcacacaaagaccttagacctttcgaggattag

SEQ ID NO: 90784 - DNA, 462 bp, Glycine max
  Peptide Sequence Number=SeqID_182469
atgcatccccataaacccaaggcccagttaggtcagtatataagaggaggatccccccagatacctctcctatttggcctcatgtacacgaaagaagcatataaattgtcgacaaaagaaccatttggcatagctagtgaccctttggcagagaatgaaaggacaaaactacacctaaggcagattctccccacccctatccttgtagaagcaagcttcatgatgatgaatcaaggtacatcctttgtgatacaagtagagggtacatctacttgggttgttgtaactgagaataagagagggtacatctcttgtggatcagttcaagtggaggatacatccacttggttgttcaaagagaacaacggagggtacatcccttgtggatctttgcttgtaaaggattttacaaggttgaaaagaaatctcaaggaccgcaggttgcttgaggactggatgtag

SEQ ID NO: 90785 - DNA, 624 bp, Glycine max
  Peptide Sequence Number=SeqID_182470
atgccctatttttcttttgtcatcactcaaattctcacgctgcaagcatcacccaatagcaattgtgagctttactgtaatgctgcaacacataaattaaaagtcatcaacaacacaatgattgggaaacaacataccaaggatgttatggagggtcgtagcgttggtgatcatgtacaagaagtttggataaatgatcatgcttttatgcaaatgggtctggaaaaaaatggaataagcttccaagaagaagcctttgacaaggatgttgaaaaggaaggtgtcaggtttgagaacgaaagagaagagaccacttgcaagggaatcatcaaggatgagttgtgtgtagggttgaagcaggaaccagtgaaatttgctaatgaaaatggagaccatgttgcccaaaagattgataataatgatattgctggtttggaggctaatggtggtcaagaaccttacatgggaatgaaatttgagtcacatgaatatgcttattttttctacaatcattatgctaaatgtgttggatttggcatgttaactaagactagtcatcgttcaaaaagtagtagacaatttattgatgtgaaatatgtttgcacaagatacaggaagaaatga

SEQ ID NO: 90786 - DNA, 1407 bp, Glycine max
  Peptide Sequence Number=SeqID_182471
atgaaagcagagacatatgcaaaggcaaaggcaaaggcttccattcaccatgacagcttgagagtgctcgaatgggacaagctttgcgacttggtcgcttccttcgcttgcacttccttgggccgtcaagccctcaaggaccaactatggtctctgaatcaaacttttgaggaaagtcttgcacttcttgaggaaaccaatgctgccgttgaaatgaacaagcatgggagtctcagattgcacttggggcaccttgatgctatgctagtcaaaactgccattcaacaagccagaagaagtataccggtgagtggctatgaggcatgggctattgtggctcttctgcagtgtgctgagaccttgccgggtgatctcaaggctgcaattaaggaagacaaagattggcataatcgtttcatgccacttacagaagtgataatggagtttgtcatcaatcgatctttaattaaagcgatagagcaagttgttgatgaagatggttctattaaggactctgcggtaggcatagaattccttttcttaatgatggtatttattggaagtggatccggagtcggaagtactatagagccactgtctgctgttcctttaaatgatgagttgcagcgagcaagaagtttggtggtaaaggctgaagcagatgtgcttttgacattaaccaaaaagatgcagctggaccttgaagatattgaaaacacattgaacagtttggttgaactagatgtgatggtcagtaatgtggttcctatgcagattaatgcccgagctacttatggtctttcatttggatggtcaagtcctcatatatttctgccagataggggtagctcttctactgcagaagcattcttaccaaggaaggaaaatccctatggaccattacccagcaaaagggaatggatgttatatcttctaaaagcttatcctcctttattgctccagagacataaggagaaattgaggaaggccaaaaaggatgtcaatattgctgcttcagttaagtcacagatgacatgtgttgaatttgaagtggttgcttttcctgggctgggaatgtttgataaaaagacttctgcgttgcttaatgctgcactggacaatgctcagccagtacctgttgatttttcggtatctcagaaaactcgtgttatagttataactggccctaatactggcagtaaaaccatatgtttgaagaccgtaggattggcagctatgatggcaaaatcaggtctctatgttcttgcttctgaatctgcgcaaattccttggtttgattttgtttttgctgacattggtgatgagcagtccttatcacaatctttgtctacgttctctggccacttgaaacagataagtgtagggaataatgttttgattgtgtag

SEQ ID NO: 90787 - DNA, 942 bp, Glycine max
  Peptide Sequence Number=SeqID_182472
atggctaaaatctggattgaggtatgcttgatatccgctcgtggggtgaggggttcaccctcactttggaagcgtcagtggtatgctgtagggtgggttgatcctaagagcaagtactgcaccaaagttgacacttctgggaacaccaaccctatttggaggactaaatttgctgttcatgttgatgactctgagccggatcttgcactccacgtggaggtttacagcatagatcctgtgtttctaactgagaagctgcatggctcagctactgttgttctcagagagtttctggctaaggaggtccacaacaactctgaggaagtgggaagctaccagttgagaaagaagaagtccaacaaaccaagtggtttcgttgatgtttcaatccgtgtttctgaggacaaggaagaacctaatttccacccacaaggtgatgggggaggaatagtgctcttagattatggcaacaatagtactattcacttgaccactgggactggatttgggcaaccctatccacagcaaaaggctcaagcttctttccatgggccacagaaacaggcccaaacaaatgtcccccactcacatccagtgccatttcctgcagactatgctactaacccttatgtgggtggaccaagctatgcacctgctggaccaagttatcaaccacccagaacaacaactccatcaccctcaaatgttaattatgctcccaattttttcccaagtagtggtggcatggcacctagttatttcaacatgccatcatcatcatcatctggggcaggtcctaggccaaggggtcctccaggatttgcaattggggcaggtgccggagcattggccgctggggctgtaatttttggtgataacatcatgtcaggatttgatgttggagatcccactcttaccattgcaactgatcctcttttctga

SEQ ID NO: 90788 - DNA, 567 bp, Glycine max
  Peptide Sequence Number=SeqID_182473
atggattggagctcctgcgctgcccttttgtgttcttttggtctccaggtgagggtggtgaattttggggcaaaggagctagtaagaattaatgatgcaaggaagaggaaagcaccaaatacttatggaccaatggaaatatatctgtctcgtgctgttgctcaagctagttgttgccaagatgcaaagacatgttcttcttttatccagattcgtgacactgtggataaagaaagtagtgatgatagagtgaggcgagttcttattagtcacaaaacgcccttgtactttcaacacgatggacattcaagaacaatagttggaattcaagtcaaacatccacggtctggaattccacaatacagtctcctggttatggatcctggtcatagaacggctgctctagaaagatcaattagggagaaagttggatggcagaaattcataaaaagaggagtgcacacactaaggaagctacagtaccagttgtgttatgttgatcctggaattgccagtgaggagatggaaaaactcaagacaattgatggtgtcttccttgaattttaa

SEQ ID NO: 90789 - DNA, 468 bp, Glycine max
  Peptide Sequence Number=SeqID_182474
atgttgggtgttataaggcacaagagtattcgccccgccttctccgcaatcagacacttctcttctgcagctaaagagttactatcaaatatcaaactttccgccgttgtttcgatgcagattactgtcagggatgctctcaactccgcactcgatgaggaaatgtcagctgatcctaaagtcttcttgatgggtgaagaggttggggaatatcagggtgcatacaagatatccaaggggctgctcgacaagtatggccccgagagggttctcgatactccaatcactgaggctgggtttgctgggattggagttggcgctgcttactatggtctaaggcctgttgtggagtttatgacttttaacttctccatgcagttatcaatcaaggatagagatgtgcatggccaacaccaaaaatgctatagcgtgatagcaactattctgaagattatgtatgcaagataa

SEQ ID NO: 90790 - DNA, 4581 bp, Glycine max
  Peptide Sequence Number=SeqID_182475
atgggggatatcgttgtttccatcgtagcaaagttagcagaatatacagtgggcccaattttacaccatgctcgatacttgtgctgtttcaacaacattgcttggaatcttctaattgccaaggaagaattggaattaacccgaaacagtgtgaatgaacgagttgaagaagctattaagaggactgaaaaaattgaaccagcagttgagaagtggctgaaagatgttgagaaagttttagaagaagtgcatatgctccaaggaagaatttcagaagtaaacaagagttatttcagaaggcaatgccaatatttccttacaaaaaaaatagcaagaaaaattgagaaaatggctcaactcaaccacaacagcaagtttgagccattttctaagattgccgaacttccaggaacgaagtactattcatccaaagattttgttcttttcaaatcagcagaatcaacttataagaaccttttggatgctttaaaggataaaagtgtttccatgattggactagttggactaggaggctcaggaaaaactactttggcgaaagcggttggtaagaaagctgtggagttaaaactttttgagaaggttgtcatggtaacagtctctccaactccaaatattagaagcatccaagtgcaaattgctgatatgttgggtttgaaatttgaggaagaatcagaggaagttagagcacaaagactatcagagagattaaggaaagacacaactcttctaatcttggatgatatatgggaaaacctagactttgaagctataggtattccatacaatgaaaataataaggggtgtggagtactcttaaccactcggagtagagaagtatgcatttccatgcaatgccaaacaataattgaggtcaatctcttaactggcgaggaagcttgggatttgttcaaatcgactgcaaacataactgatgagtccccatatgcattgaaaggcgttgcaacaaaaattgtagatgaatgcaaaggattgcctattgcaattgtgacggtgggaaggacactgaagggcaaaaccgttaaagagtgggaattagcattgtcaagactaaaagattctgaaccactagatattccaaaaggcttaagaagtccttatgcctgtcttggattgagttatgataatttgaccaatgaattagccaagtccttgttcttgttgtgttctatatttccagaggatcatgaaattgatttggaagatttatttcgatttggaaagggaatgggcttacctgggacttttggaacaatggagaaagcaaggagggagatgcggatagctgttagcatcctcattgattcttatttgttgttgcaggccagtaaaaaagaaagggtgaaaatgcatggcatggttcgtgatgtagccttctggatagcatctaaaactggtcaagcaattttggcaagtactggaatggatccaagaatgttgatagaggatgaaaccataaaagataagagggtaatatccttatgggatttgaaaaatggccagcttcttgatgatgatcaattgaattgtccatcactagaaattctcttgtttcattctcccaaggttgcctttgaagtatcaaatgcttgttttgaaaggctaaaaatgattaaaatcctggcattcttaacatctagctatgcgtgggagataccacttacatcatatctcaccttgtcactgccacaatcaatggagtcattacaaaatcttcatactctgtgcttgagaggttataacttaggtgacatctccattttggaaagcctacaagcacttgaggttcttgacttgcgtggttcttcttttatagaattgcctaatggaatcgcgtcattaaagaaattgaggcttctggatttgttctattgcacaattccggatctgttccaaaatgcttacgaggaacatagaccatgtagagctttatgcgtagaaggttttaatgcctcagttcaaagttttatatcattaccaatcaaggatttctttcaaaaagcagagcaccttcatttgatgcaccttgagggaggttacgaaaatgtaatcccatccatggatccacaaggcatgaatcacttgattttcctaatcctcgaatattgtccagagataaaatgcgtctttgatagtaccaatgctgatctgctgcaaactgaagatgcattctccagcctagtcattttaagcttgttaggattggataaccttgaagaagtgtttcatgacccctcttccagatgttctctcaaaagtttagaaaagctaaccatacagagttgtagacaattgtacaatatttcctttcccaagaactcaaagctatgccatctcaagttcttgacaatagaaaattgcccgatgctaacttgtatcttcaagccatccattttccaaactctagagctgctagaacatgtggtcatatctgaatgctatgaattgaagcagataatagaagaagtggaagaagggagtgttgattatgttagcagtcaaagtcgtacctctttgatgctcccaaaattaaggaaacttactatttctggatgtcaggggttggaatatatattccctatgtgttatgctcatgggctagcaagtttggaaaagctgagcattaaagtttgtggtaagttgaagtatgtatttggcagtgaaaaggaatatgatcttaccgtgtaccagcaccagagtaattgtcagactattcacatcaatttccttaatttggaaaccctacacttgattgggttgccgaatttggttgagatttggcctaaatattttcatccacatttaccaaatttgaaaatgtttcaatgcactgactgtccaagactgtctgactcttgtgtgcgtagggtgatgattattgattcagatctgcaacaagactcaactgcaacggagaaggaattactatgcttggttacgtccgcatgcaaccaattatccgatcaagtgcttgcctctaaacttagatatgtactcaaatttagacaccttggtttgtttgatcttggagtaaaaggtcttttccaattccaaatcagagaacatgagagcaacagagaacttgctcctttaaaattggatctaactcatgcttacttggggaatctacctgagctcgagttcatatggaagggtcccacaaattttctaagcctcgggatgcttgacatgattcatgtgaatggatgtccaaaattgaaagtcatcttctcccctaccattcttagaagcttaccaatgctgacaagactggaaataattgattgtgaggaattggagcaaatatttgacttaggtgatgcacaaagcctatatacttgttcacaagaagaacatgatcttacagggctagcaagtgtggaagaactggacattaaagaatgtaatgagttgaagtatgtatttggcagtgaaaaggaacatgatcttagagggtaccagcaccagagtcgtcgtcagactaatattcacatttaccaaattctacggttgggaactttacggttgattcggttaccaaatttgcttgacatttggcctaaatattttcatccacatttaccaaatttgaaagtgctaatatgcattgattgtccaagactgcctgactcttgtgtgcgtagggtgatgattattgattcagatctgcaacaagactcgactgcaacggagaaggaattactatgcttggttgccaccacattcaaccaattatcccatcaagtgctttcctctaaacttagacatgtacttaaatttagataccttcgtttgcttggtcttcgagtaaaaggtcttttccaattccaaatcaaagaacatgagagcaacaaagaacttgctcctttaaaattggatctaactcatgcttatttgtgggatctacttgagctcgagttcatatggaaaggccccacaaattttctaagcctccatatgcttgacatgattcatgtgaatggatgtccaaaattgaaagtcatcttctcccctaccattcttagaagcttaccaatgctgacaacactggaaataattgattgtgaggaattggagcaaatatttgattcaggtgatgcacaaagcctatatacttgttcacaatttgtgtgcttcccagatctcaacactatttatgtccggaagtgcaacaagttgaaatacttttttcataattttgtggctggtcacttttgcgatctgaactacttgaaaatagaagactgctctcagttacagaaggtttttgcttttgaatgtgaaactgatgacgatggtcaagaagggattgttaaggatggagaaaaagtactacttaaactgctacgtataacactcagcaggttgccaaacttcaaagagattcaccatggattcaagttaacagcttatgttagagaacatgacataaatgattgtcctaaatattctccaagtttatatctacacacaggggaaagaatgagcatcgagcaaagcgtacaagtgtacgagtctgcagaagagaaagatgaagactaa

SEQ ID NO: 90791 - DNA, 309 bp, Glycine max
  Peptide Sequence Number=SeqID_182476
atgaacaagagttacttcaggtgcggttacaagtatgatcaaggttgcaaagcaaacaaacaggtgcagcgggatcaagagaatccgaatatgtaccgaattacgtacattggaattcacacatgcaatgccactccaaaggctacacattcggccactgattctaacacttgggaatcatttcttctgaattctgatggtgagataatgagtgattatgtgctgactctcaacgtctggatatggattttggggtgccatctgttcattttggcactgattttccctttgacgaaggttactttctaa

SEQ ID NO: 90792 - DNA, 1892 bp, Glycine max
  Peptide Sequence Number=SeqID_182477
ggaacggggacacgactgcgtacatcatcatatccgaccacaacattcaggcaacgacgcaaggcatgtcccaggccctctgtgctgttctatgggtcatcctactcccgcattcgatcgacgctccgcgagctcagacattgtttcttgaagtagaggatcatcggtgtgagggaagagtcgcgaattcgagaacgagatttcagaaattttcaagtggaagagaggatggagaggatgaagttcatgctgaagaattgatggtaccagcaccagcaaatcctttgttggaagtgattgatttagataacaaggcaccagtctatttgacaggattgaagcaccgtggccctgactggagtgggctccatcaacatggtgactgctttttggcacatcaacggttagccatagttgatcctgcttctggggatcaacctctctttaacgaggacaaatccgtcattgttacggtaaatggagagatttacaaccatgaagagctcaggaaacagctgcctaatcacaacttccgaactggaagtgattgtgatgttattgcacacctgtacgaggaacatggagaagactttgtggacatgctggatggtatcttctcatttgttctactggacacccgtgacaacagttttatagtggctcgggatgctattggggtcacttccttgtacattggatgggggttagatggctctgtttggatttcatcagaaatgaaaggcctgaatgatgattgtgaacactttgagtgttttccacctggtcacttgtactctagcaaagaaagagggttccgcagatggtacaatcctccttggttctctgaggctattccatctgccccttatgatcctcttgttttaagacacgcctttgagcaggcagtcataaaaaggttgatgactgatgtgccttttggtgttctactctctggaggtttggactcttctttggttgcatccatcacttctcgttacttggccaacacaaaggctgctgagcagtggggatcaaagttacattcattctgtgtaggccttgagggctcaccagatttgaaggctgcaaaagaggttgctgactatctaggcactgtccaccatgagtttaccttcactgttcaggatggaatagatgccattgaagatgttatctaccatattgaaacatatgatgtgactacaattagagcaagcacacctatgtttctcatgtctcggaagattaaatcacttggtgtcaaatgggttatctcaggagaaggatctgatgagatctttggagggtatttgtacttccacaaggcacccaacaaggaggagttccacagagaaacatgccgcaagatcaaagcacttcaccaatatgattgcttgcgagccaataaatcaacatttgcttggggtctagaagcccgtgtaccatttttggacaaggcgtttatcaatgctgcaatgagtattgaccctgagtggaagatgataaaaagagatgaaggacgaattgagaagtggattctgaggagagcctttgatgatgaagagcatccttatctgccaaagcacattttatacaggcagaaagaacaattcagtgatggagttggctatagttggattgatggccttaaggcccatgctgcaaaacataactcagctaggctcactgttcctggaggagcaagtgttgcatgtagcacagccaaagctgttgagtgggatgctgcttggtctaacaaccttgatccctctggtagagcagcacttggagtgcacatttcagcctatgaaaaccagaacaacaagggtgtagaaattgagaagataatacctatggatgctgctccccttggtgttgccatccagggctaa

SEQ ID NO: 90793 - DNA, 2787 bp, Glycine max
  Peptide Sequence Number=SeqID_182478
ttgaagagtgtggaagagggttttcagggttcatggcacccagggacagtagtccgttgtgagaggcagaagcgtcatgtcaaatatgacaacattctagaagatgatggatcaaagtatctcgtggatgtggtgcgtgtttcagctattttggatggtcttggttcttcttcagattgtagcaatgaatgtggattcattagaccactgcctcctccgcttgcatttggggagagggaccttccatttggtctctgtgttgatgtgaattatgaagaagcctggtgggaaggagttatatttgatcactgcaatggaacgaaggagaggagtgtgctcttcccggatttgggtgatgaaatgaaggtaggaattcatcatatgcggctaactcaggattgggatgaagttactgagaattgggagtcgcgagggaagtgggtgttcctcgagatggttgaggaatgcgagaaggaatcggttgttgcagtctcattcaagcagatatggtatgatgtgagggcaacaaaggagtttgatgacaatataaagcactggacttgtaatgtgaaggaattgtggagagaccttgtaaaagaggtgattggtaactactatgttctcacactagaacaagttttcccagccttaaaccttccagaggatttcttcaaagaaacaccagagtcagttgaacctactgacagcattccccttcaagaggaatatgataaagatcctttggtggatggggcatccgagaaggaaattattttgcagcaagaaccagcatctccagttcaagagatcatgcctgaggctggtgaagtaatgccaggtgctagctgttgtggaaagaagagaaaacgtggacgctcagcatccatatattgggagccgctggtactgaccaatgttgaattctgtcctgatgttattaacgaatatatacatggatgtgggagcaagactgttagggaacttttgaagactaaagtaaggaaacatcttgcatatcttggatggaaaattgagtgggctgaagataaatattttcctgggcgaggacgctacaggtacaagtcacctgatgatgcacaggagcagaaggtttacacttcaattattcaagttttgacacacatgcaaatggagtccaacatgaacactgtgcagccccaaattgatcacaataggatgcattctacaaatgacactaatctttcacatctgctttcagatttacccccaaacgaccaggatgtagatgtttgtcctcctccaaaacggaaaccttctaatgtcaaagttgtagttgagccggaattttgtcctcaagctgttgttaaatattacttgaatgcatcaaacaaacattgggttgatagaggaaaatggagactgaaagcaaagaagcatttgttagcagaaggatggacctttgactacccaaccaagaagcgaaagacaactttgtacatatctccaggaaataagtggttgggcttacttcgaggtgcatgcagaatacacattaaagaaaagatttctgaatggactaattctggtatgatacctttgaatgtcccagccataaatgagtccggtgaaggtcatattgatagtgagaacctattaaaaattttgtcccaaacgcttgaaaaagagtctgaattgctaactgcttcaccagcaagtagatcaactgagaatagaaaccatagatgcaccaggaattcaaaagcttccatgccaaagagccacaggaaaggattatcaacacgtgtgctatggtcacgcaaaagggtgcagaaggtgtctgcccctagtccgtcacaccaaagacctcgaaatgtctcatcttggttgattgataacagtgtggtgatgtcaagatgtaaggtctattgctgggcagaaggaggcaggaactctaatgtggttgaggggaggataacttatgatggaatcaagtgtagctgttgcttgaaaatatatggtcttggtggctttgttaatcatgctggtggaagtagtgactgcaggccttctgctagtatctttttgaaggatggagaaaatgacaacatttgttctgtctgtcaatatggcggtgaacttgttttgtgtgaccgatgtccatcagcatttcatagcgcgtgtcttggtttggagatatatgaaggactccaaagtctattaggaaagccacttatagtgggtgcgaacaatctaacatggacattggtgaagtttatcaactctgagagttgtgatgttggtagtactaagaatgacttattggcagagaaatacagcaaactcagtgttgccctttcggtgatgcacgagtgttttgagccattaaagaacccttttactagtaaagatattattgatgatgttatattcaacactaggctcacacaacttggagtggagaggctagtcttgcctgctgtttctggagtgctagaaacatggaccaattcttttggttttgcaaagatgacaaattttgagaggtcacagttcttggactatgctttcctagattttcaggaaaccatcatgtgccagaagctgttaaaaaggagttcatcccccgaatcggttttaacaagagagatgcaaccaaaaccacatgatgttttcactgtcaaatgtaaaattaagtttgaaaagtccagttcagcacttgaagtggaccaagctgaagaggctcacaaaagtaggaaggatctacaagtggtggagtgtgttccaactttgcctacttcttcctaa

SEQ ID NO: 90794 - DNA, 510 bp, Glycine max
  Peptide Sequence Number=SeqID_182479
atggaggagtttatggcccaggtggcctggctagaagtccagtcttctcctttggggggaggctactctggaggagacaccagaggtcacccctgctgcaacaccacttatggaggctactgggaagaggatggcgctgcagatacagattatgcagctgacatggcggcggcgcagaacacttgggatccttggcccactccagctcagaacacatcattgccagccaaggatgctccgtcttcacctcaagatgatcctacaccagcacagaaggacagaagacaggacttgatttatttcctgctttttagatacaaagagaaggttcttgcagctggtgtctcgctaagcgagacatatgcgcttagcgaggcactcaactcgtttagcgtgatgggaaatcctagaagaggatcagtcagagatgtgctcgcccagtgcgccgcaagctcgcctagcgaatcgtttgtctcttctcgtgctcaacgcgcccagctcgctaattaa

SEQ ID NO: 90795 - DNA, 192 bp, Glycine max
  Peptide Sequence Number=SeqID_182480
atgaggaagatgcttgcaatcgagatagtgaaatggaagtatttgaactatgaaatcccattggtggagaagggtggaatatcaaagtatgatactaagaaggatgatttacacaaaaagtggaagaccaaattcaatgttgcacttctgacagccacaatggacaattttggagacaaacaaaagtgctaa

SEQ ID NO: 90796 - DNA, 165 bp, Glycine max
  Peptide Sequence Number=SeqID_182481
atgtccttacattacaataagactaatgaagcttgtgaatttggtgatgacttcattggacctccaacctttgaccaactgaagatgacttcgaccaacctcttggagtatggtaacatgcttgtccaagaacaaaagaatgtgaatactgacctcagagaatga

SEQ ID NO: 90797 - DNA, 390 bp, Glycine max
  Peptide Sequence Number=SeqID_182482
atgtcttggtccatctttgatccttgtaggcccggatattctagaatcttcagcattaaggcaagcttgtccattacattaagggatttgctaggggcacccagcagaattgctggtgcacccagggcggacaacggaagatttcttccgcccctgtcaatagcagaagaaatgcggaagaaccttcttccgtggttacacacactccagtcacacacttcttcctctctctatttctctaactctgaccatgcaattggcattggtctcattgcattctctatagaaatgacgaacaaggtcaaaggaaaaggcaaggaggttgccggaaaaggttatgccggcaagcgcaagggcgcctttgacgacgacaagaccggtggcggctga

SEQ ID NO: 90798 - DNA, 966 bp, Glycine max
  Peptide Sequence Number=SeqID_182483
atgtggtgttatgagtggaaaaagagtgaggctttgagagttggaaggctaagtctgaattctgtggattttgcacaagtgcagaaaaatgcttgtgtgtggttggttgtggaaagtctagtacagaatgagttctggatgtttgctagtagatcccaacgtgagaaaagctgtgatttggttggtgttttggcagagttttctgcctatgctctgttttgcttggctgtgatagcttgtgcgaggattgatggggacccggtgttgagagaaacgaggatatgggctacgtgggagtacgtgagctcagatggaggtgggcaacaggggatgcttgagatgaggaagtgtagaagggtgaaacttcctgcttttattgttgaccacagagtggtacctggagatatgtcgcgggggtcaggagaccttggggacgtcaggcgagctcctggcagtcaacagataaaaggaacaaagaccacaaagcaagaaggcttgtggtggctggccagctgtgaattttgtgtgatatgtggattatggcctctggtaatcgattaccaagggcttgaaaacgaagtcaggaaactaagggagcctctggtaatcgattaccagcctatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacggtggagataggtatggcaagacgtggtagggatcagaaccgtgatgtccttgaccgcatcaccgctgtgctggaaactctagtgcaggaacgtgatgtggagccggcggagtatcggggactcatggctttccgtaagaaccacccgccaaataatttagagaattatgagcggtaa

SEQ ID NO: 90799 - DNA, 114 bp, Glycine max
  Peptide Sequence Number=SeqID_182484
atgtctctgaatcattctccaatggatgttgatggtgagaattctcatgggaggagtaagcgtagaaaagggtcgagtaaaagaaagcttcttgtcaaccagagagttgagtaa

SEQ ID NO: 90800 - DNA, 975 bp, Glycine max
  Peptide Sequence Number=SeqID_182485
atggtttttaaggtgcattgtgagtctgtaactgaaggggcacaggcaccagatccttggaggtttacaatctcatatgataagctggaaattcgtcggaagttgctcctgaacttgatgatgtctgatgttccagggattgaagaagaggaaaaacaaaggctgttacactgtgtggttgtcggaggtggtcccactggagtggaattcagtggtgaacttagtgattttattgtaagagatgtccgtcagagatatgctcatgtgaaggactacatccacgttactttaattgaggccaatgagatattgtcttcctttgatgtccgactcaggcagtatgccaccaatcaattgacaaagtcaggagttcgacttgtccgtggcattgtgaaagatgttgaagagaagaagattatcctaaatgatggtactgaggttccgtatgggttgctggtatggtctactggagttggtccatctgctattattcaatctttggatcttcctaaagctcctggtggaaggattggcattgatgagtggcttcgtgttcctacagtagaggatatcttctcaataggtgactgcagtggatttgttgaaagtactggaaaaacaccactaccggctttagcccaagtggcagaaaggcaaggtaaatatttagcattcttattaaacaaaataggtaaagccaatggaggccgtgcaaacagtgcaaaagatgtagactttggggatcagtttgtttacaagcacatgggaagcatggcatctatagggagttacaaagctctagtggacctcagacagagcaaggagggcaaagggttatctctggcaggttttgtcagttggtttatttggcgctcggcatatctaactcgagtcatcagctggaggaacagattctatgtagctatcaactgggctactactcttgtgtttggccgtgatataagcagaatatga

SEQ ID NO: 90801 - DNA, 336 bp, Glycine max
  Peptide Sequence Number=SeqID_182486
atgtaccatgagaggacaaagtacatagatgtgaaactacacttcatcagagatgtgattgaatctgagaaggtgaaggtggagaatgtttcaacagaagaaaacccggctggtttaagaggagttcatcctgttgataagagaagaactgtcagcgagtaccgaaatatttttccagcaattgatttttcactgtggccgaatggctacagccaaagatctgacatattttccccaaatattgctgttggtcaggttatggacatgctccgtgcttttggaaatgattgtcacccagatgtaaagagtgaagcacacagtaaacatttctcctga

SEQ ID NO: 90802 - DNA, 279 bp, Glycine max
  Peptide Sequence Number=SeqID_182487
atgtcatccagtgaccgtaaccttgatgatgccagaaccaaacctgcaggagaagaggtgagtggttgttacatcgtcgccgtggcacatggggcaactcagatcagcatctaccccaccaatgttccttcagaacagagcttctctggtctgagttctattaaggatcacctgccacccaaaaacaatgaccttcaaaggtgctttcgctctccacaacacatcaaagagcttcatgataacaccaatcaaaaacattgtaaattgttatatcaataa

SEQ ID NO: 90803 - DNA, 303 bp, Glycine max
  Peptide Sequence Number=SeqID_182488
atggctatacttgtggatgataatgacttccgctcgagggggaggctaccatgtggaagagactcacacttgagggggagattgttgggttacaagtgtgagtatgatgtcaagttcccttatgtggtggatcgtggtccaccgtgtgatgtagctccattggagcttgtaggcctaggatcttcttcatcaatggattcctttgtttcttggaagatgaatggcagcggaatggagaaggaagagagagatgagatgccacttcaaggagaagatgagtctagaagaagctcaccaccatag

SEQ ID NO: 90804 - DNA, 465 bp, Glycine max
  Peptide Sequence Number=SeqID_182489
atggtggagaggattacgaaggcgtcaaaggttgcggcggcggacgcggtggcggtactgtggagcttgtgctgtttatgcaagaacgtgaaggtgagagatgacgtggcaaagcgaaatggcgtcgtggtggttttgttggttatgcagagggggtgggaggagcacgtgagaagcatgtgcatggatttgattaaggttttgaagggtgtgcgtaagaacgggttgcgacccgtgaaggtgtctcgccaatgggagaggcgagaccctatgtgtggctgtctcgccaatggagaaagcggctccctccacgtatcgctagtgccactggcggcaccctctagccagtgcactgtatcgctgttggcaatggcggctcatgctttctcgccattaccgttggcgggttccatgcaaaaagtgaccccctgtgtaaatatttacaaaatagacccctttgcgtaa

SEQ ID NO: 90805 - DNA, 726 bp, Glycine max
  Peptide Sequence Number=SeqID_182490
atggccctctttgtcttccttgtcgacaatgaagcatggcaatggcgtgttgtcgatctcgagcacgaccttgacgatgatgacactggtgtcaacctagacgcgaatgtgacatcaatgttagagagacacaacacgaagaggatcttggttggggacaagggagtagaacaagcaataatcgtggtcaaagttcatcaccatcaaggtctgaatggattccactatgtcgacgaaggtaatcaatcaatggatataggcggtgaagtggttcgccgtcgagaaggaagatggtgtgacccgctagagctctgggaggacgctaagtgtcagaacataatagcagaaggcgcatacgttggactggcaccaccaggagaagctggatcctggcaaagagaatgcaagggataccaattttggactagagctaacgagaaaggctacttctcaatcaataatatatgcggtggggattacaatctctatgcatgggttccaggtttcattggagaatattggaacaatattgttctcgccataacaccagtgaatgatccaaaacaagatcctcctctgttcattactggagtgattgggaaggacagtgcaatagcaagacatggaattcacggactctattggctattgaacatcaatgtgtctggtcttctgctagagaaaggagttaatactatatttctaacacatactatattcgtctag

SEQ ID NO: 90806 - DNA, 168 bp, Glycine max
  Peptide Sequence Number=SeqID_182491
atgcaggagtggtgcgacatgatgcatggaggttcatgggtcacgtggtggtggtgggtggaagcacagtggtgggtttggtgtggtgtggaggtggtgttggatggttgtggtggtggtgtttggggggaggttgggagccacggtcatggagaatttacgatgtaa

SEQ ID NO: 90807 - DNA, 6903 bp, Glycine max
  Peptide Sequence Number=SeqID_182492
atgtattgtcatcttaatttggtgatcgattggtttcagcctcctatggtcaaagccttcattgagaagatcatccagtgtccattacaagatattgccataccactttctggctttcggtgggagtacaataaggggaattttcatcactggagactgttgttgcttcattttgatacatacttcaagacttatttgtcgtgtagaaatgatctgacattgttagataatctagaagatgacagcccattaccaaaacatgcaattctgcaaatattgcgagtgttgcaaataattttagagaactgtccaaacaagagttcctttgatggcttagagcatttcaagcttttactagcatcaacagatcctgagattcttattgctacattagaaactctttctgcacttgtaaaaattaatccctctaagcttcatggaagtacaaagatgatttgctgtggttcggtgaacagctatcttttgtccctagcacaaggctggggaagcaaggaggagggcctaggattgtactcttgtgttatggcaaatgagaaagtccaagatgaagcactgtgcttatttccttctgaagagattggtcatgaccaatcaaattgccgcatgggcactaccctttattttgaattgcatggtcccagtgcccaaagcaaggaacatagtgcagatgcagtttcccctggctcaacagttatacatatgccagatttgcatctgcgcaaagaagatgatttgtccttgatgaagcagtgcattgaacaatttagcgttccttctgagctcagattttcattgctcactagaatcagatatgctcgtgcctttcgttctcctagaatatgcaggctttacagcaggatttgcctactttctttcattgttctggtgcagtctggtgatgctcaggaagaactcgtctccttttttgccaatgaaccagaatatacaaatgaattaattagaattgtacgttcagaggaagttatatctggatctatcaggacacttgcaatgcttgctttaggagctcaattagccgcatatacatcatcgcatcatcgggcacgaatactcagtggatctagtttaacttttgctggtgggaaccgcatgatactcctaaatgtgctccagagggctattttgtcattgaagagttctaatgatccatcatcccttgcttttgttgaagcacttcttcagttctatctgctccatgtggtttcaacctcaacttctggtaataatattagaggttctggcatggtgcctacattcttgccgttgctggaggattttgatcctacacatattcatctagtctgttttgctgtgaaaacacttcagaagcttatggattatagtagctcagctgtatcattgtttaaagaattggggggcattgaacttttggctcagagattacagaaagaggtacacagagtcattggtttggttggagaaactgataacattatgcttactggtgaaagcttgagatatagtactgatcaattgtactcccagaagagactcataaaggtctcccttaaggcgcttggttctgcaacatacgcgcctgcaaactctaccagatctcaacattctcaagacagttcattacctgtaactctaagattgatttttcagaatgtagataagtttggaggtgacatttattattcagctgttactgttatgagcgaaataatccacaaagatccaacctgtttttctgctctgcatgaaatgggtcttcctgatgcttttttattgtcagttggatctgaaatacttccatcatcaaaggctttgacatgcattccaaatggtcttggggcaatttgtcttaatgccaaagggttagaggctgttagagaatcttcatcgctacggttccttattgacattttcactagcaagaagtatatcttagccatgaatgaggctattgttcctttggcaaatgctgtggaggaacttctacgtcatgtatctacattgagaagctccagtgttgatattatcattgaaatcatccacaagatcgcatcttttggggatggaaatggtactggattttctggaaaagctgagggcactgccatggaaacagattctgaaaacaaagaaaaagaaggccattgttgcattgtaggcacatcatattcagccatagaagggataagtgatgagcagtttattcagctatgtgtctttcatttaatggtattgattcataggactatggaaaatgccgagacatgccggttgtttgtggaaaaatcaggaattgaagctttattgaatttgttgttgcggccaactattgcacaatcctcagatggcatgtctattgctttacatagcacgatggtatttaaagggtttgctcaacatcattccattcctctggcacatgccttctgttcttctcttagagagcacttgaagaaagctttagcggggcttggtgcagcatcagaacctttgttgctggatccaaggatgacaactgatggtgccatcttttcttcacttttcctggttgagttccttctatttcttgctgcaccaaaagacaatcgttgggtgactgccttgcttacagaatttggaaatggaggtaaggatgttcttgaagacattggacgtgtacaccgtgaagtcctgtggcaaattgctctacttgaaaacagaaagcctgagattgaggaagatggtgcttgtacttctgatttacaacaggccgaaggggatgcaagtgaaactgaagagcaaaggttgaattctttcaggcagtttcttgacccattattgagaagaagaacatcaggatggagcattgaatctcagttttttaaccttataaacctgtatcgagatttgggccgttccactggttctcaacatagatcaaatttagttggtccgaggtcaagttctagtaatcaggtacagcattctgggtcagatgataattctgggactgctgataagaaggaatctgacaagcagagaccatattatacctcttgttgtgacatggtcagatcactttcatttcacattacccatttgttccaagagttgggaaaagtaatgttgctaccttcacgtcgacgtgatgatgttgtgaatgtaagtcctgcttcaaaatcagtggcttctacttttgcatccattgcttttgatcacatgaattatggtggccgttgtgtaaatctttcgggaacagaagaatccatatcaacaaaatgtcgatattttgggaaagtgattgattttatggataatgttctaatggagaggccagattcatgcaatcctattatgctgaattgcttgtatggacgtggagttattgaaactgtattaactacctttgaagctaccagtcagctgctctttacagttaatcgggcccctgcctcgcccatggatactgatgatgcgaatgcaaagcaagatgacaaggaagatacagataattcatggatttatggttctttagctagttatgggaaattgatggaccatctagtgacctcctcttttatattatcatcattcacaaagcatttacttgcacagccccttactaatggtaatacagctttcccaagggatgctgagacttttgtgaaggtccttcaatccagagtgttgaagactgtgcttcctgtttggactcatccccagtttgttgactgtagttatgaatttatttctacagttatttctatcattaggcatgtctatacaggtgttgaagtaaaaaatgtgaacggaagtggtggtgctcgcattactgggccgcctcctaatgaaacaactatttcaaccattgtagagatggggttttccaggtctagagcagaagaagctttgaggcaagttgggtcaaatagtgtggagttggcaatggagtggttgttctctcatccagaggagatacaagaagatgatgaacttgcccgtgcacttgccatgtcccttggaaactcagaatcagatgcaaaggatgcagttgctaatgacaatgccctgcagcttgaagaagagatggtcctactccctcctgttgatgagttgttatctacttgcacaaaacttttgtcgaaggaaccacttgcttttcctgtccgtgacttgcttgtgatgatatgctctcatgatgatggtcaccatagatctaatgtggtctcatttattgtggaacggatcaaagaatgtggtttggttcctagcaatggaaatgttgccacgctggctgctctttttcatgttctagccttaattcttaatgaggatgctgtggctagggaagctgcttctacaagtggtttgatcaaaattgcctcagatctactctaccagtgggattctagtcttgatagcagggagaaacagcaggtaccaaaatgggtgactgctgctttccttgcattagacagattgttgcaagtagatcaaaaattgaattctgaaatcgcagagcagttgaagaaggaagctgtgaatagccagcagacatcgattaccattgatgaagacaggcaaaacaagttgcagtctgcattgggactctctatgaagtatgcagatatacatgaacagaagagacttgttgaggttgcttgtagttgtatgaataatcaacttccatctgacacaatgcatgctattctgctactatgttccaatcttacaaggaatcattctgtagctcttacatttttggatgctggtggtttgaatctacttctttctttgccaaccagcagcctcttccctgggtttgacaatgttgctgctagtattgttcgtcatgttcttgaagatccacaaacgctccagcaagcaatggaatctgagataaaacatagtcttgcagtggcatctaatcggcatccaaatggaagggtcaatcctcataatttccttttaaatttagcttctgttatttatcgggatccagtaatctttatgctagctgctcaatctgtgtgccaagttgaaatggtaggtgagaggccatacattgtcttgctgaaagatagggataaagacaaagctagggagaaagaaaaggataaggataaaacattggagaaagataaagtacagaacagtgatgggaaggttgttttgggaaatacaaacacagcacctactggcaatggccatggcaaaattcaggattcaaataccaagagtgccaaaggtcacagaaaacctaaccaaagttttattaatgtaatagagcttcttcttgaatctatatgcacttttgttcctcccttgaaggatgacattgcctcaaatgttcttcctggaaccccagcatcaactgatatggacattgatgtctccgtggttaagggaaaaggaaaagcagttgccactgtgtctgacggcaacgaaactggtagtcaggttgcttctgcatcacttgcaaagattgtcttcattttaaagcttctgacagagatattattgctgtattcatcatctgttcatgttctacttcgacgagatgctgaaataagctgcattagaggttcttatcaaaagagtcctgcaggtttaagcatgggttggatattttcccatattcttcataattttcttccatattctcgaaactcaaaaaaggacaagaaagctgatggtgattggaggcagaaactagcaaccagggccaaccagtttatagtgggtgcttgtgttcgatctacagaggcaaggaagagggtttttggtgagattagttatatcatcaatgaatttgttgattcatgtcatgacattaagcgtccaggaaatgaaattcaggtttttgttgatctactaaatgatgttttggctgctcgtacacctgctggttcgtacatttcagctgaggcctctaccacttttatagatgctggtttggttaaatcattcacttgcactctacaagttttggaccttgaccatgctggttcatctgaagttgctactggtattattaaagctcttgagttggtaaccaatgagcatgtccattcagttcattctagtgcagggaagggtgataattcaacaaaaccttctgttctaagtcaacctggaagaacaaataatattggtgaactgtctcagtccatggagacatcacaagccaatcctgattcccttcaagttgaccatgttgggtcttatgcagttcactcctatggtgggtctgaagctgttactgatgatatggaacatgatcaagatcttgatgggagctttgttcctgctaatgaggatgattacatgcatgaaaattctgaggatgcaagaaatcttgaaaatggaatggaaaatgtgggtctacaatttgaaatccaacctcatggccaagaaaatcttgatgaggatgacgatgaggatgatgatatgtctggagatgaaggtgaggatgtagatgaagatgatgatgatgaggaggaacacaatgatttggaagaagtccatcatttgccacatcctgacacagatcaagacgagcatgagattgatgatgaagattttgatgatgaagtgatggaggaagacgatgaggatgacgaggaagatgaagatggtgttatactgcgacttgaggagggaattaatggaattaatgtttttgaccatattgaggtttttggcagagataatagttttgcaaatgaagctttacatgtaatgccagttgaggtttttggatccagacgtccggggaggacgacatctatttatagtcttttgggcagaactggtgatgctgctgtgccttctcgtcacccactcttgcttgaaccttcttcattccctccacctacagggcaatcaggccagtttctctga

SEQ ID NO: 90808 - DNA, 324 bp, Glycine max
  Peptide Sequence Number=SeqID_182493
atggaccttattttgagtgacaatgaaggccaagcaggaaaatctgttaagcttccaccagcttggcctaagcatccaaatgacgaagcagctaatggatttgtaacatccattaaaggaatatttagaactcaacatcacaaggaaaaggcatttgtgcacaagacaaagaaaggagaagtggagaatgaaactcaaggggatttcagtgaatatgatggagagattgctccttttgctaggcatctcacgaacacacaagctaaaaagattattaggaagcacaccaagaagttgcagtctaaagcacaaaaagttacttga

SEQ ID NO: 90809 - DNA, 684 bp, Glycine max
  Peptide Sequence Number=SeqID_182494
atggcaaaaccctcaaagaaaagaaagggctcctcttccaccaccaccgctgcaggccaacgccgccatgacacatccggtgacccaccaacaccaaatcctccttctttttcatctcctagtcagggtgttccttttgagggaactctagttgatgactggaagcatgtctattctagtcatgatactcgtaaaatggtctacaatgaccatgttgatatgaccggcagattgcttgctgggtcattcacctttgagtgttgcatcatgcattatgtcctttgtcgagttttgcttcccaggtccaccaatcttgctcaggcctctgaggaggatttaatcttgttatgggctcttcaaaccgaggatgaaccttttgttaaggttaaaagatcttttgctattggtgctggtgttgttacttctttcggataccggaaggatatggatggccaatgggtgcgtaagcaagacctgccacctcccattcccaatgaacgcacaccctctccaccaccgcaacacgatacctcatcttccttattgaatgacgtcctcactgagctatgggatcttcgagcttttgtcaacgatcgctttgatgcaatggactcccatatcacgcatcttgaagatgacatgagcttcatccaacgttgctttgatcctcctgcagattcttag

SEQ ID NO: 90810 - DNA, 1920 bp, Glycine max
  Peptide Sequence Number=SeqID_182495
atgttaaaatacacatctgttgaaacttattcagtccttcaagcaagctgccttcaacattggttcaaaaactggcaagcactaaggagaaacaaattgacagctagcacttttgctgctgctatagggttttggcgtcggcaaagggtccagctgtggttagagaagattggtgctatcgaacctttctctggaaaccttgccacctgttggagcaatatcaaagaggaggatgcacttgaaagatacaaacttataactggaaataccgtgttgtttcctgaatttcaggtctatgatgcacacccagaagacagctggctagctgcttcacctgatggtgtaattgacagtatggtgcatgagttgccttcttgtggagtactggagataaagtgtccatattttgatggggacataagtaaagcttttccttggtttcgaattccaattcactatattcctcaagctcagggtttaatggagattctagaaagggattggatggatttttatgtttggactcctaatggtagtagtctattcaggatatatcgcgatgccgagtattgggatttaatgaaaatagcactatctgatttctggtggaagcatgtccatccagcgagagagttatatagtagtaatgttataacacatcccctatttcaattaagatcaatgaggccagctcctagacatgaattatgcagagatattgtttataaaagcaaacacattgctgctaattctaagttgttgatgcgggagatacatggaaagctgttggggagtggagactggagtgagacaggcttaaaaggctatcttcaggttatggaggattcagagcaaaggaagaaaaggctgaaagaaatgcgcgtgcaagctgatcaagctgaagtttctggtggtgtggaaggttctgtggtgcctggttttctctcaaatcccctgatggaagctccttcaactatgccatcacaggataaatcatatgctgctccaaggtttgactattatactgatccaatgagtgccttctcttctaacagaaggaacattgccagtatacaggctgcactggataatttccctccttcaaaatttggtggttctcctatggcacaatattcatcaccacatccagaatcaacaaatccacagaggactccgcatcccattcaagcttcgccagcagcatataggaagccaatttggagtggacctggtggccctgctcactataacttcccaatacatccatcaagtggtggtacttatccaagccctagatttgaaccatcgggtggtccattatataactccggacagggcatagctcacccgcccagttacagtcctaatcctccttatccaggatatggtgacagtcctaggcccagttacaatcctaatccctctccaggatatgggaacagtcctaggcccagttacaatcctaatccctctccaggatatgggaacagtcctaggcccagttacaggcccaatccttctccaggatacaggaacagtcctagccctggtcaagggcgaggcaggggtttctggcgcaacactggaagccctgtttcaggacggggtagtggacaaggaccgaattttcatggtcatcggtccaacgaaaacacagctcgtggtccagatcgattttacaataggtccatggttgaagatccatgggagcatttagaacctataatatggaaggcaaatgatggttatttaaacacttcacgtatacctctgaattcacaaccctggatttcaaaagcaacaagtacaaaaggggagggatcatctgctgcttctgtcaagtccagctctgaaccaagccttgctgagtacttggcttctgcattcaatgaagctgccaatgatgcagaaaatgtatga

SEQ ID NO: 90811 - DNA, 408 bp, Glycine max
  Peptide Sequence Number=SeqID_182496
atggatgatgctcttcaaaagcatggatgtgtagttgtttccaagtgttctcactgtggcagcaactacgaaacaacaactcacttgttattccaatgccccttccctgttaatatttggacatggttgagtattgttatgggtgtaaatcttttgcaatttgagcctctagaattgcttgataaatttgtcgtggctggcagctctcagatgaaagacatatttttggctgggcttttgagaatccgagtgttatcccttggcagttgcataatagatggcagaattgtagtgtcctccaaagaagcagaattgtggtctatgatttatggtcttcgcatggctgaagagttaaagatagaaaggcttattgttgaggccttgagggagattgtcttcctgggataa

SEQ ID NO: 90812 - DNA, 1014 bp, Glycine max
  Peptide Sequence Number=SeqID_182497
atgcacagcgccgaagcagaacgtcttctggggatcgccgagaagctcctccagaaccgcgatctcatgggctcgcgcgagttcgccatcctggctcaggaaaccgagcctctccttgaagcctccgaccagatcatggccatcgtcgacgtcctccttgccgccgacaagcgcgtcaacagccaccccgactggtacgccgtcctccagctcgaccgccgctccgacgacctcgacctcatcaagaaacagtaccgccgcctcgccctcctcctccaccccgacaagtcccgctttcacctcgccggccacgccttcaagctcgtcgccgatgcctggaccctcttatccgaccccgtcaagaaatccgtttatgacaaggacctcactttcttctcccgcgtcgatttgtccgttcccgaatgggtccagcagcaggagaagctccccgtccggaggcctgggcctgggcccagcgccggccgcaacagcgctgcggcacgcgaggacattctcgcggacgagaattcgaggaggaggcggaggaggaggaaaaggagctctactttctggaccgcgtgtccttattgttatcgtttgtatgagtaccctagggtttacgagggttattgcttgcggtgccagaattgtgatagatcctttcacggcgtcacggttccgtcgttgccgccgcttgttccgggacaggaggcttattattgctgttgggggttcttccccgtggggtttgttgttggcggcttcggttctccgccggaaaaagaagctgctcctgtggcggcgatgccggtgcaggcaccacctcctccgccacaacaggcttcttcgctgccgaattggatgccggtgccggctgagaatggcgctgggagtgttactccggtggcgacggcgagggtgacaagctcgggggcggcgatgacgaacggggttggatcggggacggggccgaagaaacgggggaggccgagaaagtatccattgccgtcgtga

SEQ ID NO: 90813 - DNA, 3234 bp, Glycine max
  Peptide Sequence Number=SeqID_182498
atgcgtgtcaccatcgatctagggttctggagcctggtcgtcgtcgcggtggtcggcctcatcgtgccggcgatcgccttcgtcgtccggcgccagtgccagcgggcggctgccagggcagaggagattaagaggctcctcgttctcgctgaggaggagtccgtgagggccgagtcagagtcggaggcttcggtctaccagcaaaacggcatcgtttcagcaccgccgaagaacaaagtatgcgcagtgtgttactctcccaccaccacgcgctgcgccaggtgcaaagcggttcattactgcctacgatatgttaccttttctagtaagccgcagatgaagaacacgcaaaaatttggtttgagttctggaaagtgccaaattgttcattggcgccaaggtcacaaagataaatgtcatcctcccagtccaacttgccagactgaggatctggtaagtgatcttggaaagaaggtagcagaaccagactatcgtggaatccatgatgagaagtctcagactaaaagcacagagtatgcaacatcatctgagaaacccccgttgtctgatatgaggtgttctcctgatatttcacgtgcaaaggatgatagtgtaagagttgagtctcttcaagagggaaatgttacaggctctaattctgaattatctagtaactcattctctggattctcagcttccactggtgctagtgaatcatctgatgattcttctgtctgtgagagtgtcacctcgaatgagtatgagagatgcgagggacataattttgtggaccccaccaatgacatttctgataccacttcaagtcgtaatagcattggcgaatccattccattatcacctaagtttgctagtttggttgattcggttgatggttatcctgcaatgcataaattaaatcaagttaggcctgcttttggtaaagaagagagtaagctcacatcaaatggtagttctggtctgcgtatacggaaaggggcagcaattgaaccttctacagtgtcttctggattctggaatacaactcgtgattccacgaggataaaagatggctctaatagtgagcctctttcatcccactctgatgattctgctccaaagtcagttaataatatgccatgtgcaagatcagcatcttcagaaaatgagggtgattctttaggttgtgctgatgctttgagcatccataatttgcaaacagttggttctagggtatcaaatcatgttatcaaccctggtagcaccttgaagtcatcagaaagtagatgtctgccacatgcagttgctgatactaagttagtttctagaactgaagagcattcacattatagtacaaaaggtgggaataatggcatcctatctggcactgctacttcaaattctaaaaatgacctgaaaacatctgttctaaaagtttctggtcagcttagaggatcaaggttgtctaaaccctttccatcagctgttgggagttatattactggaaaatacagtgataagggtctttttccatatgatttgtttgtcaagctttataattggaacagagtggagttggaaccatttggccttataaactgtggaaacagtgtggctgcattaagttcttccctgttaaatagctgttatgctaatgctgtactccagtgcttggcatttacacctcccctgactgcttatttgcttcaaggacttcattctaaatcatgtgcaaataaaaaatggtgtttcacctgtgagtttgaaagtttgattttgaagtcaaaagacacaaactctcccatctcacctgtaggcatactttctcaactacagaatattgggagtcaacttggtaatggaagagaagaagatgcacatgaatttctaaggcttgctgttgagacaatgcaatctgtttgccttatggaatctggggataacatgtcagattcattgaaagaggaaactaatttaatgggcctaacatttggaggttacctccaatcaaagataaaatgcatgaaatgtggagggaaatctgagtgtcaagaaaggatgatggatctgacagttgagatagaaggggagataacaaccctggaggaggcccttcaacagtttacaagtgctgagactctggatggagaaaacaagtaccactgtgtcaggtgtaaatcttacgagaaggccaagaagaaaatgacagtttcggaggcacctaatgttcttactattgcattaaagagatttcagtcgggaaagtttgggaagctcaataaacctattcggtttccagaaatactggacttggcacctttcatgagtgggactagtgatttgcctatatacaggctatatggggtagttgttcacctggatatcatgaatgctgctttttcaggtcattatgtgtgctatgtgaagaatttccaaagcaggtggttcaaggttgatgatagtgtggtaacagctgttgaattggaaagtgtcttggctaaaggagcatacatgcttttttatgcaaggtgctcacctagggccccaagattaatcaggaacagtatagtatcttcagactcaaaatggaaactcaagggaaaaactgccacaatgaagttgaggcgactacctaccggtgctggtgttaatttgacttctccagatggttcaccctccttagatacactctatttgaagtttctccacccgaaaatgattttggaagatgactcgtcaagtgataattcatcccttatcagcagcaattctgatgaaggttcttgtagtacagatagcacaagtgattcaaccggtacagatgactttgcagattatattttcagtgatgcgggacgtggcgcaggcggcatattgagaaattctgattccagcatctcccctgcattgtcatcctctccccactctagatattttccctcttctgatatagaccatgattcagtagttttgccacattcaactgggttccagccatctccttcagacggtcttttgtacaggaacagagtagtggatgttaaaaggagtgggggaggtgtttttcattttcatcctgacacaaatatagagcataggaagttagatacaactacaagtaggagtaactgcagtagttttagggatactgactctgtacagagagcaggatccaaccattttaatgatagaaattctggtgtatcatatacaaattctagggacagaacggattga

SEQ ID NO: 90814 - DNA, 615 bp, Glycine max
  Peptide Sequence Number=SeqID_182499
atgagtggagagcgccgagttcacgttattcggcgctgcagccatcgccaagcacgccatgccaccgtaggcggtgtgtatgagggtgttctcatagggcaaagtcacatccaagcccgtgaaccgaagcttgatcaacggcgccaaattctcgtaggtcttcacaaagcacggtcccttcacttggtatctaaactcatcccttattgcattgtaaaccggtcacacgaaccgcgttatgaccgtaccggaatctatgatggttccggatcccttattcgggtcgaatgcgagatagtcgcggggtggttcggattcttctgggctggcccgtgggcccgagttttaaggacccggaaaagtaggaggactggaaactggggaggcagtaggagagtcaggaggattgggaagggagtgacaagggccctcggcccaagcccaataggcctgggcttgggccgggagggtccagccggaggcggagttgacgcacctgaaggcgtagcttgggagggtgtcaatgcccaatctgagagagtcttgcacgagcgtggcggagaatgtggagcctgcgttatgcacaagatacgtaaggagaaggaacaaaactag

SEQ ID NO: 90815 - DNA, 828 bp, Glycine max
  Peptide Sequence Number=SeqID_182500
atgttgtggtggatgaatggacatacaagaaaagataacattagaaataagggatatatactgacttctgagattgatggcaccatacaaatgaagagttatctttctggcaatcctgaaattcgattagcacttaatgatgacctctccattggaagaagccagggaccagcttacggttataggagctcatctgactctggaacagttatattagatgactgtaatttccatgaatctgttcgtcttgatagttttgatatagacagaactctatccctggtaccaccagatggtgaatttccagtcatgaactatcgtttgacacaggaatttaggcctccttttcgtattaatgctttgattgaagaagcagggtcacttaaggcagaagtaattcttaaagtaagtgctgagtttgcctcaagtgtaacagcaaacactatcaaagtgcagatgccactaccaaaatactctagagttgtatcagttgcttatgatcattgggttagttttgagctggaacctggagctgttggacaaacaactgattttaaggaagcaaataagaggctagaatggagtttaagaaagattgtcgggggatcagagcacactctacgagcgaaactaaccttttctcaggaatctcccgttaatgtaacgaaagaatcagggcctgttagcatgacatttactataccaatgcataatgtttcacggcttcaggtaaagtatttgcagatagcaaagaaatctgcaactcatgagccataccggtgggttagatatgttacacaggcaaattcctacgtcgctcgtatatga

SEQ ID NO: 90816 - DNA, 375 bp, Glycine max
  Peptide Sequence Number=SeqID_182501
atggtgagagagaagagagaattccctaaggaagagttctcagactttggttgttggagtggacttgggcctgtgtacttgcgcttagcgccctctgttcacttagcgcaagtgcctgtttttgagcttagcacgctaagctcgcttagtgcaggttttggaatatctcctgaaaaccaaaaagaagatggaaccctcaatacatctagagatgcaagtgggacaggcatgggagagggtgtcggattaaagggtgtaagtgatcagattgctaatgaaggtcagctgctgggaacacaagaacaacaaaaagaaaagcaagattactccaatgaagtgccaagtagcaataatacagggattgagatggaatag

SEQ ID NO: 90817 - DNA, 348 bp, Glycine max
  Peptide Sequence Number=SeqID_182502
atgatgtgggaatgggaagattacgaagacaccatcaccgaacccgaacccgaacccgattccgattccgattcccacctcaatttcgatttcttctccgccctctccagacccaaggattattataagatactggaagtggattacgacgctacggatgacgctattcgttccaattacattcgcctcgcgctgaagtggcacccggacaagcacaaagaccataactctgctacctcgcgattccaagacataaacgaagcctatcaggggttagggttagggttagggttagggttcagggttactcgttgctcctgttcgttatttgtggttttagacaactaa

SEQ ID NO: 90818 - DNA, 636 bp, Glycine max
  Peptide Sequence Number=SeqID_182503
atgcccgtcgctagcaaaaccagaaatatgcttgaaggtctggtaaaagaaggatcattgaaatggttgcttggcaagaagagttactttggtgaagaatttgaagagatggaaaattctccttctgctgggaagaactttatacgagagctctctcctgttgcaaacctagttgttcgtagatgctcaaatagtgtgatattgaaggggaactcaggaagtcaagatgatgaaactgtaaccccagatgatgtaggtgatggagagaatgcagatgaggtgactatggacaaagaattagcatattcagatcctacttctgacatggatatggatttggatgtaaatgaagatgcatatctcatggaagatggagaactcgatgagcaaggtgatttagctgagaacggaaatgaaggtaagcaggatgaagagacttgcttgcctgatgaagttatggaagtggtacatactgaagttgatgtgaactccgaaaaagatgttcaaggtcaggaccatcaagagaatgtagacatgaatttcacagaaccaaagagagatacatctagacatgaattagcatcacagtccaaagttgattggcagacacacatctgtgaatgtccagattggtga

SEQ ID NO: 90819 - DNA, 366 bp, Glycine max
  Peptide Sequence Number=SeqID_182504
atgacaaccttagctttgaagcaaactatagctctaggtctaagcaaagaattagatcatgatgcaagttctatagcaattgatgtgagtgggatactcggatctttacgagaaggtggggatgagaaggatcaatctggcccacttggcccttccagatccttcctccagaaggttgttgcttctggaggaagcaaccttgctcgcctgggcgagctgggtggcaagctcctcccctattttgctataaatagggggaggagtgaagaagaaaagggttcagccttcttggcatttcgtattctcttaaatttgctgaggaaaattgtttccgtgaagaaaatccaagccgaggcgcttccgtaa

SEQ ID NO: 90820 - DNA, 195 bp, Glycine max
  Peptide Sequence Number=SeqID_182505
atggggagaccagtcagggtcacactattttgcgagaatgctccaaccatgtgggatcggtacaggcttaaaggagcactcaaattggatgtatttacccccaaggcctacactttgaagagtccgtcggggtctctccctcctaattcaggtccaatccctaaaataatttttgcatgtagatgctgctcatga

SEQ ID NO: 90821 - DNA, 384 bp, Glycine max
  Peptide Sequence Number=SeqID_182506
atggaagggaatctatactctattgttaatggtgtagatatggtcattgacgctgaattttggaatgtagttgtagggatagacatgggtggaatccgcaaatttgaagaatcaatggatggctacagcaaaatgcagacatatagaggaatccttcgtctagtggattatgaatttccatatgctatcttagcttctagattcattcattactttactatcgatgtttctaacgagatagtagactttaccaaagcctctaatgagataaccgaaaggcatctcaagaagcttggcatgacatatgttgatcatgaatgggttatggccggagagccaccaccagcaacaaatgacaatcaaatgggagaagaagctcactaa

SEQ ID NO: 90822 - DNA, 144 bp, Glycine max
  Peptide Sequence Number=SeqID_182507
atggcggcggaatggagaaggagaaaaggtgattggagacaccacttcaaggggaagatgagtcaagaacaaacttaccaccataggaagccatggcccactgatccaagatcaagttcaagattctctactaagtgtgcttag

SEQ ID NO: 90823 - DNA, 1080 bp, Glycine max
  Peptide Sequence Number=SeqID_182508
atgggtaacgacgactgctcccttgatggcggatgtagttttatgtgtccccctatgtccacacctcagcgagctcaaacggtatttgttgaagaagaagatcatcagcgtgagggaagagtcgcgagttcaaaaatgggatttcgggaactttcaggtggaaaagaggatgaaggtaaaggcaatggcggagtgtcatatcctaatcttttccggggactatcgttcgttgatttttttattcttgctagtcgacttatggtgttgaacaccaaccttagttcgcccaggctagcctctggctcgcttgggccaccaaataacttcatggtgaagaaaccaactcactcgggtaagctcattgcttcagcactaagtttcaactcgcctgggcgagctgcctttgccccaagtgcccattttccattaaatagacgtgctagggaggctgaggaagggttccaaggttcagaagtggagggaattgagagaactaagaaagaagaagaagaaagaagaggaaacgaagttgaggtgctgctgaatcgcgactgtgatcaatctctacatcgttccttgttcggtgatcttcgtgcgaccatcgacacctttttcttttcgcctcgtcctcccgtcgaaggcgtgggggcaccagagaggtgtttaggaattaagggtgagaaggtgggagagtctcatggcatagttgggtcgcgttgtgaatgctacagtgggggtttgattttggatcttgttactggcttcgacaaaggaaaccttggtgtcaccattgatgaaggagatctggttgtcatggatctagcgcctcattgttgcgttgtacgcacacattgcctcctatgtcgtgttgaaggtgcagtggcaacattgccctatgtagctgtgtatcttcgtcgaccacctcccccatggaaacttcctcactcttcgctaggtcttgctcaccgtagcttctgtgatgggtgtaacatctccccaagttccacttcctctgttgtaaagacgcctccaccatcgacatcatccacatgttttgtgattttcaatttgggaatttga

SEQ ID NO: 90824 - DNA, 336 bp, Glycine max
  Peptide Sequence Number=SeqID_182509
atggatacaactgaaattgtatcattttatcagaattcaccagacgagctttatctgttgtttgagcagttctgtgaccacttccatgcaacatcaaggaattcaatgtatatgaatttcatatcttctcattcgaataatatccacgcactggaacagctccggagcattaaagataaggcaagcagctctgcacagtttgtgaagaatatttttgaatcaagattcattaaaaaaattacagaacttatggatgacattcgtgagaatgtctctgtgttgacactgcttgctggatatgattgtaaattcatttgtttatatgatatcaactaa

SEQ ID NO: 90825 - DNA, 495 bp, Glycine max
  Peptide Sequence Number=SeqID_182510
atggcacctactaggcaccctttggacctagagaagtccaacagggccctggggtttccagccttgatcacgggcctctatcagtcctacggagttcatgtcacccccaacaaggtaatccgactgccgatcacccgagccttcatcgagaagtactccacgcctaggcaggcacagggtgacgcacatcaggatgcacgcacaccgccaccacctcggcaggctgatttggctaggcccctgggcgtggagcaatatctacaacatttggttcgccagcaggcggccaaccaccgtggacaggggcagggttccgctgtttttgtatgccctaccccgaagcagtttggggttgaggtcgcatggcctggagattggcccggtgcccaggcaggggaggagcctgctgaatcccccagtgaggcgaaggaattccatatggatgaggatatgactgacctgctcgatttcttgggaggaagcggagccacatga

SEQ ID NO: 90826 - DNA, 234 bp, Glycine max
  Peptide Sequence Number=SeqID_182511
atgatgattcttcgagcatctcatgtcgatctcataattacatttgccatgcatagcataatattggcaatcaaagcttctattcttgcgaacatagggttgaaccaagcacatgtttttaaggaaaggttcatcaagtcaaggtcaagtatggaagtaaccagcttgcaaaagttggggcagaagatggatcgagttacatcgcttctttgtctactgccaacacatgattga

SEQ ID NO: 90827 - DNA, 852 bp, Glycine max
  Peptide Sequence Number=SeqID_182512
atggtggaggtctccacagaggccattgcctcccttgctcaatattatgaccagcctttgaggtgcttcacctttggggacttccagttaacacccacggtggaagagtttgaagagatcctaggatgccctccgggagggaggaaactgtatcttttctcaggcttctatccctccttgactagaatttccaaaatagtcaaaatctcgacacaggaattggactggggaaagcaagtcgaaaatggggtggttggagtaccaaggaaatgtttggaagaaaaggaaagaaccttggcaagtcaagacgaatgggccccgttcatggacgtcctagcgcttttgatcttcggagtggtcctctttccaaatgtggatgggttggtggacctgacagcgattgatgctttcctcacctttcacaaccgcaaggaaagcccagttgttgctatctcagttgatctatatgacacattcgaccgaagatgtgagaagaacagggcaaggattgtttgctgcacactggccctctacgtgagacacgtttgcccgctagaaggtcaccgctcatgcactgcaaaaaaggaggcaaactgggaccaactcttagcaagcaaagagggagtgtctgtcaattggttctcccgatggaaagaagaaagaaccgggattcttatttcatgcagaggatttccaaacgttcccttaatggggatgaggggttgcattaattacaatctcgtcctcaccataagacaacttggttaccctatgagaggggcaccatcagaggaaggcctcacaccttttattgcgcgaggtttcaatagcaccagcgcgggggtgctttag

SEQ ID NO: 90828 - DNA, 666 bp, Glycine max
  Peptide Sequence Number=SeqID_182513
agagatgtgcagcaccaccgattacaaagttaaatcaatcggaggtatgtgcatcttaatccaaatgtgggcatgggaacgatgcacgactttagctccaaagaggacacctcccgtcatagaaaataaaccacttggacacaggtggctgcgacgtggaaatcagcatatcggcaatgatgatcttagagttttccgtcacaaattggatctgatgaaacaacatgagtttgtctgggagccatacacaccaactgtgatggcagcgttgcctccaatttgtgtgtggcaccatcccgatagggttttacgacaatatggattgcaacaacctatttccgggtgtccttcgcaatcgcagaatctccatggcataacgctcaaaggcaaacaagataagaattggttccacctgttggccccaatcattagtcagtggaacaatgcagctcagtttagggtcgacgtttatcctcgacaggagggcctactgggttttaactcggactacatggtgtggtataggcgtaaaacaaagatgtttgtcgacccaaacaatgcaaacacagctgcattgggtgaagttgtggagactttacagtatatggtgtcaccacaagggaggaacacatggacagttgatgatctcgtgccttacgtggataa

SEQ ID NO: 90829 - DNA, 374 bp, Glycine max
  Peptide Sequence Number=SeqID_182514
atgtcgatctccccttgcgaaagtatcgattggtctgtgctgtcacaacatagtcctatagggtgcccgttccccccagcaaggtcacgccgtcgtgagatagggatcgtgcccgcaagacacccaatggacccaaagaagtcaaacagggtcctggggtttcctgctctgattacgggcctctgtcaattctacggagtgcccgtcacccccaacaaggtcatcaggccccctactaatcgagctttcatcaagaggtactgcgcccctaggcaggcgcaagacgaaacaccacaacagcctggggatggccagcaacaggcaacaaatgcactgccgccacctccagagcccctcagctcatccacaaaaag

SEQ ID NO: 90830 - DNA, 303 bp, Glycine max
  Peptide Sequence Number=SeqID_182515
atgattcaacctcaaactcatttgaatgtagctgataatagcggagcacgcgaactgatgtgtattcgaatcctaggagctagtaatcgacgatatgcttatattggtgacattgttgttgctgtaatcaaacaagcagtaccaaatacgaacttagaaagatcagaaagtgatcagagctgtaattttgtcattgatcaagaaggaaatccaaaaggaactcgaatcttttgtgcaatcgcccgggaattgagacagttaaatttcactaaaatagtttcattagcacccgaggtattataa

SEQ ID NO: 90831 - DNA, 507 bp, Glycine max
  Peptide Sequence Number=SeqID_182516
gtatggcgcctaccaggcaccctctggacccaagataagtccaacagggccctgggatttcccgctttgatcacaggactctgccagtcgtttggcgtccccgtcacacctagcaaggtgattcggccacccatcacccgagcttttattgagaagtactgcacgcagaggcaggtccagggtaatgcaccacaggctgcggacgtgccgccacctcatcaggctggtccagccggattgtttgatacggagcagtatttgcggcatttggttcgccagcaggtggccaaccaccgggcacatagccagggctttacttcttttccgtgccctactccgaaccagttcagggcagaggtcgcatggcctggagattggcctgaggcccaggcaggagaggcaccagcgggggcaccaacagaggctcccgacgaggcagatgaggcccgcgaggacgaagagatgaccgatttacttgatttcttaggaggaagcggggccacatga

SEQ ID NO: 90832 - DNA, 493 bp, Glycine max
  Peptide Sequence Number=SeqID_182517
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcatcaagcttatcgataccgtcgacctcgagggggggcccg

SEQ ID NO: 90833 - DNA, 237 bp, Glycine max
  Peptide Sequence Number=SeqID_182518
atggagttcttggagctcaagcagggaaacatgactgtggctgaatatgcaggcaagtttgaggagctgtttccactcttggttaacatgtgtcggatttgggatgaagactctcgagatagggcgaactactataggagtataggtccgatgaagaacaaaaagaatggacctcaacattggggaaagtcgtacttgaaccctcctaagcaatatggtaaccgccccaacaattag

SEQ ID NO: 90834 - DNA, 171 bp, Glycine max
  Peptide Sequence Number=SeqID_182519
atgagccccgcatcgccctcccgccgaagggtaggttgcgatggtcatgcaatcctccctaggaagggaccagtcactagagtcatgagcaagaggctccaaaaggattgggctagagctgctaaagaaggccctagggttctcatgaacctcaagggctccataatgtag

SEQ ID NO: 90835 - DNA, 453 bp, Glycine max
  Peptide Sequence Number=SeqID_182520
cacctcggtcctccggatttcaagggccgccgggggcgcaccggacaccacgcgacgtgcggtgctcttccagccgctggaccctacctccggctgagccgtttccagggtgggcaggctgttaaacagaaaaagataactctttccggggcccccgccgacgtctccggactccctaacgttgccgtcagccgccacgtcccgatctgcaccgacgaccgctccgcccgggctcgcgccctgggttttgcagcgaccgccgcgccctcctactcatcggggcttggtccttgccccgacggccgggttagcgcgcagttgggcaccgtaacccagcttccggttcatcccgcatcgccagttctgcttaccaaaaatggcccacttggagctctcgattccatggcgcggctcaacagagcagccgcaccgtcctacctatttaaagtttga

SEQ ID NO: 90836 - DNA, 660 bp, Glycine max
  Peptide Sequence Number=SeqID_182521
gatcccactgatctcctccccgaagcttcattacctaacaggtcaacttacaaaagcaatccccaagagactcaacgtaaggatgcacatgccaaagttgagtatgtgaaaagattgtatgaccaagtgaatgtgcaaattgcagagaagaatgaaagctataccaagcaagccaacaagaaaaggaaggaagtggtacttgaacccgatgatgatcttggacatttgagggcaaatgttttccaagaaggagggaatgatgagaatcctgaaactggtcaaatacaggctaaaggcccaagttcacatcatctccttccagaagcttcattgcctaacagaccaacttacaatagcaagccccaacagactcagcataaggatgcacaagccaaagttgagtatgtgaaaagattgtatgaccaagtgaaggtgcaaattgcaaagaagaatgaaagctatgccaaccaagccaataagaaaatgaaggaagtggtacttgaacccgttgatgatcctggacatttaagggcaaatgttttccaagaaggaaggaatgatgagaatcctgaaactggccaaatacaggctaaaggcccaagtggagaaggacgaaggtccaagtggagaaggacaaagcccccgagtggagaaggatga

SEQ ID NO: 90837 - DNA, 249 bp, Glycine max
  Peptide Sequence Number=SeqID_182522
aaagggatagagatagatcccgagaaagtgaaggctatccttgaaatgccggaacaacgcacggagaagcagcggtcctatggaacagtgacttgccaagaggccttcgagaagatcaaacagatctctagaatcccccggcatgaccgcctgtatccccacagtctatggggtatcaatgatgattctttgcgtggcgatcaaaaggacaatgccatcggtatatctggaagtttaccgacattgtga

SEQ ID NO: 90838 - DNA, 168 bp, Glycine max
  Peptide Sequence Number=SeqID_182523
atgaagaatgttcacggaattgatcacggaaacatcacggaagcgttacagaacctcccatgcccttctatagccaaaataggggagaaggttgccgcccagctcgcccaggctagctgttgcttcctccagaaggttcctgatgggcctagatgggcccagggttga

SEQ ID NO: 90839 - DNA, 372 bp, Glycine max
  Peptide Sequence Number=SeqID_182524
atggagagaggcattaaattgatactagctcccaagtctaagagctttgcctacatcaacctcaccaatagaacacggtatcgtgatgatggaagcttgcttgtggggcttctatggaggctggatcttttagcttcaatgaggtcctttaatggtgattttccaccatggagatgcagcagaagacaaaggagaagaggtgagaggaggcgccatccactagggaataagccatggaagaaggagcttcaccaccaagatgagccttggataagaagcttggaaggatgcttcaatggaggaaaagaaagagggagagaaagagagaggggggagcacgaaattgaaggaataaaagagggagagaagtag

SEQ ID NO: 90840 - DNA, 234 bp, Glycine max
  Peptide Sequence Number=SeqID_182525
atggcttcctcgaatggaaattttccaacatctatgtctgttctcataggcaagaactatgatgattggtgtgctaaggtgaatgtaatctttcaatttcaagatgtgacaaaagtggtgcaagaaagggttcaagaacctgaaaagaacccagctgatgcacagaaggtggctcatcgtgatttgatgaaaagagatgcaaaggcttggggatcaactgaagcattcatttaa

SEQ ID NO: 90841 - DNA, 574 bp, Glycine max
  Peptide Sequence Number=SeqID_182526
atgagtcatcattcatctagtgttaatggcgaggatactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaataaaaataatgaaagaaatgaaaagagaaaaagatgtctcctatagtagtcataactcttgcaagagcctaagtgaagaacttcatgactattacgaaggaaggcataggtcacatcttagacctcactcccatagaagagaaaaggaaagaaagcctcaagaggctaacattaacctcccatacttccatgagaaggacaatgtagaggctaacttagtttgggaaataagggtagagcaacaacttaaaaagaagtctacgtcaaaatcttatggctctcactcttatccaaagaaaaaccaaggtcaaggcatcttaggggtgacaccttctaagcccaaagatgataaggggaagacaatagaaaagcaagcccctaaggcta

SEQ ID NO: 90842 - DNA, 339 bp, Glycine max
  Peptide Sequence Number=SeqID_182527
atgtgtatacacctgaagggtgaacgctgtgaaaattttcccgaacgcccgaaatggactcggggtgagaatgtcaatccttaccctcggaagcaaaaaagaagagaaggaaaatttccaatcaaagaaaaagagaaggaaaatttccaatcaaaggaaaaaaaaggaagcaaggaaattcccaatcaaagagtgggagaaagcaaaaagaaaggaaagaaaattccaagtcaaaggaaaaagaatgggaaagctcctggtcaaagaaaccagaagaaatgtgcagagaggtctttggaccggacaatatctgaacaatacaaaattgtcaccaaatga

SEQ ID NO: 90843 - DNA, 264 bp, Glycine max
  Peptide Sequence Number=SeqID_182528
atggtaatcgattaccagagagtaaaaactctttgctttgcttctacaacgggcggcccccattttgtgcaagttcaaaacaagcattcttccccaccatatggcttggctcccaaccatacaccgcccaatgttgcacacactcccatgaggatgtcgacaactctgcacccatacccattgagagccaacaaccccaagctgatcatgtacatgtccttcaactcatgggggagacacatgaaataccccaccgcaatctag

SEQ ID NO: 90844 - DNA, 733 bp, Glycine max
  Peptide Sequence Number=SeqID_182529
ttgctgataacacaggtgctaaagaagtattggttatcagagttctgggaggaaccagaagaagatatgcttcagttggtgataaaatcgtagttacgatcaaagattctacaccatcaggaaatgctaaaaaaggtcaggtatctaaagctgtagtagtaagaactaaaaaagcagttagaagaaaagatggatcatacatcaaattcgaagataacgcttgtgtattactaaacgcagcaggagaaatgagaggaacacgtgttttcggacctgtggctcgtgagttgagagacaaagaatatatgaaaatcatttcattagctcctgaaaaagatatcaaaggtaagactggtgaagttattgaagtgatcaaaaaagaaggtagagaccctagagtaattgttgcaggacttaacatcattaagaaacacgttaagccttcagcttcaaatcctcaaggaggaatcgttgaaagagaagcttctattcatatctcaaatgtagctttagttggtaaagacggtaaagctgtaaaagtaggttacaaaactgaaggagataagaaggtgcctaaattggaaaaaatcatcttatctcaaggattaggtgatgctactgcagacaaaaagatcattgattatgctgtagaagaacttacaaacattactggtcaaaaggccgtaggtactatctctaagaaagacgaagctgctttcaaattgagaaaagg

SEQ ID NO: 90845 - DNA, 261 bp, Glycine max
  Peptide Sequence Number=SeqID_182530
atgaggcaccaaatccctatgataggtggtatgatgaatgtgttaagtggtgcaaccctcttttgtaaaatcactcatgcacccaacatcttcatgatttgtgtacatagggactcattaggtaggaataatcaacatgaaaataaagaaaaaggtgttgaggaaagaatccctaagtttcaagaacctatggatttgaggtcaaatccttttcaagggggatggaatgatgcaatcctaccccccaagggcattggatag

SEQ ID NO: 90846 - DNA, 801 bp, Glycine max
  Peptide Sequence Number=SeqID_182531
atggctcgctctttctctaacgtcaaggttctctctgctcttgtggccgacggattctccaacactctcaccaggcgtgggtacgcagcagcgacacaaagcgcaacaagaggaggagctgcctccatcagcagcaagatagctcccaagtcaggggaagacaaggtaggaggaggtgctgaaaaggtttcgtgggtcccagaccctgtcactggttactacaaaccggagaacatcaaagagattgatgttgctgagctgagagccacgggagggttttccgtttctcaatttgagtttcctaattcgaaaaccatcgcaatccaagccgctaccgcactgcggggagacgaagaagttatcgaggggaaaggaagcggaggcgacgccgacggagaaatcgagatcatcgccgaaacgaacgacgtcgagaatgctgagccagaagaagaggatcttcacgctaatcccccggagttcggtgagcctgccgtcggatacgtagacggtgatgattttctggtaactcagctggtacgaaccttcgagggagaaactgcacgaaccgttcagatcggcgtggaattttccgctggacgggtccagctcgtagccggtcactcttttcgggagaatgcctgccggaaagtgaaagctctccagcatctcgtacgccgtcggggcgccggtggcggtgaccgccggaggaggaggaaggcggggttggggtttggggactctggtggcttcaatacttcacggttttgtatgttctgggatgatggaatggagggggactaa

SEQ ID NO: 90847 - DNA, 816 bp, Glycine max
  Peptide Sequence Number=SeqID_182532
atgagttgtgcgcggttaggtgcacttgagcatgggaagtgggttcatgcttacattgacaaaactgggatgaaaattgatgttgtgttggggacttctttgattgacattgccatgattactgcttttgctatgcatggactctcagaggaatgccttgaactgtttgcgaggatggtaaatgatggggtgagaccaaatgctgtgacgttcgtgggtgttctttgtgcttgtgtgcatggagggttggttagtgaagggaatgaatatttcaagaagaggatgaaagagtatggtgttagtcctaccattcaacattatggttgcatagtggacttatacagcagagcaggtcgtattgaggatgcttggagtgtggtgaaatcaatgcctgtggaacctgatgtgatgatatggggagctctgcttagtgggctaggatgcatggggacgttgaaacttgtgagggaagtgaggcatttgagagatggaggtccggggaatcaagaaacttccaggaggttggaaaagcatggttatgaacgtaacactggggaggtattacttgatttggatgaggaaggaaaggagtttgcattgtcccttcatagtgaaaaactggcaattgcatattgcttcctcaggacaagcccgggtaccacaattcggattgtgaagaacttgaggatatgtagcgattgtcatgttgcaatcaagatgatatctagggaatttaattgggagattattgttagagattgcaaccggtttcaccattttaagaatgggctttgctcctacaaagactactggtaa

SEQ ID NO: 90848 - DNA, 1437 bp, Glycine max
  Peptide Sequence Number=SeqID_182533
atggaagcagagaagcatgaagcagcattggcagtggcctcagtctccctctctctccccagagttttgcccttcttccaacccaccacccctcagccaaccaagctcaaagtcccaacccaggcctcatccctcacacacctttctctctccactccttccaaaacctccttcaaatccaccatctcctccaccccccttcacgcccctctctccctcggcccccaccgcccccgcgacccctccaacgccgccgccctccgccgcgccgcagtagtctggttccgcaacgacctccgcctcctcgacaacgagtgcctcaccgccgccaacaacgagtccctctccgtcctccccgtctactgcttcgaccccgccgactacggtaagtcggcctccggcttcgacaagaccggcccctaccgcgccgccttcctcatcgactctgtctccgacctccgccgtaacctccaggctcgcggctccgatctcgtcgttcgcgttgggaagcccgaggcggtgctggtggagctcgccaaggccgtcggggccgacgccgtgtacgcgcaccgagaggtctcgcacgacgaggcgaaggcggaggagagggtggaggcggccatgaaggaggagaatgtggaggtgaagtacttctggggaagcacgttgtatcacgtggacgatttgccttttcaattggaggacatgccttccaattacggagggtttagggatagggttcagaaattggaggtaaggaagacaattgaggcattagatcagcttaagggaatgccttctcgcggtgatgttgagcctggggagattccttctttaatggacctaggccttaatccatctgcaacaatgtcacaggttatcattgtgcagaatggaaagtgcgttgctaatgcttctatggtaggaggggagactgaggcactgcagaagcttaaaaaatttgcagctgagtgtgcagctcagccacacaaggggtttaaggatggaacacagagtatatatggtgccaacttctcctgcaagatttctccgtggttggcaatgggatgcctttcccctcgcacaatgtatgaagaactgaagaagactgccggcagagtcatttctgcttcgtccaaccggaatgatggtggtaatggctcgtccagaactggaacaaattggttgatgtttgagttgctatggagggacttctttagctgccaccatgacatagggttcggtaatccatttttacccgtaattttcatcattgtttggggttttttagtttttgaatggtgtacttgtctaagtttaaaattagaagtatctcattcccctaacctagaaatgtttataacaaaaaaatacagtactgcaaagaaacagctggaagctgctccagccactgcatgtgctggtgcatttgcttaa

SEQ ID NO: 90849 - DNA, 282 bp, Glycine max
  Peptide Sequence Number=SeqID_182534
atgagcggagcgaaggggaagaagaagggagcgagcttcgtgatcgattgcgcgaagccggtggaggataagattatggacattgcttctctggagaagttccttcaggagaggattaaggtcggcggcaaggccggtgcactcggcgattccattaccgtcaccagggacaagagcaagatcaccgtcacctccgacagcaacttctctaaacggtactctcttcaccatgctcctcttgctgagatatttcggagaatagatctaggaccctgttactga

SEQ ID NO: 90850 - DNA, 576 bp, Glycine max
  Peptide Sequence Number=SeqID_182535
atggaaggaggagggacctggctgcaagacagtgtccgaagctgctacgacgagggaaagcgtacggccgagacgttgaccatggactaccaccgaggtgccggcgtcgaggttagaattgctagaatctttaacacctacgggcctagaatgtgcttagatgatggtcgtgttgttagtaacttcgttgctcaggcactaaggaaggagcctctgaccgtttatggagatgggaagcagacaagaagtttccaatatgtctctgatttggtggagggtctaatccgccttatggaaggagaacacgtgggacctttcaatcttggaaatccgggagaatttacaatgctagaacttgccaaggtggttcaagaaacaatcgaccctgatgctaggatagagtacaggccgaacacagaggatgatccgcacaagagaaagcctgatataagtagggctaaggatcaacttggctgggaacccaaggttgatctgcgcaagggcctcccactaatggtttctgacttccggcaacgcatttttggtgaccagaaggaaaaggcaaccgtagcctaa

SEQ ID NO: 90851 - DNA, 249 bp, Glycine max
  Peptide Sequence Number=SeqID_182536
atgatgggtggaatggcgcggcgctgtaggaaccggtcggattccaaccgacgaatagaagtcttgcagactcatgccttagccacttggctacggttccctatcaattccatgtctttctcccttgtcctactttgcttcacagaatataacaaatcaatatgcttaacaccccccctccccctacaactcaagatgcctcaagggataacatctggagtttggatactaagtatcggaatcgcatag

SEQ ID NO: 90852 - DNA, 422 bp, Glycine max
  Peptide Sequence Number=SeqID_182537
atgaggctaagtcatgaagtgctaaaagtgacagttgagcttagctcatcagttgggctaagtgcagcttcagtgcacttagcgcgccagaagaatctggcaaagcatcaatatctaggtctcgcgctaagcgcgagatcagctactccatttgaatgcaaggatgtaccttatccgttggtaccctctcggaaagataaagagcgacatttggccagattgcttgatatcttcaagaaactggaaattactatgccatttggagaagcacttcagcaaatgcccctctatgccaaatttttgaaggatatgttaaccaagaagaaccggtacatccataatgacagaattgttgtggaaggcaaagctctcatagacttgggagctagtatcaatttaatgtggaagcaatgtcttccaag

SEQ ID NO: 90853 - DNA, 1191 bp, Glycine max
  Peptide Sequence Number=SeqID_182538
atggtagaagtccccatagaggccattgcctccctcgcccagtattatgatcagccgttgagatgctttacctttggggacttccagctgtcacccatggtggaagaatttgaagagatcctaggatgtaaaggcgaatgggccccgttcatagacattctcgcactgttgatcttcgaaggagtccactttccgcatgtggacgggttggtggacctagcagcgatcgatgcttttctcgcctatcatgaccacaaggaaagcccggttgtcgctatgctagccgacctatatgacaccttcgaccgaaggtgtgagaagagcagtatgaggattgtttgctgtactccagctctttatgtatggttggtttcacacctttttcgccaagaggtaaggcatgcttgcccgctagaaagtcaccgttcatgcacagagaaaggaggcgcaaattgggaccaactcttagcaaacaaagaaggagcgtctatcaactggttccctcgatggaaagaaggaagaatcggagttcttatttcatgcggaggatttccgaatattcccttgatggggatgaggggttgcatcagttacaatcccgttcttgctataagacaacttggctaccttataagaggggcaccactagaggaagagctcgcgcctgtcatttcacgaggtttcaataagaccaacatggagacacttcagaaggtccgcaaggcatgggaggtgttgcaaaagaaggacaaggaactaaggggaagtaacaacggtcccatcggcggctaccataagtggttgaaagtccacatgcaaggtttggaatggctcccgagtttgagaaccactaatggttctcaaacagtcaaagaaaggttcaaatcagcagctcttaaaatcctaaaggagaatgccgaactgagagatataaatatagctaccaccgaggccttggaacaagagaccaagagggctcgtagggaagagcacagtcagaacaagttccaaggggctctgtggcgcaacaacagcgagcttaagctctggagagaggaaatggaccaatcacgagtagacagtttgatcttgaaagatgagttgaaggtttgctcaaggtccaaaagaaacctgtctcagcggttatgcgagacaaagaccaacatgttagctatcatccgcaagtactaa

SEQ ID NO: 90854 - DNA, 944 bp, Glycine max
  Peptide Sequence Number=SeqID_182539
atggctccgaagaagctctccacgaagaggtctagaaaggacgccgctggagaaggctccagtgccaccttggagtttgatagtcaccggttctggagtgtcgagcaccagcagcgcttcgaggccattaagggatggtcattccacagggaaatgcgtgtccagctcagggaggatgagtaccctgacttccaaggagagatagctcataggcattgggcacgactagtgacccttatgtctaaatttgaccaggagatagtaatagaattctataccaatgcctggcccattgaggagggggttcgggacatgcgctcgtgggtgagaggtcactggatccccttcgatgcagatgccctcagccagttcttgggtgactcgctgattttggaggagaaccagaggaaccaggttgacagcttcgatgaagaggccatcacccagctgcagtgcataccggggcaggatttcgcccggaccgctgcgtggaggcgggtgaggatcatgcgcaccagcatgactaccctgacccagatgtggatgacactgctgctcagcaatgacttgcctagtgaccacaactccgacctccctttgcctaagtgccagttggcgtatgccatccttacacggatgagcgttcacgtggcccaggtgattgctgacgccatttatttgtttgcaggaatggcacctactaggcaccctttggacccggaaaagtccaatagggccctgggatttccagttttgatcacgggcctcttccagttctacggagtgcatgtcacccccagcaaggtaatccggccgccaatcacccgagccttcatcgagaagtactgcacgcctaggcaggtgcagggtgacgcacatcagaccgcgggtgcatcgccaccacctcggcaggccgattcggctggaccactgagtgtggagca

SEQ ID NO: 90855 - DNA, 822 bp, Glycine max
  Peptide Sequence Number=SeqID_182540
atgggactcatctggctcaacgagggatcatgcaggctcctcccctgcctgggcatcgggccagtctccaagccatgcaacctcacccccaaactgctccggagtagggcacgcaaaaggggcggaaccctgcccccgttgactgaggctgaactggtagagacacttgtgtatctgcacctacccacggtggttggccacctgctggcgaaccaaatgctgtggtggcggtatgtttgcggcctgatgttcatcaccctacgcctgcctaggcgtgcagtacttctcgatgaaggcctgggtgatcggtggtcggattactttactgggggtgacgggaactccgaagaactagcagaggcccgtgatcagtgccggaaaccccagggccctgttggacttatttgggtccagagggtgcctgttgtgatcgctaggcaagacattgctgagcagcagtgtcatccatgtctgggtcaaagtggtcattctggtgcgcatgatccacacccgcctccttgtagtggtccgagcgaaatcctgccccggtgtgcacaacagctgagcaacggcttcctcatcgaacccgtcggccctgttcctcttctggctgaactcacactgctggccttcctccaaactagcgagtcaccaaggaactggataagggcatctgcgtcaaagggaatcactgacccctcacccacgaacgcatcggcgttcaacgtctgcgagctgtctcctcctgaaagtccggatactcatcctcctgagctgacattgcctttcctggcaatgacatcctctgatggcctcaacgct

SEQ ID NO: 90856 - DNA, 476 bp, Glycine max
  Peptide Sequence Number=SeqID_182541
aaggaagaaccgggattcttatttcgtgcggggaatttccaaatgttcccttgatggggatgaggggttgcattaattacaatcccgtcctcgccataagacaacttggctaccctatgagaggagcaccattagaggaaggcctcacaccttttattgcacgaggggaagtagcaatgggcccgcccatcggcggttaccgtaggtggttgaaagcccatgcacaaggtctggattggctcccgaatttgagaactactaaagaagtggagggtgaagctccggaagaagatgaagagaacgccgaactgagagacatcaacatagccaccatcaaggccttggagcaagagaccaagagggcccgcaaggaagaacatggccataacaagtttcgaggggctctgtgggggcaactccaagaggcttgggctagagctactaaagaaggccctagggttctcatgaaccttagg

SEQ ID NO: 90857 - DNA, 162 bp, Glycine max
  Peptide Sequence Number=SeqID_182542
atgactggagatgcatcaaagtttacatatatctctcccaagaaaagcgggcatgtaacttatggtgacaacaacaaaggtagaatccttggagttggtcttaagcacaacctacttagtgttagtcaattatgggtgacaaagctgatagtgatcttctga

SEQ ID NO: 90858 - DNA, 459 bp, Glycine max
  Peptide Sequence Number=SeqID_182543
ggtagcaacagcgagcttaagctccagagagaggaaagggaccaatcaggagtagacagtctgatcttgaaagatgagttgaaggttttctcaaagtccaaaagaaacctgtctcagcggttatgcgagacagagaccaatatgttagctatcgtcagcaagtaccaagaagaattaaatctagccacggcccacgagcataaaatggcggacgagtatgcccgagtgtacgcggaaaaggaggctagaggaagggttattgactcattacatcaagaggcaacaatgtggatggaccgattcgctcttaccttgaacgggagtcaagaacttccccgattgctagccaaggccaaagcgatggtggacacctactccgcccccgaggagatccacagacttctcagctattgtcagcatatgatagacttaatgacccatataattagaaaccgctag

SEQ ID NO: 90859 - DNA, 1150 bp, Glycine max
  Peptide Sequence Number=SeqID_182544
tgaacgccgccgatatggcggtggcgctggtggcgctgtgggtatcgcgctgagcggccaaccgagtttcagcgccggttttatcttcatgcgccgtaccggatcggccgccctgtgcgccgccgggccagtgatcaacgtactgccgatggagatgcatctcgagccgcaggccacgctgtatgaggccgccgcccgcatcagccgcgagctgaaaacggtgcgccgccatcagcgctacgacgccgagcaggtgcagcgcgatctggggcgcatcggcgacggcgaaccgctgtacggcacggtcttcaacttcaaaatgttcgattaccagctggatttcgccggtatcgaaggcatcactcacgatctggcctccgggccggtgcgcgatctggagattgcgctgtttatcgacgaacaccatcagttgaaggtggaactgctggccaacgccgagcgttacggtcgccaggaactgcaggcgcacctgcagcgactgccgctgctgctggcgcagttcgccgcgcaggcaacgttgccgatcggcgaagccgatatgctgaccgccgacgatcacgcgctgctggcgcgggtcaacgacacggcgcacccggtgccggcgaccacgctgagccagttgctggcgcagcaggcgcaaaccacgccggacgcgccggcgctggcggatgcgcatttcaatttcacctaccgcgaaacgcgcgagcaggtcatggcgctggcgcgtgagctggttgcgcagggcgtgcggccgggcgacatcgtggcggtggcgctgccgcgttcggtgttcctgtcgctggcgttgatggcgatcgtggaagcgggcgccgcctatctgccgctggacaccggttatccggacgagcggctggcgatgatgctggaagacgccgcgccccggctggtcatcaccaacccggcgcagcaggcgcggttcgccgacaagggcgaaattttgctgtatgacgcgccgctgccggccgaccacgccgccggggtggcgatcgcgggcccgacgccgaaccatgcggcctatattatctttacctcccggctccaccgggcgtccgaaagcgtgctggtcggccatcagcgatcgtcaaccgtcctgctgtggatgcacaca

SEQ ID NO: 90860 - DNA, 234 bp, Glycine max
  Peptide Sequence Number=SeqID_182545
atgactcactataatccttaccctcggaagcaaaaaaggaaagaaggaaaatttacaatcaaagagaaagcaaaaagaaaagaaaggaaattcccaatcaaagagtgggagaaagcaaaaagaaaagaaaggaaattcccaatcaaagagtgggagaaagcaaaaagaagagaaagaaaattcccaaccaaagaatgggagaaagtaaaaaaaggatggaaagaaagttcttga

SEQ ID NO: 90861 - DNA, 597 bp, Glycine max
  Peptide Sequence Number=SeqID_182546
atgactccgaaaaagctttccgcaaagagatctaggagggacgccgcggttgaagggaccagtgctgcccctgagtttgatagccaccgtttcaggagcgccgagtaccagcagcgcttcgaagccatcaaaggatggtcgttccaccgagagagacgtgtccagctcagggacaatgagtacaccgattttcaggaagagatagctcgccgacattggacgtcgctggtcactcccatggctaaggttgacctagatatagtcctagagttttatgctaatgcttggcccacagaggagggagtgcgggacatgcggtcatgggagtgcgagtttagtcagaggaggaacagggtcgatgggttcgacgaagaggccattggtcagctcttatgcataccgggtcaggatttcgctcggaccgctgtagagaggcgggtgcggatcatgcgcaccagcatgaccaccttgacccaaatgtggatgacattgctgctcagaaatgtcttgcctagtgatcataactctgaccttcctctgctgaagtgtcagctggtgtatgccatcctgacacggatgagtgtccatgtggcttag

SEQ ID NO: 90862 - DNA, 162 bp, Glycine max
  Peptide Sequence Number=SeqID_182547
atgaacggatggactgaagtggtgcgcttagtgggattacccttcgctcagtgccaatgcatagctcatccttcttctagattcttcctcacgctcaacaaaggagtgttgcgctcagcggatggctcgctaagccagaagattggcttagcgagaggttga

SEQ ID NO: 90863 - DNA, 531 bp, Glycine max
  Peptide Sequence Number=SeqID_182548
atggatgggttggtggacctagcagcgatcgacgcttttctcgcctatcatgaccataaggaaatcccgatcgtcgctatgctagctgacctatatgacacgttcgaccgaaggtgtgagaagagtggtacgtggattgtttgctgtactcgagctctttatgtatggttggtttcacacctttttcgccaagaggtaaggcatgcttgcccgctagaaagttaccgttcatgcacagagaaaggaggcacaaattgggaccaactcttagcaaacaaagaaggagcgtctatcaactggttccctcaatggaaagaaggaagaattggagttcttatttcgtgcggaggatttccgaatgttcccttgatggggacgaggggttgcatcagttacaatctcgttcttgctataagacaacttggctaccctatgagaggggcaccactagaggaagagatcgcgcctgtcatttcacgaggtttcaataagaccaacgtggagacacttcagaaggtccgcatggcatga

SEQ ID NO: 90864 - DNA, 271 bp, Glycine max
  Peptide Sequence Number=SeqID_182549
gtaatccttgtggcgtctacccagacttatcttccttcaccggaagtggcgtctacccagacttatcttccttcaccggaagtggcgtctaccctaacttatcttccttaaccggaagtggcgtctaccctgacttatcttccttcactggaagtggcgtctacccagacttatctttcttcactggaagtggcgtctaccatgacttatcttccttcactggaagtggcgtcatccaaaccttcgtagcctgtatcaaacgatccgcccc

SEQ ID NO: 90865 - DNA, 398 bp, Glycine max
  Peptide Sequence Number=SeqID_182550
atggaggcccgaaacacatatgtttcacatgagatgtggagagtgtacaattactcttcaagatgtctcagtattattaggtatgcgtgttgcgtgttgcgtgttgacggggtaccattaattggtcaaactaatcttgattgggctgaattgtgtgaagaattattgggagtcagactacaggaaggtgaactccaaggcaatgtcgttaaattaagctggctggctcatcatttttcacacatcaataaccatgacgggaacgtagaacaattacaatggtttacccgtgcatggattcttagattcataggaggagtcctatttgttgacaaaagcagcagcaaagtttccctacggtacctacaatttttacgggactttgagcagtgcagcac

SEQ ID NO: 90866 - DNA, 441 bp, Glycine max
  Peptide Sequence Number=SeqID_182551
atggttaaggaggagtgtaaggaggtaagtgtctcctccaagaggttagctaagaaggaaagtcattttgaaataaagacaaatattaaagaaacttcccctcttggacaacctccacatattctcctttgtaaaaagacacttgttagcactgtcacacctcttgggcttgaggttattcctcaagtaaaggagttgttggatgagggtttggttcgtattattaggcaccaaatccctaaaataagtgatatgatgaatgtgttgagtgttgaaatcctctttcgtaaaattagtcatgcacccaacattttcatgagtcatgtacatagggactcagtaggtaggaataatcaacatgaaaatatagaaaaagtgatcaaggggttcccacggaccctaagagaatataggtcattcctgaatggcctactccactaa

SEQ ID NO: 90867 - DNA, 156 bp, Glycine max
  Peptide Sequence Number=SeqID_182552
cgccgaggtgggtcgttacaggcgcagggcgaggcaccacagcagcctggggacggccagcagcggacaacagacgcaccgccaccacctctagagtccacctcaactcatcttcaaaggctggagagtttcctacgacacatggtcgaccagtag

SEQ ID NO: 90868 - DNA, 564 bp, Glycine max
  Peptide Sequence Number=SeqID_182553
atggttgatgtttcaccaatcaaggctaacatagtggaacagattcgaacaactggactcttcaaacacgtcacaaggtggttggattctgaaagttcatgttgtaatactttagcaaaccttggtgacaaagatatgttaccagcacttgttgtcagtgtttgctgccaagcagcagatcttttgactatttgtgggaagctaaaaactcttactgagagtaccatcagagaaagagctttaacagcacagcatagttccatgatcactatctcaaaatttgagtatgagtatctaacaaatcatgcagcctcagtagaagaaattgctgataaaaaagtagcagcagctgaggcatggattgaagctctcaaggccagcgagaaggaaataatgatggaaacaaaaatagctcaaagacaactcaaagaatcaaaattggagcaagagctggaggtttacaccaaagagaagatgctttcaagaagagttagtagtagtgaggagcttgacaattggccaagaaaatgcgagaagagttcatccaagaacttcatagtttaa

SEQ ID NO: 90869 - DNA, 888 bp, Glycine max
  Peptide Sequence Number=SeqID_182554
atggccaagttcgacccagatatagtcctcgaattttatgctaatgcttggcctacagaggagggcgtgcgagatatgcgatcctgggtgagggtgctggaggagggccaggaatgcgagtatggccagagaaggaaccggtctgatgggttcgatgaggaggccatcgcccagttgctatgtatgccggggcacgattttgcccggattactgctgggagatgggtacggatcatgcgcaccaacatgaccaccttgactcagatctggatgactttgctactcagcaacatccagcccagcgatcataattccggcctccccctgccgaagtgtcatctggtgtacgccatcctgacacggatgagcattcacgtggctcagttaatcgctgatgccatctatctatttgcaggtacggcgcctaccaggcaccctctggacccggataagtccaacagggccctgggatttcctgctttgatcacaggactctgccagtcgttcggagtccccgtcgcacccagcaaggccacagacgcgtcaccacctcatcgggctggcctagctggatcatttgatacggagcagtatttacggcatttggttcgccagcaggcggccaaccaccgggctcatgtacagacccatgattgtctttaccagatgagcctcagcctgcagagccagggttttacttcttttccgtgccctactccggaccagttcagggtagaggtcgcatggcctagagattggcctgaggcccgggcaggagaggcgccagcagaggcaccagcagagactcccgacgaggccgatgaggcccgcgaggacgaggagatgaccgatttactttatttcttaggagggagcggggccacatga

SEQ ID NO: 90870 - DNA, 378 bp, Glycine max
  Peptide Sequence Number=SeqID_182555
atgttgattgatgttggaaatgcattggcatgtgcatgttgtgtatgttcgtggagggcactgtgcactgaccttccagggtctttggcactagcttttggtcacgttcatacgttggatgttgtgtatgatcgtggggggcactgtgcactgaccttccaggggggcttgtcacctggtagggaacacctttgggctcccaagctgatcacctatgggaggggggatgctacgtgcacaaccgggtggtctcgacaaactcatcacagttccctaagtgagagtgtcgtgtggacacgcttaggctatttcctgagatttggttgttgttgtcttgattgggtccatggatggatgatgagtaattgttggatgtga

SEQ ID NO: 90871 - DNA, 273 bp, Glycine max
  Peptide Sequence Number=SeqID_182556
atggggttgaaccaagcacatgcttttaagaaaaggaaagagcgtgctttacggcacccttaccgaacgcatgccagatctagagtgattagtgaaatagaggaggtgcaagagcagatgaaggccgatatggagcccatgaaagagcagatgaccacaatgatggaagccatgatgagtatgagaaaaatgatggaggtcaacatgtctacagtcgttaccgcaagtaccgccactgaggttgacccaactcacccatctagcctcaatcaa

SEQ ID NO: 90872 - DNA, 924 bp, Glycine max
  Peptide Sequence Number=SeqID_182557
atggctacaccacccagcttccctcctcctcctcctgagtcagcaacaccttcacagtctacatcaaagaagacaagaaaagaaacacgactcagatcattggctactagaccagttggggcggagagaccagtggttcatgtggatccttggaaaaaagaaaagttgatggaggaagtagcccaatcggagagcactaacacaagcattgatcctccatctcccattagaccacacgtgaagtggaagatggcccgcatgaaaatatctggtcagataacgtctcatgctacaaaggaaagaattggttccctggaagagcaggcctcacagggaagctttgttgcccatggacgtgaggatgtactgactattgccattgtgccaccagagcaccctagtcgtgtccgtgctgccggagtcggtgtcaccataaaaaaaataccttggaccggcttcaaggagctccccacgtcttcgtccatggctcctgaagacctagagcagttgacacaaaaaattggggaccagttggaggagtcaatcacagaaaaatcagatgcaatcataggacttgcaccgcctcctaaggttgaggttagtccttctactgcttgtgtcaatacaatggaaatttatgtcgatctctcaaggcaggacccagaaatgggggactcaggcaaattttatgaggggtcgacgaccgtctacaacgttcctttaggaaatgatcaagtgaaggtcgatgttgaggaagttcgagatgttgatgctcacattacaggagctgagggaccagcgaaacctgtagataggtcgaatcctgatgtcaatctcctatacttgatgacattaaccatcttgcagcttttcaccaagctattgcaagtgtcgtgggatgcaactgtgtttgggggtgtataa

SEQ ID NO: 90873 - DNA, 177 bp, Glycine max
  Peptide Sequence Number=SeqID_182558
atgtggcaatggggtgtagattgcatcactaacaatgtcgagggtacagaattgctaggggaggggcgtagtgggaggccgcaagggctggtagacttgttgttgcagtgggggctagggcttcttgaaaatgatgaagatgggttttatgaaatggcgacattgaggggagagtga

SEQ ID NO: 90874 - DNA, 1065 bp, Glycine max
  Peptide Sequence Number=SeqID_182559
gtggagagcactactatagagaaggaagagcttgcaaagattgttgctgacctccaggcccagttgaaggagtcagagtccaaactggaagagtccgagctcagggcgtcaaagggtagggaggttagtaaagagcttgaagaagagttgttggtgttaaagaaagagaccatggagcagcatgaaaatggattttataaggccgtcagggatcttgacttaggtattttttacccaacaaaggacatgaaggacggtgaactacttcgtgaagaagaaatagttgctgcaaaggaggtggaccttgggtttgatgagcctttggagatgcgagactcaccaagggcagaccttgggtttgacgagcctttggaatgtgagacacaccaaggggtagactttgagtttgacaagcctttggagatccatcgaggctcgccaagggcagaccttgggtttgacaagcctttggtgatgcaagactcaccaagggcagaccttgggtttcacaagcctttagagaagcgagactcaccaagggaggaccttgggttggacgagcctttggagaagcgagactcaccaagggcgaaccttgaatttgatgagcctttggagatgcgagactcaccaagggcagaccttggatttgatgaggctttggagatgcgagactcaccaagggtggaccttgggtttgatgagcctttggagaagcaagacttgccaaggcagactttgagtttgatgagcctttggatatctgtcgaggctagccaagggcagaacttgggtttgacaagcctttgcctttggagaaacaagattcaccaaggacgtaccttcgatttgatgagcctttggaaaagtgagacttaccaagggcggaccttagatttgacgagcctttggagatgcaagactcaccaagggaaaaccttgggttcgacgaacctttggagatccatcaaggctcaccaagcggaccttgggtttgatgagcctttgaagaagcgagactcaccaagggtgaaccttgggtttaacgagcctttgtatggttga

SEQ ID NO: 90875 - DNA, 111 bp, Glycine max
  Peptide Sequence Number=SeqID_182560
atggcgaaaggactctacagactcaagatgattcctatcaagtctaagtacaagtttgattttgctggttctagcattcccaatttttctgccttttcattcaaaggctga

SEQ ID NO: 90876 - DNA, 192 bp, Glycine max
  Peptide Sequence Number=SeqID_182561
atggcggtaatgcgcactgaatcagataccaaggaagggggcaaaagggtctttttcttgatttttctagaccccagctcgcccaggctagcatctggcttccctcggccatggaattacctcctggataagcaaccagctcgcctgggcgagctcattacttcagggttaaggttcagctcggcagggtga

SEQ ID NO: 90877 - DNA, 501 bp, Glycine max
  Peptide Sequence Number=SeqID_182562
atggtagccacggcataccaaacatcccatgagtgtctagaagaaacaattgtagacattcttgtggcaggattctctgtttggaaagataggtcagcagaattactatacaatcttaagtgtaggactttggcagactttaggtggtacagagacaccttcctgactagagtttacactagagaagatagccaacaacctttctggaaagagaaatttcaagccggacttccaagatcattaggcgataaggttagaggtaaaattcgtagtcaatctatcaacggagatattccatatgacaatttaagttatggacaattaatttcctatgtccagaaggtagccttaaaaatttgtcaagatgacaaaattcagagacaactagccaaggagaaagcccaaactaaaaaagatttagggtctttatgcgaacaatttagggtttccagcttgtccaaaacaaaagaaaaaacaaaaccccaaaaaagaatttcatga

SEQ ID NO: 90878 - DNA, 306 bp, Glycine max
  Peptide Sequence Number=SeqID_182563
atggcattgcctggcgctgttcatgcatcctccaccttcgagcctgcagccccgcgaagttattgcgtagtgttgttcggcaattctccattctccgctttttttcgaagccccatgaatgtcatttccaagcgctgttcatgcatgctccaccaacgagtctggagccccgcgaagttattgcgtagcgctgttcgccaattctccattctccacttttttatggagccccatgaatgtcattgcctagcgctattcatgcatcctccacctacgagtctggagcccagcgatgttattgcgtag

SEQ ID NO: 90879 - DNA, 372 bp, Glycine max
  Peptide Sequence Number=SeqID_182564
atgatacgcggagataccttgcggttatctgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgcggcgggcccgatgatacgcagagataccttacggttatccgcacccttttgtcatccagaggcggcgggcccgatgacaagcagaggccaagtttggtcattctgcacccttgtatcatccagaggcggcggggccgatga

SEQ ID NO: 90880 - DNA, 129 bp, Glycine max
  Peptide Sequence Number=SeqID_182565
atgactaaagcacgtcaaaagggggtacggaaaataccaggagggttgaatattttgttctaccctcctccccctattaataggaaaaagagggagaagcttgccacccagctcgcccaggcgagctag

SEQ ID NO: 90881 - DNA, 729 bp, Glycine max
  Peptide Sequence Number=SeqID_182566
atggccgcgttatcgcgcgtccgtttatcggcgacaaaagcgggtaatttccagcgtaccggtaaccgtcacgacctggccgttgagccaccggcgcctaccgtgctgcagaagctggttgatgaaaaaggcggtcacgtggtttccgtgggtaaaatcgcggatatttacgccaactgcggtatcacgaagaaagtgaaagcgaccggtctggatgcgctgtttgatgccactatcaaagagatgaaagatgcgggcgacaacaccatcgtctttaccaacttcgtggacttcgactcctcctggggtcaccgtcgcgacgtagcgggttatgcagccggtctggagctgtttgaccgccgtctgccggagctgatggagctggtaggagaagatgacattctgatcctgaccgcggaccacggctgtgacccaacctggaccggtaccgaccacacccgtgagcacattccggtgctggtgtacggtccgaaagtgaaacccggccatgttctgaatgatgttgggtgcggcctgatgccctcaccccgaccctctcccacagggagagggagaaggtcgggtaaggcgaagccgccacccgacactcactttcaggcactttgtttcagccagctcaacactacatcgtggtggttgctggttttgaagtcgtcaaacacgtgctcaattttaccgtcagcgtcgatcaggaagctgatgcggtga

SEQ ID NO: 90882 - DNA, 684 bp, Glycine max
  Peptide Sequence Number=SeqID_182567
atgactgaggatgtccctgatatggctgaggatgcacctgagatgactgcggacgtacaggctaatgatggtgctgaggggtcacatgctgacgatgctgagggattcccaggtgggccacgtgacccatcagtgctgacttcatttgcggaccatgaacgtcctgagttgaagttggtgtcgcacgggaggaaggtgacattaattgggaggccagtgcctgagattgaaggactggttggtgccacaggattaagtccattgatcgggtgttcagttgtaactggcgatcctggacttatatccgcatttgtggagagatggcacagggagaccagcaccttccaccttctagtaggagagttgacgatcacactggatgatgtgtcgtcactcctccatctacctatcagtggcgccttccacagctttcatgctctttctgtggacgaggcgatatttttgttgacagagttgcttgaggtgtctgctgaggaggctagacccgagacaacacgatcacacggggcatatgtacgactaggatgggttcgagacatctatgagatgagatgcaaggcacgacgatggattgtagcagctcgtgcttatttgctgcaccctggtcggtttgcactctttttgccaacaagagtgcaacatatgttcatgtggtgcatctaa

SEQ ID NO: 90883 - DNA, 231 bp, Glycine max
  Peptide Sequence Number=SeqID_182568
atgacagtggaatggagaaggaatagagagaggagacaccacttcaaggaaaagatgagtctagaagaagctcgccaccaaaggaggccatggataagagcttggaggaagaaggagatgaataaagggagagggagagaagaacacaaaattttgtgctctaaaagagctctgaaatctgaacccactaatccaagatcaattccaagattctccactaagtgtgcatag

SEQ ID NO: 90884 - DNA, 816 bp, Glycine max
  Peptide Sequence Number=SeqID_182569
atggctaccgcaccaaaagaaacctcagctcctggttcaccctctgtaccatcatctccatcatccaccaaagcaccatcaaaccaggaacaacctgaattccatatccaacccatacaaatgattcctggtcaagctcctgtccctgagaaactggttcccaaacaacaacagggagtgaagacttctgaaaaccctagccttgcaacaagtcctagggaagtagacacggagatggacaagaaaatccgcagtattctgatgaagatgtcccaacatcttccaccccaaatgttttctgtgcctgatgctgataaagatgttccaacatcttccactccaaatactgaagtcctcccttcacccagtgaagaggaatcaacagaggaagaggatcaagccacagaggagacccctgcaccaagggcaccagaacctgctccaggtgacctcattgatctagaagaagtagaatctgatgaggaacccattgccaacaagttggcacctggcattgcagaaagactacaaagcagaaagggaaaaacccccatcactaggtctggacgaatcaaaactatggcacagaagaagagcactccaatcactcctaccacatccagatggagcaaagttgcaatcccttccaagaagaggaaagacatttcctcatctgattctgactatgatgtcgaactagatgttcccgacatcaagcgggccaagaaatcagggaaaaagacttgccttggaaagagaactgggaagagatgccttggattgcaaggagatcatggacctcatcaaggctgctga

SEQ ID NO: 90885 - DNA, 336 bp, Glycine max
  Peptide Sequence Number=SeqID_182570
atgggtgaagtagaggaggtgcaagagcagatgaaggccgacatggaggccatgaaagagaaaatggccacaatggtggaggccatgataagcatgaagaagataatggaagccaatgcggttgcagttgccgctaccagggctgttgctaaggtgaacccgatgcccccatctgatctcaaccaaatgagtcatccaaccttagatatggtgggcaaagatttgggaagtacgagcggcccccattatgtgcaaattcaaaacaagcacgccttcacgccatatggcttgccttccaactatacaccacccaatgtggcgtacactcccaagtga

SEQ ID NO: 90886 - DNA, 222 bp, Glycine max
  Peptide Sequence Number=SeqID_182571
atgaatgactctaggtggaaacaagagttaagtccttacaatcaatatgaagaagaaagaactcctaatctcaaaaccagaagagaagaagacttggtagaggttaaagctcaagaggaaaaccctataaaagagcatgaattaagagaaaaagatgaggagaaagatgaggaacaagcacaacaacaatggaagaagtactcaactgtagaaaaccaataa

SEQ ID NO: 90887 - DNA, 69 bp, Glycine max
  Peptide Sequence Number=SeqID_182572
atgtctgggactcactctgaacgcgggcattccactgctcagcctctgaacccaggggtgcgcctgccg

SEQ ID NO: 90888 - DNA, 120 bp, Glycine max
  Peptide Sequence Number=SeqID_182573
atgtatatttttgtgaagtattttgctatatacatgcgtgtcccaggagtggatcgtttgatacaggctacggaggtttggatgacgccacttccggtgaaggaagataagtcagggtag

SEQ ID NO: 90889 - DNA, 285 bp, Glycine max
  Peptide Sequence Number=SeqID_182574
atgatcatgaaggttgatggagaaatcactagtgagtctgaaatcagtgaagaagaagtggaagaagaagagtgtgaggaggaagctatgcagggtgatatgttgatggtgagaaggctgttgggaaatcaaatgcagccactggatgacaatcaaagagaaaatattttctcacaccagtacccaatggaagcgacggctcatggaggatgtgttctgattgtaggagccatgaacaacgatcaccatcaggagtatgaggcacccaatccccaggttagatga

SEQ ID NO: 90890 - DNA, 150 bp, Glycine max
  Peptide Sequence Number=SeqID_182575
atgaagaacgaagaacgaacgggaaatcagggaccccttacttcagccttcccacacctatttatagcaaaacaaggcatttgggataaaggtagttcacccaggcgagctggttacttcattatgaagcaaccctgctcgcccaggtga

SEQ ID NO: 90891 - DNA, 65 bp, Glycine max
  Peptide Sequence Number=SeqID_182576
tcctctgcggccaagaacacccccccggcgcggcggccactggcggcgccaccgtgccggagtag

SEQ ID NO: 90892 - DNA, 123 bp, Glycine max
  Peptide Sequence Number=SeqID_182577
atgtcattgtcacttgaggacaagttaattaggcaagctttggaaagtgctgttttttaccttctcgctaagccaacatgctggcttagcgagcgtccgctaagcgcaacactcatgggctaa

SEQ ID NO: 90893 - DNA, 371 bp, Glycine max
  Peptide Sequence Number=SeqID_182578
atgctgcgcctgtgcggaaagcggcacggctgtggacggagcggcctgcaccgtggcgtgcggcgtgcggcgcggcgcctgatagtgggcgacccgggttccggagccgggctgcggttcgagaaaaccttccgccgttagctgagcgaacgcctccaatagcgtgccgcgcgccagattcaacgccgccgacagccggcgcgttgagggcagcaggtcgcccgctttcagatcgccccggtggatggcctggcgcagggcctgcgccagctgggaaaattaacgctcagagtagaccattttcggtgttaatagcggatatcttttatcatttgttcgctgttgttaagttcagcgttggctacacctga

SEQ ID NO: 90894 - DNA, 189 bp, Glycine max
  Peptide Sequence Number=SeqID_182579
atgcatgatctacatcggtcacaatctatgttctacaacgaaagcaatgatgttgaatatgggaacttctacatcagtggtgatgtagggactgctgtagtaagttgcgctttctacattgttttccataaagcaatgatgttgaatatgggaacttctacatcagtggtgaggtatgcactgatgtag

SEQ ID NO: 90895 - DNA, 450 bp, Glycine max
  Peptide Sequence Number=SeqID_182580
atgattccccacggcgggcacagagaggattcatgtttaatgcattcgggcatactgcatgacatggaaacatgttcggcggtaagaaatctattacaacaaatgatagaccaaggccggcttgaggtcggcaacgagggggaggaggaacaacatgtatacatgcagtcggtagataaggaaggtcctaaaaagcctaaacccttggtaatacacttcaccagggacacggctcccccaagacctcaacacccatcggcagtgtcgggcggtagacctattccgtttccttacgagaacaaccatgcagttccgtggagatatgcccctctgggcggtaggaaggaagaagctatcgatatcggttcactatcggccaaagtgaccaatatcaccgggctgagtggcataacccgcagcggtcgtgtgttcgcacccctgccctgctga

SEQ ID NO: 90896 - DNA, 384 bp, Glycine max
  Peptide Sequence Number=SeqID_182581
atggctggtacattcttccttttgaaacagcaaaatagtttagagattatgagcggtaagaaagaaatgactccgaatagagttggacgccacactcaacgtaaggatgcacatgccaaagttgagtatgtgaaaagattgtatgaccaagtaaagatgcaaattgcaaagaagaatgaaagctatgtcaagcaagcccacaagaaaaggaaggaagtggtacttgaacccggtgatgatcctgaacatttgaggacaaatgttttccaagaaggagggaatgatgagaatcatgaaactggccaaatacaggctaaaggcccaagtggagaaggacgaaggctcaagtggagaagcacaaagcccccgagtggagaaggatga

SEQ ID NO: 90897 - DNA, 261 bp, Glycine max
  Peptide Sequence Number=SeqID_182582
atgagaggagcaccatcagagaaaagcatcatgcctttcatcgcacggggtttcagtgaccccaacgcaagggtacttcaaggagttcgcaaggcatgggatgcggtgcgaaggaaggaaaaagagcttaagggaagcagtaatgggatcatcggcaattatcgtaggtggctgagagttcagacacaaggattagattggctaccaaagctaaaggctgcgagagacgaagaggctaaagctctggaagaaagtgaggag

SEQ ID NO: 90898 - DNA, 582 bp, Glycine max
  Peptide Sequence Number=SeqID_182583
atgtgtcgggggtttattggttctctttgtttggtggggtatgaaatcaggtgcggtgaaggtgaaggtactggtgttgagcattgcggtggtcgacggcggcattcgaggtacgcagaaggtggtgctgctattgggaagatggacgaagatgagtggatgtatgaaagtataatgcctgaagaagcgcatatggattatcaaaatgaagaagcatgtggtgtgaatgaaccatatgttgattattccgatgcgttcaagacttctcaggatgttttgcggtgggctcgatccattgctcatgaaagcagatttgtgacgatgattttaaggtcagacacaaacacaagtagtagaggaaggactttgtttgtgttaattggctgtgaaaggagatgtgagtataggtgtaggaaaaaagaatttatcagaagagacactaggactaggaaatgtgggtgtcccttcaagcttcattgcaagccagtggttggaggagaaggttggatggtgaagttgatttgtggagtgcataatcatgaattggccaagtcattagttggacatccatatgcggagtga

SEQ ID NO: 90899 - DNA, 318 bp, Glycine max
  Peptide Sequence Number=SeqID_182584
atgcattgcaaggacaaaatttccattttccaacctgtcgcaatgtgcccttttgcgggcgagcgaaggcgaggctcacgggtgcgctttccaaaggaggaaagatgcgcggagtcgccaccaacgtttatttatggaaaacgtcagaaaaaccgaaggaaaccgatcgaaatgaaaattctaagttcgggagttgtatttacgtttaaggaaggtcgacaaaagcgggctcttgctcctacgtaccctccatcgaagaggaaatcagacctacgtagttctttcttatgcgtgaatcaagtgattctttttacttga

SEQ ID NO: 90900 - DNA, 240 bp, Glycine max
  Peptide Sequence Number=SeqID_182585
atgcaaatcgccattggcaatgacgagttcgttgcggattggacatgtggaacgcaaaccgccaacgctagtggttctgaaaccgctagtttgactggcgagtttctgaaaccgcaaggctacggtgcaggagcaggagctccagtggtaggggtgcagtgcagagcggcaagtttgacttcttgggctttggttatcgccattattgctggcgatttaagctccagtggtggattataa

SEQ ID NO: 90901 - DNA, 1104 bp, Glycine max
  Peptide Sequence Number=SeqID_182586
atggggtcaaatcaagctttttcattcaccaagaggttcgcacatgttaaagtttcgacgtctgacttatccatgatggaagactttgaaaagattcttggatgccctctgggaggaactaagcctttcttcccttcgggacactctccgtccatacctagattatccgaagtgttgggaattcccgtgactgaactcagagagaaggaggtgaataggaatgaagtggtatttttccctagcatgattgactggattgatctggcagcagttgacatgttcctagcctattattatcgacgagaaagtcctatggtttctatccttgctgatgtgtactgtactctggactcgagctgggaaaagaaaagcactagagtcatctgttgttttcccgcactctatgtatggatggtgtctcattttgtgatgcacaatggtatgcctacttgtccattagaagatttttgcatggtgccagataagagaaagattaattgggaggagcttttggctagcacgacaggattaaacaaagaacatctcagtatgcaccaacaaattaggaaggtgtgggactcaccaaataggagggacaaggagttaaggaagaaagatgaggaagtcaagctgcctaagaagacaaatggtgagagggtcgagatagatgtacctattgagcagaggaggaaagaatgcaatagactaagggatgtcaacatgtcaaaaactgaagcattggagcgagaaatgagaagggctaaaggggaagagacgaacagaagaaggtaccaaggagctttgtcaggcaatagtaacgaactcaagttgagaagtgcagagagggaccaaacaatagcggaaaatgtgacactgagagatgagttgaaggattgttgggaatcaaaggaaagcttgaaggagcgactaggcatgatggaaaagagtatgctagtaattgtcgatcaatatgaggtaaagatggtgagggagaggcaagttctggctactatacatggacaagcggaagtgctagccttacagggtgaaagagaagcaggggaggaagtgatagagctactacatcaagaaagtaggaagtag

SEQ ID NO: 90902 - DNA, 250 bp, Glycine max
  Peptide Sequence Number=SeqID_182587
gagatttagggataaaaatgaggttgcagaacctaaggcagacccagaaagggatcagagaactgtttttgcctaccagatgccgctaaaagcaacagagacagatgtgtatgagttcttttcaaaagctggcaagaaccttgttcaatctaatgcttctggtggagcagccggtgtaactggcccctatggagttgtggaccgaaaattgtatgtggggaatcttcacttcaacatgactgagagttag

SEQ ID NO: 90903 - DNA, 264 bp, Glycine max
  Peptide Sequence Number=SeqID_182588
atggatcctgccaggagatttagggataaaaatgaggttgcagaacctaaggcagacccagaaagggatcagagaactgtttttgcctaccagatgccgctaaaagcaacagagacagatgtgtatgagttcttttcaaaagctggcaagaaccttgttcaatctaatgcttctagtggagcagccggtgtaactggcccctatggagctgtggaccgaaaattatatgtggggaatcttcacttcaacatgactgagagttag

SEQ ID NO: 90904 - DNA, 252 bp, Glycine max
  Peptide Sequence Number=SeqID_182589
atggccatcggagatttggaggccttcttccctgctgcaacgcgtgagtatgctcctatggtagatgaaatctggaaagatcctgctgttcaagaaacatacaagacaaaaaaggaattacataatcttcccaatgttgctaaatatttcttggatcggaaagatactcctatggtcccaataggcggtgatacctcttcagacaccttaccttggggccttaggcattcatttggctactttgactcttag

SEQ ID NO: 90905 - DNA, 491 bp, Glycine max
  Peptide Sequence Number=SeqID_182590
tgggaatctcaaggagtgactcaccttcagtatgctcgagttaatcttgttgatttggctggatctaagaggcagaagaattctggtgctgaaggggaacgcctcaagtctgccacaacctccgttgtgaccttcgatacttgtcgcaagctcgtcgtggacattccctctaaagccaccatcgctgcttccacaaacccccttcacactctcagagcgaatcataaaccctcgttccatttccccttcgcgaaggtttgtgactttcttcaagcaaagatcacaattgcatttgtgggaatcggcgagaaaaatgcagggttggttctcagggcagagcagcgaggaggaggcgaagccgacatcgtcgttgctcgccgattggaattcctagcatccgcccaatcctctgaggactcctccactttccccttcgatattgaatccgccgttaggtcttccaacaacaccgtttccgacactttcagcat

SEQ ID NO: 90906 - DNA, 969 bp, Glycine max
  Peptide Sequence Number=SeqID_182591
atggacagtagctctctttacatcttgtcaagatcttgggctttagttctgctaaatttccatacttttatgattaatagtactccaaagctttactgtgacaaagaagaattcccctatgaattacttcatccccttgaagattgcaatgtgaactcatccttgtcattcacacttcagatctgtagagtcgaggacatccttgttgaaggccttataaaaggttctattgttcatttccatagggcaaggaccataagtgttgaatcttctagaacaatatctgcctctagaataggctgtactggtggtttgggccatggaaatactctaagtaatggtattggcagtggtggtgggcatggtggtaccggtggtgaagcattttataatgataatcatgttgaaggtggctattcatatgggaatgcaaccctgccctgtgaacttggtagtggaagtggaaatggcaactctactagaaccacagctgggggtggtatcatagttgttggatcattagaacatcctttgtcaagtttgtccattcaaggttatgtaaaagctgatggaggaaattttgaaccgcaaattagaaacgaaaaatttgcaatatttgacaattttactggaggtcccgggggtggatttggtggcactatactaatgtttctccatatgctcaccattgggaaatcagttgttctttctagtatagggggatatagcagttctaatggaagtggtggtggaggtggtggaagaattcattttcattggtccgacattcccactggtgatgtttatctgccaattgctagtgtgaaaggagacattcagatctggaaaccttggaagcaacaaggctgcccaatacctttgagtataagagatggatgctccttaaaacagccttgggaagaacacatgagagagtatgaacataaccctatcatagaccaaatttaa

SEQ ID NO: 90907 - DNA, 564 bp, Glycine max
  Peptide Sequence Number=SeqID_182592
atggttgatttcacacttcttttgccaagagatgagacacgtttgcccgctagaaagccaccgcttatgcaccgagaaaaaagaggaaaactgggaccgactcttagcaagcaaagaaggagcgcctgtcaattggttcccccaatggaaggaaggaagagctgggattcttatttcatgtggggaatttccaaatgttcccttgatggggacgaggggttgcatcaattacaatctcgtcctcgcctaagacaactgggttatcctttgagaggggcaccatcagaggaaggcctcacaccttttattgcacgaggtttcaatagcaccaatgcgggggtgcttcagagggtccgcaaggcatgggagatggtgcaaaggaaggacaaggaacttaggggaagtagcaacgagcccatcggcggttaccataggtggttgaaagcctacacacaaggtatgtattggctcccaaatttgagaaccactaaaaaggtggagggtgaagcttcggaaaaagatgaagagatacaagccctcaaaacagagcttgagaaagactaa

SEQ ID NO: 90908 - DNA, 333 bp, Glycine max
  Peptide Sequence Number=SeqID_182593
atggcccttaagcacaaggtccagagcttgatcgaggcgggatggttgacgttccaagaagacgggccaaatgtgaagatgaaccttcttgccaaccatggaggtttggatgtaaatgcaattgaggcgtgtaaactgcaaaagcctaagcatttaaaggatgtaatgacctctaggaggtttatttttgaagccttgcaagaggcgggcgtggtttcgctcggtgggcataagggggatccttgcttgatgcatccaggtgaactgcatgatatggaaacatgttcagcggatgatagaccaaggccgactcgagatcggcgacgagggtga

SEQ ID NO: 90909 - DNA, 231 bp, Glycine max
  Peptide Sequence Number=SeqID_182594
atgatgaagaacggtggaaaaccttcacgaaatcgcccacggaaacatcttggaagcgttacggaagcgcctcggcttggattttcttcacggaaacgatttttctcactaatttcaagggaaaagagggaggtggttgccgcccagctccgcccaggcgagctgggttgcttaccaccgaaaggcaccgccttctgttgggaacacccttggaaggtccagatgggctag

SEQ ID NO: 90910 - DNA, 606 bp, Glycine max
  Peptide Sequence Number=SeqID_182595
atggtgacaaaaaggagtaactcctttaggctcggatttccaaccttgatcactgtcctttgcagagctagaggagttacctctgacagtctgacttatgagagcctgagttcgaccattaacttggcctacattaagaaaaattgttggaatgtggataatatgacagctaacttcagaggggcgaggaaggttgtggctccaccaggaatcatcttgacagttgagccattcatggagaaggtagcctggccaggaactcagccttcccttgtgagggaaggtgaaggtcccaatgctcaggcaggagggacacaggtaaggcaaaaggctgctacgccaaagaggtcaccacagatttcaccagatccaccttcaccagtggtggatcaatcttctcctcagcagctagcagaccctcctacgccagtgcatgagatgccagcagacccttctactccattactggagattctagaggaccctgccacaccagtcctaggactgactaccactccttcaaccactcatgtgctacattttacagataaggagggcactcaggatcaggatacccagcaggatgaccagtcacatgagttttaa

SEQ ID NO: 90911 - DNA, 207 bp, Glycine max
  Peptide Sequence Number=SeqID_182596
atgcgtctaccagggaaggagattctgctgatgaaatcccccataaccttaactgagattttggatgttagcatttcgtttctaaatgaccatttagaggaaacactgggttcgacaaaaatagaagaaaatcactcaaagtgtatcaatctcgcacagtgcggggcgaaaaagtcgctagcacacaagattttggttggcaattaa

SEQ ID NO: 90912 - DNA, 320 bp, Glycine max
  Peptide Sequence Number=SeqID_182597
ttcatgacaccgggccagccatcagatcctcgggcagatggtcatgctacgtagcccagagttgccactccggatccagacatagatatccgtccgatcacggagccaacagcaccgtcgacatctgcaaggtccgatgtggccgagccgagacatgcaatgaagcttgccatgcgattgcggagaggttggagagccatctcaacctaggggtggtcacgccagacacatcgacacatgagctgattgccaagagtgtcacacaagaccagctagtttatgttaggtctcgatgcaagcggcacacagatcagtcgtag

SEQ ID NO: 90913 - DNA, 859 bp, Glycine max
  Peptide Sequence Number=SeqID_182598
atgcgttcagccggcgatttggtgcgcgcccgcttcggggctgtgaagaccctgcggttctgttcggccatgtcgatcatcggtattcttattgccggtattgcgggaaattccaccatcgcgatcgttggcttggggattgcgggcattggcatatccaacatggtgcccattgccttttcggcggcgggcaatatgccgggcccggcaccgggaatcggcctttcggtggtcaccaccatgggttattccggcattctggaggccccatcggcgattggcttcaatgcggaacataccggtctcgccagcgtcttcctgtttctcccctccagcgcgttgggtgttgacaagaagtcccccttgtttcacctcaattgcaagaccttgccgcaagctccagagaccgccatgacgtcacatgccgattacgacccgaagccccgccgcgcctccgtcgccgtagacgtcggcggcgtcatcgtcggtggcggcgcacccgtcgtcgtgcagtcgatgaccaataccgatacggctgatatcgacgccaccgtcagccaagtggcggcgctgttccgggccggttcggaaatcgtccgtatcaccgtagaccgtgatgagagtgcggccgccgtgccgaaaattcgcgaacggctgctgcgtcttgggatggatgtgccgctggtcggtgattttcattatatcggccacaagcttctggccgaccatccggcctgcgccgaagcgctggcgaaataccgcatcaatccgggcaatgtcggtttcaaggacaagaaggacaagcagttcggcgagatcgtcgaaacggcgatccgttacgacaagcccgttcgcatcg

SEQ ID NO: 90914 - DNA, 2523 bp, Glycine max
  Peptide Sequence Number=SeqID_182599
ggtgagccactctcatttttagaccaccacttgcaatgtggtgatgccttgctaggtttaatggatttaaaagcccttgagatgggcattcctaaagatgcgtttaaaccactctcaggcgatgataatcaagtatgcaaagagctggcaaaacaaaacgctaccgagcttaaagaccttgagagaaagcgtctttttaacgcaaaagagatgttcaacactgacaatggcttagaaacactcaaagccattgaagccatgcctgagcgcaccaccaagcaaattgctgctaaagagcaagcttataaagactttttaaccagcgccaaagagtcaccgcttcgccatgccgcagatatgctgctaggtgcatttttaattgataaaaatatccaaaacaaagactctgtgcccaccactgccagtatggtgcttgagctgttaggtgaaaactctagcgcacaacaacaaaagcgtgcactggccacccaagcctgccaaaaagggtttgttttgcactggcctttagcttttccgcaggtgtttgcgcaaggtggctttgattgtgtattgggtaacccgccatgggagcgcattaagctgcaagaagaagaattttttgcctctcgtaacccaaatatcgcacaagccaaaaacaaagcggagcgctcacaacgtattcaatggttgagtgaaggtaagttagcagagcatctgtatccaagccttcaacatacagaagttgagcgccaagctgagcaagcgttgtttgaagagtttataactgccaaacgcacggctgaagcggccagtgtgttttttcatgtgaaaggtgatgaaggtggtcgttatccactcactggtgtaggggatgtaaacacctacgcgctatttagtgaggaggttgagcagcgcctgagatctaaaggctggtcgcgtaaatggatcatgggatggagaaatgttactagtgctcatgttttaagaactgtgatagcaaccgtttttccattgtcagcagtgggacattcaatgccaatatttcttccaaaggtaaatgatattaggcgttgtgcggctttttttgcgaattggtcgactatcgttcttgatttcattgcacgccaaaaagttggtggaattaatttgacatttggatatttgaaacaacttccatttataccccatgaacgatatggagataaggagctcgactttatagtcccaagagttcttgagttgacatacactgcatatgatttacatgactgggcaaaagatttgggctataacggcttaccttttgaattttcctctaaacgtagagcaattttacaagctgagttagatgcttgttacgctaaactttatggcctcacccgtgatgagttgctctatatcctcgatcctgccgatgtgatgggtgaggattaccccagcgaaactttccgtgtacttaaaaatagcgaaattaaagagtttggtgaataccgcactaaaagattaatacttcaagagtttgatcgaatgtcgttggcagaagcctcaggtgagccgtatttaagtcttttgattccaccgccaggtgaaaagtcaaaagtagagtactctgaaatcggtacacttcgaaatgaagatgatgcgcgtttaacatcattaatccttgcaatgattagacacgcaggatctttacagcggcagagtttgagtattgccattgaaatagttaatcacgggaataaagtttttgatctgatgaacactgagaatgctcaaagtgtgttggactatcgagatagtcgcttctctaaagcaaacattgattctagtcggttgcaggatttgttacatttcttggaaaccaaagaaataattcgtttcctgcaaaaaggagcactaattgaagcagtaaacgattctgagttgcctgccggaattaatttagatcaggaaacagaggccatagctagcttgttgctacaaacagcctctagtgtgattgatgcgctaattgatcatttggaaaagcatcaaggcactccatttctttgggtcgagcaattcgctatttaccatgaggccagttcagatcagattattcggttaattacctttcgacgaggtgttaaccttgtttgggcccgtgagcctgatgaaaacagtcaatacgctggtatccacgccgcaggccatggggttggaaagacctcactttgtttgttaatgaggtattgcttaggtgatagtacaaaatcaattgatgagttgcgcgacgagttgttggcggaatttccaggaggcggcgttggtgttgtagtgcacattggcgatgaaacatattcattattccgttatttcaatgcacaccgtgatgggcgaatcgatctgcggcttaaacaacgagacttcgactcattaagatcggattatgatttggctgacgcggcgagaaaaaatgatgagataactgcgtatcgccaattgcagaacgccgcaaagttagcaattcttgctggtcgctga

SEQ ID NO: 90915 - DNA, 327 bp, Glycine max
  Peptide Sequence Number=SeqID_182600
atggtgggctatacaccttcaagctttgatgatatggtcttcaccgacgaaaggatcaaagtgggtctaaaaagaggcaaatctgatcatcatgctttgataaatgccaaaaagactagggcaaatgaagagggtgagaatgagggagaagcccatgttgtgactgccattcctatacagccaagtttcccaccaacccaacaatgtcattactcagccaataacaaaccttctccttacccaccgcccaattatccacaaaggcaatccctaaaattaaccacaaagcctacctaccgcacttccaatgacaaacaccacctttag

SEQ ID NO: 90916 - DNA, 300 bp, Glycine max
  Peptide Sequence Number=SeqID_182601
atgcatagatctcccacaggcaatttagttcctctggacttggagattaaagctacgttgagaaggaacagagtcgagaggagaagaaaattactgcaagacaggagagtagcgtcaattcttgaggaagaaactcatttttctaattcttcatcatccaactcaccatcatcaagggaatctgcggcttatttactagaagccatttccatggctgatgatcaccagcaaagagttacccttgaggactattcaagcagttcaatgccacaattctttaccagcattgcacgtcctgaa

SEQ ID NO: 90917 - DNA, 184 bp, Glycine max
  Peptide Sequence Number=SeqID_182602
ttctgatctgcaattagcaatagccttgcaacaacaagagtttgagcagcagccaccacgccaggataatttacagcagaaatcatccattagtggtagctctagactggtcacgggtccccagggtttggggtttgaggtttggggtttggggtttggggttgggggttggggttggggttag

SEQ ID NO: 90918 - DNA, 128 bp, Glycine max
  Peptide Sequence Number=SeqID_182603
gtaatgtgcgccctcgtccgcatgaccttttcagagagaaaaagagaaaaaagaaagaagagagaggaaatgaacaaatgataaataacttaaaaaagaaaagaggaaaaggaaaagagagcaagtaa

SEQ ID NO: 90919 - DNA, 444 bp, Glycine max
  Peptide Sequence Number=SeqID_182604
atgggtgaagtagaggaagtacaagagaagatgaaggccagcatggaggccatgaaagagcaaatggccacgatgatggaggccatgatgatcatgaagaagataatggaagccaatgcggttacaattgccgctaccaacattgttgctaaggtgaacccgatgcccccatctggcctcaaccaaatgaatcatccaaccttagatatgacacatgaaattccccaccacaatctagccgacttcgagccttgcctcggatatgccactgaagggcaagcagttgatggtatacccctacaaaaccctttggagggccctcagtatcatccccagctacacctcttgcattccacaacaagtaaaaaccctcatgctatggcagaaatgggaaagttggatcatctagaggaaaggctcagggccattgaaggaggtgaagat

SEQ ID NO: 90920 - DNA, 235 bp, Glycine max
  Peptide Sequence Number=SeqID_182605
atgaccaagagcaagggcaaggatccacttgaaggacttggaggacctattgatgaggacatgaccaagagcaagggcaaggatccacttgaaggacttggaggacctatgacaagggctagagcaaggaaagccaaggaagctcttcaacaagtgctgtccaagggcccaattggcaacctaggcatcagccttttgggagaccaaatggtggctgacttgttggctgttgggg

SEQ ID NO: 90921 - DNA, 195 bp, Glycine max
  Peptide Sequence Number=SeqID_182606
atgtctatttttatccttttgttcagatacactacttatcaaggtaatccttgtggcgtctaccctgacttatcttccttcattggaagtggcgtcatccaaatctctgtagcctgtatcaagcgatccactcctagtcaggatcacatcaagtgtactctaccccccatgacatacactccgtacgacgtatga

SEQ ID NO: 90922 - DNA, 356 bp, Glycine max
  Peptide Sequence Number=SeqID_182607
atgatgataacaaaagatgatgacaatggtgatgacaaaaagctcaaagatcaatcaaagaacaactcaagtgaatcaaagatcaatcaaagaacaactcaagtgaatcaaagatcaatcaaagaacaactcaagtgcatcaagaacaattcaagagttcaagataagaatcaagaagaattcaagactcaagaagaaagtttagagtcaagaatcaagattcaagggtacatcctttgtggtacaagtagagggtacatctacttgggtttgactaagaacaatagagggaacatctcttatggatcagttctagtggagggtacatccactaggttcaaagagaacaagggagg

SEQ ID NO: 90923 - DNA, 318 bp, Glycine max
  Peptide Sequence Number=SeqID_182608
atggtcatgatggtaatccagccagcaaagaagaaaaagatcccaaacttgaatgagcagagaagagcaaggaaggccgaggcaattatgaaagtgaagaaaaggtttacagcaactgttatgccctgcccagctgaccggatttccaatggaaatatctcactaggaactgtctacccaagtaggccccatgaccatccaaacgcaacaacaaataggcaaatcaccacaaccaccaaaattgaaaagtcttttgacaattcttggtctgttccaaacttgacccctagaataatggccactataatctgctcatga

SEQ ID NO: 90924 - DNA, 207 bp, Glycine max
  Peptide Sequence Number=SeqID_182609
atggcaggaggagggtctttcacaacaggtactgggagcaaggagagggcaaagcagtataaagggagagtcactgcttttgtcatcatctcttgcattgttgccgccataggaggggttctctttggctatgatattgggatttcaggttgtcataatccatactatcctgatccaacggtgaacgaatccacagttgcaatctaa

SEQ ID NO: 90925 - DNA, 621 bp, Glycine max
  Peptide Sequence Number=SeqID_182610
atgaaggatggtgaactacttgatgaagaagaagtggttgctacggaggaggatgtcgatcttggcggaataggaagcgagaccttgatgggtttgtatggaatagagaacgaatccatgacggatttgtatgaaatagagaatttgatgacaatcaatcatcttgggtttgatttcaccctggttgaaggtcttgctaaccaatctggtggtgtgctttgggttcctgcaaagataaaacttggtaacagagagactcaacaagggcagaccttgggtttctacaaagataaaactcaacaacagaaaggctcaccaaaccttgggtttgacgagcctttggagattagaccagggatggacatgtccatcttggattttggtgaggctcatcaagggcataccttaggtttgacgagcttttggagaatcgaccagggatatgtcggtcttggattttggatggaccttgggtttgacaagcctttggagattccaccagggacgtgtttgtcttgggttttggagagactcaccaagggcggaccttggcttgtggagattcgattagggacacattcttcttgggcttacttaggactcgccacactaggtcgctag

SEQ ID NO: 90926 - DNA, 351 bp, Glycine max
  Peptide Sequence Number=SeqID_182611
atggcaagagaggaggaagaaccatactggatgaccccctataagaatttcttaattcgtggaatgttgccaccaaatgaaaatgaagcccgatgcctaaaaaggaaggatggatatcctaggaccattgccaaaagcttcgagacagacaggaagagacaaccaatgaggtcatccttaaagccctgtgcacaagactcgataagtccaagggtctgtggaaggaagaactccccaacatactttaggcttatgattgttcaccccaaacgacaaccaatgaaagctcttttcgctttacatacaacacggatgccatggtccctgtcaaagtcaaggaaccatcgataa

SEQ ID NO: 90927 - DNA, 312 bp, Glycine max
  Peptide Sequence Number=SeqID_182612
atggaggaaagaaagagggagagaaagagagagggggagcacgaaattgaaggaagaaaaagggagagaacccatgggctcgaaatctaccctaaggctcatgagaaccctagggcctttccttggatctctagcccaatatacttggagtcttttagccaatgcccttgcggggtaggattgcatcattcccagccatctgcaccaccatcagagccagagcagcctattgttcaggatccaccagctactctggtgctggatctaaacgagcatgcagaagatcaacaacaggatgatcaggagttttaa

SEQ ID NO: 90928 - DNA, 243 bp, Glycine max
  Peptide Sequence Number=SeqID_182613
atgtggagcgcagagaatcagaaagtgattgttctgatggatgtgctctgtcttggcttgcaggaaaagaatgagaggcaaaacttctacaaggaatcttgccttccatttccggaacctatatttttcacagttcagagtcagatgcaatatttcgcaagtgatactcttgagtgcataatattgccagcaagcactgagggctgttcattccctaccattatccaaacacagtctccataa

SEQ ID NO: 90929 - DNA, 414 bp, Glycine max
  Peptide Sequence Number=SeqID_182614
atggctgcacttgatttcacctacgaaagcttgtgcattcaataccctaatgaggatgtcccatatgttcttaaaactggactgatccatttgcttctaaagtttcatggccttgcagagggagtggcaaaggactggttgtattaccttgctccaaggtccatcacgagctgggatgacctcaagagagtattcttagaaaaaaatttccttacttccaggaccacgaccatcagaaaagatatttcaggactcagtaacatggacagaagtatgatagatgctgccagtggtggagcccttggagacatgacccctgctgaagccagaaatttaattgagaagatggcttccaactcccaacattttaatgctagaaatgatgctatagtcattagaggagtgctgaggtag

SEQ ID NO: 90930 - DNA, 926 bp, Glycine max
  Peptide Sequence Number=SeqID_182615
atggccaagttcgatccagaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgcgagtatggccagaggaggaaccggtctgatgggttcgatgaggaggccatcgcccagctgctatgtataccagggcaggattttgcccggactgctgcagggaggcgagtgcgaatcatgcgcaccaacatgaccaccctgacccagatatggatgacgttgctcctcagcaacatcctgcccaccgatcataattccgacctccccatgccgaagtatggcgcctaccagcatcctttggatccagataagtccaacagggccctgggatttccctcgctgatcacaggactctgccagtcattcggagtccccgttgcacctaccaaggtaattcggccgcccatcacccgggcttttattgagaagtactgtacccagagacaggctcagggtgatgctccacaggccgcaggcgcgccaccaccacctcatcaggctggccaggctggggcatttgacatggagcagtatttacggcatttggttcgccagcaggcggccaaccaccgagcacatgtacagacccatgattgtctgtaccagatgagcctcagcatgcagagccagggcttcgcttctttttcatgccttactctagaccagttcagggcagaggtcgcatggcccggagattggcccgaggcccaagcaggagaggcacccccagaagctcctaacggtggagaagaggcccacgaggacgaggagatggccgatttgcttgacttcttgggagggagtgaagatac

SEQ ID NO: 90931 - DNA, 432 bp, Glycine max
  Peptide Sequence Number=SeqID_182616
atgaggggcatcgtgcatgagcctcaagatggaccctcgggtactagtaccctcgcctccagaggactacacgtcctcaccttcggtggactacacgtcttcgccttgagagggctacacgtcctcgccatcagaggcctgtacgccctaaccttcagagggttgcacaccctcgccttcagagggttacatccccaaacttcagaggactacacgtcctcaccttcagagggctacacgtctgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 90932 - DNA, 354 bp, Glycine max
  Peptide Sequence Number=SeqID_182617
atggaaaaagaaaaacatgtctcctattgtagtcatgacttttgcaagagcctaagtgaagaacttagtgactattatagaggaaggcataggtcacatcctagacctcactcccatatgagagaaaaggaaagaaaacctcaagaggctaacattaacctcccatactaccatgggaaggatgtggaagcaatgtcttctaagattttcaaaattcaaaatgaagagtgtcgcaacatgcccttttgcgggcgagcgaaggcaaggctcacgggtgcgctttccaaaggaggaaagatgcgcggagtcgccaccaacgtttatttgtggaaaacgtcggaaaaaccaaagtaa

SEQ ID NO: 90933 - DNA, 528 bp, Glycine max
  Peptide Sequence Number=SeqID_182618
catggcaaaccgaccaaagtgaacaatttctgggaaacgtccggcctcaatatccttgagaccgtagcccgtctcgatcacaaaagcgtcccgcagctgatcgataacctgctgtccgtgcgcaccaatatcgcgtcgatctttattcgcgccgcggtgcgcaatcatcctgagcaggcgcaggaagtgctggcgaaagccgccgaggtggaagatcaggcggacgctttcaatctgctcgattacgagatcttccgcggcttggcgttcgcttccggcaacccgatctacggcctgattttcaacggcctgaaagggctgtatacccgcgtgggccgttactacttctccaacccggaagcgcgcaagctggcgctggccttctacagcaagctgtccacgctgtgccatgagaagctgtacgatcaggtgatggataccgtgcgcaactacggtaaagacagcggggcgatttggcagagcatgcagggcaccatgccgagcgatctgaccgaagcgcgtcgctaa

SEQ ID NO: 90934 - DNA, 802 bp, Glycine max
  Peptide Sequence Number=SeqID_182619
gactacacgtcctcacctttagagggctacacgccctcgccttcagagggctacacgtcctcgccttcagggggctacacgccttcaccttcagaggactacacgtcctcgccttgaggactacacatcctcaccttcagagggctacacgccctcaccttcagaggactacacatcctcgccttgaggactacacggctgcacgccctcgccttcagaggactacacgtcttccccttcagaggattacacatcctagccttcagagggctacattccctcgctttcagaggactacacgtcctcgccttcatagggctgcagatttgcgccttcagagaactcaaggtcctccgcccttaatggttaatcgaggcctgcgctcccggagggaggctatcgtgaaactactatgcataccagggcaagatttcacccagccgctgcaaggagacgagtatggatcatgcacaccaccacaactccgatctccccctgctggagtgtcagttgggatcgtgcccacaagacaccctgtggacgtggagaagtccaacatggccctagggtttctagctttggttgtgggcctctgtcagtcctaccgggtgctcgtccccccagcaaggtcatgccatcgtgacatagggatcgcgcctataagacactcagtgggcccggagaagtccagcagggtcctggggtttccagctctgactacgagcctttctcagttctacggagtgcccgttgcccctaacaaggtcatcaggcctcctactaatcgagctttcatcaggaa

SEQ ID NO: 90935 - DNA, 891 bp, Glycine max
  Peptide Sequence Number=SeqID_182620
atggcgaggatagccaaggtgatcaaaatctcggtgcaagaattggaccgagtaaaacaaaatagaaatggggttattggaataccaaggaagcacttggaggagaaagcgaaggcattggtggatcaaggtgaatgggcttcattcattgatgtcttggtgctattggtatttggagtcgtcctctttccaaatgtggatgggctagtggacctagcagcgatcgatgccttccttgcttatcaccataacaaggaaagtccggtcgttgttgttttggccgatgcctatgacacatttgatcgaagatgtgaaaggagcggcgtaaggatcatctgttgcacacccgctctttatgtatggctggtcttgcacctctttcgtcatgaaagtagacccgtctgtcccctacaaggtcaccgcatatacgccgagaaagggaaggccaattgggagcaactcttggctagtatgggattctcaaacgtccccttgatgggaatgaggggttgtatcaattataatctcgtccttgtcataagacagtttggctatcccatgagaggagcaccgtcagaagaaagtatcatgcctttcatcgcccggggttttagtgaccccaatgcaaggatatttcaaaaagtctggaaggcatggagcgtggtgcaaagaaaagataaggagtttagggggagcagcaatgggatcattggcggctatcacaagtggctgaaggcttggacacaagaactagattggctcctgaagctaaaggcctcaagtgaggaagaggctgaaacccctggggagagcgaggaggtgcaagccttaaaggtggaacttgaaagggcacaagcagtcaaggaaaagttcaagacgatggccatcaag

SEQ ID NO: 90936 - DNA, 978 bp, Glycine max
  Peptide Sequence Number=SeqID_182621
atggcttccaactcccaacagtttagtgccagaaatgatgccatagtcattagaggagtgcatgaagtagccacgaattcatcttcagcagttgaaaccaagaagcttgaaggtaaactagatgccttagttaacctcgtaacccagctagccttgaatcagaagtctatatctgtcacaagagtctgtggtttatgctcctctgtcgaccaccacacagacctttgcccttctgtgcaacaatctgaagcaatcaaacagcctgaagcttatgctgcgaacatctacaatagacctcctcctcctcaacctcaacaacaaaatcagccacaacagaataactatgacctctccagcaacagatggtcgaatccttcacaagagcagccacaacaacagccttattttcagaatgttgctggcccaagcaaaccatacgttcctccaccaattcagcagcaacagccccaaaaacagccaacaattgagactcctccgcaaccttcccttgaagaactcgtgaggcaaatgactatgcaaaacatgcaatttcaacaagagacaagagtctccattcagagcatgactaatcagatgagacaattggctacacagttaaatcaacaacagtcccagaattctggtagattaccttctcaatctgtccaaaatcccaaaaatgtgagtgccattatattgaggtcgggaaagcagtgtcaaccagtagcatcttcctcatccgcaaatgaacctgcccaacttcactctactccagaaaaaggtgaatcttccactggtaattctgatttgcagaagcaacatatccctcttccattccctccaagagcaatttctgacaaaaaaatggaagaggcagagaaggagatcttggaaacatttagaaaagtagaggagggattttctcaaggatcagttcccatcattctaggtagaccctttatgagtgggatcctctag

SEQ ID NO: 90937 - DNA, 177 bp, Glycine max
  Peptide Sequence Number=SeqID_182622
atggtttccgcggcttccatggcttccgtaaaatttccaaaaaccttggaaaatccaagccgaggtgcttccataacgcttccgagacatttccgtaagcgatttatgtggaaattcttcatcgttcttcaccgttcttcgttcgttcttcatcgttcttcagtcttcaaccggtaa

SEQ ID NO: 90938 - DNA, 675 bp, Glycine max
  Peptide Sequence Number=SeqID_182623
atgaatgccgaaataaatagaatttttttgcaggacattgaggcaacaacaattcaggaagaacctctatcttctgaggcatcttctagttttccaaaaaaaggggaatctcacacagtattaattgaagccaatatcatggctgatgagccaagacgagtgaccctggaagattactcaagtacttctgtgccgcaattcttcacaagcattgcgcggccagaggaacaagctcagaatataacctatccacattcattaattcagttgattcagaacaatttgtttcatggtttgcctaatgaagactcgtatgcagatctagctacctatattgagatatgcaacatagagaagaatcctaaggaggagtgcaaggctattatgactagaagcaaaatgatgagcatgaatgaaggagagaagaggatagcaattgacccagtggtggaacctttgagtgagattgaggaagaagtggaagtagaagatgatcagcaaaaggggataccaataattgtgagtgaaaaagaaataaaaaaagagagaaaagaaggaaagagaaaaagcaagagtgaatgtgctagagagaaaaagaaagaagcatcttcagctaaagggagagaagtaccatatccttggtaccttctaggaaggacaaagaaagacatctag

SEQ ID NO: 90939 - DNA, 207 bp, Glycine max
  Peptide Sequence Number=SeqID_182624
atgaggaaacaaaacattcacagggatgagttcctgcgttgcaagagatgcgggaaggagcgcaggttccatctcaagagcacaccagacattaagaactaccatgatgctttaaacaacaaatgctggacttgttctctttggccttatcaaaattggtacttagtcttgcaaaaccccttatatgttggaagtgggatcctctag

SEQ ID NO: 90940 - DNA, 264 bp, Glycine max
  Peptide Sequence Number=SeqID_182625
gggctctggaggtggcggcggtgcatttgttgcctgttgccggccatccccaggctgttatggtgtctcgccctctgcctgtctgggggtgcaatacttcttgatgaaaactcggttagcaggaggcctgatgaccttgctagggatgacgggcactccatagaactgacagaggcccgtaatcagagctggaaatcccaggaccctgttggacttctttgggtccattgggtgtcctgcgggcgtgatccctgcaaacaatag

SEQ ID NO: 90941 - DNA, 306 bp, Glycine max
  Peptide Sequence Number=SeqID_182626
atggatgatcagaccaaaagcatacaaacattaagcattgaaggaagcattaaacatagaaaacataatcaattagatattaagtatttacatcatcggttcattagaaatccccaactagggtgtttagccagccattatagaagaaaccctaacaataataagcttacaaaacctagcgcactgatctcgcgcttagcacacgaccttgatattgatgtagaagcaagcttcatgatgatgaatcaagttgattcaagtagttttgataatgacaaagatgatgacaaaaagcccaaagaatga

SEQ ID NO: 90942 - DNA, 297 bp, Glycine max
  Peptide Sequence Number=SeqID_182627
atgaatgtagtgaaaattgttttccctgagtcaaacaacttgttgtgttggttccgcattgataagaatgtgaaggcaaaatgtaaaacccttgtgggtcaaaaaaatgcatgggattatgtcatggaagcacatgggagtctggtggattgtccttttgagcaagagttcgatgattgccttatgaagtttgaaattggttgctcaccatggccaatgtttgttgactatgtaaagcaaacatggttgattccccataaagaaaaatttgttaaagcctggatgaataagggttga

SEQ ID NO: 90943 - DNA, 138 bp, Glycine max
  Peptide Sequence Number=SeqID_182628
atgttgagagcttctatgttcaatttcgagcgtcccgatatgatgcaatcctaccccgcaagggcattggatagaaaactccaagtagattgggccagagatgcaagagaaggccctagggttcttatgagccttagg

SEQ ID NO: 90944 - DNA, 584 bp, Glycine max
  Peptide Sequence Number=SeqID_182629
gagaagccaagaagtggctccattcattcaaaggtaatagtctgaagacgtgggaggaagttgttgagaaatttttgaataaatacttccccaagtcaaagactgcagaaaggaaagatgctatttcgtcatttcaccagttccctgatgaatccttgagtgaagcattggagaggtttcgggcaagagggaagataaaactgaaaacccccgaagaggcaattgaactgattgagaatatgtctgccagtgatcatgctattctacatgatagagtgcatcaacccaccaagaagagcttattggagttacaggttgtaccatttgtggtggtgctcatgaatccggccattgtattccttttgaagaacaaatgtaggaagactaccaaactagaagaaaccctggctcaattcatgcaagtgaccatgtccaaccataagagtactgagtcagccctgaaaaaccttgagattcaggtgggtcaactggccaagaagcttatggcggctaaggatgaggatgttgttgctttgaaggagcaagttgctttcaaggacactactgttaaaaagaagaatgag

SEQ ID NO: 90945 - DNA, 255 bp, Glycine max
  Peptide Sequence Number=SeqID_182630
atggacacgctaagcgccgcatacgaaacttccaaaaattataagtgccttaggtctcactgcatctgccctcaccttgcttcatctccttgcattcctgcacctttgctcttctttgcattcatctacacaatccaaatgaatgtgctaagcgcagttgtcgcgctaagcgtgttcatcttctcttttgagttatctgttgaactcgctaagcgcgactgtgcactaagcgagtactatgtatcaaacacttag

SEQ ID NO: 90946 - DNA, 222 bp, Glycine max
  Peptide Sequence Number=SeqID_182631
atgagtctcagcctgcaaagccagggctttatttctttttcgtgccctactccggaccagttcagggcagaggtcgcatggcctggagattggcctgaggcccaggcaggagaggcaccagcaggggcaccagcagaggctcccgacgaggcagatgaggcccgcgaggatgaagagatgaccaatttactcgatttcttaggagggagcggtgccacatga

SEQ ID NO: 90947 - DNA, 414 bp, Glycine max
  Peptide Sequence Number=SeqID_182632
atggcaagagtagcaaaggtggtcaagatctcggcgcaagaattggaccgagtgaaacaaattagaaatagggtggctgggataccaaagaagcacttggaagagaaagcgaaatctttgatgggtcgaggagagtggacttcattcattgaggttttagcactattggtgtttggggtcgtcctctttccaaatatggatgtgctagtggatctagcggcgatcgatgcttttcttgcttatcaccacaacaaggaaagttcggtcattgctattttggccgatgactatgacatgtttgaccggagatgcgagaagagtaacacgagaattgtctgttgtacacccactctttatgtatggctggtctctcacattttttgtcatgaaagtagacctgtctatcccttataa

SEQ ID NO: 90948 - DNA, 648 bp, Glycine max
  Peptide Sequence Number=SeqID_182633
atggtcaaaaggattaggaaggtagcaaaggagactcttggtgaatcaagaggctacggacttaaagtttatcatagaattcaagagcctaaggctaaacaagcattaaagaggatgaaaaatggcaaagcacttgatttacataatatacccattggtgtatggaagagtctagattctcctatgctcagcgttttgaagggatttcagaggatgagagcccttgtaagaagtatgggtgaaattttattttcatgcggaagtaatagaagggctgtgattgcaactttgagcatttccgagaatgacattcagcgttttgaagggatttcagaagttgaggttgttacaaaatcacttcaaggtctttccattgaatctgccttggatctgcaaaaagttcttagagttgaaacatgcacatcacaaacaactgctttgcaaaggcttgaagcaaatcttccccttttccaaagtcgaatgggagcattgcttttcctaatctctgctttactttctcgaggactgggttccttgatgccattccccacccctgcccctgaaccccatttcatgctccttaattgttcaggacctacacaagggtcctgcgctcctggagctacctgcacccaaagtggtggttaa

SEQ ID NO: 90949 - DNA, 84 bp, Glycine max
  Peptide Sequence Number=SeqID_182634
atggaggctcctgctggtgcgaggagcgatgacattgcagggtcgaggtcgaggggcagtgaattgagacatgttaaaagctga

SEQ ID NO: 90950 - DNA, 1012 bp, Glycine max
  Peptide Sequence Number=SeqID_182635
acctcacgaggaaatgggcccttgcagccgatcaggacggcgtcgaggacactgtctgtgagaaatacggcatcagcaaggaaaagtgggtccagttttgccagactcgcagagacccttcttgggaggatgtgcgcaagaaggcacatgccatccagaagcagaatattgccccccacgttttgtctcgtgggggttatgattatttggagcagaagctcctgattgagaagacgaagaagaagctggaggaagctgcacagtcaggaagcgttgatggcgtcatcgaccctccatccccggtcagacgccacgtgaagtggaagatggcccgcacgaagaagacagaggagatgacgactgaggccgcaaaggaaatcgctgaaaagattgattcgtttgaggagcaggccacacagggatcgttcgtcctccatggacgtcaagatgttctcgccgctgctattggacgtccagagcaccctggacgtgtccgtgctgctggagctgcagctgacccagcagatcagggactagctagaggagtccatcacagagaaagtgacgaggcaagtcaggcatccttcaaccagcttcagtcgcagatgcaatctcaaggacttgcagtgcctcctgagcctctggttggtccctccggtcctcaagtgagcacaaaggggagttgtgtttatccctcaggaaacgatcctgagaccggtgactctgacaggtgtggcttgtacatagaagcagatcctgcccacctggttgccatggggagagtttatgagggatccactgttgtttataacactcctttgttgcttggccaagtaaaggtgagtgtggaggaggttacagatgcagatgctccagttcttgtacccactgatgaggtttccttagtggggcaggcacttcacaccttccttgcttggccgacacatctggtcaagtctttatcacagcaagtagctgtgtctcggcaaaccacctccgagctcgatccgaa

SEQ ID NO: 90951 - DNA, 156 bp, Glycine max
  Peptide Sequence Number=SeqID_182636
atgaagaacgatgaagaatggagaaaagagggaggtggttgccgcccagctcccccaggcgagctggattgcttccaccagaaggcaccgccttctgttggaacccctggaaggcccaagtgggcctggttgctatttgcaccccctttttactaa

SEQ ID NO: 90952 - DNA, 333 bp, Glycine max
  Peptide Sequence Number=SeqID_182637
atggaggtcatgatgagcatgaagaagataatggaagctaatgcagttgtagttgccgctaccagggctgttgctaaggtgaactcgatgcccccaactggcctcaagcaaatgaatcatccaacctcagatatggtaggcaaagatttaggaagtatgggcagcccccatgatgtgcaaattcaaaacgagtacgctttcccgccatatggcttgcctctcaactatacgccacccaatatggcgtacactcccaatgagaatgtcaataactccactcctatactcgttgagagccaacaacctcaatctgatcatgcacatgtctcttga

SEQ ID NO: 90953 - DNA, 315 bp, Glycine max
  Peptide Sequence Number=SeqID_182638
atggaaatttatgtgagtgatcgactaggaaaaagtgtgtatgtgtgtttcttgatttcagatgttgtcatcatcaaaaagggggagattgtagaagcaaagcttcatgatgaatcaagagtgattcaaagatgttttgttgataacaaagatgatgacaaaggcgatgacaaaaagctcaaagatagaatcaagaacacttcaagattcaagaggaaagttgatttcaagaatcaagaatcaagattcaagacatcaagatttcaagagatcaagattcaagactcaagactcaagaatcaagagaaggcttaa

SEQ ID NO: 90954 - DNA, 146 bp, Glycine max
  Peptide Sequence Number=SeqID_182639
atgaagagaacgaggatgtgggacttcccccggagttgcaaaggatggtcgcccatgagaccaagaaatgaggcctcatcaagaagagacagaactagtagacttagaagctggcagtggaaaaagggaagtaaagataggaacgg

SEQ ID NO: 90955 - DNA, 180 bp, Glycine max
  Peptide Sequence Number=SeqID_182640
atggcacgcagcgtgtccgcttcgtgcccctattcaaaggacctatatgggagggagctaactaggcttttagtgataattcccaaggtggtcatatctctcttgatggtttctagaggaattaatgaaacattgggcttaatccggattttggttatggacttgaagagggcaaattaa

SEQ ID NO: 90956 - DNA, 473 bp, Glycine max
  Peptide Sequence Number=SeqID_182641
taccctcaccttcagaggactacacgtcctcgccatcagaaggctacacgccctcgcctttagaggactacacgtcctcgccttcagaggactacctatccttgccatcagaggattacatgtcctttccttcagagggctacacgccctcgccttcagaaggctacacaccatcgccttcagagggctacacgcccttgccatcagagggttgcacgccctcacctttagaggacttcacgtcctcaccttcagagaactgcacgtcctcaacatcagagggttgcacgccctcaccttcagaggactacacgtcctcgcctttagaggactacaagtcctcgccatccgagggctgcatgccctcacctttaaaggactacacatcctcgccatcgaagggctgcacgccctcgccatcgaaggactacacgtcctcgccatcagaggactacacgtcctcgccttcagac

SEQ ID NO: 90957 - DNA, 636 bp, Glycine max
  Peptide Sequence Number=SeqID_182642
atgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtagcggacaaattggagtattacccaaatcatgcgcctattgccacagccgtagatataggtattttgagaatacgtcttcttaaagaccaatggttaacgatggctctgatgggcggttttgctagaataaacaataatgagatcactgttttagtaaatgatgcggaaaagggtagtgacattgatccacaagaagcacagcaaactcttgaaatagcagaagctaatttgaataaggcggaaggcaagagacaaacaattgaggcaaatctagctcttagacgagctaggacacgagtagaggctatcaatgtgatttcataa

SEQ ID NO: 90958 - DNA, 513 bp, Glycine max
  Peptide Sequence Number=SeqID_182643
atgtacgacacacctgttgagttgaagtgggatggcagcaaatttgggctttcaaatgttgatgcttcattcttcttgacattctctgatgtaaatgaaatagtagctggatacaaatgtttgaacatatctatactacagttatggatgttgtttttggatgagtggagctcaactttgggtcatgcttccgtgtatggattccttgagccacaatcgatacacaatgcaaaggatcttgctgaatgtgagcattacttacaagcatggctcaaggaatcgcaacgagaggtgggccattggcaactggtagtactgtgtcctacgaccaatgagtgtggctactacgtgatgcattggatgtggaacatcatcggtgggggtttaaagaatgattggagcatgtggtttcttgatggaacggcgttagacaacgaaacaattacaacgattcgccagaaatgggcagcatattttcttaaagttcaaagcaatcaatgtacaaagtcttag

SEQ ID NO: 90959 - DNA, 306 bp, Glycine max
  Peptide Sequence Number=SeqID_182644
atgcctggagactatcatcatcttgtacaccttttgtcgtcctgtcccgtgaagtcagacatgcggggttacgttatggttacccgcacctttcgtagacaaggggaaaacgagcccgttgacgcgcaaagactaacatcgtcttctgcaccttttgtcgtcctgacccgtgaagtcagcgacatgcggggttaccctatgtttaccctcaccctttgtcaaccaggggcaaacgaaaccgttgaggcgcggagactgacatcgtcttctgcacctattgtcgtcctgacccgtgaagtcaggtga

SEQ ID NO: 90960 - DNA, 198 bp, Glycine max
  Peptide Sequence Number=SeqID_182645
atgaaggaaatccaacaaaggatggagtcgccaactgtcgcaacctactcttcggcgggagggcgacgcgtgactcgcgggatgcgtgttccacgaaaggaatacgcacggagtcgccaccaacgtttatttgaggaaaacgtcggaaaaaccggaaaagacgcgatctacgaacttttaagtggtgggatcctctag

SEQ ID NO: 90961 - DNA, 175 bp, Glycine max
  Peptide Sequence Number=SeqID_182646
cgcacccgtgagcctcgccctcgctcgcccgcgaagggcatgttgcgacaacagggctcaagaggaggatgcttctacaaaccagatcccaaagccatccctagcacccatacttgattatgccacaccatctgcaccagctgctcaggtgttggaccttaatgagcatgcatag

SEQ ID NO: 90962 - DNA, 219 bp, Glycine max
  Peptide Sequence Number=SeqID_182647
atgcaaaaatgccctaggtatggggtatcacggtacaaagtgaaggatgatgacaagtgtagtagtgacgaaaactcaaagaagggccccctagtgacggtttgtggtatcttccgatcattctatggtttaagcgtctatttgctaatagagacgatacaaaagactttacatggcatgcaaatgggagaaattgcgatggaatgctccatcatctag

SEQ ID NO: 90963 - DNA, 291 bp, Glycine max
  Peptide Sequence Number=SeqID_182648
atgaagctttgcttctacacgcagttgatccatgatcgcgtggtgatggagtgcctagaggttgagccggtccaagtgatagaggtgtcatcctctgaaggggatcttgaagaggacccaatggagttacctcctgaacctgctatggacgcccttgacttacctgaggatgatgaagacccactccctgatgttgattctccagaggatattatgtcagcatctgaggcagactctatagaggagagtggccctggaggaatagcgaatagtgacgactcttcatcatag

SEQ ID NO: 90964 - DNA, 356 bp, Glycine max
  Peptide Sequence Number=SeqID_182649
atgatacgcggagataccttacggttatccgccccctccctttgccattcagacacagtcgtgttcgatggcaagcagagaccaaagaccaagtttggtcattctgcacacatgatacgcggagataccttacggttatccgccccctccctttgccattcagacacagtcgtgttcgatggcaagcagagaccaaagaccaagtttggtcattctgcacacatgatacgcggagataccttacggttatccgccccctccctttgccattcagacacagtcgtgttcgatggcaagcagagaccaaagaccaagtttggtcattctgcacacatgatacgcggggataccttacg

SEQ ID NO: 90965 - DNA, 415 bp, Glycine max
  Peptide Sequence Number=SeqID_182650
atggcagctggccaacctaggctggctgagtgtatgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcag

SEQ ID NO: 90966 - DNA, 120 bp, Glycine max
  Peptide Sequence Number=SeqID_182651
atggaaatggccccgaggaagcttgcctcaaagagatctaggaaggacgccgcggctgcagggactagtgccgctcctgagttcgatagccatcgttttaggagcgctgagcaccagtag

SEQ ID NO: 90967 - DNA, 390 bp, Glycine max
  Peptide Sequence Number=SeqID_182652
atggcaacacagttgatccatgatcgcgttctgatggagtgcctagagggtgtttgggagaccctcgaaggcattgagaggtgccgattccgtggcacaattcgactcactgctacttcattagtacatccggaggaacccgcacgcacacttcagcagcctgtggagtggatactacctacacctactccatatcgactagttgagccgaggacccagaggagttacctcctgaacctgctatggacgtccttgacttacctgaggatgatgaagacccgctccccagatgttgattccccagaggatattatgtcagcatctgaggcagactctacagaggagagtggccctagagggacagcgattagtgacgactcttcatcatag

SEQ ID NO: 90968 - DNA, 290 bp, Glycine max
  Peptide Sequence Number=SeqID_182653
catttgatttgaggacgaaaaagaaaatacttcaaaccataggggagcggtggagacagttcaagtctaatttaacatcgaaatgggcacttgcagccgacaaggatggtgtcgatgacattgtttgtgaaagtacaacattagcaaagagaactggacccaattttgtcagagtcgcagagacccttcgtgggagattccttagaggagcaggcctcacagggttcctttgtcacccatggatgtcaggatgtactgactgctgccattgggcaaccagaacaccctag

SEQ ID NO: 90969 - DNA, 81 bp, Glycine max
  Peptide Sequence Number=SeqID_182654
atgaaaaggaacaaggagtacccgttgcctgactgtcgggagaaaatgttggaagagatagtgcaaagtataggcatgtga

SEQ ID NO: 90970 - DNA, 465 bp, Glycine max
  Peptide Sequence Number=SeqID_182655
atgaatcccaaaatttcggactttggccttgctcccagattatggggagaccaagtagatgctaacactaacaagattgccgggacatatggatacgtgcctcctgattatgctgtacacggacatttctcaatgaaatccgatgtctttagttttggtgtcatggtgttagaaatagcatggagactatggactgaaggaaggccaacaaacttgatggatgtatttttaggtgaaagatgcacttcagctgaagttattcgatgtatacatataggcttgttatgtgtgcaacagataccagttgataggcctgatatgtcagctgtggttctaaggctgaatggtgaaaaatcgttgccacaaccaaaggcacttggtttttacaatggaagggacaaagcagatttgtatggaccattttctaacaattatgtttcccttacagtttttgagccaagataa

SEQ ID NO: 90971 - DNA, 327 bp, Glycine max
  Peptide Sequence Number=SeqID_182656
atgtggatcaaagggagggggggagtatccaaagacactttttgtggggatgctaaaggggaggacaagaaagtctttagggtgaggtgggaggtggtgtgttctccaaaagaaaaggtgttggaggtgggaaaggtggaatggggaagtttggaagcgggatctcgagtggaggagggaatggtatcgatctatcatgaagctggtgcatggcaaagcatctcatataaatgcttgaaagtggatttggaagtgcatcaatatcatcaactgggacgcggagtttttggattacgtagaggttgggataattattgtaacatctga

SEQ ID NO: 90972 - DNA, 172 bp, Glycine max
  Peptide Sequence Number=SeqID_182657
gttgcgacagtggttaaagagaagtgtaaggaggtaagtgtctcctccaagagacacttgctagcattgccagaccttgggcttgagtttattcctcaagtaaagaagttattggatgagggttcggttcgcaagagcttaaatccttgtgctttgttggtgcccaaaatag

SEQ ID NO: 90973 - DNA, 129 bp, Glycine max
  Peptide Sequence Number=SeqID_182658
atggcacaagaatgcttcccaaatgaatataggatgtggaattgcccctccagtgtagataaatggcatgaaagttccttttcaaatgcaagaaatggccccgaggaagctcgcctcaaagagatctag

SEQ ID NO: 90974 - DNA, 201 bp, Glycine max
  Peptide Sequence Number=SeqID_182659
atgacacaaccacccaggctggtagggatcatcctcgaaagccgtgagaatatcactacaaagaaagccctcaagctcaacttcagagtctcaaacaaccaggcagagtacgaggcaattatcgcaggtttgaagctagcaagagaagtcaaagctaagaaattgcgatgctacacagactcacaacttgtccatagataa

SEQ ID NO: 90975 - DNA, 244 bp, Glycine max
  Peptide Sequence Number=SeqID_182660
atgactacaggtgattcaccccaacagaagacaagtcaaggaaatgagaaaaagaaagaagatgagaatataactcaagtggattttattgattatcgaagtaattttactccacctcaacaggagagaagtctaagaatcgatatagaagaagaactcaagaatattacgaaaggcgatccacctcaacgtgagagaagtcaaaaaatcggcaaaaagaagaaattcaagaatatagcacaag

SEQ ID NO: 90976 - DNA, 255 bp, Glycine max
  Peptide Sequence Number=SeqID_182661
atgacagaaccatcgaagaagcgaaagggcacttcgagtcggagtcaacggcattccgggtcacaggaaacaccaattccttcctccattccctctggatcattgttttcatcagaggaacagcaagtccatgaaggtaccctaatgtctgaggtttatgggattaagatggtcattgaccagtccctattctatgatttaacccaattgccaagcgaaggtgtaccatttgagggtgcactgattgacaattga

SEQ ID NO: 90977 - DNA, 168 bp, Glycine max
  Peptide Sequence Number=SeqID_182662
atgggattccggggcttccgggacacccgtaatgcttccgaaaaagtgggaggaggttgccacccagctcgcttgggcgagctaacgtcgcttgggcgagctgggcggcaacctcctcccactttttcctataaaaaggctgaagggggctgttctaaggatccttaa

SEQ ID NO: 90978 - DNA, 720 bp, Glycine max
  Peptide Sequence Number=SeqID_182663
atgaacttaatcattgttatcaaaaggaaagaacacgttgtatggcacccttaccaaacccatgctagagctagagtaatgggtgaagtagaggaggtgcaaaagcagatgaaggccgacatggaggccatgaaagagcaaatggccacaatgatggaggccatgatgagcatgaagaagataatggaagccaatgcggttacagtttccgctaccagagttgttgctaaggtgaacccgatgcccccatctggcctcaaccaaatgaatcatccaacctcagatatggtaggcaaagatttgggaagtacagacggcccctattatgtgcaaattcaaaacaagaacgccttcccgccatatggcttgcctcccaactatacaccacccaatgtggcgtacactcccagtgagaatgccaataactccactcccatactcattgagagccgacaaccccaaactgatcatgcacatgtctctcaaaccatgggggagacacatgaaattccccaccacaatctagccgactttgagccttgcctcagatatgccactgaagagcaagcggttggtggtatacccttgcaaaacactttggagggccatcagtatcacccacaaccacaccccttgcattccacagtgggtaaaaaccctcatgctatggcaaaaaatgggaaagttggatcatctagaggaaaggctcagagccattga

SEQ ID NO: 90979 - DNA, 699 bp, Glycine max
  Peptide Sequence Number=SeqID_182664
gcggaatttgaaatccctgaagcttctgacagtaggacaaagaagaaaattcttcagattatcggcgagcgctggaggcagtttaaatctgacttgactaggaaatgggcacttggagccgacaaggacggtgcggacgacattgtctgtgaaaaatatggcattagcaaggagaaatggacccaggatgatgtgcggaaaaaggcacaggcctcccagaagcaaaacactgccccccacgtattgtctagtgggggttatgaatatttagcagaaaagctcatggctgagaagacaaagaaaatactggaagaagctgcccagtttggaagcactgagggaattattgaccctccatctcccatcagacaccacgtgaaatggaagatggcccgcacgaagaaaactggacagatgatgtctgaggcagcaaaggaaatagctgacaggattgatatcctgactgctgccattgggcgaccagaacaccctggccgtgttcgtgctgttggagccggtgtcaccataaagcaatactttggatcggcttcgcgaacgtcccacagttcttcctccatgcctcctgaagacctagaacagttgacccaaaaaatcagagaccaactggaggagtcaatcacagaaaaagtgactcgaaagatgatggaatccttcagccagatgcagtcccagttttag

SEQ ID NO: 90980 - DNA, 276 bp, Glycine max
  Peptide Sequence Number=SeqID_182665
cacttggttcgccagcaggcggccaaccaccgggggcaggtacagatacatgagtgtctctactggttcagcctcagtcaacaggggcaaggttttgctccttttgcatgccctactccagagcagtttagggctgaggtcgcatggcccggagattggcccgaggcccaggcaggggaggagcctactggatctcccggcgatgcagaggaggcccgtatggatgaggagataacggacttgctcggtttcttgggaggaagcggagccatgtga

SEQ ID NO: 90981 - DNA, 204 bp, Glycine max
  Peptide Sequence Number=SeqID_182666
atgggggttcaaatagcaaccaggcccacttgggccttccaggatgttcctccagaaggcggttgcttctggaggaagcaacctagctcgcctggaaaattcaagccgaggcgcttccgtaacgttttcgtgggtgatttcgcgaagattttagaccgttcttcgacgttcttcgtcgttcatcggtcttcaaccgatttctaa

SEQ ID NO: 90982 - DNA, 788 bp, Glycine max
  Peptide Sequence Number=SeqID_182667
cttgcttctacaaggtagaattgtttgtcccctacaaggtcatcgcatgtgtgccgaaaagtgaaaaaaaattaggaggaactcttggcaagtatggattcccgaatgaccccttgatgggaacaaggggttgtattaattataatcccatactagccataagacaactaggttaccctatgagaggggcaccgttggaagagatcatcgcgcctttcgttgcatggggtttcaatgaaggcaacgcaaaaatacttcagagaatccgcaaggcgtggaatgcagtggaaagaagagataaggagcttagggggagcagcaacagtgtcgttggtggctatcataagtggttgaaggctaggacgcaagggataacttggctcccaaagcaaaaagatccaaagcttgaaagaacgagggtgatcaaggaaaagctcaagacaacagttactagggtcaaaaaagagtgtgacgagctaaaggatgtcaacatgactatagacgaagacaacaacgagttcaagcttcaaagggccgaaagggacaagtcaagggtggaatgcatggctttaaaggataaaatgaaggcttgtcaaaggtcaaagagaagtttgaccgaacagctgagtagaacaaaagaaaatatgttcacaatcattgaccagtataaggagaaggcgatgaaatggatggatagattcgctctcactctgaatgggagtcaagagcttccaaggctgttagccagagccaaggcaatggcggatgtatacccagctcccgatgaa

SEQ ID NO: 90983 - DNA, 768 bp, Glycine max
  Peptide Sequence Number=SeqID_182668
atgaagcgtgaaagtctgcatcgctttcttagttgcatacattgggtaccatgtgaagtagccagcttgcgaaaactggggcagcggatggatcaagttcaatgtcaggctttcaacaaaggatatgggaagatctgggatctggcgatgattgaagtgtccattgaagccatcgcatctcttactcaatactatgaccaatcactcagacgcttcacttttggggactttcagttagcaccaaccatagaggagttcgaagggatcttaggatgcccgatagaaggaaggaagccatatcttttttttggattctacctttctatggtgagaatagtagtggtggtcaagatcccggaacaagaactagaccgaatgaagcaaaataggaatgtggtagcagggataccaaggaagtgcttggaagagaaggcggaaactctgtccagccaaggagagtggacatcattcatcaacgtattaacactgctagtgtttgggatagtactattttcaaatgtagacgggagtaggaataagttccgaggggctttgtggggcagcagtaacgagctcaaacttagaaaggtcaagagggacaaatcaaggataggaagcctgatgttaggggataagttaaagagttgtcaaaggtcgaagagaagtttgagagaacagttgagcaaaacggaaggaaatatgttgataatcattgaccaatataaagagaaggtgaacctaattgctagtcacgggtgtaaatcatga

SEQ ID NO: 90984 - DNA, 330 bp, Glycine max
  Peptide Sequence Number=SeqID_182669
acttatcaaggtaatccttgtggcgtctatcctgacttatcttccttcaccggaagtggcgtctacacagacttatcttccttcaccggaagtggcgtctacccagacttatcttccttcaccggaagtggtgtctacccggacttatcttccttcaccggaagtggcgtctaccctgacttatcttccttcactggaagtggcgtcatccaaaacctccgtagcctgtatcaaacgatccgctcctactcaggacggctaggtttttccgtgcgagctcaaccgagggttcgttccgaccgacactggcatgttgttcttctcatttag

SEQ ID NO: 90985 - DNA, 144 bp, Glycine max
  Peptide Sequence Number=SeqID_182670
atgacgaagaacgaacgaagaacaatgaagaacggggaaaagagggaggtggttgccgcccaggtcgcccaggcgagctgggttacttccaccagaaggcaccgccttctgttggaacaccctagaaggtccaagtgggcttag

SEQ ID NO: 90986 - DNA, 205 bp, Glycine max
  Peptide Sequence Number=SeqID_182671
gatcaataacaatgtctataggttggacctcccagaagagtatggagtcaagaccacttttaacatttctgatttaatttcttttgcaggtgcaactgatgttgaggaggagaaacaaactgatttgagagccatgagcaggaggctccaagaggattgggctagagcagctgaagagggccctaaggttctcatgaacctcaag

SEQ ID NO: 90987 - DNA, 369 bp, Glycine max
  Peptide Sequence Number=SeqID_182672
atgcaagaagaaaatgaagaagaagattcagatgatgaagaagagttttcattctttaggaagaaatttcagaaatttatcaaaaaaagaagaattgacaggcatcagaacttcaacaatggaagaaaatctcaagaagattctcaagtccttagatgttacaaatgcaaccaaattggtcacatcaaagtcaattgtccttcaaatgaagaatggcctgagaaaagtgataagaaaaggtatgatgaaagaaggaacaagaaagcctacattgcatgggatgacaatgattcatccgatggttcaaaaaaggagattaatcttctaaccaaggattatgaaagtgatgagaacatttctcaagaatga

SEQ ID NO: 90988 - DNA, 378 bp, Glycine max
  Peptide Sequence Number=SeqID_182673
atgaggggcatcgtgcatgagcctcaagtgaacctaggggccgatcaaaataccctcacctttagagggctacaagccctcgctttcagagggctgcacgtcctcgccatcagagggctgcacgccctcaccatcagagggttgcaccccctcgccttcaatgggcgacacgtcctcaacttcagagggctgcacgccctcgccttgagaggactagacatcctcgccgttagaggactagacgtcctcgcctttagaggactacatgtcctccacttcagaggactacacgtcctcgcctttagagggctacgcgctctcgccttcagtgggcttcatagccacaccttaagagaatttaaggtcctctacccttaa

SEQ ID NO: 90989 - DNA, 372 bp, Glycine max
  Peptide Sequence Number=SeqID_182674
atgtcattgcctagcgctgttcatgcgtcctccaccttcgagcctggagccccgcgaatgtcattgccaaccgttgttcgccaattctccattctccacttttattcggagacccatgaatgtcattgcctagcgctgttcatgggtcctccaccttcgagtctagagccccacgaatttcattgcctagcactgttcgccaattctccattctccacttttattcgagagacccatgaatgtcatttcctagcgctgttcatgtgtcctccaccttcgagtctggagccccgcgaatgtcattgcctagcgctgttcgccaattctccattctccacttttattcggagacccatgaatgtcattgtctag

SEQ ID NO: 90990 - DNA, 654 bp, Glycine max
  Peptide Sequence Number=SeqID_182675
atgatcatcatcaaaacaccaaaggcagttgcatctacaagatttgtgtatggtaactccgaaggtcaacgtgaacatgatcctccggtgaaatatgacgtagataaagaaacttgggagcaatttgctgcaagccgcaaaactcctaactggcagggaatcaggaagaagatgcaagagatccaaaaatacaatgactgcccccatgtactttctcgtggggggtatgatttgcttgaaaagaagatgatggaggagaagatgaacaaaagacaacatgacacaatgacaactgagaatacaccaaactctagggatcccccatctcccattcaaagacatgtcaagtgggtgttggcacgcactaagcaatatggacagatgacatcaaagtcggcacaagaaatatctgataaaattattgcctcattggaagaacaaacgagacagggtacctttgtcccccatggtcgtgaagacatattgaacactgccatcgggcgaccggatcatggaggctgtgttcgggcagcggggtttggggtcacaataagtcaatactttggaagggcagcacatggctccatttgttcatcagggtcgatcagccaagtacaaatggctgaaataattggaggcctacaggaacagtga

SEQ ID NO: 90991 - DNA, 87 bp, Glycine max
  Peptide Sequence Number=SeqID_182676
atggcaatactggaaggacttcttgaactactagagaataaagaatgtgctcactggaaagctaagtatgtatctggctggatctaa

SEQ ID NO: 90992 - DNA, 1002 bp, Glycine max
  Peptide Sequence Number=SeqID_182677
atggcagaaccatcgaaaaagcgaaaaggaacctcgagtcgaagtcagcggcattctgggtcacaagaagccccaattcctccctccattccctctggatcattattttcatcagaggaacagcgtacacggtacacaaacctcttttcctctcgttccattgtagacccaaaattcatagatatggagttcttctctaatgagaattttgaatgcttccaagcatttgaaaactccaatcttattccatttatgtctctgaaattacctatctattctgaattagtcaaagttttttattctaattttgaaatccatgaaggtactctaaactctgaagtttatgggatcaagatggtcattgaccaatccctattttatgatttaaccaaattgcctagtgaaggtgtgccttatgagggtgcactgattgatgaatggaaattcgatttcgcggtgcatgatgcccgccggttggtttgcaccaaccaagcggatatgaccggaagacttcttgccggttcattggcttttgaaagtcgcatcctccattaccttatagttcgcattttgcttcctagatcttcaaaccttgcccaggccccattgccttatcctcaccttgttaccctcttccttcaacatttcaacatctctcttgattttgaaccttatgttccaatcaagagatcattccttataggcgcttcagtcatagcatcctttggttatattaaggagcatgattgctcatgcgtaaagaagggtgctagaaatattggtgaagaaggacatgagggagaagattcatctcttctttcgaagattttggaaaggtttgatggtcttcaaacctttgttggtgagaggtttgatactttagaattgcaagtggatatgcgcttcaatgaaatggagtcaaggatgacaaaggttgaagaagatgtatcttacatccggtcaagcttcgatcttccatcaccgccgcctccatcatcttag

SEQ ID NO: 90993 - DNA, 291 bp, Glycine max
  Peptide Sequence Number=SeqID_182678
atgaacgttgtgggaggttgggagaaggaagaagaagtggaaaagtatggattggagcgcgatttgcgaggggaagaggtgaaggtggattcggtaaccaattcggggatccagtgcaccgatttttttgtgctgccggacgatgatacggcgcgttccttcgggaccttgcgctggagggcgatgtgcttggccttcatggaggcagactcatcgagcgcgtcagggccaagaggaacagcgtcgaacggaggtggaagcggcggcagaaccttggggacggggacctaa

SEQ ID NO: 90994 - DNA, 435 bp, Glycine max
  Peptide Sequence Number=SeqID_182679
atggctactccacctgcctcgcctcctcctctttctccttctcctcctcctcctcctcctgcagtagcatcagaaccacctagggcagagagaccagtggtccatgtcgatcctgctaccgggaaggtcgatggtccccacaagaagaaattaaaaacatatgtgggaattgtcgctcgtgataaggttgacgtgacatacgagacttggaaggaagtccctaccgctcaaaaggatttgatatgggaggatattcaggctgaatttgatgtccctgaagcatctgacacctacaaggataatgtggatgacactatttgtgaaaaatatggccctccatctcccatcagacaacacgtgaagtggaagatggcccgcaccaagaaaactaggcagatgatgtctgaggcagcaaacaaaaatgctgagaagatt

SEQ ID NO: 90995 - DNA, 369 bp, Glycine max
  Peptide Sequence Number=SeqID_182680
ggtacatctacttgggtttgactgagaacaagagagggtacatctcttgtggatcagttctaatggagggtacatccactaggttcaaagagaacaagggagggtacatcccttgtggatctttgcttgtaaatggatttttacaaggtatgagccctccaagaacagaagctggtttggatagaatagcttggaaaggaactgttgatggtctgaaaagaattagaatgttcttatggaagattagtcatgaaagcattttgacaaatgcaaagagattgagaattggcataagtgtgaatgatgagtcttgtgcatgtcaagctaaagctgaggctctcttgcatcttttctgggactgtaatgatt

SEQ ID NO: 90996 - DNA, 108 bp, Glycine max
  Peptide Sequence Number=SeqID_182681
atggatgtggacccgatttgtccaagatgtggtcaaggagaagaagacacattgggggttcatctagaccatcgtgctgagcatcccaagttgaatcctagagggtag

SEQ ID NO: 90997 - DNA, 486 bp, Glycine max
  Peptide Sequence Number=SeqID_182682
atgggtgaccaagaggaagtacaggaacagatgaaagccaacatgtcggctttgaaagagcaaatggcttccatgatggatgccatgctaggaatgagccaactattggagaataacgcggccaccgctgccgctgttagttcggctgccgaagcagacccaactctcccagctaccgcgcaccatcctatcccaaatgtggtaggacaagaaagaagcacactggggcacatcagcaacccccatctgggatacaaccgagtggcttacccttatggattaccacctaattacacgtcaccagtcatgcgtgatgacgcgggtcatgtcccttcccccatccttaaaggggagcctcctcgacagtcggacgagattcacgaggatcgtagagagcatacccaaggagacatcgattcctactccccagtccccgtcgaggggccgacaccaaacacactacctcagcccaacctcatgggataa

SEQ ID NO: 90998 - DNA, 354 bp, Glycine max
  Peptide Sequence Number=SeqID_182683
atgactagaggcaatccatctgacttacaaccctttgatcctgagatagataggacatttcatagattagttagggatcattttataccttttgagcatcctgaacattctgttattggtgagtctgagcattttgtggttagtaattttgaacatcctgattttgagcattatagttttgaacattctgattttgaaaattctgagaacatggcacaatctccaccccgtgaagacccgcacaaacatctgaaagaattccatattgtctgctccaccatgaaacccccagatgtccaggaggatcacatatttctaaaggcttttcctcattctttagaggggatcctctag

SEQ ID NO: 90999 - DNA, 525 bp, Glycine max
  Peptide Sequence Number=SeqID_182684
atgcaaaatcaggaaattcaggttggaaacagctactccatggaaaattatcaatgggagcaagagttacaaccctacaatcaatatgaagaagaaagaacttctaatctggataatttattgatgcaattcaaggaagtcactgaatatactcaacaagcatttaaaagttttgaaattcaagttggtaagctagcagaagaagtgactaaatttatggccagaagagaagaaaactttataaaggttgaagctcaagaggaaagccctgtacgaaagcatgattcaaaagaaaaagatgaagataaaagtgaggagaaagcacaacaatgggagaagtactcacaagaagaaagacatggagaacatgagaaagccttaagtgctattctttccttgatcactagcacttctcttgcaatgatatggaaggtgcttccagaatacatgactttcatggagtctctagctaggaggcaaaaatacaaggaatatgtgttctttgtgaccttcatgccaccttga

SEQ ID NO: 91000 - DNA, 791 bp, Glycine max
  Peptide Sequence Number=SeqID_182685
gactgcacgccctcgccttagaggactacacgccctcgtcttcagaggactacacgtcctcgccttcagagggctacacgctctcgccttcagagaactacacgtcatcgcctctccatgatagggctacaagtcctcgccttcagagggctacacgccctcggcgtgaggactacacgtccttacctttagaggactacacgtcctcgccatcagagggctacatgccctcacctttagagggatgcacaccctcgcctacagaggactacatgtcctcgccatcagagggcttcacgccctcgccttcagaggactacacgtcttcgccttcagaggactacacgttctcaccttcagagggctacacgccctcgcctcgaggactacacgtccatacctttagaggactacacgtcctcaccatcagagggttagacgccctcaccttcagagagctggacaccctcgccttcaaaggactacacatcctcgccatcagagggttgcatgcccttaccttcagaggactacacgtcctcgccatcagagggttgtacgtcctcaccttcagagggctacacgccctcgccttcagaggattgcacatcctcgtcttcagagggcttcacgtcctcgcctttagagggttgtacaccctcgccttcaaagggcaacacgtcctcaacttcagagggctgcacgccctcgcctttagagggctatgcgtcctcacttttagtgggctccatatccacaccgtaagagaatttaaggtccttttcccttaa

SEQ ID NO: 91001 - DNA, 237 bp, Glycine max
  Peptide Sequence Number=SeqID_182686
atggaagtgcttcttagtccaatagctcttaaggtggttggccccttgcttatggactcaaattctttaagggatggcaccaatcctccttccaattcctatatggcaacccacaaacaaggaaacaaagagacaagcaataaacaaagaccaaaaagaaataaaatgaaagctaaaccaatggagttttacaacaaagacttagatttttgcaaggaacatgttattcaggactaa

SEQ ID NO: 91002 - DNA, 903 bp, Glycine max
  Peptide Sequence Number=SeqID_182687
gtacattgagcaactgactgaaatgcctcaaaatgttctttacgatgccattgggatatatcaacggtgttggaactcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattaaagagctctgccctgactgtggcacagcaggcctaggcatttgctctggcctttccttgctggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 91003 - DNA, 1122 bp, Glycine max
  Peptide Sequence Number=SeqID_182688
atgggacccctccaaaggcaagccttccgcaaagtgtacaggaagatcctagatttggccgcagcggaggtatttacggaagctgtcgtatccctcgcccaatactatgaccatccgttgaggtgtttcacgtttggggacttccaaatggtgccaactattgaggagtttgaagagatattaggatgccctctcggggggagaaaaccgtatcttttctccggctttcttccttccttgagcaaggttgcagctgtgattggagattcggcaaaagagttggatcgcatgaagcaaattcggaacggcgtagtgggcctgcctcagaaatacttggaagacaaggcaagggatatggcaagccaagagaagtgggggccgtttgcggatgttttagctttgctgatttttggggttgtcctctttccgaacgttgacggcttggtagacttagccgccattgatgctttcctcgcatatcaccatagcaaggaaagtccagtggtagctatcttggcggatttgttcgatacctttgaccggaggtgtgagaaaaacagtgtacggattttctgttgtttacccgctctctgtgtgtggttgacttcacaccttttccgacaagacacgagacacccgtgtccgcttcaaagctatcgctcatgcgccgaaaaaggaagagtcgattgggaccaacatttggcagggatagggggcagcacgatcaattggtttcctcattggatggaaggcaaggaaggagttcttttctcgtgtggggactatcctaatgttccattgatagggactaggggttgtattaattataatcccgcactcgccataagacagctagggtatcccatgaggggagcgccaaccgaagaaagtctctcgcctttccttgtgagagatctaggagcgcaaggtctcaaggttatacaaagagtccacaaggcgtggaggagtccgttgaggaaagacaaggagcttaggggcatccgaaacggcgtcattggaggttatcatgggtggctaagaattcacacgcggggcttagattggctctccaaattgaaagttatcaatgaggagaaccgtcgaagctccggaggaagatga

SEQ ID NO: 91004 - DNA, 781 bp, Glycine max
  Peptide Sequence Number=SeqID_182689
atggcattaaagaagagaaaggaacctgccataccttcccaagtccaatatgaccgatccaggctcacttctcctgaggcctgggaaaggtacacagatattgtggtaaccaggaagaaagagttttatgctaacctctacgatctcgaggataaatcacctaagcatgtgagggtgagaggccatttggtgaagtttgatgcagacactctgaacattttcttgaagacccctatgataattgaggagggggaagagcttcctgcctactctagatttgcactcttgaggcctgatcctcaaaagttggctgctaagctctgcatcccagggaggggatttgagcttaatgtcgacagcttgccactgaagatccttaggaagaacattaccacactcgctcagacttggagtgttctttcttactccaacttggtccctacctcccacgcttctgacatcacactggatcgggccaagttgattgatggcattatcatgaagatggacatgaatctaggctacctcatctcccaccagatttatatcatttcccagcatgactcctctaggcttggatttccagccttaatcacaactttgtgtaaagctagaggagtcacatcagattctagatctttggagagccttagccctgccattaacttggcatatataaagaagagctgttggaatctagatgatccaatagtgacattcagagggccaaggaaggccaagggtaagagatctgaggctccccctacttcagtagcaccag

SEQ ID NO: 91005 - DNA, 496 bp, Glycine max
  Peptide Sequence Number=SeqID_182690
gtcgactctagaggatcccacgtcaacctttcgaactgctgctgaatccacgggcaggcaagagactccctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagcagtggcttggttaagggaaaccaccggagccgtagcgaaagcgagtcttcacagggcaattgatgaagcttgggtgaaaactaagtggaggtccgaaccgactgatgttgaagaatcagcggatgagttgtggttaggggtgaaatgccactcgaacccagagctagctggttctccccgaaatgcgttgaggcgcagcagttga

SEQ ID NO: 91006 - DNA, 453 bp, Glycine max
  Peptide Sequence Number=SeqID_182691
atgaaggttcactgttatcaagcaagtcggagacccaacatgatcacaaattcacctccactccttatgttcccatggacccggttcccagtggagtcgccaactgtcgcaacctacccttcgacgggagggcaacacggggctcacgggtgtgtcttccaatggaggaaggcatgtggagtcactaccaacatttattcaaggaaattgtcagaaaaaccggaaaggtgtggtctacgaactttatgtgtgaaaggttcgggagttgtttttacgcacggggaagggtgtttcccttgctcctacgtatccttaattgcgatgaggaaattagacctatgtagttctgcaaaagcagtaagttacatgttgatttatgcttttgaacggtccatgttaaccgataaaaacaaaggagaccgtttaaggcgttggaccttaaaacggttttaa

SEQ ID NO: 91007 - DNA, 1667 bp, Glycine max
  Peptide Sequence Number=SeqID_182692
ccttcaatggactacacgtcgtccccttcataaagctacacaccttcacattcagaggactacacatcctcgccttcagagggctacatgctctcaccatcagaggactacacgtcctccccttcagaggactagacatcctcaccatcagaggactacacgtcctcgccttcatagggctacacaacctcaccatcataggactacacaacctccccttcatagggctacacgccctcgccttcagaggactacccatcctcgccttcagagggctacacgctatcgcctttagaggactacacgtcctcaccttcataaagctacacgccctcaccttcagagggctacacgccctcgacttcagagggctacacgctctcgccatcagaggactacacatcctccccttcagaggactagacgtcctcgctacgcgccctggccttcagagggctgcacgccgactacatgacctcacctttagagggctacacgccctcaccttcagagggctacatgtcgtcgccatcagaggactacacgtcctcgcctttagaggactacacgtcctcaccttcagaggactacacgtcctcgccttcagaggcctacaggccttcgccttcaggggactatgcgtcctcacattcagagggctgcacgccctcgcctttagaggaaaacacgtcctcgcctttagagggctggacaccctcgcctttagaggactacacgtcctccccttcatagggctacacgccctcaccttcagaggactacacgtcctcaccttcatagggctacacgccctcaccttcatagggctacacgccctcaccttcattgggctacatgccctcactttcagaggactacacgccctcgcctttagagggctacatgctctcgccttcagagggctacacgccctcgccttaagaggactacacggctacacgccctgcctctcaaaggactacacgtcgtcacctttagagggcttcaagcccacgcgttcagagggctacacgccctcaccttcaaagggctgcacgccctcgccttcagagggcaacacgccctcaccttcaaagggctgcacatcctcgcctttagaggactacacaggattgcacgtcctcgccatcagaagactacatgtccttgccttcagaggactacacgtcctcacctttagagggctacactcccttgccttcagaggactagacgtcctcaccttcatagggctacacgccctcaccttcataggtctacacaaccttaccttcatagggctacacgccgtcaccttcagaggactacacgtcctcgcctttagagggctacacgccctcgccttcaatggactacacgtcctccccttcataaagctacacgccctcacattcaaaggactacacatcctcaccttcagagggctacatgctctcgccatcagaggactacacgtcctccccttcagaggactagacgtcctcaccatcagaggactacacgtcctcgccttcatagggctacacaacctcaccatcataggactacacaacctcaccttcattgggctacacgccctcaccttcagaggactacatgtcatcgccttcagagggctacacgccatcgccttcagaggactacac

SEQ ID NO: 91008 - DNA, 187 bp, Glycine max
  Peptide Sequence Number=SeqID_182693
gtcgactctagaggatcccacgttattttcccgattgaatcctccaatctccaatgtgttctaccccgtcaagagcggaccctctttactgggaaatgtgatctttgttattttcccgattggatttttccattctccaacgtgttcttcaccgtcaagaacggaccctcttgactgggaaatatga

SEQ ID NO: 91009 - DNA, 174 bp, Glycine max
  Peptide Sequence Number=SeqID_182694
atgaaagaaagagaatggaagatcttcaaaccagataaattttcaacaagattgccattcaaggtcgttctcgactggcgatatcccaccacacatgaacaaagaggaaaagatcgaaacacccagcgtccactccaaaaacactaccctcaagaaaatcctattgatccgtga

SEQ ID NO: 91010 - DNA, 411 bp, Glycine max
  Peptide Sequence Number=SeqID_182695
atgaagaaaatgataagaagaagaagggaattgcttttaaagcctcatcttaaatctaagaagaaagtgacagaagattcaattgacttagatgaaaatgaagatcttagcctctttgtcaaaagattcaacaaattttttagaatgagaggaaatcaaagaagacaaaacttcgaacctaaaagaaggactgaagagtcatttcaaactccaaaatgctttgagtgcaatcaacccggacatctgagggatgattgtccaatctttaaggaaagaataaagaagtctgaaaagaaggcaatgaaggcctacatcacatgggatgatagcgacttagaatcgtctgatgattctgaaaaagaaatgattaatctatgtccaatgggcaaaaactatgaaagcgacaaagag

SEQ ID NO: 91011 - DNA, 606 bp, Glycine max
  Peptide Sequence Number=SeqID_182696
atgcatgccggggcaagatttcacccagacgctgcaaggagacgagtgtggatcatgtgcatcaacatatggatgatgttgctacttagcaaccttcttcccagtgaccaccactccgatctccccctgccgaagtgtcagctgggatcacgcccgcaagacacccagtggacccgaagaagtccaatagggccttggggttctagctctgattacaggcctctgtcggttctacgaagtgaccaccactctgatctccccctgccgaaatggatcacgcctacaagacactcagtgtgcctagagaagtccaacagggtcctagggtttccaggtttgattacgagcctccgtcagttctacggagtgcccgtcgcccctaatagggtcatgaggcccctattaacaaggctttcatcgagaagtactacaccatcaggcaggaacagggtgaggcatcatagtagtgggcaacagacgcaccgccaccacctccaaagttcacctcaactcatccacaaaaaggctggagcgttgcctacgacacatggccgaccaacaggcgaccatcatcattttcactcctcttttaaacccaccaattga

SEQ ID NO: 91012 - DNA, 2075 bp, Glycine max
  Peptide Sequence Number=SeqID_182697
tactcgtcttccagcttgcggcggccgatggtctcgcggacctgggcgcgctggttgtcgttggttacgtcggtctggcgggtagccacgcgctgcacgatgtgccaaccggcatcggtgcggaacggctggctgacgccgccgtcctggatgccggctacctgctggccgaacgccggaccgaacgcgtcgaccgggaaccagcccagatcgccgccctggcccttgctgttgttgtcctcggaggattccttggccacggtctcgaaatccgcgccgccggcgatgcgggcgcgcagggtatcgatcttggccttggcggcagcgtcggtctggtgatcgtccacgcgcaccaggatgtggcggccgtggtattcggtgaccgtgtgcgcgccaccgctggcggcgctggcatcacgcacttccaccagcttcagcagctggaagccgctggggccgcggatcgggccgaccacttcgccgggtttcatcttttccatcagctgggcaaaggcctgcgggatttcatccaggctgcgccagcccagatcgccgccttccagcgcgttcgggctgtccgaataacgcacggcggccgcgttgaagtccagctcacccttgtccagcagggccttcacgccctcggccttcttctggccggtggcgatctggtcggcgttggagccgtcgggcagggcgatcaggatgtgcgccaggtggtactggttgcccaccgtggcctgctgcttcagcgcggcgtccacttcaccctcgctgacgctgatgcggctctgcgcgaagctctggcgcaggcgctgcacggtgatttcatcgcgcaccgaagcacggaaatcgttgaaatcgatgccgtcgtgggccaggcgctggcgcagtgcatccaggtccgagccgttctgctgggcgatggcattcatcgcctggttcagctcctggtcgctgacgcggatgccgctgccctgggcgcgggccacctgcagcttgaccagcaccaggcgctcgagcacctggcggctgagcacgtcttccggcggcagctggttttcacggccggcgtactgcgccttgatgttggcgatcgcacgctggagctcgctctgcaggatcacgtcctcgtcgacgacggcggcgatgcggtccaacggctgcgcctcctgcgcgagcacctgcaggggggcggacacgctggacaccgccagcagggaggcgagaagaacggggaagcgctttggtcatgggatcagattcggatcgtagtcatcccgggtcgccccggtgttgctgggcggcacgagatagaggtcgtcgcggttatagccgaggatagcacggcgcagcgtgcggtccgtgtcctggccgatggagctcaggcccttgaggacgaactccagctggatggcgttgttcatctcgccttcgcggttgcgcacgtagcgccgggcgacagcgcgcacggccaggcagcagctgtcccactgcacgccggcgatgatttccagcggttccttgtcctgcagcgagtagtaatagcggccgaccaggctccagcgcgcattcagcgggtacaggaacgacaggtcggcctgctccagcagggtgcggtcatgcttgttggcacccggcagggcaccggcattgatgcggtagcggtagctcaggttgaccacgccgtcgttgggcatcaggtaacgggcgcggacgctggccagatcctcgcgcttgtacttcgggtcccactggtaggtggcgcccagggtccagcggtcgttgatcatgtagttgccgtcggcgatccaggccgacttgcccttctccaccggcgcgccgccgggggtgacggtcacccgcgactcatcgaagtactggatctggccgatcgaggccgagaagcgttccttgccggtggtctggtcgatgaagcgggtactcagcgccagggtcagctggttggcgtcgttctggcggtcggcaccggtatagcgcgagtcgcggaacagctggccccagctgaaggtgaagtcgcgggtatcgaagatcggcagctcgtcctggttgcg

SEQ ID NO: 91013 - DNA, 570 bp, Glycine max
  Peptide Sequence Number=SeqID_182698
gactacacgtcctcgccttgagaggactacacgtcctcaccatcagagggctgcacaccctcacctccagaggactacatgtcctcgccttgagagggctacacgccctcaccttggaggactacacgtcctcgccttgagaggactacacgtcctcaccatcagagggctgcacgccctcacctccagaggactacatgtcctcgccttgagagggctgcacgccctcaccttgggtactagttaccctcaccgtgagaggactacacgtcctggccttgagagggctacacgtcctcgccatcagagggctgcacgccctcaccttcagaggactacactaggactacacgtcctcaccatcagagggctgcacgccctccccagagactacatgcccgccttgagagggctacacgccctcaccttggttctagttaccctcaccgttgagaggactacacgtcctcgccttgagaggactacgcgtcctcaccatcagagggctgcacgtccttcactatcagaggactacacgtctcgccttgagaggctacacgctctcatctg

SEQ ID NO: 91014 - DNA, 246 bp, Glycine max
  Peptide Sequence Number=SeqID_182699
atggtttacaagattcatagaagaagtaaaggaaacaatgaaatcccagataaaccaaatcatgtttataaattgcaaaaggctctttatggtttgaaacaagcccctagggcatgtagaaaaatcaagcaaactcaagaagaattcatcaatcaagccaagtactgcaaggaattgatcaaaagatctgggttttatggaaatgcaaataacatggctacaccgttattagaaatagctggttag

SEQ ID NO: 91015 - DNA, 1941 bp, Glycine max
  Peptide Sequence Number=SeqID_182700
atgcctctcttcctctccgacgaggagttcgcgtggtgctccggtgacggctctgccgtggccgcgaaggccgacgccttcatccgcggcctcttcaacgagctcgacaccgtccgctccaaggcccacgccgccgacatcaacgccgagcagaactgccttctcatcgagcagaagtatctctccctcaccgccgagttctccaaactcgagtcgaacatcgccgaacttcaatcctctctcgatcagcgcctccgcgaaatcgacgaggtgcaatcgcagaaccaccgaatcaaattggaagcggttgagaaagatagggagatagagcggttgaggacggaggtggcggagttgcacaagtcgaagaggcagttgcttgagttgaacgagcagaaggatttggagctaagtgagaagaatgcaaccatgaagagttatcttgataagattgttttaaaaatcaatccgcggttcgtggtggcaatgtcaaggtttttggagtgtttgccaccgcaattatggccatatatcggctgcatttgtttgcaatttcccactatcgaggaacaagacaaaacagctattgcaactgccatggttcgtttaagtgaaaatgctgctcataaggaggcacggttgagtgaagttgaggcagaattggcactgtgccgggctgcttgcactcgctttgaacaggagaaggagattgttgagaggcagaattcgtggctcaacgaggagttgaatgctaaagttaacattgtttttgagctgcgcagaaagcacactgaatttgaagctgatatgacctccaaacttgcagatatgcagaggcagtttggtgaaagttctaaatctctactgtggaatgaggatagagtgagggagcttgaaattaagcttaaatctgtgcaggaggaattaatttctgctaaagatgttgctgcagcgaacgaagaacaattatctgctgaactttccactgtgtctgagcaagggtctgaagaactgacacctgcagcttgtctattaacatttgaaattgagtgggagagagagccttggtcaaaaggccggccaaaaaagatgcaggaccctcatgttgatctcctatcatcaggattagaagcccaatctgcattagaaaatgcagtgagctgtacaggaattgctgatgatgctattgctttgcagctgaatgagctgattaatgagggactcgatgagccttggagtatagaattgtttaatagggaattgaatgaacatcttccttacccttgcatatgcaaagaggctgtttccggattcgaacccatgaccaacaagtcaccaagacacaactttaccgctgcaccagggctcgccctcacacatcttgttaataagcttaatgagctatataaagagagttccgaggaatggtcaaaaaaagcagcagacctagagggtgtgataaaagcaatagagtcacgcctaaagcaagttgaagatgattataaagagaaacttgagaaggaattatctgccagaaaacaagttgaaaaggttacaacaatggtaatgcttggagttgatgaatacttgggtgacattgggttgctggaggccactgatttaaaagaaaagcttgagaagtgtgaagctgaaattgagacaaggaagaagactgatggagtgaataatcttcctcttagcagttttgctactgaaccgtggatggaaccaattgaagctgataccatggttgaggaaaatagcttgctactagtcccaagaattcctgttggagtttctggaactgcattggctgcttcacttctgcgagatgggtggagtttggccaaaatgtatgcaaaatatcaagaggcaattgatgcattgaggcacgaacaattgggaaggaaggagtcagaagcagtactgcaacgggtatga

SEQ ID NO: 91016 - DNA, 3306 bp, Glycine max
  Peptide Sequence Number=SeqID_182701
gttgttgctgaattgcaaaaggcaaaggacgaaattgaaaagtggaaagaggaagctcatgccaacaaagcccacatgctgcagtataagagcattgctgaggtgaatgaagatgcactgaaagagatagaaaaggcgcatgagaagtttaaaatagaggctgacaatggaaagaaagatctggaatctgaacttaagtcactaagagacaagatgttagagcttgaaaataaatcttctttgaaatatgaagaagttgcttctgaaactgtgggaaaggaagaggctcttacatctgctatggctgaaatcacaaatcttaaagaagaaattttaaccaaatcttctcaaatttctgcaatggaaattcagatctcgggtttaaaagaaaaactggacagggaacatcagaaatggcgggcagctcaaaccaattatgaaagacaggttgttctccagtccgaaactattcaggagttgacaaaaacatctgaagcactagccttgctgcaggaggaggcatctgagttacggaaactagccaatactcagaaaattgaaaataatgaactaaaggctaagtgggaagatgagaaggtacaactagagaagtctaggaatgatgctgagaagaaatacaatgaaatcaatgaacagaataaaatactacatagtcaacttgaggcttttcatattcaatgggccgagaaggagcgtaacgctgctggtatttcatctggaagtagtagtgcagatgcctttggtgatgctggtcttcaaaacgcagaaacagaagtttcattgttaaaacaagagaagctgcgactacagtcacagcatgagagtgctttgaaggcagcagagtctgcacatgcatcactagaaactgagcgtgcaaaatcaagatcatttttgtttaccgaagaggagttcaaagcattgcagcttcagaaattgcgtgaactagcacaaaaggttagagctgagacagagaacctagagaatctcctgagggaaagagaaattgagcttcagcgccataagaaagaaattggaacattaaaaatggaaaaagataatctcaataagaaggtttctgagttgcttgaaaggagtaaaaatgttgatgttgaggattatgatcgagtgaagaaacttgctagagaaatccaggataaactaagagagagagatgctcggattgaggaacttggtaaaagtctatcagaaaagcaggattctgtttcatgcctagagaaagatctttcaaactgccgattggagctagcagagagagagaagagaattaatgacattctgcataatgaggctaacctaaaacttgattcggagaagcataggaaactgctggctcagtttaaggtgcatggaaattcttatcttggaaaatggatagagttctttggatggttggaaaaggaagacctagggaaagagaaccaacaactttctaggcaattagatgaaattaaacaagggaaaaggtcaacatgtgatacaacaggtgaacaagcgatgaaggaggaaaaggacacaagaatacagattctggagaaacatctggagagacagagagatgaattaaagaaggagaaggaagagagtcgtttagagagaagtagacgactgaagactgaaaaggccataaaggactcttacaacaatgttgaacaggagaaaataaaattgattattgaaattgagaggtataaggagtctctgaaaaggttatctgatgaagttgaaaagcttaagattgttattggcaatcttcctgagggttcaaatgtggttcaacttctttctggatccaatgtcgatgactttgctgctccttacatatctgctgtggaaagttttgaaaaggaagctcagtcagtatttcgggagcttggaggtcgcggtaatcttggagatgcagcaacaattacggatggttcagccgctgctacagcggcccctggagttagcggtttaccacctaaagccactggagaaagtgagaaaagacttgcattacccaaagctagtgttgaaactcgtcgaacaggtaggagattggtcaggcctaaactactagagaaaagtgagaaaagacctgaggagcttcaaggtggtgacacagaaatgtctgatgctgaaggacctgggggcaagcctgggcagtctagtgacacagatactagtaatgttgttcaatcatctcaacaattggctcgtaagcgtgttgctcctacctccacttctgaattacgtgaagaatcagttgcacctggtgagaagagctctgatgtcttgaagaagtcaaaaggatctgagtccctagaagagaatacagaagaacaacctgctgcaattctagaatttactggcagccaccctgtcactgaagaattatttgatagcagtgacatgccccaatgccaaaatgaggaggttggtgaagctcaaaatgaagatggtgaaattgctgtcgggaatgatgaggaatccaaagatccacggcacttggatggtactggtcaagaggaattacaagctgacaaaactggaactttagaagagaatcaagatcaatctgctgaaacaaaagtgctgtctgatgagatgcagaggaatcagacagacccagacaatcagcagtcaacattggcgcccagtggtgagagagaagagggagaattgatgccagatactggagatctagagggtgctagtgatttgtctaacattgcggaaaaccaagaatctcgggaaggtcaatctgagtctgctgcaactcctgaacgttccccagctagggttgatgatgatgctctagaggctggtgagattaattctcctgagctttcaagtgatgataagaatgatgagggtgacttggtagaggaggctgctgatggttctgacaagttgattgatgtcaacgaaccaatatcagctgagagcgatcaagtggctgagcctgttgcgagtgagactgctacttcgacaagcactgttgcagagagtagctcctctaaagtgaacttacctgttccaaggcaagggacccctagtgcccccgctgaaacagaagagacaaagcaggcatcacctgttggtagtacttcaacaaccataaatttatcagagcgagcacgggaaagggctcaaatgagacaggctgggttggtttcttctacccttagaggtcgtggaagaggcggtgctccccgtggtcgagttggtcgaggtaggggagtagtacgccgaccacctccaccacctggcagtgatcaatga

SEQ ID NO: 91017 - DNA, 672 bp, Glycine max
  Peptide Sequence Number=SeqID_182702
atgacggaagggtgtggtgaagggttttgccttgcaaaccttcccggtgatgcttttagtctatgggggaacttctttgaggcaaagaaacaaatgatggctgatgccaagttgcggggctgcttgccgttggttgaaatttgccccccggtcaacttcgtggttttgcccgttgttggcttggctagggtcggcggtgctgggttatggccccgtgctaagtttcggattggttggccccctcctcccccccgtgatcagttttgttgccaggattttgccaactttggcttgcgccccggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 91018 - DNA, 555 bp, Glycine max
  Peptide Sequence Number=SeqID_182703
cgcttttcatgcatcctccacccacgagcctggagccccgcgaaattatttcctagcgctgttcgccaattctccattctccacttttatccggaaacccatgaatttattgcctagcgctgttcatgcatcctccaccaacgagtttggagcccccctcatgaatttattgcctagcgctgttcatgcatcctccaccaacgagtctggagacccgggaatttattgcctagcgctgttcgccaattctccattctccacttttatccggagccccatgaattcattgcctagcgctgttcatgcatcctccacccacgagcctggagccccgcgaaattatttcctagcgctgttcgccaattctcctttctccacttttatctggagcctcatgaatttatttcctagcgctgttcatgcatcctccacaaacgagtctggagacacgggaatttattacctagcgctgttcgccaattctccattctccacttttatccgcagccccatgaatacattgcctagcgctgttcatgcattatccacccacga

SEQ ID NO: 91019 - DNA, 239 bp, Glycine max
  Peptide Sequence Number=SeqID_182704
atggtggctgatgttaaggcgatggttgtgcgtctgcggctggctgctgctgctggtcttgcctcgactgctagacctgaaatcaatgccgaaaatcctagtgccttgttggacttctctgggtccactgggtgtcttggaggtcatctagatttaagtcagagtggtcatgctagtgtgcatgatctgcacccgcttcctcgctacgcttcgtgcaaaatcatgtccaggagagcaaa

SEQ ID NO: 91020 - DNA, 276 bp, Glycine max
  Peptide Sequence Number=SeqID_182705
atgaccatgattacgccaagctcgaaattaaccctcactaaagggaacaaaagctggtaccgggccccccctcgaggggatgctttggtttggggtgaggctaatggggatgctgacgtgaatttgtctcttcttattgtcactgctgcacagggtttggcttggtttgtgttgagcttctcggccttgtattgcaagatcgaattcctgcagcccgggggatccactagttctagagcggccgccaccgcggtggagctccaattcgccctatag

SEQ ID NO: 91021 - DNA, 1015 bp, Glycine max
  Peptide Sequence Number=SeqID_182706
aggactacatgtcctcgccgttagagggctgcacgccctcgccttagaggactacacgtcctcgccttcagtgggctacacgccttcgccttcagaggactccacgtcctcgccttcagaggactgcatgtcctacccatcaaagggctacacaccctcgccttcagaggactatacgtcctcctcttcagaaggctacacgcctttgccttcggaggactacatgtcctcccctttacaggactacccgtcctcgccatcagatgactgcacaggactacccgtcctcaccttcagaggactgaatgtcctccttttgggagggctacacgcactcgccttcagaggactatatgtcctcctcttcagaggattacacgtcctccccttcagaggactacacatcctcaccatcaaaggacctcacgtcctcgccttcagagggatacacgtgctgaccttcataggactacacgtcctccccttcagagggctacacgccctcgccttcagaggactacacgtcctcaccatcagagggatacacagcctcaccttcagaaggatacacatcctcctgttcagaggactacacgtccacgctttcagagggctacacgccctcgccttcataggactacacgtcatcgccttcagagggttgcacgccctcgcctttgttgggcttcaccccctcgccttcataggactccacatctgcgccttcagagaactcgagggatcgcgcccacaagacacccagtggacttggaggagtccaacagagccttggggtttccagctctggttatgggcctctgtcagtcctacaaggtgtccgtcccccccagcaaggtcacaccatcgtgacataggtaaggattgcactcgcaagatacccagtggacccggagaagtccaacagggtcctggggtttgcagctctgattacagacctttgtcaattctacggagtgtccatcgcccccaacaaggtcatcaggccccctattaa

SEQ ID NO: 91022 - DNA, 402 bp, Glycine max
  Peptide Sequence Number=SeqID_182707
atgtcgaaaaaagacagaaaagcaacacaactcagatcattggctactagaccagttaaggcgaagggaccagtggttcatgttgttctagccactgggaaagctctggcacatggaaaggagggtgaggatgacaaagtatgtgaaaagtatgacataagcaaagagaagtggaaccaattttgtcagaatcgtagagatccttcatgggagaaggcacaggccattcaaaaacaaaacactgcccctcatgtgttgtctcatggaggttatgattttctggaacaaaagttgatggaagagaagaaaaagaaacgattggaggaagcaacccaatctaggagcactgacataatcgttgaccctccatctcccattagacgacacatgaagtggaagatg

SEQ ID NO: 91023 - DNA, 392 bp, Glycine max
  Peptide Sequence Number=SeqID_182708
aagcgttaggtgtggcaaagcctttagtagctagttaccttagccaggagatactggcagagcaagaagttgatagagtgcatggattacctgcgcagcctccggtgaagttcaagaatatggtggttatatcactgtcaatgaaactcaaggaagagcactgttctattggtttttcgaggccactcacaaaccagaacaaaaacccgttctcttatggctcaatggagtgtcaaaatcttcttctcgaactcgctgattactttgtctatcaatgtggtggctgtggtgccgttcttcgagcgaagcataaaggttatgtgagtggtagcttgtcggatgaggggaaggttgtacttggaggacattctggtaaattagaaagttcttag

SEQ ID NO: 91024 - DNA, 167 bp, Glycine max
  Peptide Sequence Number=SeqID_182709
gtttgctgggaaagtggatatgggccttagcttatcatctgcaacaaccttgggccaggattatcaattccaagtatggagccaagtctgattttcagtcagctcgtgttcaagggggggcattcatactggtggaaggacctaagaaagctttatcaccagtctga

SEQ ID NO: 91025 - DNA, 249 bp, Glycine max
  Peptide Sequence Number=SeqID_182710
atgcatgagaacaaatggcacggagcatgtttgctctttgcccctatttggaaacctatagataggcctaactcacaaaagtccccagtggagtcgccaactatcgcaacgtgcccttcgcgggcgagcgagggcgaggctcacaggtgcgctttccaaaggaggaaagatgcgcggagtcgccaccaacgtttatttgtggaaaacatcggaaaaaccgaaggaaactggtcaaaaggaaaattctaa

SEQ ID NO: 91026 - DNA, 1059 bp, Glycine max
  Peptide Sequence Number=SeqID_182711
atgtgcagcgccaccgattacaaagttaaatcaatcggaggtatgtgtatcttaatccaaatgtgggcatgggaacgatgcatgactttggctccaaagaggacgcctcccgtcatagaaaataaaccactgggacacaggtggctgcgacgtggaaatcagcatattggcaatgatgatcttagacttttccgtcgcaaattggatctgatgaaacgacatgagtttgtctgggagccatacacaccaactgtgatggcagcgttgcctccaatttgtgtggttggaagtgtagcctggttcgcggtggtgccactgatttgtttccatgttgttgagtggcaccaacccgatagagttttacgacaatttggattgcaacaacctattctcgggcgtccttcgcaatcgcagaatctccatggcataacgctcaaagagtttagggtcgacgtttatcctcgacaggagggcctactgggttataactcggactacatggtgtggtataggcgtaaaacaaagatgtttgtcgacccaaacaatgcaaacacagctgcattgggtgacgttgtggagactctacagtatatggtgtcaccacaagggaggaacacatggacagttgatgatctcgcgccttatgtggataagttagcgattatatcagaagagcaagagagaatcactgagccagtgtcacatggtccagcatcagagcgtgaatttccagcacaagagtttcacattcttcagtcaagtgttgaaactcggggcataggcagacgaagggagcttgttgaagcagaacaatattcccaacaaatgatggagcgtggtcatggaatgtattacatgccagcaacattttccgaatatccttcacagatgtatcagtatccttttgaaggtcatcacactgatacttctgcgagcgaacattcgttcggtggtgttgcggaaacacaagctcatttttcatggcccactatgactccttcgcagcagcacgatgcccccatggcaacacctaacaccccatttgctccgcaatggaat

SEQ ID NO: 91027 - DNA, 1083 bp, Glycine max
  Peptide Sequence Number=SeqID_182712
atgggtcagctccagcagcaagcttttcacaaaacttacggtaaaatcatggacctagccatgatagaagtctccacagaggccatttcctctctcgcccagtattatgatcagccgttgagatgctttacctttggggacttccagctgtcacccatggtggaagaatttgaagagatcctaagatgtcctctagggggaaggagaccatacctcttctcagggttctatccctcattagctagaatttcaaagatattccaaatctcggcgcaggaattagaccatggaaagcaagttagaaatggggtggttggaataccgagaaaatgtttggaggcaaaagcaagaaccttggcaggtagaggcgaatgggccccgttcatagatgttctcgcactgttgatcttcggaggagtcctctttccaaatatggatgggttggtggatctagtagcgatcgacgcttttctcgcccatcatgaccacaaggaaagcccggttgtcgctatgttagccgacctatatgacaccttcgaccgaagatgtgagaagagcagtacgaggattgtttgctgtattccagctctttatgtatggttggtttcgcacttttttcgccaagaggtgaggcaagcttgcccgctagaaagccatcgttcatgcacagagaaaggagggacaaattgggaccgactcttagcaaacaaagaaagagcgtctgtcaactggttccctcgatggaaagaaggaagaaccggggttcttatttcatgcaaaggatttccgaatgttcccttgatggggacaaggggttgcatcagttacaatcctgttcttgctataaggcaacttggctaccctatgagaggggcaccgctagaggaagagctcgcgcctatcatttcacgaggtttcaataagaccaacggggagacacttcagaaggtccgcaaggcatgggaggtggtgcaaaagaaggataaagaactcaggggcagtaacaatgggcccatcggtggctaccgaaggtggttgaaagcccacgtgcaaggtttggattggctccgctcccgagtttga

SEQ ID NO: 91028 - DNA, 801 bp, Glycine max
  Peptide Sequence Number=SeqID_182713
atgggtcaacttcaacggcaagccttccgcaaagcctatggtaagatttgggacctagctagggtagaagtctccatggaaccgattgcatccctttcccagtattatgaccaacccctaaggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaaatctcagcacaagagttggaccgtgtaaatcaaaacaggaatggggtagttggagtaccaagaaaatatttggaggtaaaagcaagaatcttggcagataaaggcgagtggaccccattcatagatattctcacactgttgattttcgagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 91029 - DNA, 162 bp, Glycine max
  Peptide Sequence Number=SeqID_182714
atggagtatcgggaatatccgaggaaatgcttggaggagaaggcggaaactttggcaagccaaggagaactggctggtggatctagcagcgaccaatgcttttcttgcttatcaccaaaacaaggaaagcccgatcagtgctgttttagcagatgcgtatga

SEQ ID NO: 91030 - DNA, 222 bp, Glycine max
  Peptide Sequence Number=SeqID_182715
atgcttctcacaaccattacatgcaaactggtaatcgattaccagaggtctctacaacctgctgccttcaattctaagcgtggtaatcgattaccccccttggtaatcgattaccagaagcccttatggcttcctgacctcgttttcaagcctggtaatcgattacacccccttggtaatcgattaccagagaccatcttagcctcctgttttcatttttaa

SEQ ID NO: 91031 - DNA, 318 bp, Glycine max
  Peptide Sequence Number=SeqID_182716
atgggtgacttatgggatggacaaaaatcggtagatagaagttgtgataattacatcgatatagtttctcctttcattctcaataatatatgtcctatgatggtgagctttgctagggtttccgaaataagagtttcagaggcaacaagtcaagaggaggatcttctccatagaagtacaaagaagattaaggaaggtgcaaaggtttatatgaagggatcctctatgtcctttgcagataaaattcttcaacctgtgggacgggctggcatgtctatggagacggctatgaatttgcataaggatgtgatgaattaa

SEQ ID NO: 91032 - DNA, 366 bp, Glycine max
  Peptide Sequence Number=SeqID_182717
atggagtggcaaaagaagggtttgatcgagaagattgtggacccttttattgtggacgagataaaaccgagctctttgaagaagtttggggaaacggctgagaagtgtttggctgagtacggtgtggataggccgactatgggggatgttttgtggaatttggagtatgcttatcagcttcagacgaacgaaaggaaaagggaacatgggattgatgctgatgatggctccgaagcggcggtaacaccaccacctatgggtgttccggcaaggcgtggtggcgttgatgcggacagtgatgatggtacttcggatatatcgagcagccgtgttttttcgcagctgataaccaatgaaggcagataa

SEQ ID NO: 91033 - DNA, 261 bp, Glycine max
  Peptide Sequence Number=SeqID_182718
acacttcaaatagagtatggtttggaagggctagttggacccgaatacgctggccctttgggaattcttcaagctctagcagatggtacaaaactgcttttcaaagagaatcttcttccatctagaggagatactcgtttattcagtatcgggccatccatagcagtcatatccatttcactaagttattcggtgaaaaacgataattatgtgtccatgaaggaaaaaaagatcaaaaagaaaggaaaaagttgcaaataa

SEQ ID NO: 91034 - DNA, 519 bp, Glycine max
  Peptide Sequence Number=SeqID_182719
atgactaccttgacccagatatggatgacactgctgctcagcaatgtcttgcctaacgaccacaacttcgacctccctctgcctaagtgccagttggtgtatgccatcctgacatggatgagcattcacgtagccgaggtgattgctgatgccatttatttgtttgcaggaatggcacctactaggcaccctttggacctagagaagtccaacagggccctggggtttccagccttgatcacgggcctctatcagtcctacggagttcatgtcacccccaacaaggtaatccgactgccgatcacccgagccttcatcgagaagtactccacgcctaggcaggcacagggtgacgcacatcaggatgcacgcacaccgccaccacctcggcaggctgatttggctaggcccctgggcgtggagcaatatctacaacatttggttcgccagcaggcggccaaccaccgtggacaggtgcagatacatgagtgtctctaccggttcaggctcagtcagtag

SEQ ID NO: 91035 - DNA, 813 bp, Glycine max
  Peptide Sequence Number=SeqID_182720
atgccgacgaggagtcagcctttatcgcggatatgttctcccacggcgtgcgcggcggaacaaggcatgaccattattagctatgacaaccggctggccgaaagcgtcccgcctcgggcgcgctacttcgatagtgtctcaatggacaacgttgaagcgggacgtctggcggcgcaacatctgctggacaacggttgccgtaatatcgtctttgccaccgaaagcgggttaacgctgggacgcagccataaaatcctcggctttcagtccgcgctttcccaaagcggtacagcggccagaggcgtggtgatagaaggtaaaggcaatcgggaattcggcgacgccgagatgttcgaactgggcgtaagcctggcgcaaaaaattagcgccttaacgccgcgagtggatggcgtggtagcgattaacgatgctttagccatcggcctgatggttgggctacgcgcgcagggcctgaaaatagcggaagatatttcggtgattggcatcgataacatctccctgtcggcgttatcgtcaccgggcctcacctcggtaatggccccgctttcggcaatggcgtcgatgatggttgagcggcttgtccagagaattactgagccgggattacaaaccgacgaatttatctttgcaccggaagtgatacagcgtcagtcgggagacctataccctattacattcaaaacgcatattaatgtcgggatttccatcccattcttttgtactttaacgagtataaccggaaataatgatgaacctacaatctgcgcaatatatagaaaagagcgccattaa

SEQ ID NO: 91036 - DNA, 1341 bp, Glycine max
  Peptide Sequence Number=SeqID_182721
atgatgtggacaaatcaaaacgccaaaaggttttatcaagtcaaggttaaaggtctagatgtcacttgcctcaaggaattgggacgattgatgggacccctccaaagggaagccttccgcaaagtttacgggaagattctagatttgaccgtagcggaggtatttacggaagccgtcgtatccctcgcccaatactatgaccagccgttgaggtgtttcacgtttggggacttccaaatggtgccaactattgaggagtttgaagagatattaggatgccctctcggggggagaaaaccgtatcttttctccgactttcttccttccttgagcaaggttgcggctgtgattggagattcagcaaaagagttggatcgcataaagcaaattcggaacggcgtagtgggcctgcctcggaaatacctggaagacaaggcaagggatatggcaagccaagagaagtggggggcgtttgcggatgttttagctttgctgatttttggggttgtcctctttccgaacgttgacggcttggtagacttagccgccattgatgctttcctggcatatcaccatagcaaggaaagtccagtgatggctatcttggcagatttgttcgacacctttgaccggaggtgcgagaaaaacagtgcacggattgtctgttgtttacccgctctctgtggggcagcacgatcaattggttcctcgttggaaggaaggcaaggaaggagtcttttctcgtgtggggactatcctaatgttccactgatagggactaggggttgtattaattataatcccgcacttgccataagacagctagggtatcccatgaggggagcgccgaccgaagaaagtctctcgccttttcttatgagagatctaagcgcgcaaggtctcaaggttatacaaagaatccacaaggcgtggaggagtccgttgtggaaagacaaggagcttaggggcatccgaaacggcgtcattggaggttatcatggatggctaagaattcacacgcggggcttagattggctctccaaattgaaagttatcgacgaggagaacttcgaagctctggaggaagatgaagaagtccgagctctaaagttagaactagggaaggcgagactcgccaaggagaagttcaaatcagctgctacacacatccggaaggagtgcaccgagttacaagaggaaaacgcagccactgcaaaagccctcgaacaagaaaccaaaagggcccgcaaggaggaatatggccgagagaaattccgaggagcattgtggggtagtaagaatgagctcaagcttcgaagagaggagagagatcggtcacgg

SEQ ID NO: 91037 - DNA, 585 bp, Glycine max
  Peptide Sequence Number=SeqID_182722
atgccttctgctgtgggttatcaacccactcttagtactgaaatgggtctttacaagaaagaatcacttctaccaaagagggacgatttaaccgatcctgcgcctgctacgacatttgcacatttagatgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtaggtaatatcgatgaagctactgcgaaagctacgaacttagaaatggagagcaatttgaagaaatga

SEQ ID NO: 91038 - DNA, 360 bp, Glycine max
  Peptide Sequence Number=SeqID_182723
atgctccaaccatatgggatcaacataggcttaaaggagcactcaaacccggtgacccccaaggcctacactccgaagagtccttcagggcctcttcctcctgattcagttattcctccggctgttccgatagaattcccaaatgtcagagagacggagaagagattaaaacctccacttgtaccgtcttcatacgattcctttttctccctccacgaatattatctcaaaaatcccaacggtggaagtgtgcaaaacttagttttgaacaaaatatccaaatttaatcaaaatccaacggttaacgaaaccgggatcgtagttttaccgagacagttttgggtttctgtgggaaattaa

SEQ ID NO: 91039 - DNA, 447 bp, Glycine max
  Peptide Sequence Number=SeqID_182724
atgaaactggccaaatacaggctagggcctctagagtgggaaggacgaccaggcccaagtggagaaggacaaagcccccgagtggagaaggatgaaggcccagaggcagagacactatcaagactattaattacttatcaaggtaatccttgtggcgtctacccagacttatcttccttcattggaagtggcgtctacccggacttatcttccttcaccggaagtggcgtctacccagacttatcttccttcactggaagtggcgtctaccctgacttatcttccttcactggaagtggcgtcatccaaatcttcgtaacctgtatcaaacgatccgctcctactcaggttcacatcacatttcctaatcgccatcatgcaaatttcattcagcgattgaatagaagagacaacagctggcagcggtcgcgaaataaccgtgactga

SEQ ID NO: 91040 - DNA, 303 bp, Glycine max
  Peptide Sequence Number=SeqID_182725
atggtgtacactcatcgggaatgggaggtggcaggtcttgcttgtgcacccactgatcatccatgtcttttcgataaccaaaaaagaattaagaataatacctttgacgttgatcatcggaggaaaacaaagtggatgatcggggagatgaaagagaaggaggaattggtgctggtgggtcaccggatgttccatggcaacggtggcttgcaacggtggtggtggaggaggatcccttttgtttctttgacaattatgccatttgaggttgtttcaactaattctgataggtgggctttgtag

SEQ ID NO: 91041 - DNA, 117 bp, Glycine max
  Peptide Sequence Number=SeqID_182726
atgcctgcaggtgtggatggaagaagcccagagtttcatgaacctcgggatttgaggtcgaatccttttcaagggggagggaatgatgcaatcctaccccccaagggcattggataa

SEQ ID NO: 91042 - DNA, 117 bp, Glycine max
  Peptide Sequence Number=SeqID_182727
atggcggcaattttctcttcttcgctcttcgtttcctcgcctattcctgaatccataaagctccacaacttttcagggctcgctcctcgctccttcaggataaagaggaaaaagtga

SEQ ID NO: 91043 - DNA, 645 bp, Glycine max
  Peptide Sequence Number=SeqID_182728
atgatcacgaaccttgttcgtgggagcagaatgacagtggcagggtgtagggatgttaccattcctcacaaggaggcagcaattaagtgttgtgatgaggttgatccagtggctaagtcaataggagctgtgaattgcattgtaagaagaccaactgacgggaaattgattgggtataacacagattatgttggtgctgttactgcaattgaggatgggttacgaggtaagcataatggtagtagcacaactatttcgccattagccagtaagttgtttgttgttattggggctgatgttgctgggaaggcacttgcctatggtgcaaaagcaaaaggagcaagggttgtgattgcaaaccgtacctttgagaacttgctgatgcaaattggaggagatgctttagccctttctgatttagataattaccatccggaggatggtatgattcttacaaatacaacatcaattggaatgcaaccaaaagttgatgagaagcctgtttctaagcatgctttgaaatattactccctagtttttgatgctgtcaatacgcccaagattactagactcttgaaagaagcggaagaatctggagccactattgtaacaggattggagatgtttatggggcggacaatatga

SEQ ID NO: 91044 - DNA, 297 bp, Glycine max
  Peptide Sequence Number=SeqID_182729
atgaaacttaatgaaacatttcctatttgcaccatatctccaaaggtagcgtatgagttctatgactctatacgtgggaagacattcaataaaaccaaggtcattgtttcatctcacaactatcagcttactccttcaatggaggatcttggtaaccttgtagcaagaatacaagcaacgggagcagacattgtgaagattgcaacaactgccttggacattactgatgtggcacgcatgtttcaaataatggtgcattctcaagtaagacgcttatgcctagaaattgaattttga

SEQ ID NO: 91045 - DNA, 417 bp, Glycine max
  Peptide Sequence Number=SeqID_182730
atggacgaagagcagtggatgtatgataatatgatgtctgaagaagttgatatgaatattgaaaatgagaaagatgctggcgttaaagtagaacacgttgattgctctgatatctttaatacttctcagttgtttgctacccgtgatgaagttttacaatgggctcgatcgttggctcatgacattggattttttgttgttataatgaggtcagacaccgatactggtgttcgaggaagagcctcgtttctattgatagcttgtgaaaggagaggggagtataggcctaagaaacataatttggtaagaacatgcactggcagtagaaaatgtggatgtccgttaaagttccatgcgaagccagtttcgggaggaggaggatggatggtgaagttaatttatggggttcacaattga

SEQ ID NO: 91046 - DNA, 510 bp, Glycine max
  Peptide Sequence Number=SeqID_182731
atgcctatgagagaaaagacatggctaagtaatacatgggtgggaagattgaagaaccttgtgttgtttgatagaatggaagatgatctcatgtggaatgggggcgaaggcatcacgccaaaatatattggagatgacatggtattattaatgggactcacagagaccagaactggacaaatggcgaaggaagcaaatgaacaaggtttgtccttattcaactcgttggaaaagtggactcctcaactgagaattgggtaccttctggtctggctattatactggggtatatctttgcatgcttgggacttggagcacattaaacagattgtgatggtggtaggagaagtgatggaggtggatgacaaaatggacaaactccacaagttggatagggcgcggatattggttaagacaccacaacaaccattaatccaacacaaggtctcaacatggattaatgggatagaatacaccatgcatatggttgaagaaacatgttacaactag

SEQ ID NO: 91047 - DNA, 251 bp, Glycine max
  Peptide Sequence Number=SeqID_182732
atgatggtactcaacaaaccaagaagggggttgtcgcaacatgcccttttgcgggcgagcgaggcgagggtcacgggtgcgctttccaagggaggaaagatgcgcagagtcgccaccaatgaaggtattagcacctctcacgtcgacaaaagcggggctcttgctcctacgtaccctccatcgaagaggaaatcagacctacgtagttcttctttaagagtgaatcaagcgattctttttttacttgaaag

SEQ ID NO: 91048 - DNA, 540 bp, Glycine max
  Peptide Sequence Number=SeqID_182733
atggggttagaaatctaccctaaggttcatgagaacccttggaccttcttcagcagctttagcccaatcctattggagtctcttgctcatggctctagtgactggtccctttctagggaggattgcatcagatctcatttgaggcataaaatttcgtgctcgttctctccttctccctccactcatcttctcctaccttcaggctcttatcgatggcttcctatggtgtggcatctccaatcatctttcttccttctccattccgcttccattgatcttcaagaagcaaaggacttcattgatgaagaagatccaaggcctacaagctccacatggagctacatcaaaacctctttttcaaagaaaactcactttgtatcctcaaaaggggtgaacctaactaaggtgtgcctaaaagcaagaaattcactatggtacttggatagtggctgctctaggaaattgactggtgacaagtccaaactctctgactttgtgtcaagggtggtggatacgtcatgttcggagaaggaaatttag

SEQ ID NO: 91049 - DNA, 369 bp, Glycine max
  Peptide Sequence Number=SeqID_182734
atgggaaaatcgtcaaagaagcgaaagggaacgtcctccaccaccgctgctgctggccatcgccgccacaaacaatctgaagcacccacagcaccaattcatccttccttatcatctccacgatcatctactctattttcttcagatgatcaacatctacagtacaattctcaattttcttctaggatcattttagacactaagtacctagacatagatttctttaatgatgagacatttgactgttatcaagtgtttcaaaactctggattaattgattttatgtccttaaaattgccttactatcctgaactagttagagtcttttacagtaatttaaaaattcaggatggtgtgattcgttctaag

SEQ ID NO: 91050 - DNA, 378 bp, Glycine max
  Peptide Sequence Number=SeqID_182735
atgttagaagacgactgtcggtatctgatggtaagtaagatacctacggtcggtatatctttgaaagctcagacggagataaacggactcctcgagggctacttaaggcactttagtgcaaaccaaccagaaggactggagctgttggatcctctgacgccccacaccattgcggcaggaggaggcttgcccatcagcctacttttttgccaagacgtggcaggagcgcaacgacctagcccaaacctacttaaactaaaggcttggcccggtctgaaggaagaagaaagtagaccttgtagagaagcggataggagagaccgacccagagaggaacgtgcccagcccacgagggcaccaccagatgttgtagattaa

SEQ ID NO: 91051 - DNA, 276 bp, Glycine max
  Peptide Sequence Number=SeqID_182736
atggcgcctactaggcaccctttggacccagagaagtccaatagggccttggggttttcggctatgatcacgggcctctgccattcctacggagttcctgtcacccccagcaaggacgctggcgcaccgccaccacctcggcaggccgattcggctgggtcactgggcgtggagcgcctcagtcagcaggggcagggttccgccccttttgtatgccctaccccggagcagtttggggctaaggtcacatggcctggagactggcccgatgcctag

SEQ ID NO: 91052 - DNA, 225 bp, Glycine max
  Peptide Sequence Number=SeqID_182737
atgtccgattcaagcgcatcacatatcgagacgctcgaaatagaacaatggaagctctcgacatattccactggtcataactattcacacggaggtcttattcaggcgcatcatataacgaggcgttcgtcattgcaacaacagaagctctcgagaaattcaaattgtcatgacctttcccagggaggtccgattaaggcgcataatatatcgagacgttcgtaa

SEQ ID NO: 91053 - DNA, 179 bp, Glycine max
  Peptide Sequence Number=SeqID_182738
ctgtggattatgcctctaaatgggttgaagcagtggctgccccaaagaatgatgccaaaactgtagtgaagttcttgaagaaaaaaacttttgctcgctttgggaactaccttcaagacccctataggcctgtctccgttccaaatggtttatggcaaatgcctaccacttaccggtag

SEQ ID NO: 91054 - DNA, 128 bp, Glycine max
  Peptide Sequence Number=SeqID_182739
atggattcatttcgtctgaagcaagagcaagccttaggtttcttggatccccgacaaactccggatacaagctatcaattgtcttccactgtggagaatcagtgggatgtcgcagcaagccatctaag

SEQ ID NO: 91055 - DNA, 831 bp, Glycine max
  Peptide Sequence Number=SeqID_182740
ttcaagcaaagagatccttgctggagttttattcaattgctcgactaccttaaactcgctttgttggatgaggcggaggaactcatgggcctcttccaaagtcacggtttttccttgaagtccctctttcttttcggctcctcttgccatgggaggatctacttccttcgagggggtggctatgtctgtgggctcttggaccatgggcgccttccctttagagggaaattccaccgggtgaggggaagcgaacacccgaccactgcgggttacgccactgaggccggtgatgttggcgctgtccgggggtatatgggtgtggagccggtccctttcctagtaaaacatatcactagggccttgggggttagaggaacctttttctcttccgactgcatacaaatttgtggttcttccctccctcctatggacacttcaagctgccccgctgaagcaattcttctaccgcgggataggtttccatgtcgtgtgactccccgaggtgaaacaaacattcgtccccttcgcctccgccacgggagaccatacatgccgcttgcagtgattggagtcaatgttgtgtccgggagctccactatggtacgcacacttggcacccgggtcataccacttgaggtagggtggctgaaagaccctcccgggagagaagttatcttccgggagtgggctctgtgcattattatagctcgtgccgggggccgtattgttgactggccggggcgtggctggagctgtgcgttgggccggcgttctctctgccgcgggcggtccttttacttgagtcaggggggaactctcggctcggattga

SEQ ID NO: 91056 - DNA, 312 bp, Glycine max
  Peptide Sequence Number=SeqID_182741
atgactcaatttatgtccagacgagaaaaatactttatagaggttgaagctcaagaggaaagccctgtaaaagagcatgagtcaagggaaaaagatgaggaacaagcacaaaaacaatgggagaagcccctcgctaagctcataactgttcatgcgctaagctgcgagtctcaagtgcttagtgctcaacccttgcatcttaagctgattcattctgctaagctagccaaggctgagttgagccaaatccaattcgatctagatttggctaagagaaagcctaccgctaagcgacagcttatccttggctaa

SEQ ID NO: 91057 - DNA, 204 bp, Glycine max
  Peptide Sequence Number=SeqID_182742
atgaggcttcactgtcatcaagcgagtcagagacccaacatgaccacagattcacctccactccttatggctcacatagacccgggcatagggcctaatatctcaatgagagaaacgttaaggcactggaccagtaacgatctcttgttttttttaaaaggggtggtcgacaaaagcggggcttttgctcctatgtatccttaa

SEQ ID NO: 91058 - DNA, 231 bp, Glycine max
  Peptide Sequence Number=SeqID_182743
atgttatcagttccgctaggatttccagaagaagatgccattcgtttgatgagaaataaaaaggggatatcgaaaattcgagtggctgaagctgaagcagctactttcgaagtaacagaaagaaaagcaacgactggagtgggagagtcagagtcgaaaagaggattcctcacttctttctctcattcaaaaccgtgcatgagactttcatctcgcacggctcctaagtga

SEQ ID NO: 91059 - DNA, 486 bp, Glycine max
  Peptide Sequence Number=SeqID_182744
atggagagagaagaaagagagagagtattagaatcattgcacggagaagctatgaaatggatggataagttcgctctcactctgaatgggagtcaagagcttctaaggatgttagccagagccaaggcaatggtggacgtatactcagctcttgaggaagttcatgggcttttcgattatttagtcatagtcaaagtaaacacaataaccaaaaagaatgaatgcgctttacggtacccctatcaaacacgtgccaaaaccaaaatcatgagtgagatagaggaagtgcaagagcagatgaaggccgacatggaggccatgaaggaccaaatgacctccatgatggaagccatgttaagtatgagatggatgatggagggcaatgcggccgcagttgccgccaccagcgccgtcgctgaggcggatctgactcacccattcgacataaacaaaacaagtcatccagtcccggacatggtaggttag

SEQ ID NO: 91060 - DNA, 465 bp, Glycine max
  Peptide Sequence Number=SeqID_182745
atgtctgaactgaccgccgccgccgcgctaaagctggtgggcgagatttttgtttatcatatgccttttaaccgtgcccttgggctggaactggaacggtatgaaaaagagtttgcccagctcagctttaataatcagccgatgatggttggcaactgggcgcagagtattctgcacggcggcgttattgcgtctgcgctggatgtcgccgcggggttggtctgcgtcggcagcaccctgactcgccatgacaccatcaacgaagaagagctgcgccagcgcctctcgcggatgggaactatcgatttgcgcgtcgattatttacgccctggccgcggcgaacgcttcaccgcgaccagcagcctgctgcgtgccggaaacaaagtcgccgtggctcgcgtcgagctgcataacgaagagcaggtttatatcgccagcgccacggccacctatatggtgggttga

SEQ ID NO: 91061 - DNA, 1778 bp, Glycine max
  Peptide Sequence Number=SeqID_182746
atgggcggcgccattgccacgctgttcttgcagcgtcaccggcagcattgcgacgccattgccttatgcgcgccaatgtttggcatcatcatgcgcctgccggactggatggtgcgccatattctcgactgggctgagggccatcagcgtattcgtgaagagtatgccatcgtcgccaacgctatcgtcgcaacctgcgtttttatgccgacgatccgcggttgcgcgtcggcgggccgacctatcactgggtgcgcgaaggccgaggatgaaaaggtggtcgataacctgatgcacgaccgctattgtgaactccgttccgctgccgggcacccttgtgaaggcgataagccgctcgttattgaaggggcatatcacgagatcctttttgaaaaggacgctatgcgctcagtcgcgctaaatgccatcgttgttgcgtctgatttagatggcacgctgctttcccccgaccatttcctcaccccctatgccaaagagacgctgaagctactcaccgcgcgcgggataaatttcgttttcgccactggccgccactacatcgatgtggggcagatccgcgataatctcggcattaagtcgtacatgatcacctctaacggcgcgcgggtacacgatagcgaaggtaaacaaatcttcgctcataacctcgaccgcgatatcgccagcgatctgtttgagatggtgcgtaacgatgtgaagattgtgaccaacgtctatcgtgaagatgaatggtttatgaatcgccatcgcccggaagagatgcgcttcttcaaagaggcggtgttcaactacaagctttatgaaccgggcgagctggatgcggatggcatcagcaaagttttcttcacttgtgaagatcatgaacatctgctgccgcttgagcaggctatcaacgcgcgctggggcgaccgcgtgaatgtgagtttctccacactaacttgtcttgaagtgatggctggcggtgtttcgaaggggcatgcgctggaggccgtcgcgaaaatgctcggctacagcctcaaagagtgtatcgcctttggcgacggcatgaacgatgccgagatgctgtcgatggccggtaaaggctgcatcatggcgaacgcccatcagcggttgaaggatttgcatcctgagctggaagtgatcggcagcaacgccgatgatgccgtaccgcattacctacgcaagctcctgattggcgaataccttgccggtagcgtcgatagctatttttccgtgctgatgcgcgtggggctggcagcgctggtttttttgcctttcctgcatacgcgcggccagtctccgcgcaccatcgtactctatatgctagtgggggcgatgcagcttggcatcatcggtcgtaaactgcgctggggctatctgcttagcgcggcgctggcggtgttaggggcggcgatcatccgctatgacaaagtcagcgatcatttctggaccgggctattgctggtgcagttgtcgaatatctgcttcgccatcggcatggtgggctacaagcgtttgatggaagtccgcccgatgccgcaacacaatgcttttgcctggttctatgcaggcgcctttattgtggcggtagcggcgtggtttatgctgagcaatccgcagaggttgccgaccaccgacctgcagtggggaatcctggactggcttggcgtggttgcttccggattgggatatttcatgtggaactacggcgcgacgcacgtggatgccgtgacgttggggatcatgataacgttcac

SEQ ID NO: 91062 - DNA, 318 bp, Glycine max
  Peptide Sequence Number=SeqID_182747
atgggtgaccaagaggaagtacaggaacagatgaaagccaacatgtcagctttgaaagagcgaatggcttccatgatggatgccatgctaggaatgagacaactaatggcgaataacgcggccaccgccgccgctgttagttcggctgccgaagcagacccaactccccgagggccacccccggcagcagaagaaaagaggaaactcgatctcatcgaagagagattgagggctgttgaaggctttagcgactatccgttcgcggacatgactgatctttgcttagtgtcggacgtcgtcatccccccgaaattcaag

SEQ ID NO: 91063 - DNA, 225 bp, Glycine max
  Peptide Sequence Number=SeqID_182748
atgaaaaacaaggagaaaaagaatgtcctcatctttgaagatctagacacttcaattctgaaaaagaaccatcgaagaagcggaaaggcacttcaagtcgaagttagcggcatttcgggtcacaggaaaccccaattcctcccttcatttcctctggaccattgttctcatcagaggaacagcgtatatggtacacaaacctcttttcctctcgttccattatag

SEQ ID NO: 91064 - DNA, 505 bp, Glycine max
  Peptide Sequence Number=SeqID_182749
ggccctgggatttcccaccttgatcacaggactctgccagtcgttcggagtccctgtcgcacctagcaaggtgattcggccgcccatcacccgagcttttattgagaagtattgcacgcagagacaggtccagggggatgctccacaggccgcagacgcaccgccacctcatcaggccggtccagccagattgtttgatacggagcagtatttgcggcatttggttcgccagcaggcggccaaccaccgggcacatgtacagacccatgattgtctttatcagatgagtctcagcctgcagagccagggctttacttcttttctgtgccctactctggaccagttcagggcagaggtcgcatggcctggagattggcctgaggcccgggcaggagaggcgccagcagaggcaccagtagaggctcccgcagaggcagatgaggcccacgaggacgaggagatgaccgatttacttgatttcttaggaggaagcggggccacatga

SEQ ID NO: 91065 - DNA, 87 bp, Glycine max
  Peptide Sequence Number=SeqID_182750
gatgaaagttctgagttgaaagctatagactttgggttatcagattttgtcagaccaggtcttccttcacaagtccttacttggtag

SEQ ID NO: 91066 - DNA, 468 bp, Glycine max
  Peptide Sequence Number=SeqID_182751
atggatgataaacctctattgcgccatcaacatgttcatcgttcacgtactacgattaatgagttaatcacttcctattaccatatattacctgaaccagaaccacaaattataccattattattgtctaccgggcctgaaacacatacctttcacctgccatggggagagtgcaccatcacactcgaagatgttgctcatcatctagacattagagtcgatggtcgtgttgtggctgaacctagcttcttacattgggatgagttatgccacgagttactaggggaagttcgtcccgaaaatgcacgtaaaggagccgcgctgaagctgacatggttgctaaacatgttgcgcgcaccattgcctgaagaaccaacaacgcaccaactacaatgcagtcatgggcttggtatcgcatgttattgcaccaagagtcccacgatccgaaacaagttttccactggctaa

SEQ ID NO: 91067 - DNA, 141 bp, Glycine max
  Peptide Sequence Number=SeqID_182752
atggatacctcaaacccctacactggggcaatgaagggcatcgtgcatgaacctcaagttctcagctacaaggtcatgtcgaaagatgacaattggtacctcaaagcctcacactggggcaatgaggggcatcgtgcatga

SEQ ID NO: 91068 - DNA, 839 bp, Glycine max
  Peptide Sequence Number=SeqID_182753
atgaccaagttcgacccagacatagtcctcgagttttatgccaatgcttggcctacagaggagggtgtgcgagatatgcgatcttgggtgaggggtcaatggatccctttcgatgcggatgccctcagccaattcctgggataccctttagtgctggaggagggccaggagtgcgagtatggccagaggaggaaccaggtcgatgggtttgatgaggaggccatcgctcagttgctatgtataccggggcaggattttgcccggactgctgctgggagacgggtgcagatcatgcgcaccaacatgaccaccctgacccagatatggatgacgttgctgctcagcaacatccagcccagcgatcataattccgacctccccctaccgaagtgtcagctggtgtacgccgtcctgacacggatgagcattcacgtggctcagttgatcgctgatgccatttatctatttgcaggtatggcgccgactaggcaccctttggacccggataagtccaacagggccctgggatttcccgcattgatcacaggactttgtcagtcgttcggagtccccgtcgcacctagcaaggtgattcgtccacccatcacccgggcttttattgagaagtattgcacgcagagaccggcccagggtgattcaccacaggccgcagacacgccgccacctcatcaggctggtccagctggggcagaggtcgcttggcccggagattggcccgaggcccgggcaggggaggcaccagcagaggcacctgcaggggctcccgacgaggcagatgaggcccgcgaggatgaggagatgaccgatttgttagacaa

SEQ ID NO: 91069 - DNA, 231 bp, Glycine max
  Peptide Sequence Number=SeqID_182754
atgcggggttaccttatggttaaccgtacctttggtcaaccaggggcaaacgagcccgttggcgcgcggagattaacatcgtcctcgacacctttttccgtcttgacccttgagggttaccttatggttacccgcacatttcgtcaaccaggggcaaacgagcttgttgacgcgcggggactaacatcgtcttctgcaccttttgtcgtcctgccccgtgaagtcaaatga

SEQ ID NO: 91070 - DNA, 940 bp, Glycine max
  Peptide Sequence Number=SeqID_182755
agggctacacgccctcgccatcagaggaccacacgtcctcaccttcagagggctacacgccctcgccatcagaggactgcatgtcctcaccttcagggggctacacgccctcgccatcagaggactgcatgtcctcaccttcagcgggctacacgccctcgccatcagaggactgcatgtcctcaccttcgtagggctacacgccctcacctttagaggaccacacgtcctcaccttcagagggctacacgccctcgccatcagaggaccacacgttctcaccttcgtagggctacacgccctcaccttcagaggactacatgtcctcacctttagtgggctaaacgccctcggctctgaggactatacgtcctcatcttcagaggactacatgtcctcaccttcagagggctacgcgccctcgccttcagggctacgcgccctcgccttcgtagggctacacgccctcaccttccgaggactacatgtcctcacctttagagggctacgcgccctcgccttcgtagggctacacgcccttaccttcggaggactacatgtcctcaccttcggaggacaacatgtcctcgccctcaccttccgaggactacatgtcctcacctttagaggactacacgtccttgcctttagaggactacacgtccttaccttcagaggactacacctcctcgccttcaaagggtcatgtaccttcaccttcgtagggctacacgccctcacctttagaggactacacgtcctcgccaatagagggctgcacgccctcaccttggagagggctacacgtcctcgccaacagagggctgcacgccctcaccttgagaggtctacacgtcctcgccaacagagggctgcacgccctcaccttggagagggctacacgtcctcgccaacagagggctgcacgccctcaccttga

SEQ ID NO: 91071 - DNA, 600 bp, Glycine max
  Peptide Sequence Number=SeqID_182756
atggctcttccctcaacatcatgcccaagctactttggacaagctgtctttcaacgtgtcacacttgaggctgagctccatggtggtgcgagctttcaatggatggtcccgtcaatgctgcaccagaagttaaaattcgtggtggaggggcagctgattatagtatcaggagaggaagacatacttgctgtagaggagtcgttggaaacatccttccaggcactagaagttgtgagtagtgcatatgtggagtctcctccggtgcagccacacctatctggtgccactttgatggtggctcgggttatgttgggccacggatatgagcccggaatgggtttagaccgaaacgggaatggcatagcaagtttggtggagttcgctgagaattgcggaaggttcgggttgggttacgagcctacatgtgttgacaagaggaggatcgccttagaaaggaaggagagaagctcggctcagccacaagggctacaagtggaagaagtccccttttgtcacatcgatgaaagcttcgtcagtgcagggtggatgtgcaagggacaagttgtcgtgataaatgaagaaacccctcaagaccaatga

SEQ ID NO: 91072 - DNA, 1500 bp, Glycine max
  Peptide Sequence Number=SeqID_182757
atggggtcgaaccaagcaccctcttttaaaaaaaggttctatcatgtcaaagtcaagaacctagaactagccagcttgcgagagctagggcaacaaatggatcaagttcgacatcaagccttcagcaaggcgtatgggaaaatctgggatttgaccatgatagaagtgtctgttgaagccattgcatcccttgctcaatactatgaccaatcgctcagatgcttcacgtttggggactttcaattggtactaaccatagaagagttcgaagggatcttgggatgcctgctaggaggaaggaagtcatatctttttttcagattccacccttccatggcaagagtagcaaaagtggtcaaaatctcagcacaagagttagaccgagtgaagcaaaacaagaatggggtggtagggataccaaggaagcgcttggaggagaaggcagaagctttggaaaatcaaggagagtggacctcgttcattaacatattagcattgttggtgtttgggaccatactctttccaaatgtagacgagctagtggatttagcagtgatagacgcttttcttgcttatcatcatagtaaggaaagtctggtcattgttgttttggccaatgcatatgatacattcgacctgagatgcgaaaagagtgattcaagaattgtctgttgtacgcctgctctttttgtgtggttggtctcccacgtttttcgtcatgaaggtgtggtaggagcgtctgttaattggttcccccgatggaaagaaggaggggccagagtgttgtgctcgtgtgaaggattcccaaacgtccccttgatgggaacaaggggtgcaccgtcagaggagatcatcgcacctttcatcgcatggggtttcaatgaaggcaatgccaaaatacttcaaagaatccgtaagctcccaaagccaaaaagtctaagttggaaagaagctgaagtccctgaggaaagcgaagaagtgcaagccttgaaagtggagcttgaaaaaattagagcagtcaaggaaaagctaaagacaacaatcactagggtcaagaaagagtgtgatgagctaagaaatgtcaacatgactacgatcgaagcattagagcgggaaacgaagagggcccgaaaggaagaatggagcaggaacaagttccgaagggctctatggggcagtagcaacgagctcaagcttagaagggccgaaagggatgagtcaagggtggaaaacatggagaaggtaaacctagctgctattcatgggcagagactagaggatgagcatgcaaaggtatcgactctacaaattgaaagggtagcaagagagaggctgatagaatcattgcacacagaagctatgaaatggatggataggttcgctctcactctgaatgggggtcaagagcttccaaggttattagccagagccaaggcaatggcagatgtatactcgactcctgatgaagttcatgggcttttcgattactaccaacacatg

SEQ ID NO: 91073 - DNA, 300 bp, Glycine max
  Peptide Sequence Number=SeqID_182758
atggctaaagaagatcccaaaagaaaaatggactactgcttaggacaacaggcaatgatgggacaaagtgatgagaatcctgaaattggccaaatacaggctaaaggcccaagtggagaaggatacagcccccgagtggagaaggatgaaggcctagaggcagagacactatcaagactattaattacttatcaaggtaatccttatggcgtctaccctgacttatcttccttcaccggaagtggcgtctaccctgacttatctttcttcactggaagtggcgtcatccaaaaattgtaa

SEQ ID NO: 91074 - DNA, 519 bp, Glycine max
  Peptide Sequence Number=SeqID_182759
atggcagcggaatggagaaggaagagagagaggagacgccacttcaaggagaagatgagtctagaagaagctcaccaccataggaggccatggataagagcttggaggaagaaggagatgaatgaagggagagagagagaagagcacgaaattttgtgctcaaaaggagctctgaaatctgaaaaatctaccctaaggttcatgagaaccctagggccttcttcagcagctctagcccaatcttcttggagcctcttgctcatggttctagtgattggtcccttcctagggaggattgcatcaattcttgtcacatgggaaccaaatgagaactttgattccaagtcattgcccattacctcctccgatgaggttgccctatgcttagatagtgcctctattggtcattgtcttgttgttgctggtcatatggttggtcattatgttgttgctactggtcatctagttggtcattgtcgtgttgttgctgatggtcaggttgttgatgttgatgaataa

SEQ ID NO: 91075 - DNA, 3564 bp, Glycine max
  Peptide Sequence Number=SeqID_182760
atggaaccaacttccgttgctcaagccatggaatggagcattcaactagaaatgggtctccgatctaccaaacctggtgttcctgtgaaagccatatcagatatggagcctcgccttcagcaatggagtacagagcctgaatttggcattgctccctatgccatgtttggtcttgttccaggtgaagataagttatttgccaataccatcctcttgcgccttgttgatgcctttagaggaggtgacatagagacaaaactttcagttgttagggttttcttgtctgaacggaaacaccgtgataaagagaagaaaaaacagtgtaaaggattgctgtcagaggccaaagtagctaatcacttggagttgttgaagagagtgaaatctgtttttgatagtggggaattgaagtcgaaggcattggctttggttctgtttggttgttgggctgattttgtgaaagacaatgctcagatacgatacttgatattttctagccttgtttctcctcatgattgtgaggtgagagcatctttgtatgccactgggtgcatttgtgagatatcagatgattttgcatctatttcagtggagatgctattcaatataatgaattcatcttcagtgcctttgcctataaagttggatgcagctcaagttttggcaaaatgcaaatcttcttattcagttgcttataaagcatataagacaggtatggagttggtactaaattcctcggatgaagaatttttggttgccatgttattctcactctcaaaattggcttgcattttaattccttgtatctcttatcaagtggactttcttctttcatttctcaaccgagacagaacttcacatgtacaagacacgacgttaaaatgcttgcattttttattccgaagaggattgtatgaacactcagataatttaggtctaattcgggggttattttccataatggagggacctgaaatttcattggccatgcaatataaagctctaagggtcttgcacaaggttcttctttcaattccaccttcttcacttcacaaggaacttcgtgagtttgtcaggcttctaactgttgttgagaatgcaagtcaatatccagcctcaaggaagaggtgtttgtcaattcgtattctggcagatttgtgttgtaggacgaaggatatagcagatattgacgaagttttttgttgttctttgccatcgcgtgttatctccctaatcaaagatcatatcaaacttttgttgaagacattgttggaaggttgtcaaaatgatttgacaatttttcaagagctccagggtttgctaaagattcttctaaatattgttgaaagacaccctaatcttggttctttggtacttgatagcttaaaacaagtgattgaatatcttgtgactgttgcatctactaattgtgcagtaccatcaactcttttgaccataaattttacagaagagaaaaaatcctttattttaaaacttttctgcaagatatacagatttctggtggccttccttgaaaatttttatatagttggtgctatcaataccaaagtgttcagtgaagtgaatattttggttggacttgtgtgccagtgtagtttaattgattgctatacatacacactgtaccatctactgttgcacagtcaacctatttgtgatggcttggtccatgagattgatgaaacacacctagctagttgttgcacaatgtttgtaaacaaagtcttgacaggaacaaatgattggactgcttataaggttggtgctcatgcagcgtgtcagggtgaatggttgctagctactaatatattcaggacgttaatagagaaagtgaagtctgattcttgctgtagctggttaaaagcattattccattatgctcattctgaaggaaaaatccaacttcttagtcaaccaaaacagggaaccacctcaatggagttgatggagactatcaaatttcctataacatcatgtgattacaagggtgatacatgtccaagacttgctaggagtatcaatgattgtaattactatgatcagcttactcagtctcatatggcagttttctcttccttgaaaattttagaagcgtccgtgacaagttctcaagcattttgttttcagaggtggtttttatcattaagagctagagtgttggaaaatttagtgggtgtgcttggagctttgagggaagtttcattgaatgtagctcagaatttcaatcaggtagagattgagagtagtgataagcttcaatgcctgaaatcttatcaagatattactcaagcttctttacaattgttcagactagtagaagaatttgatctacttagagcatctttcattgggatggacagtgaaacttctgcagtccttgcagctcatggtctgagttgttcaatattagcatttgcaactgcttttggagtgtctaacatagaccaacattctcagagaattttaattggtggcaaaacctctaatttacaggctttgacaatacaaagtttaaggaggctattttggagtgtggatcatgaaacccgagcaagtttctctttgctgttgaattattttcacccaaatgagaactgtttatccccgctgcctagttaccaaaattggaacattggttataaagacagagaggtgctaaatgtttgtagttatgccatctctggtgctgtccgcttgtttgagaaaattgcacctcagtttactgagaacgctttatcactaactttcaatactttgatgaaatggatgcacattcattttcggcttcccaggccattcattgggtcgaagctttttgtccacaataaggactctagtaatggggttgatatatctgtttcgcaaggctcccacctaacactgaatatttgtcttcaattgaagaatgtgccaccaaaactcctggttaagtcaactaagttgtactgcatccttcatgtcccatgtggacaaagacaagccccagggaactcacactctggatatgaagcttggaaagatgatgaaattgttgaaatgaaccagaagttgttttgccttgtcttggatagtgcggcaggcaagagaagaattggcatgcgtagtaggggccatggtaatagtagggccgtggagacatttatggattttagacctaatgagaaagggcaggggttttcacattgctcacttgatgtgtctaactttccctttctttcattgagaagtgtagaaaggaaactgcaagtcatgctaaaacaagtttgtctgctggcatccgtggagttcagtcatatagttgagtctcctgttattcaaactgaaatttcaactgttcctttgggatggaataatggaggagtaaaagatggagaacctctgaaagtttatattactggttttgggtggcatctatgtacacatgtccaagtgaatgaaagaagaaatggtttggttttcttaaaatgcacagtcgtgagtattttacattcccaagaatgtaaaacatcatttattgttgaagggttgatgggagtgctatga

SEQ ID NO: 91076 - DNA, 1206 bp, Glycine max
  Peptide Sequence Number=SeqID_182761
atgggtttcaagctcatgggaattgacacgctgtatggcttaagaaccaacactgcactagagatagagtatagaatcaaagtgggagaaataaatgatctagcaactaacatgaacagtaagatgaacataatggtgaatcccgattacgtggcacccaaggaactgtacagaacaactcgtggcatgggtctgaacaagagcctcgagttgacttgggagttccctgttgactctggtttcacttacatggccaggttccatttttgcgagcttgacccaaatattactaacattggagacatggttttcttcacttacatagggagcgagttggctgaggaccacgctgatgttataagttggagccagaaacagaaaggcctagctgtgtacaaagattatgcgattttaatcccaagaatgatactcataaaaagtttactcttgttgtcaaccaacacgcaggattacaagcttccaaccaacatgtgggattataggctgccaaccaacatgcaggattacagcgaaaaatgttggccatacaatcgcctctgccaatgcttttccctcgacgaaatcaaagccgccacaaacaacttcgacaacacctcagttgttggtgaagggggattcgaccatgtgtacaagggctacatagatgacatttccatcccagtagatatcaagcatctcaaaccaggatcaaagcaggggtttgaagaggctgcattatcttcacaaattagttgtaactgcacaatcatccacgatgaagtgaaaaccaccaacatcttgttggatgaggactgggtggccaaggggagctttgggtatatagacccagagtattacaaacggaagcatttgacggagaagtttgacatgtactctttcggggtagtgttgtttgaggtcctgtgtgctcgtttggctctgatttgcaccacagagtcgaatcaggagtctcttgcttattgggtcagatactgttaccaaaatggaaccatagagcatattgttgcccccgagtgcttcaagatgttttgcgagattgggatgatgagttgtttgtctgggacagagaggtcgtccatgaatgacattgttcggatgctgcaatttgcgttaccgatatttagtagccaagacttctttctccgagattatagacccaaggctgtgtttggggaatcaaattaa

SEQ ID NO: 91077 - DNA, 258 bp, Glycine max
  Peptide Sequence Number=SeqID_182762
atggtgcaagcaaaccatcagtgggactggcggcgagttgcacatgcacaggaacaaatcgcccttgccattggcgatatagctggaaggtggaaccgccaatcaaactggcgagttccagggtacaggcttttgcaggtggcagaggtgatgcgcagtgtttgcaggccaaaaggcaagttgcaactgccattggcgatttcatggcaagttgcaactgccattggcggtttaaggccaagtagccattccaaatag

SEQ ID NO: 91078 - DNA, 966 bp, Glycine max
  Peptide Sequence Number=SeqID_182763
atggacagggaacacagactcaagcttttatctgtccaagatggcatcgttactgctaatgcaacaacccaatctcctactatcaataagtcccctacaccaaagctcgcttgtcccgttctcgattcaactaccctttcccaatcacctcaggcccctaattccttcgcctcttcttctaccctgttgactacccttcttttccccgcaccaacaaatcctttactgttcaatccaaccaattcatcctccttgatggtttcaatgcctctttcaacgctgatgctgcaaacaaggaaaccatcttcagagaatatgttgtctatgtggataatgatcagaggcttatcctcagcttctctccgtctcaaccaaactgatcctatgctttcatcaatggaattgaagcagtttccctgccaaccgatctgtattacatctaacacggatggtaagatgaacataaccgtgaatcctgatcatgtggcgcccaaggaactgtacagaacagcccataacatgggcacaaacaccactctgaacataatcagcaacctgacttgggagtttcccgttgatgctggcttcacttacgtgctcaggtttcacttttgggagcttgaccccaatcttgatatagacggtgacagggtgttcttcatttacatagcaagccacttggttgatgatcgcgctgatgttatgagatggacacagaaacagaaaaggtttctccgcaaaaaggtgtacaagggctactttgaaggcggtttcaccccagtcactatcaaacacctcaaactagattcacagcagggtgcaaatgatatcatgaacaagattgagatgctctcacagctctgccaccttcatcttgtgttcctcatcgggtactgcaatgagaactatgaaatgatccttgactatgatttcatggcgtgtggcaccccccgccaacatctctaa

SEQ ID NO: 91079 - DNA, 441 bp, Glycine max
  Peptide Sequence Number=SeqID_182764
atggatggagatggtggttgcgagttgcaacaccgtgttcacgcacgtgaacgagggcacgatggtggtgttcgtgcactgtgttcacgccgtggtgatgtgctggtgtcacaattcgagctcaactactccttcctcgtcactactggtcccaagtttctttgcatgttcttccaccctacttcttacgacccatcctttccccgtatcaacacatccttcatggttcaattcaatgaaattacactcatctactgtttcaatgcctctctaaccgctgatgcagaaaacatagaaaccattttcagagaatatgtggcaatcattagtgagaggctggacctcagcttcatcatatcccgtctcaaccaaactcctatgctttcatcaatggaattgagatacttttcattccaaccaatctacattacacgtctttga

SEQ ID NO: 91080 - DNA, 276 bp, Glycine max
  Peptide Sequence Number=SeqID_182765
atgggaagctactggctttggagtttaattgagccagaattctaccaagttgatttcacaagcaagctaatcttcaagctcttggaaaccaacaattccaatctccaatcaataattgttatggagtacctaaagctcaatgtagatgcgacactcttcaccaatgagaacaagtctggtattggtctatttgtatgcaatgaggaaggaacattttttaaagcaaaaacaatgcaagattcaggaagaccagaagcaaagaaagcggaagcatga

SEQ ID NO: 91081 - DNA, 225 bp, Glycine max
  Peptide Sequence Number=SeqID_182766
atggaggtgtcattggcttgccaacacccttgtcattgctttgatcatcattttgatcatcgctttggtgatatcgatgtgatcaaagaactgttaatcctcatcctcactttgcgtaagaggaaaagactattaccgaagtcatgcattcaaagttttagcgtaaaaaaacttaagcaaaagaagaaaaagcttctcatgggcactaccaaagagcttcactaa

SEQ ID NO: 91082 - DNA, 1566 bp, Glycine max
  Peptide Sequence Number=SeqID_182767
atggatgatggaagccaaggtttcttttaccaacccgaccaagcatatgaagtagaggctaatgataatgatgaaaatctgggtggtgatgacattgatatgcattcacatcctaactatcctgactttttccatttcattcaagacgagggagttttgagtcatggtgaggcagtacttggcaatctctctgaacttggggacactcctgagatcgaccttggtgccatccttgagcgttatgacaacgtcaccccactctccaatgaagctcgacatgacctgtacatccttgatcacattgtagctgaagtccttgtggtcctgccccgtcagggtcagggggagccaaaagagggtgaaatcggggaggaggttcgctgcgaggtcgcggtactggccccaccgacaaagaatatgggtgagggaggtgggagaggacacgtggagtcgcgtgaaacgacgacaatggagggtgtggggtttgaaggggatgggggaactgttggttcaagggagattaaatccgcagctagctccaagcgatccatgcaatggcctcctccgagattaactgggacaggactcttcacgggtgttacagcggcactctacccggtttctgttgtgaaaactaggctgcaggttgcctcaaaggatactttggagagaagtgcgttttctgttgtgaaaggtttacttaaaacggatggcatccctggtttgtataaagggtttggtacagttatcattggagcgattcctaccagaatcatattcctcactgccttagagacaaccaaggtggcttccttcagggtggtggagccgtttagactatctgaaactactcaggctgccatagcaaatggaattgcaggcatggcatcatcatttttgtcacaaactctatttgttccaattgatgtggttagccaaaagttgatggtgcaaggattatcaggccatgcccaatatagtgggggtttggatgttgctcgtaaggtgttaaggtctgatggcatcaggggattatatagaggatttggtctatctgtcatgacttatgtaccatctaatgttgtatggtgggcaagctatggttcaagtcaacgctacttatggagattcttgggagataacagtgaggaatatactcctagtctaccaaagattatttttgctcaggctactggagggatcattgctggtgctactgcatcctgcattacaaacccattggatactatcaagacacgattacaggtgctgggacttgaaaagaaaatccctgtaaaacaagttgttaaagatttgatcgctgaggatggttggaaaggtgtatatagaggattaggtccaagacttttcagcacgtcagcatggggtacttcaatgatattggcttatgaatatctgagtaagaacttgctctctgatttcattgtgttgataatcctgtttgtttatactggtttggcagttgactcactgaaattaagtatgactgaaatatcatctgaagttttcacaagggatggtcgttttcttaagccacaattttaa

SEQ ID NO: 91083 - DNA, 150 bp, Glycine max
  Peptide Sequence Number=SeqID_182768
atgactccgacacagctaggggatcctcctagagtttcgccggttcagcaatatgacacatttgttgaaccagatgtgcatcagcaaccggtggcggcaacaacacatgatgaatcaaacattcatgtgcatcgtcctagacatgcagtg

SEQ ID NO: 91084 - DNA, 924 bp, Glycine max
  Peptide Sequence Number=SeqID_182769
atggagaccttggatcagatgcttgtgtctagttggtacaatgttcattcctcggtgcccccatcctttgtgcaattaccagaaaacaggcctggcagggtggttagttctttgcataaggcaataccggtgattgattttggaggacatgaccttggtgataccacaaaacaagttttggaagcctccgaggaatatggctttttccaggttatcaaccatggagtttccaaggatttaatggacgaaacaatgaacatttttaaagaattccatgccatgcctcccaaagagaaggactcactaacacatccttgtcctccttctggggaatacatggagtattggccacaaaaaccatccaaataccgagatgttgttggaaaatacacaagagaattgaagaaactagcccttaaaattttggagctgctttgtgaagggttagggctaaacctaggatatttctgtggtggactaagtgaaaatccatcagtgttggttcatcactaccctccttgccctgacccaagtttaacactaggcttagctaagcacagggaccctaccattatcaccattttgcttcaagataaggaggttcaaggacttcaagtcctgaaggatggagaatggattggagttgagcctattcccaacgcttttgtggttaacattggtctactcttgcagatcataactaatggaaggcttgttggtgctgaacaccgagctgtgacgaattcgagcagtgcacgcacaagtgttgcctatttcgtctatccatcatttgaaagcatcatagaacctgcacaagctttgatcaatgaaagcactccagcaatatacaaatccatgacattcggagagtttcgtagaaatttctttcaaaagggtcccaagattgaagaagaactgcaatag

SEQ ID NO: 91085 - DNA, 364 bp, Glycine max
  Peptide Sequence Number=SeqID_182770
atgaaggggtgtagggaaggagaagctgctacaggagggaggggtgccgctgttgtgagtgtgccatcaaagaagggatgttgtcgtgggttgagagaaaggagaaaagaggcgtttgggttgggaaatgagaggtgcaagattcaacttgggagtgtaggattgaagtcccaggaggaaggcttcttcttcgcgtttctgcttcttcttagaggtaagtttctccttcgcgtttctgcttcttccaccattgttgccggcgatggcggaaaccgctatcaggaagttgctaggctgtttacggatcatctgatccgtaagcctcttatggatcaagttgatccggaagaggcttacagatcaa

SEQ ID NO: 91086 - DNA, 476 bp, Glycine max
  Peptide Sequence Number=SeqID_182771
gctacggaggtttggatgacgatgtgaacctgagtaggagtggatcgtttgatacaggctacggaggtttggatgacgccacttccgggctaagcaagcctgtctcgctaagtcattattgttgcagtggtcagtcccgctatgtgatgcagtacaacgagtttcgtcaggaacttaagagatgcaggtggcacaaggccttgaccaggcagtcggataaccatattgatgtggggcagtgcaaagtgcgaagcaagctcataaagtttgatgcaacgactctgaatgagtttctggagaccctagtcgtcctggagcctggggagagatattctacatactccaggttctgtcacactcacttggacccacatgagcttacatcaaagctctgtattccagggcgagggttcatgttgaacgctgagggagccccttggaagcttctgaggaaggacctcactaccttggcttag

SEQ ID NO: 91087 - DNA, 837 bp, Glycine max
  Peptide Sequence Number=SeqID_182772
atgaagttgtgggtgctcccaccatccacaaggacaaccacggagtggccaacgatcgtgtcaatcaaacggagcattttcggggccaattggcccgttaaggaattaaaactaattcgggatgaaaccgggtcatggatatcgggtggttctaggcccgggcctcgttcacgacgagtgataatctcctccggcgacaggcgcttcaaggtgggcggtggacggggtggaggcgagcgtgaaattggaggagggagcaacgcaggcgagggagctgggcgtggctatggcacgagcaagatcggaggagcacggttgcggaaggggggtcgcgtgtccaagagcttttcttcctggagacgagcaagcccggtggcctgcaccaaggtcaggggttgcaacacctgcacttcgcggcggatgtcaggccttgaagagggtgccggtggggtcgttgtagtgggaagacgcgaagcaggtttggagtgcctggatgaaagcgggccaagaagtaaactggccattgttggccatccactggaaccacgcgagggaataaggaagaaggtgggaatgggtggagttgcagcggaggatgagaaagaggatgggggaaggcggagcataagggcatcaaacttctgggccattgtgtggactgtctcaccaagggaggcatggaggtcagtgagtttgaggatggcagcttcaaggttattagaggaactggcggtggagggagggtcagacatggtaacgagagcaccaaatgataggaacaagcttgttatggatttcgaggaccagagcctcctagagaagaaggagaggaattag

SEQ ID NO: 91088 - DNA, 168 bp, Glycine max
  Peptide Sequence Number=SeqID_182773
atgattaatgcaaactgtccgcaagaatcattgcatccaatctcaaacgggaatctaagaaggaataccaggattccgtttcagtatagctgcatggagtggagagtttccaaagcacagtggaagctagcttctcaacagatagcctgtttaaccaagtatgattaa

SEQ ID NO: 91089 - DNA, 234 bp, Glycine max
  Peptide Sequence Number=SeqID_182774
atggaagtaacaattacatcatacgtatatggaaaaggctattgtgcgcatgctccagctgttgacatgtgtccaatttattggttttttgggcatttctacatcacacttacaggcctgttggttgttattgttgagtgtttgatggtgctttacttgcttcgtttctttgctttgtttttcatgcaggtagttcctgaggctatcttttgcccttttgagattgatgtctaa

SEQ ID NO: 91090 - DNA, 1080 bp, Glycine max
  Peptide Sequence Number=SeqID_182775
atggagaataacaattatcagagagaaataatggaagagcaaaggtttgaattgccaccaggattcaggtttcatccaacagacgaagaactcatcactcactacctctcacagaaggttcttgatagctgcttctgtgcaagagccattggagaggctgatttgaacaagtgtgaaccatgggatttgccttgtatggccaaaatgggtgaaaaggagtggtattttttctgtgtgagggacagaaaatacccaactggtcaaaggactaatagggccactggtgctggatactggaaggccacaggcaaggacagagagatatacaaggcaaagacactgattggaatgaagaaaactctggttttctacaaaggaagagctccaagtggtgaaaaatctaactgggtcatgcatgaatacagattagaaaatgaacattctgtgcaaaatccacccaaaaaggccatgaatgattgggccatctgcaggattttccagaagagtaattgtgggaagaaaatgcccatttctaggttgttgaggttcagcacttttgcaaaggacataccttcattgatggattcttctccaaacaacaacaacaacagtgaatcaaaacctgttttgggggagtcatcacatgcaacctgcttctctgatccaaaccaaagtgaggataaaaaaacagaaaacgaaaacatagctgaaagctatgaaatcatcatgttggcatcttcatattcttcaaacccctctgatgtttcccctgactcatggactttttccaaatctgcccctactgtgtcccaccaatcactccaagttggaaactcacactgctcagattacttcatgcttcatcaggaacagtccatgttggggatgttgattgaaaaccatggatcaagtactggccaaagaactcagaaagctcaggataataataaagactttgatgctgacatgtcctcggtgatgtacaacaacaatgaaatgtttcaaagatcatttgggaaccaggaatattcatcaccttctgtaggacatgtgtattctagtggcctatggggattttaa

SEQ ID NO: 91091 - DNA, 318 bp, Glycine max
  Peptide Sequence Number=SeqID_182776
atggcatcttcatcacatattaacattaagtctggccccatcgatactgatgtattatggatgcaacctaagcatgtttcagaacatgtttggaatggggaaaaagataggaaattacatatcagacgagttgtccccacgtggttgcgagagagagcggcgatggtggctcaaggagcaatggtggttgtgcgagcaagcgacagaggtggctcgaggggttttcatggttgcgagggagcgacattggtggctcgagggacggcggtggttgcgctagggagtggggttgttgtggttgcgagggagcgtgactag

SEQ ID NO: 91092 - DNA, 267 bp, Glycine max
  Peptide Sequence Number=SeqID_182777
atgatcttaagttggcaacaagaaattgagtctaagaatcttcttagggggggggggggggcgaggggggttggaactgtgttgaaaggttgggtcaatgagcatgagaactttgcagcacaacctagaacagggattcccgttgcagtgaagactctcaacccaaatggatttctaaaagaatgccttcgcaagagtagtttacacaacctcaagatatcaaggaagcaccaaattaacatcatccctaaacacaagaaaatttga

SEQ ID NO: 91093 - DNA, 129 bp, Glycine max
  Peptide Sequence Number=SeqID_182778
atggatattgaagaggatctaagatcccccactgattttgggtcgtcccttcatgctaaccgccaattgtatggtggatatggggaaagagaagcactcactaaagccaagattgctccagacccttaa

SEQ ID NO: 91094 - DNA, 417 bp, Glycine max
  Peptide Sequence Number=SeqID_182779
atggagaggagttcctcatcgtacaccttcgaggcccgaagtcacgtgttgtgtctctgtaatgtagaggctccactggtgacatcgtggaccgaggataatccagggatgcgtttctatagatgtggtctatacaaggttacaggtaggaaaggctataattattttgagtggcacgatctagttgccaacattcgtcagaagaagatcattgtagcattgatgaagaaagttgatgaattgaagttgagggaaaaggacttgcaaagcaggatcagggacatgaagatgaaggaaaaaattttagggattgttttggttgtgtcttggattgtaattgtggaattgttgaattggtacagtgttaaggttgtagagtgctttgtgtatccttcattacaggtccatcagctctaa

SEQ ID NO: 91095 - DNA, 294 bp, Glycine max
  Peptide Sequence Number=SeqID_182780
atggatgattttaatgaggatgaggatcaacagttctttgatcacatcaatcaccaaagcgatgaccaaagtgatgaccaaagcgatgatgatgagggagttggaagaccaacgacaccttcgtcacctccgttgcaatatcaccaacctaggtgtccagtagacttcaactttgaccacctaccacactacattgatcgacaccatttcgttcagaagcaacataatgtacaaccaccaaccagtgcactcgaggttggcatgaccttcgatgaaaaagcacaatatatttga

SEQ ID NO: 91096 - DNA, 366 bp, Glycine max
  Peptide Sequence Number=SeqID_182781
atgacggtgaaaacctcggacacaagcagctcccggagacggtcacagcttgtctgtaagcggatgccgcgagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtgtgcgagtctgcaatggagctggtggtggcatcaatggagggtgcaacaacataggtgacgacagtggtagtcacatgcactcaggtggaggtggtgacaatcacaagttaggtggagaatag

SEQ ID NO: 91097 - DNA, 483 bp, Glycine max
  Peptide Sequence Number=SeqID_182782
atggaggagaagatgaagactggtctcagtgatgcaaaaattaagatcttgaagactcacaaggctggattcaaaagaccctgtggcaggtctcccttgttggggattcagaagtacaatgataagtccatagtatggccgatagttcttcagcccgatcaaagtctttggaattacaaaccagcagactctgatttctattgtcaagatatggctatgggttcggcctctatccatttggtgaattggtttattcctactaggagatattgcacttgctcttttggttgtgggaaaaggttgagtatgtctactccctatacaacaaagggccatagtgccattatgttgtgcagttcctcgacagtatttgggagtaagctcttctctaagaagtcccaaaactcagtcatccattctcgaccaaccggagttaggcttgacactactttgcttagactcggttctaagattatctcttga

SEQ ID NO: 91098 - DNA, 783 bp, Glycine max
  Peptide Sequence Number=SeqID_182783
atgactttcttggatcctgcgagagacaatttcactgttgctcaagattcagaccttaatgtgcggaagccagttgaacatagtagtgatgcaaagcttgcaggtgaatctgatccattgggagagttgatgaagatattgttttatgtgtaccagaatccaatggaagtgctctgggaggcgagccaatttggacttcctgatattggggcaaaattttacatcagacatgcagatctagtggaaataatatcaggtgacaagtgtttaaacatagcgatactacagttgtggaccatatttatgaatgagtgcgatagaagcaaagctgatcagtcactgtatggtttgctggagcctcaatctatacaaaatgctaaggaaagacgtcaacaattcaaacaatacattgaaacatgggtcaaggaatcacaaaggcagttgtatttaggagcttacttgcatcaggcacattggcaactatttgttctccacccaagggaaaacacggtcgtttggttttgttctctgaggaagaagcctgatattaacatgaaaggcgcaattaacagcaaaaatggttgtcatatatatgctatttttttaactagtgcaatgaagacaataaccagttcttttgaaggcatgtctaatcaaggtgcacctcggtgggttgaacccaagagtaatgttcaaagtggagggtttgagtgcggatattatgtcatgcattggatgtggtgcatcgtgactgccgatttgaaggatgactggcacaagtga

SEQ ID NO: 91099 - DNA, 528 bp, Glycine max
  Peptide Sequence Number=SeqID_182784
atgaacctgatttggccgaagcagaactggatgacagtctttgcctccttgctttatcagctttttgcaagtaatgttaatgagattggtgtttggtccttgcaaggaggtcccactggtgtggaacttgctggagcaaggcttacactagtgcacaaaggagcaaggcttctggaattcgtaggggcaaaagccgaggataagactctaaattggttgaaatcaaagaatgttgtgaagatatatcaaacttcaaatggagggaccattgaggcagattgtcatttcttatgtatagggaaaccacttgcttcagcatggcttaaggaaactgtgttgaagaatgacttggatggtcaaggtaggatcaaggtagatgaaagattgagggtcaagggccggaacaacatttttgcaattggagatgttacagacattccggaaatcaagcaagggtttttggcacaacaacagcttgaagtggttgtgaagaacttaaatgtgacaatagagggaggaagagaatga

SEQ ID NO: 91100 - DNA, 360 bp, Glycine max
  Peptide Sequence Number=SeqID_182785
atggagcttcgagttccggtggaggtggaagtgtcgttgtttgattccgcttgttctccgtcttcaacctatgcaggacatgtaccactgtctcatggacttttcggggattttatgagaagtttatatctgtgctttgatgatgttcctttaaagcttacaaaaagattgcttttaggtatatgctttagttcctggcctgtcgagggaagagcatattatttttgccatttctcctcttcctttgagaggaagttgcaacatgggagacatgcaaaagtcatagaagtccatgtacagtcagaccctgcaggacgcctagtcataagtggggagcctgaacatcccaacaatccttag

SEQ ID NO: 91101 - DNA, 285 bp, Glycine max
  Peptide Sequence Number=SeqID_182786
atggaaaccctaatcagagaagaggaagggttacttgtgggtgaggaaggagcagatctagtaaacgttggcacgtattgtattactaagtttgatccaacacacaatcatgaagttgtcactcctaaggttttcatgttgaaatcacatcgaaaagtaaccacaactcaagctgctacaattgagcaagttgaaaagtctgggattagaccaaaagctggttatgaaatgatggataatgaagttggtgagcataagaatttgggcttccttcctgaagattaa

SEQ ID NO: 91102 - DNA, 417 bp, Glycine max
  Peptide Sequence Number=SeqID_182787
atggatgattttagtgaggatgaggatcaacatttctttgatcacatcaatcaccaaagtgatgaccaaagcgatggcgagggcgtttgcagaccaacgaaacctccgtcaccttcattgcaatatcaccaagctaggtgtccagtagacttgaactttgaccacctaccacacaacattgatcgacaccattttgttcatcagcaacataatgtacaaccaccaatcggtgaactcgagaaaaggataagcttcgtgtgtaaattacatgaaaatggttgtacatggagcttgggcgcatgcaattcaaagaggcataacaaatggattatcaagagtatcagaggtcatcatacttgtctcatgccaatgcttaaacaagattatcaccaactcaacaaacatgtcatagcatag

SEQ ID NO: 91103 - DNA, 282 bp, Glycine max
  Peptide Sequence Number=SeqID_182788
atgaacctgcaagcaatctgccgatcatttctgcctgatcggtgcagaccattcggcgggcatcatgacttgagaaatcaaatttccagtcatcaacaatggtgccctcaaaagtcaaatacttctccatcaaagaattctaggtctaggtacttgggatcaagaatttgcctagaggaaaagagagatgagtaccgtagacgttgttcgtccgatgagaataatgtggatgatgacaatgaaggtggaattggtgtcgggggtgctccggtggctccgtga

SEQ ID NO: 91104 - DNA, 537 bp, Glycine max
  Peptide Sequence Number=SeqID_182789
ttgtccagtcaaggtgtaccttttgagggcaccattgttgatgactggaaatttgatttctcaagtcatgatgcccgccgaatggtctgcaccgatcaggcagaaatgatcggcagattgcttgcaggttcattgacttttgaatgtcgcatcatgcattatctgattgtgcgtattcttcttccccgttcatcaaatcttgctcagttaatcactttatttctgcgtcatttcaatgtacctcttgcttctgagcctttcattcaagttaaacgatccttctctattggtgctggagcgatcacctcttttggctactgcaaggagttggatgcctcttgggtgaagaaagatgcaccgccgctacagatgagcatacaccttttcctccatgacttacgaggattccgagcacatgttgatgaccacttggatggtatagacacacactttgaagcgctggacctccgcatcgaccagcttgcagatgacatgaacgtcatccgtcgttgctttgatccgcctacagacccttag

SEQ ID NO: 91105 - DNA, 324 bp, Glycine max
  Peptide Sequence Number=SeqID_182790
atggagtcatggaagctaggaagggcacttgaaggttgcaaggaatttgaggggtttgttcatgtaaatttgggaaagcaagaggagttgggtgttggggaagaggtatttggtgatggagaaggggagaacccatggggttgtgagagaaacttgatggtggcaaccactgtagaggcgacaatgactattgcgatgggaaagatgaggaatgttgtggtcagtacaacgacaatgaccgtggcaacgattattattgtagtggtgacgaatgttgttggtgcaagcattgaatatgcggaggatatgtgtgtgaaagtgtga

SEQ ID NO: 91106 - DNA, 192 bp, Glycine max
  Peptide Sequence Number=SeqID_182791
atggtgctttcatcaacttactcccctcccaactccaccccaccaccatggaagacaaccttcaagttggaagaactggacagctcgcttagcacaccacctaggcttagtgcgtgtgcatgcagctcaggcttagcgtgcgaaaatgcctacaatgaagcccaaaggcgcccgaaggaaaagatacactga

SEQ ID NO: 91107 - DNA, 465 bp, Glycine max
  Peptide Sequence Number=SeqID_182792
atggaagacaaatctaaccctgtcaaagacatgcttggaggtacttttccagataaatgcttcttaggaaggtatagaatagaaagcttggtcagtagaccaaaggagggaggaatatttccatccaaattgcagttcacgactgcaaattctgataaggcactacagttccccaagcttgaggaaagacaagtggttactatgaacatacaacagcaagagctgagtcatgttcccaatacttgtgggatggatccacttaaattcgagccgagaactttgaacctcgtccacttcaatgtacagggcttcaatgtcaatagggttcaatggaaggtcacaaggctgtctacagggttcaaagaaatgagaatgctgaagggttcaatcgaaggtctcagtgctgtctacagggttcaaagaaaagagaatgttgaagggcacaaatatgtctacgcggtttaa

SEQ ID NO: 91108 - DNA, 393 bp, Glycine max
  Peptide Sequence Number=SeqID_182793
atggaaccggttcttgtatatgtagcagaaatagcaccaaaaaatcttcaaggaagactagcaacaacaaatcagctttttattgttactggaaggtcagtctcattcttactaggaaatgccataaattggagagaactaccactagcgagtaagcacataataacatttggatatgtagaaaggtataacaattggctcgatttgaatttagggctagtaccttgcattttcttgttggttggtttgtgctttatccctgaatcccccatatggctggcagaggttagccacaaaaaagaatttcaactagctttaagtagacttcagggtaaagatgttgatatttctgatgaagctgctaaaattctggaactttccaagctctcttaa

SEQ ID NO: 91109 - DNA, 1413 bp, Glycine max
  Peptide Sequence Number=SeqID_182794
atgattctatccgcccttttaacttccgttggaattaatcttggcctctgttttttgtttttcaccctatattccatattgagaaagcagcctggtaatatcactgtctatgcaccacgcttagttgttgaaggaaaagttaaagagggtggtcattttaacttggaaaggttgttacctaatgctggttgggtgagacaagcatggcagccttctgaggaagattttttatcaaattcaggcttagatgctttcgtcttcatgcgcatatttatcttcagtttaaaagtattttcttttggtggaatcattggcacgttcattcttcttccaattaattatatggggagtcagcttagtgatgattcagattttcagcacaagtctttggactcattcagtatttctaatgtcaacaatggttcaaacaggttatgggtccatttttctgctgcatatattttcactggaattgtttgctatcttctttattatgagtatttgtacctttcatcaaaaagaattacttatttctattcatccaagcctcagcctcagcagtttaccttattagttcgtggtattcctgttcttccgggaagtacatgtcatgatactgttgagcgttttttccaagagtatcacccttctacgtatctctcacattcggtggtccgtcgaaccaacaaattacaaagtcttgtttcttgtagattaaaagcaattcttgattcattatataacaacttaagctttgaggttgaaaggttccttgaaaagaatgatgcagataaactttacaaaaagcttacccatctgaaacaaaaaaatgatgctcctgaaaggcagaggcgtgatgggtgtttgggactttttggccgtaaagttgatactttagatcactatgaaaggagtttgggtgatattgaagataatgtgagaatggaacagtcctcactagaagcgaagatttggatcatgaaaagttgtgttgtgctcatggatattctttcgtacaatagatattatttgttaatagttaggtttactatgggtcttatggtgatgtctaatacatcaacttattctgtaatcactttcaacttaaaggaacttcaagctgccttcgtctcatttaagacacgatttggtgctgcaatagctttacacattcaagaaagtgtcaatcccacggaatggattactgagaaagctcctgagcctcatgatgtttattggcctttctttaccgtttcatttattaaaagatggatcagcaagctggtagtttatgttgcatgtgcttttattacagttttgtttttgataccagttgcaatagtacaaggtcttacccatctggatcaattggaaatgtggttcccgtttttgaaaggcatactaagactgtaa

SEQ ID NO: 91110 - DNA, 96 bp, Glycine max
  Peptide Sequence Number=SeqID_182795
atgaatcaatggatatttgagtctttttactctcgtctaatttccacttccaattcaggttttaaccacgctgttcttgaccccggttctggttaa

SEQ ID NO: 91111 - DNA, 576 bp, Glycine max
  Peptide Sequence Number=SeqID_182796
atgcggctcgccactgtcgtcgccgtccagttcaccgctggagaggctggtggagaagtggaagaagaagacgaggcgcgagaagcgaaagccgagaaccaagttgatgaggcagcagacaccgtggattaccagccagaaaatcactgtcggagacttcacagcgccgttgccagacgaatccaactgcgccaatcctctgaagctgttcccctggcgcgtgagagaaagattggagctggtggtagctttaggttgctggaaaatgtggctgccttttatgagaaagcttgtggcattttcaattctgcatatatccctcccccaagatttgatggcagagaagctgcagaacatgtggctacccctggggtcactgttggactagtttgggctgcttttggtggagaagttcagtttgtggaggctacagctatagttgagaagggtgaactgcatctcactggacaacttggtgatataaaagaatcagcttatcctgtgagagatcagtctggcaaagtttcagctgcagaactggtgcaggctgtcaatgaaatcctctctgctgcttag

SEQ ID NO: 91112 - DNA, 235 bp, Glycine max
  Peptide Sequence Number=SeqID_182797
atggggagttgctacgtgcacccagcattattgctggggcacccagcaaacagtgaagtggccaaattgcccttcaacaattcttcttccggaagaagtatttccggaaaccttccggaaaagcttgttccgaaaagtttacggaaatacttcttccggaaaaagaatttgggaattccggaagtactcacgaacttcgtccggaagatcgtcatccggaagtttccggaagaag

SEQ ID NO: 91113 - DNA, 2197 bp, Glycine max
  Peptide Sequence Number=SeqID_182798
gcagcagtgtttttctgatgcatcaactaggcggcctgctgatttgttatcttcattttccaccatcaaaactgtcatgaacaacttatatgatggcctagctgaagtactcctcatcctccttaaaagccaagatactcgtgaaagtgtacttgagtatcttgcggaggcgatcaatataaatgcatccagggctcatatacaggttgaccctattacttgtgcaagttcaggcatgtttgtaaatctcagtgctgtcatgcttcgtttatgtgagccatttttagatgcaaatttaacaaaaagggataaaattgatgcaaaatatgtgcactgctcaaaccgcttgaagctaagtgggttgactgctcttcatgcatcatcagaagaagttactgaatggcttaatagtaaaaacccagctacaactggggcaaccaatcaatatagtgatgatcaaaaacgcttgcaacaatcccaagaggccagcagttctggtagtaataattttggtgagctgtcaaatgaaaattctgcacgtgctgaaaagacaaaatattcatttatttgtgaatgcttctttatgaccgcaagagtgctcaacttgggccttttaaaagcattttctgacttcaaacacttagttcaggatatttctcggtgtgaagatgctcttgccacacttaaagccatgcaggagcggacacccacccctcaggcagaattggatataaatcggcttgagaaagaaatggagttgtactcacaggaaaaactttgttatgaggctcagatattgaggatgcctctaccaccaacttgcccaatggaatttgctaccatgcctgaacattttgtggaagatgccatggaacttttaatatttgcttcccggattccaaaggccttagatggagttgtgctggaagaatttatgaactttataattatgttcatggccagccctgaatttatcaaaaacccatatcttagagcaaagatggttgaagtattgaactgctggatgccccgcaggagcggctcaactgctacagccactctatttgaaggccaccaactctctcttgagtatcttgtgaggaatcttctgaaactctacgttgacattgagttcactggttctcacacacagttctatgacaagtttaacatccgccataatattgctgaactccttgaatacctgtggcaagtccctagtcatcgtaatgcttggagacagattgctaaagaggaggaaaagggtgtctatctgaatttcttaaactttctgattaatgatagtatttatcttcttgatgaaagtctgaacaaaattcttgagctaaaagaattggaggctgagatgtcaaatacggtcgagtgggagcgacgaccagttcaagagaggcaggagaggacccggttattccattctcaagaaaatattattcggatagatatgaagttggcaaacgaagatgtcagtatgcttgcatttacttcagagcagattactgctccattcctacttcccgagatggttgaaagagtggctagcatgctcaattactttctgctgcaattggtgggtcctcaaagaaaatcgcttagtctgaaggatcctgagaaatatgaatttcgtcctaagcatttgctaaaacagattgtgcacatatatgttcatctagctaggggtgacacgaattccatcttcccagctgccatctcaaaggatggccggtcatacaatgatcaggcaagttttttgtttagtgctggggcagatgtccttcacagaattggggaggatgggagaattatacaggaatttattcaacttggtgctaaagctaaagttgctgcttcagaggcaatggatgctgaagctactctaggggagataccagatgaattcctggatccaattcaatacactttgatgaaggatccagttatcttgccttcttcaaggatcacggttgatcgtcctgtcattcagaggcatcttcttagtgatagtactgacccattcaaccgttctcatcttactgcggatatgttgattcccgatgatgcgctaaaagctagaattgaggagtttgtcaggtctcaggaaatgaagaaacacttgagcctacagagtaccaaggccacaattcagactacaaatggggaaacaatgttggttgattag

SEQ ID NO: 91114 - DNA, 423 bp, Glycine max
  Peptide Sequence Number=SeqID_182799
atggcaattgatatgaaaaccaagtttgataaatattggcgtgattatagcaatgtgttttcctttgggtgcattctagattcatgctttaaaatcaaatttttgaagtattgttattcaaaacttggtcttgatccaatatcttgccaagcaaagttgaaagttgtggagtacaagttgtataatctatataatgagtatattcaaatgtattccaaagaaacaagaaacaatgttggtttaagtcaaggttcatcacaagagactatagctactactactaatagcgttgctcagggaaacccaccaacatcacaagttgatgttatggatgtaagtcaaggaaaagaagatgaagatgtggagatggagaaggatcaagctactttaaagatggaatcatttgttgttggagatgtttaa

SEQ ID NO: 91115 - DNA, 861 bp, Glycine max
  Peptide Sequence Number=SeqID_182800
atggcggaaccgtcgtccaccgccgccaccgctgccaccgccgccaccgcttccaccgctgatcctccggcgccagtgactaaaagctgggccgacgaagcagacgaagaaaccaacaacacctccaccgccgagtcagaaagctcctccattaacctggaagcgttaaccatcgacgataaagaaaataactcttccaaattcttggatgatcccgatgattccaatatccaagcgggttttgaattgaatattattagggttttgaattgtgtccaggttacttctggcgacacgccgtacacctcggcggcgaggttcgaggacctgagcctctcgccggagcttttgaaggggctctatgtggagatgaagtttgagaagccgagcaagatccaggcgataagcttgccgatgatcctgagcccgccccaccgggacctgatcgcgcaggcgcacaatggctccggcaagactacatgtttcgtgcttgggatgctcagccgcgtcgacccaaaggtgcaggcgccgcaggcgctctgtgtctgccccacccgggagctggccattcagaacgtggaggtgctccgcaggatggggaagtacaccgggattgcatctgagtgccttgtgcggttggaccgggatgccgttcatgtatcgaaaagggcacctattatggcgcaggtggtgattgggaccccagggacaatcaagaagttcattagcttcaagaaacttgggacctcgaggttgaagattcttgttttcgacgaggctgatcaaatgcttgcgcaggatggtggaaggccaaaattccgccacataaacacatcattgcagcctatggcgcagccataa

SEQ ID NO: 91116 - DNA, 189 bp, Glycine max
  Peptide Sequence Number=SeqID_182801
atggagagtagtgtgacactcgtcgaagatgtgtcacatgcaaagggagagaagatcagtgtgatgcttgctggagatggatcacgcatcgtgtgcatgaacttcacgttggttgcacatgtggatgatgtgatggtcatcgatgatgggcgacaatggccaaagatatgctccgacaataaggcataa

SEQ ID NO: 91117 - DNA, 1092 bp, Glycine max
  Peptide Sequence Number=SeqID_182802
atgattctcacaaagcaataccgatgtgtacattcagctagttgtcaatgcactaaggggcatgtaagtgaagatgtgatattcttggtgtttcagcatttgaattggaaccccaagctaattgctgctctgtcatgtgtgtgcaaatggtttgatgatctttcgaagcaagttctatggaaagagttttgcaaaacgagagctccaaagatgatgcttgatctgcaatctagtggaagccacagtgttgatgggaactggagggctctagggaagcttcttatattctgttcaggttgcaggcagggtggtttgttcaataacgttcaggttcctggtcattttgttaataagactcgattttctagaacatcaggaaagagctttctcatgccacaatgcataaatgatgttttgtatgtgtctgatccttgtgaacatattggacaaagtgaagagggtgatttaggattcttcagaggaattttcaagtcgtttgcatcgtcaaatgtcaagaggatgcttattaacagaggtgcacagctccatcaaaccgagatttgcccgtattgtaaggcaaagctgtggagcatgctgcaggctaatatgattccacaaactgctagttgcaggttgggttcctatgaagattatattgagtattacgtgtgccttaatggtcacttgcttggggtctgcacattgttaccattgtctgattcagaagatgtgtctgaggagtgccgtattttcttcggttccttggcaaaggttaggttcgatgaaggtgaaggtagtggtgttcagtattgtggtggtcatcggcagcatacgagatatgcatttttgttgcttgtgcattcaggtgtacggttgatcgtcaccaccaccacgcgccaaatgccagtcgaggagaacgcgcgaggaagaagcatagcaaagcatcacaacaacaccaccaccacgccaccaacaatggtgaagaagcaacccacgccgccgacaacaacagtccactcgaggccgtggaatggcacaaaagaagtctggtcacgacagaaggaagaagaaacgactcagaagaagaaatag

SEQ ID NO: 91118 - DNA, 717 bp, Glycine max
  Peptide Sequence Number=SeqID_182803
atggcaacaaactgttggatgatgcaacattcttactgtggacatggttcagaaatctggagacagcaacacactttaaccaatggtccattaatcttagaaaagctctgccttacaaacagacttgctcaaagaattgttcaaggagatgttcctcaagctttgatgaatcgaaggcttatatcccttgatatgggtgcacttattgctggagcaaagtaccggggagaatttgaggatagactgaaagctgttctgaaagaagtaacagaatctgatggtcagactatccttttcattgatgaaatccatacagttgtcggggcaggtgcttcaaatggtgctatggatgctggtaatctcttaaaacctatgcttggtcggggggagctgcgatgtattggtgcaacaacattagatgagtatcgaaagtatattgagaaggaccctgcacttgagcgtcgtttccagcaagtttatgttgaccaaccttctgttgaggataccatttcaatactaaggggactgcgggaaagatatgagctgcatcacggagttcgcatttctgacagtgcacttgtggatgctgcaattctctcagatcgatacataagtgggaggtttttgcctgataaaggtattaatacagtaatactagcatttttcctgcatgcagttgatagtttatggataatctacagaatagatgattgttaa

SEQ ID NO: 91119 - DNA, 345 bp, Glycine max
  Peptide Sequence Number=SeqID_182804
atggctgggaaccaagatcagttagagatcaagtttctgttgagtgatggtacagatattggccccaaaagttatgctgctgccactagtattgcaacactgaaagaaagtgttcttgctcaatggccaaaagataaggagtatggaccaagaactgtaaaagatttgaagttaattagtgccggaaaaatattggagaacaacagaacagtgggagaatgtcagagtcccctgtgtgatctacctggtggagttataacaatgcatgtggttgtgcaaccaccttctgtggagaaaggcatgccaaaagtctgttttacttgtatatacagcttcaagatttaa

SEQ ID NO: 91120 - DNA, 183 bp, Glycine max
  Peptide Sequence Number=SeqID_182805
atgggtttcttcgcgttctcgaagacccatttgagaaagcttctcttttcttcaacggtgtcgaattcaaacccttcagggaaggtggggcccgaaaacgacgtcgccgaggccatcgccggtaaccggaaacggcgaggattttccggcgaggttgttggtgttgtggagaaggttgtgtga

SEQ ID NO: 91121 - DNA, 522 bp, Glycine max
  Peptide Sequence Number=SeqID_182806
atgtcttttactatacaagttgctgaagaactttcactccctattgttctatttcaaccggcgagtgcatgctcgttattgtctggtttgcactttcgtgctatttttgataaaggtctcatacaactcaaagctgaccttgtcatgggtggctcagtgattttgtcatctgagtttgttaatgaaacttcagatagaggcctaatagcaagctggcgtccacaagagcaagtgctgaaccagacttcaattggtggattcttgactcattgtggatggaactcaacaattgaaagcatttgtgcaggtgtgccaatgttgtgttggcctttttatgttgatcagccaacaaactgtatatatatatgcaatgaatggaacattggggttgaaattgacactgatgtgaagagagaggaagtggaaaagctggtcaatgaattgatggtgggagagaaaggaaagaaaatgaggcaaaaggttacggagctgaagaaaaaggcagggcaggacactatttga

SEQ ID NO: 91122 - DNA, 1464 bp, Glycine max
  Peptide Sequence Number=SeqID_182807
atggcactagcaagtaccaacactgatcaatccacaatcaccactccttcaaagaaaccctcaaaaaactccgagaatctgaaccctaacgtgcctcatcatcgaagcccttcttcaaagtcccctgctttgcgatcctccaagccaaacaacagcaacccaattgcgcaatcgccgcagaacaggatccggcagaggaagttcgtggtggcaaagaagaaaaatcagaagggtacccaaaacgacgccgtttcgtgcaagtgcaaacacaatggtggcgccaagtgtgtttgtgtagctttccagactctgagggcttctcaggaagagtttttcctcaaagaaaagaaggattgtgattatgattttgaagaagaaagagaagaagaagcaaaagctgtgaatgctattgaaatctatggaacaaaaagtgaaacagtgcaaggagaagaagaaaaagaagaaggaggttccacagtgaaacgaaggagggagagagataggttgttggaagaggcaaggaatagtgttcctgaaaatgggtttgggagggttatgcatttggtgaaagcctttgagaagcttctcactatacctaagagttcaaaggagaaagatcacaaggaggagcatgatcatgagcatgaagagcaaaagaataagagccaggtgatgaaatgggcattgccagggttgcaatttcaacaacatcctaagcctaagacacttgaagctactactgatgatgcttctgtttcgggttcttcttcattttgttgtacttctgatttggttttgacatccaagaaccttggtattggtcaagggatttcagtttcttcatcttgggattgtaaccgtgcaagtgtatctagtaggacttctgggggtagaaggagcaggagaaatagctcggagtcatctgggacttttggagggaggaggtggaagcagaaggagaagctaaaagtcactaggcaaaaaccatttaagttaagaacagagcaaaggggaaagttgaaagaggaagaatttgtgaagaaagtacaagagatgatgactgaagaagagaagatgaggataccaattgctcaggggcttccatggacaacagatgaacctgagtgcttgttaaaacctacagttaaagaaagcacaaggcctattgacctaaagcttcatagtgatattcgggcaattgatcgtgctgaatttgaccaacaggtggcagaaaaaatgaacttcatagaacaactcaagttggaaaaggaaagacaacaaaagttagaagaagaagaagaaatcaggaggttgaggaaggaactcattccaaaagctcaaccaatgccttattttgacagaccatttgtcccaaggaggtcaatgaagcatcccactatacctagagaacccaagttccacatgccccaacataagaagatcaagtgtttggtcatggaatga

SEQ ID NO: 91123 - DNA, 669 bp, Glycine max
  Peptide Sequence Number=SeqID_182808
atggcatgtgttcctgataagattaagtccattgatgggtcaagagaaactctcaagcttactgtaaggatcgctgatctttggttcattgggatccctgacaaatctgaacaaggggaaatggttattgttgattctaatggagatgaaatccatgttgtttgtaaacaagatcagctcaagttttggaaggctgatttgaaggaaaattctacctatgtcatgcaatccgatctggatcacctgccttttaagaaatttaaatttgttgacttttctactgtcgttgttgctggtgatttccaaactggactgttggttgacatcattggcgtcgttgatgaagtggtgttccgagagcatcgtctccgacaaagagccttgtctccgttgcgtcttcttccgtttgcagccgccgccgacaaaggcaaggctgcatttaggccgttagttgttgttggtggtctacatcgtcgtaaagctgtgtcccataaaagtggcatttatgtgggcctccttgatgaagctgacttgcgcccagtgagtgaacgacctttgggaacagcctcctgccatccttcatcagtggtgtcatcctgtgccagattattgctttcattgagcattgtttggtctaagttagtacactcaactttatcaatcccctga

SEQ ID NO: 91124 - DNA, 201 bp, Glycine max
  Peptide Sequence Number=SeqID_182809
atgcaggatacattatacttggagaacatagaggaaagggaaactgggggcacgcctccattaatccagacagcgagagcatgggacttgtttctaacgttgatgcattgcaaagtttctgataaccctcaaccaaagattaaggaggtcaaggagaagatgaaaggaaaggtcaatacttcaagcatacctggaaactga

SEQ ID NO: 91125 - DNA, 474 bp, Glycine max
  Peptide Sequence Number=SeqID_182810
atgttgagaggaatgcccaataatcaacttcttgtaactgtaataaagcgcaatttgtcacttgattttttgccgcaatctgcaaaagccgttggggtaaacccagtgtcccttgcaatagtgcgtaagcgttgtgagttgatgtgcaaatgcttgctggagaagatgttgcaggttgacgaaatgaacaatgatggagtggaagtgggtgcacttccatatgtgttagtcttgcatgcattttgtcttgtggacccaactctctgtgcacctgcttcaaacccttcccaatttgttgttacattgcagccatatctgaagagtcaggctctgaaccaggacagaactggcgatatgtcaggtttgggaaagggacacttttctagggctggtttggaatcaaaccatctgctgctgcacaccctccaatcttctgcctgctgccagattgtggaatgtaaaccatctttttga

SEQ ID NO: 91126 - DNA, 1044 bp, Glycine max
  Peptide Sequence Number=SeqID_182811
atgggtgacttcatctgtaggccacttatgaagcagatcgaacatgtgggtggtgttatgctactgtctactgctcctgttattggagaagagggtcaacctcctgctgagaagtcgagggccccttcgagcattcttgccctaaggaaagttgcagggttgacgtccggtgtgggtcgcccttcaagtgtgcaggatgttcctctaactccatcggtcatcgaggctcctgctgctaatgttgttattgttattactcttgatcctccacctaggcatggcaataggacgggtcggggccgacggggcgggtttgggggcgggttcgggtcgggtattaataatctcatccccaaccttgaacccaactttggctatcggggaaaacccgaacccaacctcgaccctggtcaactcgggttttccctgtcagaatcgaggtgggaggtcgatcttattactgctgaagagagtgtgccagctgctttggctagttctgttgtagcatcctcgtccaccaccgttgcgcctttattaagtgttggtgtggtgaccaccaatgcccttgtggtgcctcctctttccccttcgactccaatggtccctccctccactgcattggcttctacttccgcctcctctcaaccctgtgtttccctatatcatatctatacttctaacaatgttgattccttgtggggcataggtgtgttggccaagttgctgcacaacaggttggacggtgatgaactgcaagaagagaaaaagaacttggttggcaggatggaggacgttgcggcggagaaggatgagccttccaagaagggcttcaacaaggctgtcaggcaagttgggttcttcgccaaggaacttagcttaggtctttttaacccattcaaggacgtgaaggacgatgttctgcttgacgaggacgatattgttgtaaaggaagaggctgttgtaaggagcaggcttcttggccccaacttctgttgtcagtttcagacctacaatgagcgcctcatactccacctgattgtttga

SEQ ID NO: 91127 - DNA, 378 bp, Glycine max
  Peptide Sequence Number=SeqID_182812
atgccacgctctcgtccgtcgtcatcatgttggaccagcctcaatgaggaactggagcaacttcttgcgactgtgcctaaattaacaattgaagagcacggagaatggagaaaaatgacaaacatgatgcagaatgttgtggttccactagagactattttccagaccattcatgccagggaccagattttcggtgaagttagtaaggtatatgctgtcaggacgtttcaagcagcatgtattatttttttaaagacaaaggctgaactcatttgcacttggaaaacgttgcagaatgctggcttgcgttcaatcattggaggaagacacttaaaattggagttggatggaaacatttctgcaaaaccttgtccttga

SEQ ID NO: 91128 - DNA, 483 bp, Glycine max
  Peptide Sequence Number=SeqID_182813
atgattgcggagacagagccctttggcagcgacgagaatggtgaagaggaggaggagaaaggggtggttgagatttgtgtccctaaccgtggcagcacacacaatagaaagggagaagcgaatgtcgaagagaaggatactgcgactggatggctttgtgtgggaccggttactggcggctgggagggggtcggagaagagtgtgtggtgcttgttaacgggaaggtggaaagttgtcatgggaaggggaggcaacgtggtttctactgttggtggaggcagtatgaagatgggttggttaccttgggaagcaaaggcgacataggtggtgacttcgcaaaggcaggagatggagagggttgtctgtttggaagcaatggaagtttgggctgcagtaatgaaagtttggactgcaacgagtttggtcatggcggcctcaagacgatccacacaagcggtgtaaagttcagtgtccgccattga

SEQ ID NO: 91129 - DNA, 1359 bp, Glycine max
  Peptide Sequence Number=SeqID_182814
atgaacattccaaatgtgttgattgtaccatatcccgtccaaggacatgtcaatcccttgatgaacttctcacaaaagttggttgagcatggatgcaaaattacctttgtgaacacagacttcacccacaagcgggtgatgaattcaatggccaagcaagaaagccatgatgaatcaccaatgaagttggtctcaatccctgatggtttaggacctgatgatgacagaagcgatgtaggtgaactatctgtttccatattaagtaccatgcctgccatgctagaaaggctcattgaagatattcatttgaatggtggtaacaaaatcacatgcatagttgctgatgtgataatgggatgggcattggaagttgggagtaagctaggaatcaaaggagttctcttctggacagcttcagcaactatgtttgccttgcagtacaacattcctacgcttattcaagatggcatcatagattctgatggattcccaattacacaaagaacatttcaaatatcaccaagcatgcctactatggacacaggagtcatttggtggtcaaaagtctatgatcgagaaacagagaagaaagtatttaattatgtagtacactgtactcaaaattcaaatctggctgagtggttcatctgcaacaccacatatgaacttgaacctaaagcattatcttttgttccaaagctcctaccagttggtccattattgagaagctatgacaatacaaataccaatgcaagttcattggggcagttctgggaagaagatcactcttgcttaaattggctgaatcaacaacctcatggttctgtgttgtatgttgcctttggtagtttcactcattttgaccaaaaccaattcaatgaactagctcttggactagacctcaccagtagaccatttctttgggttgtacgtgaagacaataagttggaataccctaatgaattcttggggaatagaggcaagattgttggttggactcctcaactgaaggtattaaatcaccctgccatagcttgttttgttagccattgtggatggaattctatcatggaaggtttgtctaatggggtacccttcttgtgttggccttattttactgaccaattttacaacaaaacttacatttgtgatgagttgaaggttggactgggattaaactcagatgaaaatggacttgtgtcaaggtgggagattaagaagaaattggaccaactacttagtaatgaacaaataagagcaaggtgtctagaattgaaagaaacgggcatgaacaacattgaagaaggtggtggatcttcaaagaatattagtagattcgttaactggctgaaatcttga

SEQ ID NO: 91130 - DNA, 867 bp, Glycine max
  Peptide Sequence Number=SeqID_182815
atggacaagcacataatcaatggagttgtgttgtgtcctgcatcaacaactctttttacattgttgtacagcatccccaagtttatatacgacgggatcatagattctgattttgaattaacattgacgacgggcaagagaattcggatatcaccaagtatgcctgagatggacacagaggactttttttggttgaatatgggtcacccaataattggtaagaaagtacttaagtatttggtgcattgtacacgaagcttacatttgacagaatggtggctttgcaacaccacacatgaacttgaaccagggacattatcctttgttcccaagatcctcccaattggaccattgttgagaagacatgatgataatacaaaatcaatgggacaattttgggaagaagatctctctcgcatgagttggctagatcaacaacctcctggttttgttgcctttggtaacattgttggttgggctcctcaacaaaaggtgctaagtcaccctgccatagcatgttttgccacccattgtggttggaattctatcatggaaggtttgtccaatggggtccttttgttgtgctggccatactttgcagaccaactttataacaaaacacatatttgtgatgagttgaaagttgggctgggatttgagaaagataaaaatgggctcgtgtcacgcgaggagttcaaaatgaaagtggatcaattcttcaatgatgagaacataaaatctaggtttatggagttgaaggaaaaagtcatgaacaacatagaaaagggtgttgctaggtgcacccagcaattttccatttttccaaattgcccgtatgactttcaggttattaacacaatgctttaa

SEQ ID NO: 91131 - DNA, 1386 bp, Glycine max
  Peptide Sequence Number=SeqID_182816
atgattccaactgtgttagttttaccatatccagctcaagggcatatcaatcccatgatgagactctcacaaaagttggtcgaaaatggatgcaaagtcattgttgtgaacacagattacgaccacaagcgagtggtgagttccatgggcgagcaacaacatagccttgatgaatcactactgaagtttgtctcaatccccgatggtttaggaccagatgatgacagaaacgatatgggcaaggttggtgaagctatgatgaacatctggccacctatgcttgagaagctcatagaggatatacatttgaagggtgacaatagaatcagcttaattattgcagaattgtgcatgggatgggccttggatgttgggactaaatttggaatcaaagggaccctattgtggcctgcatcagcagctttatttgcccttgtatacaacctccctaagcttattgatgatgggatcatagattctgatggtggattaacaccaaccactaaaaagaccattcacatatcacaaggtatggctgagatggacccggaaacctttttttggtttaatatgggtgacacagtaaacagaacgacagtactgaaatatttgatgcagtgtacacaaagactgaatttagcggaatggtggctttgcaacaccgcaaatgaacttgaagatgggccattatcctctattcctaagcttgtaccaattggtccattgttgacaagtcatgatgatacaattgcaactacaaaatcaattggacaatattgggaagaagatctctcttgcatgagttggctcgatcaacaacctcgtgattctgtgttgtatgttgcctttggtagtttcactcattttgatcaaaaccaattcaacgaactagctcttggattggacctcaccaatagaccttttctttgggttgtgcgtcaagacaataagagggtataccctaatgaattcttgggaagtaaaggtaagattgttggttgggctcctcaacaaaaggtgttaagccaccctgctgtagcatgttttgtcacccattgtggttggaattctatcttggaagggttgtctaatggggttcctttcttgtgtttgccatatgtgggagaccacatttataacaaaacatatatttgtgatgagttgaaggttgggttgggctttgactcagaaaaaaatggacttgtgtcacgcatggagttaaaaaggaaagtggagcacctccttagtgatgagaacatgaaatcaaggtctctggagttgaaggagaaagtcatgaacaccatagccgaaggaggtcaatctttggagaaccttaatagttttgtcaagtgggttaaagaattaggatcgacattttatgcataa

SEQ ID NO: 91132 - DNA, 129 bp, Glycine max
  Peptide Sequence Number=SeqID_182817
atgaaagctatgccaagcaagccaacaagaaaaggaaggaagtgggcaaatgttttccaagaaggagggaatgatgagaatcctgaaactggccaaatacaggctaaaggtccaagtggagaaggatga

SEQ ID NO: 91133 - DNA, 327 bp, Glycine max
  Peptide Sequence Number=SeqID_182818
atgaagcgtcaacaaagtgcagatgggaagttggatgttctcattcatcctacaaagctggtagcagtaggtccaggctacaatgatttcattactggtctttctcttattgttcaccagaatgcccgtcttaatgtgctccagtggaagaaagttccacaaagtactagggatacaatagtgcaaagtattttggcaaaggttggaagttacaaaaacttccatcaacggttggaagttacatggaagttactaaaacttccatcaacgacagtttttaaaatagaaaaaacttccatcaaccgccaaaaaccacctgttctttga

SEQ ID NO: 91134 - DNA, 960 bp, Glycine max
  Peptide Sequence Number=SeqID_182819
atggccttcttgaattatgagaacaagaaaggaagtggtaagaaactaaaagtgcattttgatcttcctgaggatgatgattttcccaatcacaggcattcaagttcttcagtttcatctgaatcctcattagattcagatgatactgacaatgacaatagcataaacaatgttgattccaagtacggtttgtacggctcgcctgtatggagctttcaaggagggtcagtaactcaatctcctccagttcagtttatgaattctcctggctatgatccaaacagaatcccctcttctgtattcaataaacctacaagtcctatggaatggagtgtagcctcaaatgaatcactattcagcatacaattaggaaacagcagtttctcaagggattatgcttttgcattcaacaacaaatctggggaattgcctaggactagtgatttgcccaacatgcccgcaacattgccatctgttcaagaggtacctgctaaagaaaaaaatgtggacatggagagacagtctgtgtcatcagattcatcaagtgaaaccgcagattcgattagggggcatgaccatgacaaaacatcacatgaatcagcaggttcagttgttgacctcaagaaaacagaaaattcagaagaaattggcactgatgaagtagtgttggacaaatatccagatgatcattctaaagaagcaaagatccctaatggggaagccaagaactatgcaagtgtttcataccgttcggtggaaagcaatatgagcacacgttcgtttcaatttcctatattgacagcagaaggaggaagaactagttcgtcaacagtagagtcagaaaagcaggagcagcagccagagaagccacagcagcctcctagtcctaaaacagaaaaagcaccaaagaaaagtggtaaaagttggtgtttctgcttctcttgttcaccatgtttctaa

SEQ ID NO: 91135 - DNA, 372 bp, Glycine max
  Peptide Sequence Number=SeqID_182820
atggcattggcttcaactaggacttctacaccctgtgggacaaagtgtaaagttgttatggttgatgtcactgatacacaatttgataagttcaacacaggtcttgataacgtggttgaagcgattgggtgtggtagtgtatatgctttaaaacaatcaaatgtagctgagaaacaaggggacatttgggagttattggaaggaatgagttcaactaaccagcctttaatggagcaatgttatgactatttatgtagcaaccaatccgagacccaaagattgtttagtatgccttcccatttgcaatgcaatcatctgatcaaattgatgaaggatccaacctcattgcctagtgatagttgtgttgagtaa

SEQ ID NO: 91136 - DNA, 282 bp, Glycine max
  Peptide Sequence Number=SeqID_182821
atggatacaatgggcatttcgccagaggtattagcgggagcacatggactatcaatattccgccagagggattggcgtaaccacatgcatgggtattccgtcaaccatattggcgtaacccatgttgtggcgtgcaatggtggccatgtgtgcatggggtggggtgcatgcatgcatgcatgggtatttctcgcaactgcggctggcgtaacccacatgtatgccgccagtggtgatggcgtaactctttggggtgtctcgccaaacgcaatggcagaataa

SEQ ID NO: 91137 - DNA, 1398 bp, Glycine max
  Peptide Sequence Number=SeqID_182822
atggagaaagcaacaagagtgaaaatacttgaaatttgccttgtgtcaccaccacaggaaaaaacgacaacacaaacatctttgtctctcacattctttgagttactatggctgaggcttcccccagttgagcgtcttttcttctatgaattccccaaccaaaccatttcattcttcgacaccattcttccaaatctcaaacactctctttccctcacactccaacactttctaccttttgctggctccatcatttggccccttgactcaccccaccccatcatcaactatgtccctggcaatgccgtttccctcaccatagctgagtccaacactgacttcaacatgctttgttccaatatctgtgatgcttctctacgccatcccttgataccccatttggccaattcacacgaacaagcttctgtgatggccctccaagttaccctttttccaaaccatggcttttctcttggaatagccacacaccatgcagctatggatggaaaagcctcaactttgtttctcaaagcatgggcctatgcttgctccaataataataataacctcattggagaatcattctcatcacctttgttgtcattaccacaacatctcacacccttctatgataggtcaacgataagagacacttcagggattggtgcagattatttgtctgcttggttgcactatggtggagataataatagtaggagcatgaaggtgttggatcaattcggtggtggtgtaaatgcaacgacaaaagaagcaatcagatggtcgtttgaattaacctcatcgaacatccaaaagctcaagcatcatgcacaatccaagctcaaagaagagaatgctcacttttcaacattttcggttacatgtgcttatgtgttgcaatgtttggtcaaagcagacaaaccaaaggccaatggagtggcttttttgttcagtgtggattgcaggtctcgcttggagccacctcttccatcaacatatgttggaagctgcattattggccataaggttctgtatgaaacaaagaatttgtcaggggatgatgatttcatcaatgctctcaaggggataaaagaagctttgcaaaagttggagaatgaagtgctaagtggagcaacaactttggcagaaaaggtgcaaatgcggatgaataataaaatatttactgttggtgggtcaccacggtttgaggtttatagcattgattttggttgggggaggcccaagaaggtggatgtgacttctataggcccaaccggaggatttttcatttctgaaagtaggaatgacagtggaggaattgagattactttggtgttatacaaacaagaaatggaatcattcatgactcattttgctgaaggacttgaatctctttga

SEQ ID NO: 91138 - DNA, 282 bp, Glycine max
  Peptide Sequence Number=SeqID_182823
atggccgatgatggagcaaccttgacaaggatgagccagagaaaggcgtcatggagagatagagaaaacaacaagagaagagaacggaggagaagagcaatagcggcgaaaatatactctggacttcaagctcaagggaacttcaacttgccaaagcaccacgacaacaacaaaactctgaaagctctctgcacaaaagctggttggtgcgtcaaagaagcttggctacgggtggatggtggtggcacggtggagaaggagaagaagaggatgatgtactaa

SEQ ID NO: 91139 - DNA, 102 bp, Glycine max
  Peptide Sequence Number=SeqID_182824
atggagaaggggaagaaggagaaggagaaaggtggtgacacggtagtggtgattcccgttggagaagtagaagaagatgacatgacaatgacatgttattga

SEQ ID NO: 91140 - DNA, 150 bp, Glycine max
  Peptide Sequence Number=SeqID_182825
atggataagagtttgaaggtaggagaagatgagtggagggagagggagagaaggggcacgaatatgcctcaaatgagcccactaattcaagatcaagtccaatattctccactaagtgtgcttaggtgtcgtgaggcatataaaacatga

SEQ ID NO: 91141 - DNA, 456 bp, Glycine max
  Peptide Sequence Number=SeqID_182826
atggaagacataaaaatcctaagaacttttctaggccttcttaattatgcaagaaatttcatcaaagacctaggaaaatatacaacccctctttataacaaaacatctttgactggacaaagaaaattcaatactgaggatataaagtatgccttgggaaaatatcatacaaaacctcaggaatacaacaaaatgaaaccttgtaaggtttcctaccaaaacataaagcagaaaatgaagttcggtaatcaagaattgccgataaccaaggagttccttttcttacaaaagcctctccttctggaaaaggctatacagcttttgtcctgttatcaggaccgcataaaggtgtttataccaatttcaaagacctttgcctcgcaaaggagggtattcaaagcccaatctataaaggtttctattcaagggaagaagcagaaaaagcccttgaattaa

SEQ ID NO: 91142 - DNA, 993 bp, Glycine max
  Peptide Sequence Number=SeqID_182827
atggctccgagaaagctcccaaccaagaggtccataaaagacaccgctggagatggttccagtgcagccccacgggcagacgtggagttcgatagacacagagagaggcgggtccagctgagggacgaggagtatgttgagttccaagaggagataggctggaagcaatgggctcagcttgcatcacccatggctaagttcgatcctgagatagtcatggagttttatgctaatgcctggcctacagaagaaggagtcagggacatgcactactgggtgaggggtcagtgggttccttttgatggggacgccattaaccagtttctggggcatccattgatcttggaggaaggccagcagtgtgagtatagccagagaaggagtcaagccttaggctttgatgaagaggctatcgaccagttgctatgcgtgccggggcagctcagaccttcccctaccgaagtgtcaactggtctctgccatcctgacataggggttacgcctccgagacacccagtgaacccggagaagtccaacagggccctggggtttcctactctgatcacatgcctctatcagttctatggagtatcggtcacccccaccaagctcatccggcctcttattaacaaggctttcatcgtgaagtactgcatgcccaggcaacagcaaccagctgcagatgcaccaccgccacctctacaggaggaacattctctgaggtccatctctgatcacctgcggaggttagaactccagatgcacaggtacatccaccatgtgactagccagcaggcggctaatcaccgaggccagagccaagaccccaatcctttcccttggcctacccctgaggagttcgaggctacggtggcctggctcgaagatgagaccaatttcgagacacaggcaggacccgcaggggctctaggaggtgacggagaagatcaaaaggatgatgatatggtcgacatgctagatttcttcacttga

SEQ ID NO: 91143 - DNA, 420 bp, Glycine max
  Peptide Sequence Number=SeqID_182828
atggtattggaagacaagttgaaggcttgccaaaggtcaaaaaggaatttgtctaagcaactgagcaagaccgaagaaaacatgtgggccatcattgaccaatacaaagagaagctaagtctagtttcaacccatgagcaaagactagaggatgagtatgcaaaggtgtcagtcctgcaagaagaaagggaagcaagggagagggtgatcgattcattacacagagaagcaatgatgtggatgaataggttctcttttaccttaaatgagagtcaagagcttccaagactgctagccaaagctaaggcaatgacggacatgtactcggcccctgaggaagttcatgggctcctcgattattatcagcacatgattaacttgatggcccacatagctaaggcgtttgtactttcgatttaa

SEQ ID NO: 91144 - DNA, 240 bp, Glycine max
  Peptide Sequence Number=SeqID_182829
atggacaatagtgaaggagggggggcgggtcctggaaactatgttagaatgacaatggtggtggttgggcttggtgagaaggtggtgcacgatggtgcagagagtcagacaacagggaaaagacattccaaattcaagccaatgcaagtaggtaggattaaaccacgatcaaaacctaagcaacaaaagctcatcactgttgctgatgatttgccaattatgaatgacattgcaaattaa

SEQ ID NO: 91145 - DNA, 330 bp, Glycine max
  Peptide Sequence Number=SeqID_182830
atgtcttcaccacaggacatttcattggctgttgcattgggttcagcaactcagattgctatgtttgtggctttggcatatttgttgtcccttcctgagatgaagaatggtggcatcgatccaaaccaaaaatcagattcaaattctaggaatgctggaaagtctacgacgattattagaacaatcgatgtagcatgttttagcatgggcaactttctacgacggttcaccgccacaaccaatgcagaatgctttagcatggacaacattctacgacggttcaccatcacaactgatgtaaaatgctggacattctacgacggttattaa

SEQ ID NO: 91146 - DNA, 327 bp, Glycine max
  Peptide Sequence Number=SeqID_182831
atgttcacgaacaattttggggccaacacagagaagaatcccaaggaggagtgcaaggtaattttcactaggagtcagaggagggagaatgcaaagagagaaaagagagctgagggagtattggaggatgtgagtaatgaggaaagaaagaataataagagagaaaagggtgatgaagagaaagaagaaagcaaggagaagggtgaaaaggtcttacccactaagaccaagagtcagttagcaaggaaggctagaatagagataccctcagtcccagtgaaggacatcccatatcccttggtgccatcaaagaaatataaggagtga

SEQ ID NO: 91147 - DNA, 387 bp, Glycine max
  Peptide Sequence Number=SeqID_182832
atgagctcatcctcttccatagctggctcctcctctactggttcagaaggagctagaattggtgtcgtaagctgtggaatacgcggagctgaactggatggtgcggaaggatctggtaaagaagttgaagaaggagcagaagtatctggtgctgtagaagtaggaggaacagaagatgtaggggcttcagacctcttagcttgggccttccttggccctctgaatgtgactgttggatcatctagattccaaaagttcttctttatgtatgccatgttaatggcagggttgaggctctccaaggatctggaatctaaagtgactcctctagctttgcacaaagctgtaatcaaggttggaaacccaagcctagaggagtcatgctag

SEQ ID NO: 91148 - DNA, 915 bp, Glycine max
  Peptide Sequence Number=SeqID_182833
atgatcggaaggctgctagccggttcattagctcttgaaagccgtatccttcattatctaattgtccgtatcttactccccagatcttcaaaccttgcacaggtttctgaagaagatctaatagtcatgtgggcctttgataccgaccgacaaattgattgggcacatctagtccggtatcgcatgcataaggcattgcgatttaatgctcctttgccctatcctcacttatttactttgttccttcaacattttaacatcccttttgattctgaaccttatgttccaatcaagagatctttcttgatcggtgctgttgtggttgcctcctttggttaccgcaaagagcatgatggcacttgggtaaaaaagggtgctcaaccaaatgatgatgaaggacaattaccggttcaagaagactcttctctccttcagagtattttggataggtttgatggacttcaaacctatgttggtgagaggtttgactccttggaacatgaagtggacacacgattcgaggagatgaactcaaggattgcaaaggttgaagaagatgtttgtcatcatcaaaaagggggagattatggaagcaaagccttccaagtttattttgatgatgccaaggactcaagtcaagaatcaagagtcaagcaagtatcaagaatcaaagagtcgttcaatagagaatcaagattcaagagaagactcaagatgtacaagaacttcaagaaaagcatcaagataaggtacatcctttgtggtacaagtagagcgtacatctacttgggttgtaatactgagaacaagagagagtacatctcttgtggatcagttcaagtggagtgtatatccacttggttgttcaaagagaacaagggagggaaccagtggttgcttggggactggatgtag

SEQ ID NO: 91149 - DNA, 249 bp, Glycine max
  Peptide Sequence Number=SeqID_182834
agacctactcttggtgactgttttcaagagaaggtcttcttggttgcaaacactgaattgtggaagcaatgacttccaaggttattttgatgatgccaaagaatcaagagttaagaaaagtttcaagcaaagattcgagaatcaagcttcaagtttcaagattagagattcaagaatcaagattcaagtatcaagatcaagattcaagactcaagattcaagaatcaagagaagactcgatcaagataa

SEQ ID NO: 91150 - DNA, 543 bp, Glycine max
  Peptide Sequence Number=SeqID_182835
atgcatgagaatgttgatcatgctattcaagctaccttcgaagctcagcctccccagcctatagggggtgcccatgaagagcctcgggagcacgcccaagttaacttcgactcataccccccactcaccgacgagggatcggcgttcaatgccatgcctcagcctaatactgcgggagcctctcaaccccacccgatgcaaccactacatttctccgtaggggcgacacctccgacaatggagggaaacgaaaaacttgacctcatcgaagagaggttaagagtggtcgaagggttcggtgattactcttttgtcgatatgactgatttgtgtttggtaccggatgtggccatccttcccaaatacaagacctcagtgtctttcgaccaagactattgcggtctccatttcgtcatccagagacaatcaagtccgatggcatgtagagaccgtcatggtcacacgctttcgttgttccaagactatcaaagtcctctttatcatccaaagacaagcaagtttgatggtatgtggggacaatga

SEQ ID NO: 91151 - DNA, 966 bp, Glycine max
  Peptide Sequence Number=SeqID_182836
atgaaaggttgtcaaaatatgaggtatattgtggttaactgcctagcccatggaccatgtagcaggttgtgtctggctttgttggatgaggattacacccgacttttgctaataggggaactggcaagcactgtcaaagagttagaagaaagcaatcacaagcttgcaactcttaaggcagagagagatgctgcaaaaggggttctcccactcttaaatgttggaagtacacacattcctagtgataagatcaaagacaagcaaaaggatttgcaagatatggaatctactttgaaggagctattggaccaaggttcagctcgattaatggaactgaaaagtcttcacgaggaaagaataagaatattacagcagttgtgtgatctacagaacactttgaagaatttgaagtgtattacttcttcccatgctttccaattggttagagatcagatagaaaagtcgaaagcagaagtcctggagtatcaggccttatatgagaaactacaggttgagaaggataatcttgcatggagggagagggagtggtacattaaaaatgatttagcagatgtttttcaaagatctgtggcagtttcagattttagggtggctgatctacgctttgagatacagaaaaagatagaggaaagatatgtgattgaaaataagctgaaagaggaagcaagagggcctggaaggaagcaaattattgctgaatttaaatctctggtttcttcatttcctgatgaaatggggtctatgcaaatccaactaagaaaatataaagaatcggcttcagatatccattcactgcgtgcagatgtgaagtctgtttctagtattcttgacagaaaggtaaaagaatgtgatgtattttctgttaggtctgctggtcaacttgctgagataaagagactgcttggtgtggtacgtatcgggcccgtacccaagttcaataattaa

SEQ ID NO: 91152 - DNA, 411 bp, Glycine max
  Peptide Sequence Number=SeqID_182837
atgtccaatgatggttccaaagtcagaaaagatgcaaagataagcttaaactaccaaggaacaagcttagaatcacagttacctcgaagaaaaccgcgaagggttcctctcgatgtgggatttcaacagagaattacggcggtttgtggcggccaccgatggttttgggttgtggagaagaagcttgggatgttgggaagggtcttggggaaaagaaagggaaagaaatggttgcttttccactaccacacgaaaacaaagctcgcaacactcaagtgtttttgctctcgggaaaaggaacatctctcacactccagaagtcatatcgcatatcacaatggtcagaatgtggacagttgtcctatgaacctcctgaacaaatttcgagatgatccaacggttaacaaatga

SEQ ID NO: 91153 - DNA, 462 bp, Glycine max
  Peptide Sequence Number=SeqID_182838
atggggcacgaatcatgtgtgccaaacttattgcagacacgattaactctgctcccattatgtggcttagaaaaagtagtagtagcagggaaggatgtagaaatcaataaagcaagttcagtgagtcaaaattacactcaacttcaacttggcatcagagctgagttctcctgggtcgttcgctgcctccgtccgccgtcgctgccgccggccaccattttttccgatgaagccagggttaggtgcgccttgaagagcgcgactcacccctggaagtcgcgccgccacacactgccacaatctcgcgctaatttcggcgcgtgtagtccacgcgccgccatccggtcaccggacttgttccagcagcctcgtcctcttctcctggacacgtttcagacctcgtctttgctttttggcaagttgcatgtgccagcccttgctttccctccacttctttgttag

SEQ ID NO: 91154 - DNA, 432 bp, Glycine max
  Peptide Sequence Number=SeqID_182839
atgatgatttggaaacaacgtgcaaaattagtcatggccatagccaggagggcactcaagcatcccatttacggcattgtgatactacggtcaggaatttacacaaacagacccatcgtttcccaattatgttctttcatcagttcaatgaattcatccattcttatctcggacgacgttcctaaatggaaaactccacacgactctggaatttcgaaaaacactattgacaacaatgaaacaagtactaatgtaacaactcaaacgatatatagcatacaaatgataaatgatggaacatacgaatttggggatcccacggtcatgtggctccgcatgccaccggactcttgggacacggtaacaaaaggtggggtggtcgacaaaagcagggcttttgctcctacgtatctccgcgcggttagtgcttga

SEQ ID NO: 91155 - DNA, 109 bp, Glycine max
  Peptide Sequence Number=SeqID_182840
atggcgaccaaaatgaaacaatgtccatttgaagctttgggctcaatagcttcaatcatgtctataccccacatagagaatggccaaggtgctgccaagacgttcaaag

SEQ ID NO: 91156 - DNA, 390 bp, Glycine max
  Peptide Sequence Number=SeqID_182841
atgtcagcgtcttccagtcgagactgtgaaaaagtcttgtttgctatccgtcagactcaagggtccgatggcaagtccgatgacatgcggatataccttatggttatccgcaccttttgtcagctagcggcaagcgagcccattgacacgcagagactaacatcgtcatctgcacctttttcatccagagacggcaaatccgatgatatgcggagataccttatggttatccgtaccttttgtcagctagaggcaagcgagcccattgacacgcagagactagcatcgtcatctacacctttcctggagatgtcagcgtcttccggccgagactgcaaaaaagtctcgtttgctatccgtcagactcaaaagtctagtagcatgcagtga

SEQ ID NO: 91157 - DNA, 243 bp, Glycine max
  Peptide Sequence Number=SeqID_182842
atgggatcgagtcaagcgccttcgcttaaaaagaggttctatcaagtcaaggtcaagaggctaggaaccaccagtctaaaagaattggggcaattgatgggtcagctccagcaacaagcgtttcgcaaagcttacggtaaaatctgggacctggccatggcagaagtctccatagaggccattgcatccctcgcccagtattatgaccagccgttgagatgcttcacctttggggacttctag

SEQ ID NO: 91158 - DNA, 675 bp, Glycine max
  Peptide Sequence Number=SeqID_182843
agctaaaagttgacatcctacccttcattgtcgattacaaggaagattacccttggcacaagtatattgtttctctaagatatggtgctctcgcgaatgatttatttttctttgaaaaaagcatgtttgcttttatagtggaaagacccggtggatcgttcgatcctgcccaccaacccctttttcatagccccatgaattgcgttttcgttcatgtgtcatccaccttcgagtttggagctatgcttagtgattgcttaatgcaattctccattctcaacctttttcggagccccatgaattgcattttcgttcatgtgtcctccaccttcgagtttggagctatgcgtaagtttggagctatgcgtagtgattgcttagtgcaattctccattctcaacctttttcggagccccatgaattgcgttttcgttcatgtgtcctccaccttcgagtttagagctatgcgttgtgattgcttagtgcaattctccattctcaacctttttcggagccccatgaattgcgttttcgttcatgtgtcctccaccttcgagtttggagctatgcgtagtgattgcttagtgcaattctccattctcaacctttttcggagccccatgaattgcgttttcgttcatgtgccctccaccttcgagtttggagctatgcgta

SEQ ID NO: 91159 - DNA, 314 bp, Glycine max
  Peptide Sequence Number=SeqID_182844
atgcacgagacatcgaggtttagcagtccaggagacaacatagaacataggaatgtttttagatctcccacaggcaacctagttcctctggacttggaaattgaagccaccttaagaaggaatagagccgagaggagaaggaagttgttgcaagataggacaatagcttccattctagaagaagaagctcaatcttctaactctacatcatttgattcactatcatcaagggaatcgactatatacttaccagaagcctctgtcatggctgatgaacaccagcaaagggttacccttgaggattattctagtag

SEQ ID NO: 91160 - DNA, 338 bp, Glycine max
  Peptide Sequence Number=SeqID_182845
acgcgcctccacctcatcaggccggtccactcggattgtttgatacggagcagtatttgcggcatttggttcgccagcaggcggccaaccaccgggcacatgtacagacccatgattgtatttaccagatgagcctcagcctgcagagccaggattttacttcttttccgtgccctactccggaccagttcagggcagaggtcgcatggcctggagattggcctgaggcccgggcaggagaggcaccagtagaggctctcgacgaggcagatgaggcccgcgaggacgaggagatgactgatttacttgatttcttaggagggagcggagccacatga

SEQ ID NO: 91161 - DNA, 360 bp, Glycine max
  Peptide Sequence Number=SeqID_182846
atgcccttgcggggtaggattgtatcattaggtcacattattggtagaggtgtgggcagaggagattgtgatgattccgatgatgctccgaagcgtcgacggcctaccgcatccgcacggaggcagcgagtacctatgattgtggcgcaagatgagccaatggtccctgcgccagatgtagaggctgacgtatttcccgttgacccgatggcactagctgatgtagaagacactagggcagacattcctgcagacacaggcacgcaggttgctgaggatgagcatgagggatttccgggtggtccgagcgacccatccgtgctgacccagtatgcagatcacgttgcttgcagcgtatag

SEQ ID NO: 91162 - DNA, 423 bp, Glycine max
  Peptide Sequence Number=SeqID_182847
atggtggcccgggtgatgttggggaatggctatgagcccagaatgggtttaggcaagaacaacggcagcagaaccagcctggaagagcagaggccaaggttgcaattgggacgacaagtcgaagggatcccgccttgccacatcagtaggagctttataagtgtgggtctaggacacgaaggccaagtcgtcgcgatatgcgaggatgactctccgagtggatccgacgacgagtccctcgaaggtactaatacctgggacccgaccatcgatttcaagcaagaagcgggtcagacggagagtgaagaggacgaggatgtgggacttcccccagagttggagaagatagacgctcaggaggaccgagagatggggcctcatcaagaagagacagaactagtggacttaggaactggcaatggg

SEQ ID NO: 91163 - DNA, 135 bp, Glycine max
  Peptide Sequence Number=SeqID_182848
atgtcggaagagaaaattgaagcggacttgttgagtcaagctgaggaagagtttggatatgatcatcccatgggtggcctcacaattccttgcagtgaagatgtcttccaacgtataacttcttgcttgaattga

SEQ ID NO: 91164 - DNA, 315 bp, Glycine max
  Peptide Sequence Number=SeqID_182849
atggataacaaagagggagtgcaagaacagatgaaggccgacatgtcggccttaaaagatcagatggcttctatcacgaaagccatgctaaaaattcaaaaatcaatagaagacaatgctatggcagccgcttccaaaacagctagggaagcagaaccggtgctacagcccgcaatgaacttgggccgggacagaagcgcgacgggtttcaatcggagacttcaccccccgtaccgctccaaacgatttgcgccaagcccctaccttcgaggggcaactccctcttcatgccgactatcctctgcaggaagatga

SEQ ID NO: 91165 - DNA, 147 bp, Glycine max
  Peptide Sequence Number=SeqID_182850
atggaagatgtctattttatgcagttaaatttgcagctcaaagctcaaagtattcagaccatagaagagttaagaagacagtatgccagaactgacaacaaccagaatttcaacctagaaatcaagagtagtgtttatgctgtttaa

SEQ ID NO: 91166 - DNA, 173 bp, Glycine max
  Peptide Sequence Number=SeqID_182851
atggcctcctatggtggtgagctttttctagactcatccttctccttgaagtggcgtctcctctctctcttcctttcttcgggggcgctgtcattcatcttccaagaagcaaaggaatccattgatgaagaagatcctaggcctacaagctccaatagagcttgcatcatgtg

SEQ ID NO: 91167 - DNA, 615 bp, Glycine max
  Peptide Sequence Number=SeqID_182852
atgggtcagctccagcggcaagctttccgcaaagcctatggtaagatttgggacctagctagggtagaagtctccatggaaccgattgcatccctttgccagtattatgaccagcccctaaggtgcttcacatttgaggacttccaactagtgccgactgtgaaagagtttgaagaaatcctgggatgcccactggggaggaaggaagccatatcttttctctgggttctatccctccacgacaagagttgccaagggttagtggacctagcagcgattgacgctttcctcgcctttcagcatggcaaggaaagcccggtcgtcgccattttggccatgtatgacacgttcgaccggggatgtgaaaagagcgatgcaagaattttttgttgtgcactggctctctatgtgtggctggtttcacacccttttcttcaagaaggtaggcccgtctatccgctacaaggtcaccgctcgtgcgtcgaaaaaggaaaggcgaattgggaccaactcttggctagcatggaggggcgtctgttaatttgttccctcgctagaaggaaggaagaatcaggattctatcttcatgcgaaggatgtccaaatgttcccttga

SEQ ID NO: 91168 - DNA, 396 bp, Glycine max
  Peptide Sequence Number=SeqID_182853
gcgacccgactgagatcattggctactggactagttggggcagagagacccctggtccatgtggatcctgcaactgggaaagccgacaatccccacagaaagaagttaagaacatatttggggatcgtcgctcgtgatatggtagatgtgacatatgagaattggaaacaagtccctactacccagaaggatttgatatgggaggatattcgagatgtgcgaaagaaggcacagaccattcagaaacaaaacactgcccctcacgtgttgtctcgtgggggttatgaatttctagaaaagaagttgatggatgagaagaaaaagaaacaactggaggaagatgctaaatctggaagcactgacaccgtgattgatcctccatctcccatcagatga

SEQ ID NO: 91169 - DNA, 267 bp, Glycine max
  Peptide Sequence Number=SeqID_182854
atggaaagaagaagaaggaaaagagttcttatttcatgcggaggatttccaaatgttcccttgatggggacgaggggttgcatcaactacaatctcgttcttgctataagaaaacttggctaccctatgagaggggcgccactagaggatgagctcgcacctgtcatttcacaaggcttcaataagacgccccgtggagacacttcagaaggcccacaaggcatgggaggtgttgcaaaaaaaggacaaggaactcaggggcagtaa

SEQ ID NO: 91170 - DNA, 1449 bp, Glycine max
  Peptide Sequence Number=SeqID_182855
ttgatgggtcagctccagcgacaagcttttcgcaaagcttacggtaaaatctgggacctagccatgccgttgaggtgcttcacctttggggacttccagctatcacccattgtggaagaatttggagagatcctaggatgccctctaggggggaggaaaccatacctcttctcagggttctaccccttattagccagaatttctaaaatagtccaaatctcggcgcaggaattaaaccgccaaaagcaagtcgaaaatggggtggttggaataccgagaaaatgtttggaggcaaaagcaagaatcttggcaggtaaaggcgaatgggcactgttcatagacattctcgcactattgatctttggaggagtcctctttccaaatgtggacgggttggtggacctagcagcgattgacgcttttcttgcctatcatgaccataaggaaagcccggtcgtttctatgctagccgacctctatgacacctttgaccgaagatgtgagaagagcagtacgacgattttctgctatactcccactctttatgtatgggcgaattgggaccaactcttagcaaacagagaaggagcatctgtcaattggttccctcgatggaaagaaggaataaccggagttgttatctcgtgcggaggatttccgaatgttcccttgatagggacaaggggttgcatcaattacaatcccgttcttttgataaggcaacttggctacccgatgagaggggcaccactagaggaagagctcgcacctgtccgcaaagcatgggaagtggtacaaaagaaggacaaagagctcagaggcagtaaaaatgggcccattggtggctaccgtgagtggttgaaagcccacgtgcaaggtttggattggctcccaagtctgagaatcgctaaaagggagcaagttgaggcaccagaggaagacgaagaggtgcaggctcttaggacagaactcgagcaagctcaaacagtcaaagaaaggttcaaatcagtggctcttaggatccgaaaggagaatgccgaactgagggatgtaaatgtagctaccaccaaggccttggaacaagagaccaagagggctcgggctctgtggggtagtaacaacgagcttaaactctggagggaggaaagggaccaatcgcgggtagacagtttgatcttgaaggatgagttgaaggcttgctcgagctccaagagaagtttgtctcagtgtttatgcgagatagagaccaacatgttagctatcatcaccaagtaccaagaagaactaagtctagccacggcccacgagcatagggtgtcggacgagtatgcccaagtgtacgcggaaaaggaggctagaggaagggtgatcaactcgttacaccaagaggcaaccatgtggatggaccgatttgatcttaccttgaacgggagtcaagaacttccctga

SEQ ID NO: 91171 - DNA, 459 bp, Glycine max
  Peptide Sequence Number=SeqID_182856
atgggtgtccagtgccctcgaagtggtcaaagcgaaggtcgcatcccaccaaacagatggtccccggacgaaattagggcgcggatgattataaggtatctccgcatgtcatcgggcttgccgcctctggatgacaaaaggtgcagaatgaccataatttgtctctgcatgtcatcggactcgattgtctctggaaggcaaaaggcgcagaatgactgtcgcaatgtgcccttttgcgggcgagcgaaggcgtggctcacgggtgtctttccaaaggaggaaagatgcacggagtcaccaccaacgtttatttgtggaaaacgtcgggaaaaccgaaggaaaccggtcaaaatgaaaattctaagttcaggagttgtatttacgtttgaggaaggtcaacaaaagcggggctcttgctcctacgtaccctccatcaaagaggaaatccgacctacgtag

SEQ ID NO: 91172 - DNA, 237 bp, Glycine max
  Peptide Sequence Number=SeqID_182857
atgacctttcagtggttccggaagcactttccggaagaagtggttcttccggaaatcatggccagaacacgaggtttaggtcgtgccataggtagagttgtaggcagagatagacctgctgaccaggatgctgctgatgttcccgagaggcgtaggcctactgcctcagcccgtaggctacgcgttcatcagatgactacggagggacgtgatatggctgagacgtcgctgacatga

SEQ ID NO: 91173 - DNA, 792 bp, Glycine max
  Peptide Sequence Number=SeqID_182858
atgaacacgctaagtgcgccagctgcgcttagccgtgcgttcatccttctaatgagtttcaatgatgagctcactaagcgcgtctatgcactaagcgagactagtgtttcaggccgattatgcatccctgggaaggaatttgagctaaatgcagatgggccacccttgaagatcctaaggaagaatttgaccactctcactcatacatggagcgttctttcattctccaacctggtccctacttctcacacttctgacatcacactagacagggccaggttgatatacgacatcatccaaaagatggacatgaacttgggaaagactaatggcaagaggtctgagtctccaccatctcctgctctccctaccccagctccttttacttctactacagctccatctgttccagctccagctttagcatccactcctttgcctcctatcaagagagtggaagagttcattagccaggtggcttggccaggagtccagccttcttcttcgggagggggtgaggcctctgcagcccaggagcctgtgctagaggaggacgagcccatccctcctgagccatttgtttatgagactgatccaactagtgctcaggaggaggtagcatcaccagagtccgttcctcagtcatccccatctccaactacaattcttgatgatatcccagagccatctgcactagcactagtgtctgatcagcccattgttcaggatccactagttacaccggtgttggaccttaacgagcatgcagaggaccatttgcaggatgattga

SEQ ID NO: 91174 - DNA, 255 bp, Glycine max
  Peptide Sequence Number=SeqID_182859
atggcagctcgcccaggcgagctaatgcttcatcttgaatcttatcataacccgagcaattgtgcccagtgcattgatgtagctccatgtggagcttgtaggccttggatcttcttcatcaatggagtcctttgcttctttaagatcatggcagcagaatggagaaggaagaaagatgattggagatgccacttcaaggagaagatgagtctagaagaagctcaccaccataggaagccatggataagagcttga

SEQ ID NO: 91175 - DNA, 171 bp, Glycine max
  Peptide Sequence Number=SeqID_182860
atggatttcatagaggatctaccaagagcacaaggaaagaatgtaattctagttgtggtagacaaattgactaagagaaaaaccaaagcattggccttcctgcttaagttgggcagaatttttgtagaagcaaatgactttgatgttttgatgatgatcatcatgatttga

SEQ ID NO: 91176 - DNA, 202 bp, Glycine max
  Peptide Sequence Number=SeqID_182861
gcaggcgcaaggcgaaacaccacagcagcctggggatggccagcagcgggcaacagacacaccgccatcacctctagagttcacctcagctcatccacaaaaaggttatagcgttgctgacgacccatggccgcccaataggcaaccaagtccagagccaaaggtagcaaaatacctcatgggaaaaaagagagcaaaatga

SEQ ID NO: 91177 - DNA, 180 bp, Glycine max
  Peptide Sequence Number=SeqID_182862
atggggtgcaagaattggacccaaacttggcccatgggcttagaaatctaccctgaggttcatgagaaccctagggccttcttcagcagctctagcccaatcctcttggagcctcttgctcatgactctagtgactggtcctttcctagggtggattgcatcactgagctgcttgaataa

SEQ ID NO: 91178 - DNA, 147 bp, Glycine max
  Peptide Sequence Number=SeqID_182863
atggagttgcagtggaagaaaaaggagaagagcctagtacatgggaagcttccttggcaagcaaggaaggtagcttccttggcaagcaaggaagaaagcttccttgagaagctagaggagggctactcacacccctccaatagctaa

SEQ ID NO: 91179 - DNA, 148 bp, Glycine max
  Peptide Sequence Number=SeqID_182864
ctcactaagcgaggtaattgtctcttttgcgctaagcgcaagattggcactaagcaaaatatcacttacccgtgctaagtgcgagaatggcgctaagcgtgccttcaaggttcttagaggtggaggagacatccccactgctatgtaa

SEQ ID NO: 91180 - DNA, 201 bp, Glycine max
  Peptide Sequence Number=SeqID_182865
atgccgaccagggatcggcggatgttgctttttaggactccgctggcaccttatgagaaatcaaagtctttgggttccggggggattggtggagcgatttgtctggttaattccgttaacgaacgagacctcagcctgctaaatagctatgtggaggtaaccctccacggccagcttcttagagggactatggccgcttag

SEQ ID NO: 91181 - DNA, 219 bp, Glycine max
  Peptide Sequence Number=SeqID_182866
atgtcctccaccttcgagtttggagctatgcttcatgattgcctaagtgcggaccctctagtgcaatcctccattctccccctttttcggagccccatgaatgttattgcctacgctgttcatgtgtcctccaccttcgagtttggagctatgtttcatgattgcctaagtgcggaccctctagaatcctccattctcctctttttcggagccccatga

SEQ ID NO: 91182 - DNA, 249 bp, Glycine max
  Peptide Sequence Number=SeqID_182867
atggagaattgcactaagaaatcactacgcacggctccaaactcgtgggtggatgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 91183 - DNA, 318 bp, Glycine max
  Peptide Sequence Number=SeqID_182868
atggatgtcttgtgtcttgttggaacaagtgtgaaaccaaccaaacacagagggcgggcaaggaaagcgtcgattgctgctaggcctaccaaaccatccacgcccgctatgccgttccgagtctgtttttatgcggtccaaacctcttgcggaatccttgaccacagttgcaattctgctcaaggagggggagacatcccggaggaaagatatggttttcttcccccgagaggacatcctagaattctctcaaattcttcaatggttggtactaattggaagtctccgaatgtgaagcatctcaaaggctggtcgtag

SEQ ID NO: 91184 - DNA, 219 bp, Glycine max
  Peptide Sequence Number=SeqID_182869
atgacttacattcacattctagtggaagtcaagtcgcatcaattagaccttgcactttatgtttcagggtcctacaatgctcaatggaatgccccgaaactcctccatggtaagcacatgttgcgtccgagtcgtatcctcgaaaaaatggaggttgaggaaccttggctggggttagggctaccattgaattatcgagtagatatgggagcaagttag

SEQ ID NO: 91185 - DNA, 336 bp, Glycine max
  Peptide Sequence Number=SeqID_182870
atgaggaaacaagaagttattttacatggaatctggaaatggaacgtgtattggctgatgtacttagagatcaaaggaatttgtgcaacaagggtggcggaggttggaaaagatagagccaccggtcatggagctgaaactgctatggatgctgatgaagcgatgagtagagaaacaaatgaagtggaattcatggggttaggtgctactgccatagatttagaagaaccaagctctaatacaaaaggaaaaaaaacaaggttcgacttcttctggcacacatcctcacaagagaaagatgagagaaaaagaaggaatagcagcttctttggataa

SEQ ID NO: 91186 - DNA, 485 bp, Glycine max
  Peptide Sequence Number=SeqID_182871
tggatcccccgggctgcaggaattcgatggacattgaggaggttggcagccagtttcttcatgagcggaggcacactgtataagagaaatcacgacatgacactcctgcgatgtgtggatgccaaggaggcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 91187 - DNA, 288 bp, Glycine max
  Peptide Sequence Number=SeqID_182872
atgcctataggttggacctcccagaagagtggagctgatattgaggaggaggaactaacagatttgaggtcaaatcctcttcaaggggaaggggatgatgaaatcctccctaggaaggaacctgtcactagaaccatgagcaagaggcaccaagaagatagggctagagctgctgaagaaggccctagggttctcatgaacctcagggtagatttctgtgcccatgggccaaggttgaatccaattatctttgtacatattagactaggatttggtccttatatttag

SEQ ID NO: 91188 - DNA, 174 bp, Glycine max
  Peptide Sequence Number=SeqID_182873
atggggagaatttatgtgagtgatcgactaggaaaaaatgatgacaaaggtgatgacaaaaagctcaaaggtcaatcaaaggatgagttcaagatgttcaagaagaaatcaagaacaattcaagactcaagacgaaaggttgaaggacacttcaagattcaagaggaaagttga

SEQ ID NO: 91189 - DNA, 270 bp, Glycine max
  Peptide Sequence Number=SeqID_182874
atgaattatgccactacgaagaaggagatgctagccattgcctttgccttagaaaagtttaggccatacttggtggggtcaaagtttgatatagtcatcagggacaagaagggatccgagaatgtggtggcttatcacctctcccagtcgacgaatgaagaagtgatcaaagaagaaacaaagataaggggagaactcccagatgagttcctcttacaagccaccaccagaccttggtttgttgatgtggccaaccataaagccacatga

SEQ ID NO: 91190 - DNA, 480 bp, Glycine max
  Peptide Sequence Number=SeqID_182875
atgcgcacacaaagtttcacaaatccacaattccttaaaataggcctaactcacaaaaatagtccccagtggagttgccaactgtcgcaacgtgcccttttgtgggcgagcgaggcgagggtcacgggtgcgctttccaaaggaggaaagatgcacggagtcaccaccaacgtttatttgtggaaaacgtcggaaaaaccgaaggaaaccggtcgacaaaagcggggctttgctcctacgtaccctccatcgaagagaaaccagacctacgtagtcttcttaagggtgaatcaagcgatcttttacttggaaggtggtccttttaaggcgtgggaccttaaaattatccatttttacttggtgagaaaaactaaggtatcgaaccttaaaatcctttttagtgattttttgcggacgagcttgactttgcgagttgattttagccttagtttcactttagttattagtcaattcaattaa

SEQ ID NO: 91191 - DNA, 396 bp, Glycine max
  Peptide Sequence Number=SeqID_182876
atgaaaagagaaaaatatgcctcctatagtagtcatgactcttgcaagagtttaagtgaaaaacctagcaattattatggagggcgacataggtcacatactaaacatcactcccaaagaagagaaaaagatagaaggcctctagaggttaacattagcctcccatatttccatggaaaagataatgttgaggcctacctagattgggaaatgaagacttcccttgttaggaaaagaatgattcatagggatcctctagtagagtattggaatgatcttaagagttcccttaggaagaggtacattctctcctactatgaaagggaacttatggacaagctccaaagtcttagacaaggaagtatgagtgttgaagaatatagactacaaatgtaa

SEQ ID NO: 91192 - DNA, 189 bp, Glycine max
  Peptide Sequence Number=SeqID_182877
atgggtataccaccaactgcttgcccttcagtggcatatccgaggtgtcgcaacgtgcccttttacgggcgagcgagggcgaggctcacgggtgcgctttccaaaggaggaaagatgcgcggagtctccaccaatgaaggtattagcacctctcgcgtttgtctcaaaggacaacaacctattttttag

SEQ ID NO: 91193 - DNA, 207 bp, Glycine max
  Peptide Sequence Number=SeqID_182878
atgaaaagatatagcacacttttgttttctgtgaaagaacaaggttgggaaaccagaaaactcagaaagcttttggcaaaggaagaagaagaagaagaagttcaaaaagatgttcaaagagattcaatggttgtaaaagaaactggtaatcgattaccagagagtaaaaactctggtaacttagaaaattttgagaaaaactcttga

SEQ ID NO: 91194 - DNA, 555 bp, Glycine max
  Peptide Sequence Number=SeqID_182879
atggcatactccgagttatggccttcattattggagaatcatttggtggtggccatacccgggaaggtcttccagccaccctaccccaagtggtacgacccgggtgccaagtgtgcataccatagtgtgcaacacctgattagtgccggttggctatcgtttcagggggaaggcccaaatgttaaaaccaacatgctagctagtcatggaggggctagcgtgaacaccgtcgaagaggatgggccatcgcgggcaaagagattaggagaggtggctacttctagacgcttcatctaccaatcactgcaagcggcgtgcatggtctcccgtgttggagacgaaagggatgaatttttgtttcacctcggggagtcgcatgacatggaaacctgtcccgcggtggaagaattgcttcaatggctcatggattgcgggcagcttgaagtgtccataggagggaggaaagaaccacaaatttgcatgcagtcggaagagaagaaggttcccctaacccccaaggccctagtgatatgttttactaggaaagggacctga

SEQ ID NO: 91195 - DNA, 282 bp, Glycine max
  Peptide Sequence Number=SeqID_182880
atggcacgcagcgtgtttgctccgtgcccctatttaagggacctatatgggagggagctaaaagggattttagtgataattcccaaggtggtcatatctttcttgatggtctctagagtccccagtggagtcaccaactgtcgcaacctacccttcggcgggagagcgatgcgtgactcgcgggtgcatcttccaagaaaggaatacgcgcggagtcgccaccaacgtttatttgaggaaaacgtcggaaaagccagaaaagacgtggtctacgaactttaa

SEQ ID NO: 91196 - DNA, 267 bp, Glycine max
  Peptide Sequence Number=SeqID_182881
atggtgaaagttggaacctcttacgtgccgatcaacgtctcattttcgccaaaagttggcccagggcttcccggtatcaacagggacaccaggatttatttatttctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 91197 - DNA, 435 bp, Glycine max
  Peptide Sequence Number=SeqID_182882
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgaggatttgaaactattaacaacggatgcccaactatacaaggctgatgaaatatga

SEQ ID NO: 91198 - DNA, 504 bp, Glycine max
  Peptide Sequence Number=SeqID_182883
atgggtcaacttcaacggcaagccttccgcaaagcctatggtaagatttgggacctagctagggtagaagtctccatgggaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaagaaatggagtagtcggagtaccaaggaagtgtttggaggaaagggcaaaggccttggcaaaatcaaggcgaatgggctttcttttattgacatcttggcgcttttgatctttggagttgtcctctttccgaatatggaagggttggtggacctagcagcgattgacgctttcctcgcctttcatcatggcaaggaaagcccggtcgtcgccattttggccatgtatgacacgttcgaccgggggatgtga

SEQ ID NO: 91199 - DNA, 479 bp, Glycine max
  Peptide Sequence Number=SeqID_182884
atggccgcacctgaatggtggtgtggcgcactttttgttgttgatgtccccggagttgatgcatcgtttcagactgggctatctgaagccagccggcgtgtggcacaagaagagtccaaccggcaaacgggcttgctgcttgaagaaatcgagtcgcacaagaaaaccgatgcgcaactgcaaaaggcgcgccgcctggcggaagaggccaaccaggccaagagtcgctatattactggcattagtcatgagttgcgtacccctttgaatagtattcttggttatgcgcaattgctgactaacgatgacagtattcccgagcaccgcaggcaggcgattagaaccattagccgtggtggcgaacatttgttatcgctgattgaaagtacgctggatattgcacgtattgagagcggcaagatggcgtttgatgtcaagcctctgcactttcccgagtttattagccagatagtcagcat

SEQ ID NO: 91200 - DNA, 861 bp, Glycine max
  Peptide Sequence Number=SeqID_182885
atgggccacgccacagatgatgttgacgcgtgtgggccagggaagtggagggagggagagagagagatcgggctcgtggagccactggtcgagggtttccatctcggtggtgaactcgcagaagccttggaaagcgccaggggagagtttttttactgcgacagtggtactgctaaagaggcgggccttgtagacgaggccgaagttgtcgtcgtcgacgatgaggtgaagggagaagttgtcggtggcgcgggcgagcttgtcccaggagattttgatgaggttggggtcggaggaccagctggcgtccacggcggagagggaggaggaggcttcacggtgggggccagggcgggttcagatatgagaggagcgagttcgagtcttggtggagttgcggtggtgctggtagaggaggatggcagcagcgagaaggagggtgaccacgaagaagctgccgatagaggcgacaacggcttgcttgtgacccagtgtgttggacttggagttgaactcgttcagaacttccgattcaaatgtgtagcaatcctttcatacaagggtgattgttatttcgtggaaggtgttgtgggagaccagggtgatgttcatcatggcatctttagatggtcaagcaagtctgttagaggcttcatggctggattcaaagccattgcccttacagttgataccctaagactgggacgcagagaagctgatatcaagaacagattcacactgccaccatttttgacattgaagaactttgaaggattggaccttggaaagatggacaaagctgatgactttggacttgcttcaaatgttgtcggtcaaattgaccgtactcttagctggaag

SEQ ID NO: 91201 - DNA, 657 bp, Glycine max
  Peptide Sequence Number=SeqID_182886
atggcagcaaggatagttgtacaaagtggtgcagctagaattatagtgtccaatcacaaagctagacatttgtttatgtgttgggataatagtattgcctattggagaaaatttgtggctgaatattactctcctcgtgcaaagaaacggtggcacttgtcattatatagcaatgttgggcatcatgcacttggtgttttgccccaagcaactatgtgtgacatatgtggttctaaatctggaaggggatttgaggcaacttatgaagtgttacctaggcttaatgaaataaaatttggcagtggagtaattgatgaacttttgtttctgaacttgccacgtgaaacaagacttggagagagtgtatatgagctgcttcgtgttgtttgtgaaggtcaacttcgcatcatattcactcaagacttgaagatcttatcatgggagttctgtgcaagatgccatgaagaacttcttcctcgaaggttggttgcaccacagactgatgatgctgattatgtggagccatcatttgctgttgggaaatctcctgaaaatgtgaatgttgcttctaatcaattgtggctttggtctaatgtatcttcatcaccttgtagacagtttattcattatgaactaaacttgtggacaattctatga

SEQ ID NO: 91202 - DNA, 348 bp, Glycine max
  Peptide Sequence Number=SeqID_182887
atgcaaagggtcaagaaacaacacattgaagagccaatgagcataaacactagccatgaaaaaaaaagaattggaaagctaaacatcaatgacttaagaatacaactgtcgcaacctacccttttgcgggcgagcgaggcaaggctcacgggtgcgtcttccaaaggaggaaaatgcgcggagtcgccaccaacgtttatttgtggaaaacgtcggaaaaatcgaaggaaaccagtcatgaagaatattccagattcgggagttgtatttacgtttgaggaaggtcgacaaaagcggggctcttgctcctacgcaccctccatcgaagaggaaatcagacctacgtag

SEQ ID NO: 91203 - DNA, 423 bp, Glycine max
  Peptide Sequence Number=SeqID_182888
atggccaatccaacactaatgaacctgcaatcaacagtgaaggcaatcctaactagggtgatcaagccatgctcaaatttgtcttctgaatcaagttttgtgattttaattttacacacaactatcattgatggcctgggtgttgctggatgggcagtcggtggaatagaatcagaagctgcaatgcttggccagggttcaaaattgcaaatttacaaatcacgggctactgcgttcaaggagatggaagttgctgaatggttaaaatggggcagattaactataaataatattttggcagaaaagaagacggtagttggaactggctattttgatgtatttgagagattttattcaactattcatgcagcatactatggtcctaaaattcagtccatggagcttcttcttgatgtagtttga

SEQ ID NO: 91204 - DNA, 417 bp, Glycine max
  Peptide Sequence Number=SeqID_182889
atggaggagcgtggccatggaatgtattacacgccaccaacattttctcagtatccttcacagatgtatcggtatcctttcgaaggtcatcacactgatatgtctccaagcgaacattcgttcggtggtgttgcggaaacacatcctcatttttcatggccaactatgaccccttcacagcaacatgatgccccaatggcaacacctaacgccccattagctccgcaatggaatgtacccggagcaatacctgatatgggtgacttattaggtgttgatttgcagcacgagtctgttgaggctgagcaagtagaagcggggagacatcgcggcagaagaaatcctgatcgtcaagtgcaaagatgggatcgaccatgtggcacatcctcacgacatcacagacaccataatgaatga

SEQ ID NO: 91205 - DNA, 225 bp, Glycine max
  Peptide Sequence Number=SeqID_182890
atgggatcaagggatgtttggtttgtcgtggggtcctgtaaatgtggcaaattaagagaaagttgggctgggatgcactcatgttatggaggggaggttatgaaaggaataaagcagcaacaatggactcagcaatctaataatactctaacagaaatgctagaggcagatacaagggagacaaacacaaaccagaggctcagaaggaaaatcatcaaaccttag

SEQ ID NO: 91206 - DNA, 474 bp, Glycine max
  Peptide Sequence Number=SeqID_182891
atggataaaattccgtcgaaaaataggattaaattctgtcagaaagttttgaattccaaccgattttatcgaaggaatcagatccattatccccaattaaaagacccaaaccctagccctctattttttcactttgcgatattcctctatgtgcctcagtcttgtggccacaaccgtcgtgcctccattgtgccttcactatctgcccatgccgccaacagtttggttggtgatggtggcggtttggttggtggtggtggtttgggtctcgagtggttgatgatggtttggattagaggaattggaaatgttgcacttttccttttccaagttggctattttatgaggcgtggtgtcactctcaaatttaataacttagggaaattagtatcttcctcaaattgtgcacacgtggcttccttattgacaatttgccttcaagaagccttgagaaaaagcatcaagcatgtttga

SEQ ID NO: 91207 - DNA, 138 bp, Glycine max
  Peptide Sequence Number=SeqID_182892
atggttattgaagtattggcgatcaaaatttctattcctgcgaacatggggtcgaaccaagcacagtcctttaagaaaaggttttatcaagtcaaggtcaaaaatctagaagtagccagcttgcgaaagttagggtag

SEQ ID NO: 91208 - DNA, 339 bp, Glycine max
  Peptide Sequence Number=SeqID_182893
atgaactacactactgactttgtgataattatattccttgaagggacttggatcatgggttctccacctgcctcgcctcctcctcctcctccttcacctcctcctccttccgacacatcgcctttgccgtctgccgtgaagcggacacagaaagcctcacgtctacgatcattgtctactagaccacctggtgctgagagaccagtggtccatgttgatcctgctaccggcaaggccgaaggtccccacatgaagaaattaagaacatatttggggattgtggcatgtgataaggtggacgtcacctatgagaactggaaggaggtccctactggttag

SEQ ID NO: 91209 - DNA, 528 bp, Glycine max
  Peptide Sequence Number=SeqID_182894
atgagtcttcattcttcatctagtgttaatggtgagggttctactcctaaggaccccttgtataagatattagatgagttgagatcccttaagttgtggaaagaaaaacaagagagaaaagaaaaaggaaaaaaaagagtggaagaaataagtcaagatgaaagagtgaaaataagagaggaagaaagaagaaaaataaggaaaaaaatgaaaagagaaaaacatgcctcctatagtagtcataactcttgcaagagcctaagtgaagaacttcgtgactattatgaaggaagacataggtcacatcttagacttcactcccataggagagaaaatgaaagaaagcctactttaaaatcttatggctatcattcttatccaaagaaagaccaaggtctaggcatcttaggggcaacaccttctaagcccaatgatgataaggggaagacaatagaaaagcaaccccctaaggctagtatgcaagaaaagactagctccataaagtgctttaaatgtcttagaagatga

SEQ ID NO: 91210 - DNA, 794 bp, Glycine max
  Peptide Sequence Number=SeqID_182895
agaagaaaaaactggaggaaactgctcaatccggaagcactgacaccgtcattgatcctccatctcctatcaaacgacacgtgaagtggaagctggcccgcaccaagaaaactggtcacatgacatctgaggcagcaaaggaaattgttgacaagattgcctcacaaggtttctttgtcacccatggatgtgatgatgtactgactgttgtcattgggcgatcagaacaccctggtcgtgtgcgtgttgcaggagtcggtgtaaccatcaagcagtactttggatcagcttcaagtacctcctgcacgtcttcctccatggctcccaaagacctgcaactgttgacgcaacaaatcaaggaccagctggaggactcaatcacagaaaaaatgcaatcacagggactcgcactacctcctgaacctgaggttggtccttcagctgctcgtgttaacacaaaggagaattgtgttgatccctcagggaacggtccagacacaggtaactcagacaaatgcgggttgtacatcaaagaatatcctccctgcctggtttccctaggaagagtttatgacggatccacaacagttgacaacattcctttgctgcatgatcaagtcaaggttggtgttgaggaggttagagatgcatatgctcccattcctgtacccactaaagaggttaagggagctgtgggacccacgaaacctgcagataggccggatcatgaggtcgatgatcccctatatctgatgacattgaccatcccacagctttttctaaagccattgcag

SEQ ID NO: 91211 - DNA, 321 bp, Glycine max
  Peptide Sequence Number=SeqID_182896
atgtaccctctcttgttctcaattacaacaacccaagtagatgtaccctctacttgtaccacaaaggatgtaccctctgtcgcaacgtgcccttttgtgggcgggcgacgcgtgactcgcgggtgcgctttccaaagggggaaaagatgcacggagtcgccaccaacgttcatttgtggaaaacgtcgggaaaaccgaaggaaaccggtcgaaatgaaaattctaagttcgggagttgtatttacgtttgaggaaggtcgacaaaagcggggctttcgctcctacgtaccctcctttggagaggaaatcagacctacgtag

SEQ ID NO: 91212 - DNA, 243 bp, Glycine max
  Peptide Sequence Number=SeqID_182897
atggggattcacaaccaagggggctgccctgccaggtgctggctgatgaaagacatccccagaatgcccccctttcgtgcctatctcacttgtttacagctcttatgggtcttttcgctgctttcacatgatgcaatatctgggcctcctagacctgctctctcgcccaagcctcatagcattcatattccaagcactaagtattccctgcctgctcagatgcgtcaatccgcctatcggtag

SEQ ID NO: 91213 - DNA, 156 bp, Glycine max
  Peptide Sequence Number=SeqID_182898
atgggtgccaagcacctcacgaggaccaaagaatggtcgcacgtcatcgagcaaaggttcccggacgaaattaggggtcccgagatcatacagctctattgcgccataaggccaaatttccttgatgatgaagggtccagaccatttggattttag

SEQ ID NO: 91214 - DNA, 684 bp, Glycine max
  Peptide Sequence Number=SeqID_182899
atgacatctaacgaagttcctgcatattataaacatcttaaagatgacgatgcaccaccatgtagtttacgatgcggttcaatacaatataaaaaatatgctacacaagaagatgcaaaaaaggccattgaagatgaagaactaatagttatcagcggctttctccagacccgtcctgaaaataatccaagggccgattttggaggggatgaagtacctatcgactctcattttgagagagaggatggaaaagaagtttctcttccaatagctcgccataatggtgaatctttccgcgtcccaagtcagataaccagtatccagtctttgtgtgcaaacttcattcacaattattatcgtgaaatatatcttttagacgaagatggaagagctaaaagatatagggttgagaaatttaaagggcactctaatatttggctaaggattgacaatagcacgctatatcgtgattttcgtataagaataacaaacgacacagctgaggggcgaggttttttgaacgatagaaatgttggtcgcatcgcaatattttacagtaaagttcatggggctggattgggtttcattacacctgagttagggtggggtgaggttgctttactgccagacaagtatgatgattttttaaatcgcgtctatcatgaagaagatacagataattaa

SEQ ID NO: 91215 - DNA, 747 bp, Glycine max
  Peptide Sequence Number=SeqID_182900
atgatgcagagctatcgcaacctgatccgttttgcccgtcgcaacaatttaagcgtcagcgccagcccgcaggatatcggcgtgctgacgcgtaaattgtacgccgcgtttgaagcgctgccgggcaaagtcacgctggtgaacccgcaaatctcgcccgatctgtcggaagagaacctgacctttattcatgtgccggccgggcgcgccaaccgtgccggctggtatctgtataaccagtcgccggacatgagttcaatcatcagccatcagccgctggaatataaccgctatctcaacaagttagtggcatgggcgtggttcaacggattgctgacgcgcaaaacccgtctgcacattaagggcaacgagttctgcgatctgccgcgcctgcaggagctggtcaacgatgtctccagccacttcccgctgcgcctgccggcaccgacgccgaaagcgctctacagcccgtgcgaaatccggcatctggcgatcatcgttaacctcgaacacgatccgacctcggcgttccgcaatcaggtagtgcacttcgacttccgtaagctggatgtgtttagctttggtcagcagcagcagtgcctgatcggcagcatcgatctgctgtaccgcaactcatggaacgaagtgcgtacgctgcacttcagcggcgagcaggcgatgattgaagcgctgaaaaccatcctgggcaaaatgcatcaggacgccgcaccgccggacacggtggaa

SEQ ID NO: 91216 - DNA, 246 bp, Glycine max
  Peptide Sequence Number=SeqID_182901
atggtagccgtaaggggcggtcagggttcctcaacctccatttttccgaggatacgactcgaatgcaactggattttcaggtttatgccatttgatctttgtccctcatcctctcataattacatctttgcttccactggaatgtgggtgcaagccattggtttgtttgctcaagcaacccgcgctcctgagtttggacttccaagaccattcaatcagaaattactcgtgctacacatttggtga

SEQ ID NO: 91217 - DNA, 228 bp, Glycine max
  Peptide Sequence Number=SeqID_182902
atgatggcacatcaaaaccccccatacttagccttttgcactcctgggcaaaatgaaacaaagaacaaaatccaagggtatcaaagagagacaaacgaaaacattcacatatttctcaatgaacatcaaggaatgaaagtaatggggccaaggacaaggtatggaaaaatatggaataagtggctaaatcccaaaggaatagaggagcaatggggaataagtgcataa

SEQ ID NO: 91218 - DNA, 418 bp, Glycine max
  Peptide Sequence Number=SeqID_182903
caccgcctacatacctcgctctgctaatccggttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 91219 - DNA, 201 bp, Glycine max
  Peptide Sequence Number=SeqID_182904
atgacgggagacacatcaaaattcacagatatctctcctaagaaaagtggacatgtaacttatggtgacaacaacaaaggtagaattcttggagttggaaaaataggtcttaaacatagtctgcttagtgtgagtcaattatgtgacaaaggctatctgatgatgatccatggttgtggcataaacggattgcacatataa

SEQ ID NO: 91220 - DNA, 348 bp, Glycine max
  Peptide Sequence Number=SeqID_182905
cccgcatcaattagaccttgcaccttacgcttcagacccctacaatgctcaatggaatgccccggggcttctccatgacaagcacacgttgcgttcgagtcgtattctcggagaaatggaggttgatgaaccttggttggggctttctcgctgcaaaattcatttcttggttggtgttttggtttacgctaaagggatggcctttgtggataactgggcggtgggtaaggagaaggtttgttattggctgagtaatgacattgttgggttggtgggaaacttggctgtattggaatggcagtcacagcacaggcttctccttcatcctcaccctcttcatttgcccca

SEQ ID NO: 91221 - DNA, 318 bp, Glycine max
  Peptide Sequence Number=SeqID_182906
atgggttctctgccccagcggggatggagcgaaagaagttttgagccctcccacagaaggcgtagaggaacacaccaatccatcccgaacttggtggttaaactctactgcggtgacgatactgtaggggagatatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttgtga

SEQ ID NO: 91222 - DNA, 432 bp, Glycine max
  Peptide Sequence Number=SeqID_182907
atgcgggctttgggtccaaaggacaccgggggcgagtcaaaaaaatcgttccattttcccttccggtcgagcacttcgttccttcttgttcatcaatcggaaatcaagcaagacaaaccgggcactacgacatggtcaaagctcggaagaaaagtgctaaacgcacaagtcaaaatcgaaagggccattgagaaagctctgctctccgacgggtattcccgggatgagctttctcaaaggagcaaacgagatgaaagaaggaccttgttgttctaccgtactgggaaacttctttcgatgaaaacatatgactcatatgtaaaagaagtcgaattagggacccaccggagccaaccctataagattgggctcacagaatacttcagggctggccacgcacctgtcaggaactgtataagtgggatcctctag

SEQ ID NO: 91223 - DNA, 747 bp, Glycine max
  Peptide Sequence Number=SeqID_182908
atgagccttaagattcatgccaatcggttgtgttgtttcagagatagtaagcttacaaggattttgcgagactccttgggagggaaaacaaaaacatgtataattgctactatttccccatctgcttattgtatggaagaaacacttagtacattagactatgctagccgtgcaaaaagcataaagaataagcctgaggcaaaccaaaaggtttcgaaggttgttttgttgaaggacttgtacatggaaattgataggatgaaagaagatattcgagcagcaagggaaaagaatggtgtatatatttctcatgaaagatttgccaaggaagaagctgaaaagaagtggaaggaagagagaaatagaaagaaaaaagaaaatgaagagagtgggagaaagaaaaatgagatgaaagagaggttgagatactgtgtagactctgaagatcccaaggcttcgaagctcgttgcctcaaagaagcacaaactagactccgttgctaaagacaacaagaacaagaagacaactcctcttaccggccgagaacgtcgtcttcatttcgaggaactagcagatgctagaaaaaagaagagaaagcgacatttcactcttaagcaagagcttgcacgtctatgggaaaagatgagacgtcatgagattgctaaagaggacaaagctaagctagtgactgaagctttgcaaaagatgaaagggaagattccaaagattgcaaaaatgaatgtgtga

SEQ ID NO: 91224 - DNA, 459 bp, Glycine max
  Peptide Sequence Number=SeqID_182909
atggaagctcaccaagagctcactggaaacaacaccgacagggagcttagtggggtcgtagttgaaagagtcactgtcgaaggagacactacaggaggcttagtcgctggagcaggcgtcgtcggggtagacagagttgtcttaggagcatgtgcgactcgagtatatggagatgtcacccacaacgatgcatgtttgcaatcaaggaatgaagcgagagagcatagaggattagggacaaagttggccaatgatggtagcatggtagggggagtacggtgtgggggagtggatcgagatgacgccaaattgggagtcacgggtgaggttcacgaaaccgaagttgtcagtggcacgacccgtggtttgagggagcatggtgatgaccttgcccgaggggggggggggagggggcgaaggttgaaccaagatgtcagcgagggcaagcaggagatgtga

SEQ ID NO: 91225 - DNA, 144 bp, Glycine max
  Peptide Sequence Number=SeqID_182910
atggtcgaacaacaggctgacactgtagagttactcacagtctaccatgtgctcgttgtagaagcaagcttcatgatgatgaatcaagttgattcaagtagttttgatgatgacaaagatgatgacaaaaagcccaagaaatga

SEQ ID NO: 91226 - DNA, 609 bp, Glycine max
  Peptide Sequence Number=SeqID_182911
atgaatatgttaaaaattgagatttcacaagccgcgcgcgctcgaaaaccttgccctccctcttctctttgtcaccgtgaaatcgcttttctctttctcctcccgcctgaaaactgccgaaatccgctccctcgacacccacattgtcctcgctcgaacccacacaaccccctacactgccggaaaacccacattgtcctcgctcgaacccacagaaccccctacactaccggaaaacccacattgtcctcgctcgaacccacagaaccccctacacttttcttcgaagtttggctcgaagaaaacccaacatacactgttgctactagggtgctgaaactatcgtgggtgctcaaagctcaaagctttctccgcgaggtattattgctgattgaggtacgaggaaagcttaaagtttcgtgccattttgttagatctcattgccattgtcactgtttgggttcgagacttcttggagcaccagtagagattactagtgataaggatcctgttattgttcataacaagttactgacacttcttgcaattattttggagtttggggcacttgtttgtcaaagaagagataagatgcagtttcctccttaa

SEQ ID NO: 91227 - DNA, 277 bp, Glycine max
  Peptide Sequence Number=SeqID_182912
atgtcggggttcaagccgggcatatcttggtacgaccaagctaagatgtcttggttaaataagcaagtttgtggaagtgctgattttgagttgctcgctaagccaattctctggctcagtgagccttccactaagcgtagcaattcatggctaaagtttggctgtggaagagactggagagaaccgagcttgaagaggaagctatcttgccgagcattggatgagattttgagtgattgtgaggttcctagaggtggaggagacatccccactacct

SEQ ID NO: 91228 - DNA, 318 bp, Glycine max
  Peptide Sequence Number=SeqID_182913
atgcctcaatggcatttgcgcatgatttcatggaacttagcttgtggaacgaattgtgcacatatggctgccattgtgagggaaatggctccgaaaaagctcccagccaagagatccaggaaggatgttgctagaaagggttctagtgcggccccacaggcagatgtggactttgatagacacaggttctggagtgaggaacaccagcaacgatttgaggccattaaaggtgtaaaagcaagcttcatgatgatgaatcaagttgattcaagtagttttgatgataacaaagatgatgacaaaaagcccaaagaatga

SEQ ID NO: 91229 - DNA, 345 bp, Glycine max
  Peptide Sequence Number=SeqID_182914
atgattatgaggggccaagacatttatagtagccaagatgaggctactacttcaccttcctctagtgaaagtgaagaagcaaaaggggaaaaatctagtgaagaaatctacccccaagaagaaggacaaccattaatggttaaagagaaatgtaaggagagacttgctagcattgccacacctcttgggcttgaggttattcctcaagtaaagaagttgttggatgagggtttggttcgtgttgacgaaagaagcccagagtatgaagaacctaaggattttaggtcaaattctttcctaggtggatggaatgatgcaatcctaacccgcaagggcattggatag

SEQ ID NO: 91230 - DNA, 354 bp, Glycine max
  Peptide Sequence Number=SeqID_182915
atggaggccatgaaaagagcaaatggccacaatgatggaggccatgatgaacatgaaaaagataatggaagccatgcggttatagttgccgctaccagcactgttgctaaggtgaacccaatgcccccatctggctttaaccaaatgaatcatccaacctcagatatggcacatgaaattccccaccacaatctagccgacttcgagccttgcctcagatatgccactgaagggcaagcagttggtggtatacccatgccaaacactttggagggccctcagtttcgcccacaaccacaacccttgcattttgcggtgggaagagcccctcctgctatggctgaaaagggaaag

SEQ ID NO: 91231 - DNA, 294 bp, Glycine max
  Peptide Sequence Number=SeqID_182916
atgtcaggatttacacgcaattctcctcaaatttcagccagcccgtatcaattagactttgcaccttatgcttcagagccctaccatgctcaatggaacgccccggggcttctccatgacaagcacacgttgcgtttgagtcgtattctcggagaaatggaggttaataaaccttggctagggttatggctaccattgaattatcaagtagatatgggagcaagtcagcatatgacaacggaatttggggtggtcttcgtcattggaagtgcggtagacagactttgtggttga

SEQ ID NO: 91232 - DNA, 460 bp, Glycine max
  Peptide Sequence Number=SeqID_182917
gtcgactctagaggatcccacaaggagcgcctggaccaactccggattccagatgtctgttggatcccatatggggagcaccgaccgggtcgtgcggcaatttggatacacccagaccattcctgctccgcctgttgattcatgggtgtcgtatgatgatatacacgacaggtggatgcactactcggattatatggttctagcaggtcacgcatcagatcctctgccagatggtcatgctccgcagccccgagtcatccctcaggccccacagacagatatccctcacgtgctggagccaggagcaccgtcgacatctacgaggcccgctgtagaggagcctagacatgtagtggaagtttgccatgggattgctaagaggttgcagcgacatctgagcctaggggtggtcacgccaggctcatcgacacatgaggtgatcgaagaatgcctcaggatg

SEQ ID NO: 91233 - DNA, 126 bp, Glycine max
  Peptide Sequence Number=SeqID_182918
atgcctttttcaagagatttactctttggtaatggattaccagaggatgtaatcgattaccagtggccaaatgactatacagctttagaaatgatcaatttacattgtgtatcgatacacatggat

SEQ ID NO: 91234 - DNA, 492 bp, Glycine max
  Peptide Sequence Number=SeqID_182919
atggagacactttggaagtggttgaaagcccatgtgcaaggtttggattggctcccgagtttgagaaccgctaaaggggaggaagttgaggcaccggaggaagacaaagaggtgcagaccccagggcagaactcgagcaagctcaaacagtcaaagaaagctaccaccaaggccttggagcaagagacaaaaagggctcgtagggaagagcacggccggaacaagttccgaggggctctgtggggcagcaacaacgagcttaagctccagagggaggaaagggaccaatcctgggtagacagtttgatcttgaaggataagttgaaggcttgctcgaggtccaagagaaacttgtctcagcggttatgcgagacagagaccaacatgctagccatcatcagcaagtaccaagaagaactaaatctagccacggctcacgagcacaaagtggcggacgagtatgcccaagtgtacgctgaaaaggaggcttga

SEQ ID NO: 91235 - DNA, 624 bp, Glycine max
  Peptide Sequence Number=SeqID_182920
atggcatggggtgcagtgcaaagtaaagataaggagcttaggggaagcagcaacgggatcgtcggcggctatcataagtggctgagagtccgaacgcaagagttggattggctcccaaagctaaaagctgcaagagaggaagaggctgaaacttcgaaggagagtgaggaagtgcaaaccctaaatgcggaacttgaaagagcccaagtagtaaaagagaagttcaagtcaacagccatcaaagttcgaaaagagtacaatgaactaagggacatcaatatgaccacaaccgaagccttggaacgagaaaccaagagatacaaggaaaagctaagcctagcagcgactcatgagcaaaggctagaggacgagtacgccaaggtatcagtcctgcaagcggagagggaagcaagggaaagggtgatcgattcattgcacagagaagcaatgatgtggatggacaggttcacctttactttgaatgggagtcaagagcttccccgactgctagccgaggtcaaggcaatggcggatgtgtactcagctcccgaggaggttcacgggctcctcgattattaccaacacatgattgatctgatggcccacataattaggagccgctaa

SEQ ID NO: 91236 - DNA, 212 bp, Glycine max
  Peptide Sequence Number=SeqID_182921
ggatcgcgcccgcaagacacccagtggacccgaagaagttcaacaaggtcttgtggtttccagctctgattacgggcctctgtcagttctatggagtgcccatcgcccctaacaaggtcatcaggcccttattaaccggactttcatcgagaagtactgcgcccccaggcaggcgcaggacgaggcaccatagtagtgggcaacaggcgtaa

SEQ ID NO: 91237 - DNA, 720 bp, Glycine max
  Peptide Sequence Number=SeqID_182922
atggcgttaagcgagtatgtcagcgcgtttttaccctatgccatgacaatgttgaatacggagaacaaggccagagaggagatggcgctgatccgcggggcgggcaaggggattttgagaatcggctgcgtatccagtctgttaaccagccattttattgataaattagccgcctttcataaacgccatccccggatacacatcaaaatattcgaccgcattgactcagagttgtttaagttgctgctgatgcatgaaattgatatcgccctctgcgggcctttaccgcacgacgataaaatcgtagttcgtggaaaaattaactggcaggatcgtatttgtatcatttcaaggccaggccatccgctacaaaaagaaaaacgtctgtcgcttgcggcgatgctcgactatccgtggatcatgccgccgccattaagcacgccgatgcttatccttgaagatatttttcgctcgcatcagttaccctgtccggttcctattatcgagtgcgcttcatccgcggcgataaaatcctttatcgctgagagcgatcttttaacgtcaatgcctgcccccgtctatcgactggaagagaagcttggattgttgcgcccgctggaggcggagggcagcgtgtttgtccgagatttctatgcctggagccattttggcgtgttatccggagccgcgctgcagttaatccagcatctgaagcagtga

SEQ ID NO: 91238 - DNA, 673 bp, Glycine max
  Peptide Sequence Number=SeqID_182923
atggcagaagtctccacagaggccattgcctccctcacccagtattatgaccagcctttgagtaccgagaaaatgtttggaggcaaagcaagactcttggcaggtagaggcgaatgggcctcgttcatagacatccttgcacttttgagcttcagaggagtcctctttccaaatgtggatggattggtggacctagcagcgatcgatgcttttctcgcctttcatgatcgcaaggaaagcttggttgtcgctatcctagccgatctatatgacaccttcgaccgaagatgtgaaaagagcagtacaaggattgtttgttgtactccggccctctatgtatggttggtttcgcaccttttccgccaagaggtgaggcatgcttgcccgctagaaagccaccgttcatgcacagagaaaagagaggcaagatttccaaatgttcccttgatggggacaaggggttgcatcagttacaattctgttcttgctataagacaacttggctaccctatgagaggggcaccactagaggaagagctcgcacctattattgcacgaggtttcaataggaccaacgtggaggcgcttcagaaggtctgcaaggcatgggagatggtgcaaaaaaaggataaggaactcagaggtagtaacaacgggcccatcgtcggctacc

SEQ ID NO: 91239 - DNA, 66 bp, Glycine max
  Peptide Sequence Number=SeqID_182924
atggactgccccccgtataaaggagctggaagctggaatggaaatggagcaggaagtggtatctga

SEQ ID NO: 91240 - DNA, 303 bp, Glycine max
  Peptide Sequence Number=SeqID_182925
atgaataagtatttacctcatgcatacattttaaaatgcactaaaagcaacaagattaaatggcctaactctcaaaaaagcatttccccagtggagttgccaactgtcgcaacctaccgttcggcgggagggcgacgcgtgactcgcgggatgcgtgttccacgaaaggaatacgcgcggagttgccaccaacgtttatttgaggaaaacgtcggaaaaaccaaaaaagacgcgatctacgaacttttaagtgaaaggttcaagagttgtatttacgcacggggaaggttaagcgagaaatga

SEQ ID NO: 91241 - DNA, 273 bp, Glycine max
  Peptide Sequence Number=SeqID_182926
atgggtgaagtagaggaggcgcaagagcagatgaaggccgacatggaggccatgaaagagcaaatgactacaatgattgaggccatgatgagcataaaggagataatagaggtaaaatccctccaattatggaagaaatgggagaagttggatcatctagaggaaaggctcagggtcgttgaaggaggcagagattatgcctttactgacatagaagagttgttcctagtatccaaacatggttattcccaagttcaaggtgccggactttga

SEQ ID NO: 91242 - DNA, 534 bp, Glycine max
  Peptide Sequence Number=SeqID_182927
atggcatctagcagaggtgggaatggaagacgaataggaggttgctacaagttagaactactagaagaaggtgctgctactggtggaggcacttcaattttcttgccagaccacaagccatctgccccatctgatttgtcagactctgaatggaggctcttgtctcttgttgaaattgcatatcctggatggtcatttgcctcactaactcctctaaggaaggttgagaaggggtctcaattgcttgttgtctttgttgttgttgctgctactgcattggaggaggaacatatggcttgcttggaccagcagcattctggaaaggaggggcaggctgttgttgttgtagaggacttgcccatctcagatttggatgattcatccaacttggattgtatctactgcttgaaagatcataattattctattgttgattgctgcaaagaaggacaaagatctgtatggttatctgttgaagaacatagaccacagattcttgcaacaggtgcagatttcttattcatggcaagctaa

SEQ ID NO: 91243 - DNA, 975 bp, Glycine max
  Peptide Sequence Number=SeqID_182928
atggagggtacatcccttgtggatctttgcttgaaatggctccgaagaaactctccacgaagaggtctagaaaggacgccactggagaaggctccaatgccgcctcagagttatagtcaccgtttccggagtgtcgagcacctgcagcgcttcgaggccatcaagggatggtcattccacaaggagaggcatgtccagcttagggaagacgagtaccatgacttccagggagagatagcttgcaggcattgggcacgactagtgacccctatggctaaattcgactcggagatagtcatagaatttaatgccaatgcctggcccactaaggagggggttcgggacatgcgctcatgggtgaggggtcactgggtccccttggatgcaaaggccatcaaccagttcttgggcgacccgctgattttggaggaagaccaacagtgtgaggaagccatcgcccagctgctgtgccaggatttcgcctggaccgctacagggaggcaggtgcggatcatgtgcaccaacatgactaccttgacccagatatggatgacactactgctcagcaatgtcttgcctagcgaccacaactctgacctccctctgcctaagtgccagttggtgtatgtcatcctgacattgatgagcgttcacgtggcccaggtgattgctgatgtcatttatttgtttgtaggaatggcgcctactaggcaccctctggacccagagaagtccaacagggccctggagtttttgactctgatcacgggcctctgccagtccgaaggagttcctgtcacccccagcaaggtaatccgactgccgatcacccgagccttcatcgagaagtactgcaagcctaggcaggcgcagggtgacacacatcaggacgcgggcgcaccactgccacctcggctagccgattcggctgggccattgggcgtggagcggtatctacagcatttggttcgctag

SEQ ID NO: 91244 - DNA, 935 bp, Glycine max
  Peptide Sequence Number=SeqID_182929
tttcgcacctttttcgccaagaggtgaggcatgcttgcccgttagaaagctaccgttcatgcacagagaaaggaggggcgaattgggaccaactcttagcaagcaaagaaggagcatccgtcaactggttccctcgatggaaggaaggaagaactggagttctgatttcgtgtggaggatttccaaatgttcccttgatggggacgaggggttgcatcagctacaatctcgttcttgctacaagacaacttggctacccgatgagaggggcaccactagaggaagagctcgcacctgtcatttcacgaggtttcaataagaccaacatggagacacttcagaaggtctgcaaggcatgggaggtggtacaaaagaaggacaaagagctcagaggcagtaacaatgggcccattggaggtgccctcccaagtctgagaaccgctaaaagggaggaagttgaggcagcggaggaagacgaagaggtgcaggctcttaggacagaactcgagcaagctcaaacagtcaaagaaaggttcaaatcagtggctcttaggatccgaaaagagaaggtcgaactgagggatgtaaatgtagctaccaccaaggccttggaacaagagaccaagagggctcgtagggaagagcacggccggaacaagttccgaggggctctatggggtagtaacaatgagcttaaactccggagggaggaaagggaccaatcgcgggtagacagtttgatcttgaaggatgagttgaaggcttgctcgaggtccaagagaagtttgtctcagcgtttatgcgagacggagaccaacatgttagccatcatcagcaagtaccaagaggaactaagtctagccacggcccacgagcatagggtggcagacgagtatgcccaagtgtaccggaaaaggaggctagaggaagggtga

SEQ ID NO: 91245 - DNA, 411 bp, Glycine max
  Peptide Sequence Number=SeqID_182930
atgcagtcccgtggaggtatgcacctccaagcgaaaggaaggaagaggccaccgacatcagctcgttgtcagccaagtcgtgtgtttgcaccccctgacttgccgacacaacccgcaaatgttaaagggaaggcaaagatggtggaagaacaaaatgacaaaacgaccctcacttcgaacgaggatattccagtgaaaggtctttcggagaaatgggatggctgtggcaagaatgaagcatcactagaggaggcaggcgagttcctccgcattattcagcaaagcgagttcaaggtcattgagcaggtcaacaaaaccccgaccaaggtctctcttttggaactagtcatgagttctgagcctcatcgggctttgctagtgaaggtcttgaacgaaactcatgtcgcctaa

SEQ ID NO: 91246 - DNA, 201 bp, Glycine max
  Peptide Sequence Number=SeqID_182931
atgatgacaaaggtggtgaacaaaaaagctcaaaaatcaaagaacatctcaagtgaatcaagaacaagtcaagagttcaagaatcaaggacaatttaagactcaagaagaaagcctagaatcaagaatcaagattcaagatctcaaaaatcaagatcaagattcaagaatgaagaaaagagtcaatcaagataagtattaa

SEQ ID NO: 91247 - DNA, 1387 bp, Glycine max
  Peptide Sequence Number=SeqID_182932
atgcgtctggactggcgccgggcttacggcggcacccagttcgccgataatccgcacggcatcggcgccactccagaaacatttccgcagggccgcatccatcgcctacccaatattgaaccgctgcaggggcgcctcgcgtctcctcggcaaagcgcgcaaccggcaagctttgacgcgttggatatcacctggccgcgccgcttctcccgcatcggtaaaaactacgacgccgactggttgaaaaacggctttcccggcttcgccaacgatatcgactggcgcctgttcaacatggcggaaggcgatcagcagtttcctcaacgcgacagcttgccgccccgcgccgcctatcgaatttggaacatgcacccttcagaaccggtgcagcaaggtcatttgccaccgtggcgcacacgctgtttcatcaaccggctgcgcggcgacgaaacgcatttcgaagaaatcgcgatgcgccacaccaccgtctggttcttcccccatcgggaacagatgctgctgatttatcagggcagtacacgcatcaatgaagacgatgccgccgacgtaatgcagctgatgccggctttggaaatcgaaggcgagccccgctccaccgcgcattatcggcaggtgttgacccagcggctggataaggaacggggggctctgcacgcgtttcgtgagcaagagttgttgccggaagcgtgcatcggcgcctggctggatacggaaacgccgacgcagcaaagcccgatggcggaaaatatcgccgcctacgagcaccggcagcgcgaagagcaccgccagcgcctgctgcgtgaaggccaggacatcgatgaactgttcccgctgccgtcgcaagacgcgccgccgaagctggacgagcttgccgaattcgtcgagcgtctggaaagccaggccgaggcgcagtatcaggacatgctcaagctggcgcaagccgagggtatcgatccgcgcaatcccggtggggatcacgtgccgccatccggtgcggaaagctaccagcagcagcgcgatctgctgttccaggaggcgcgccggcatcccgacgcgttcagcgaaaaacagctgggggaaagcgagcgagcgctgcaccaaatgtatttaatgtcggcacaggcgcaaagccctgcgctgcgtttaagcggcgatctggcgcaaatcattcgccaacgcgtcaccgccgccatgctgcgcgataaggatctcagcggtcttgatctcaccggcgccgatctgtccggcatggatctctgccaggctaacttgcgcggcgctttgctggaaaacgccaatctgcgccaaacccgactggtgggctgcgaccttcgcgaggcgatgctggcgcgcgccgatctcagcg

SEQ ID NO: 91248 - DNA, 225 bp, Glycine max
  Peptide Sequence Number=SeqID_182933
atgtcgtccaaaaaagtccaagccggcgtttgccaaaatattgccccaactgacatccgatcaaaaatagtctcgattgatgttgtcgcaacctacccttcggcgggagggcgacgcgtgactcgcgggatgcgtgttccacgaaaggaatacgcgtggagtcgccaccaacgtttatttgaggaaaacgtcggaaaaaccggaaaagacgcgatctacctttaa

SEQ ID NO: 91249 - DNA, 582 bp, Glycine max
  Peptide Sequence Number=SeqID_182934
gattgtcatcatcaaaaagggggagattgtggaaataatgacctccaagattattttgatgatgctaaagaatcaagagttaagcaagttccaaagaatcaggcttcaagaatcaagtctcaaagaatcaagattcaagaacaattaagtttcaagattcaagattcaagaacaatcaagatcaagattcaaggttcaagagaagctgatttaaagattcaagagaagaaatcaagaaacaacagtcaagacttcacaagggaagtatttttcaaaaatccaaacatagcacaatcttgttttacaaaagagttttctcaaaaattttctaagttacctgagtatttactctctgggtacatcctttgtggcacaagtagagggtacatctacttgggttgttatactgagaacaagagagggtacatctcttgtggatcagttcaagtggagggtacatccacttggttgttcaaagagaacaagggagggtacatcccttgtggatctttgcattgtaaaggattttacaaggttgaaagaaatctcaagaatcgttggttgcttggggactggacgtag

SEQ ID NO: 91250 - DNA, 798 bp, Glycine max
  Peptide Sequence Number=SeqID_182935
agttcgaattcaaccaagaagagagccccatcggagagcaacataagcttcctgaactcttcgattactgacatggactcaatggcggatttggggccggaggagaaaggaaagagggaggtggaggaggacgatgatgactcatccgagttacacgacttagtggctcacttgggtgaggaagggacaagggagagaagcaaggtgcaaaccttagtgagcttgatgcggaagaggaagacgcgacggaggaagaaggtttcagtgggaactgttgtttggtggaacagacctgcccgcaatgatgaagtgtttctcggtgtccttagcctctttatgggttttccttgctctcttttctctgaggaatggagccaccctgttcactgggaatttgatcaagcaaggaccaatccacatgtgccacgtgctcaacaagtgctgaaggttggagcccaagaacgaagggagcttgtgtttgtgcaagtgcaattagctcagtatgttccagcactggaaagactggctaccatgaggttgctgcagcaggtgtctaatgtgtaccaatctatgaagattgaaaccttatcggggatgatccccttctttgatttctctcaagtggaaaagagtcttgagtctgatggcttaagggatcacttggccaattttgctgaagaattaaataaagcaagacagatgatttatcctcctgataagagatcatcaaaacttggagctttacttccctctttgtcagaggttgtggccaaagaacacaagaggcttcttgcttga

SEQ ID NO: 91251 - DNA, 219 bp, Glycine max
  Peptide Sequence Number=SeqID_182936
atgactcctaggtcgacaactatgctcttcaaactattggagattctctgtaacttcaatccaagcaagttgacgttgtccaatagatcaaagatttctataagatctccagaatcaagagacaaggagattcatggatgcgaaaaaatccaaaaagaaacacaaacaagatacatagagagtgtgagtggagatgaagagggcaagagagttgcttga

SEQ ID NO: 91252 - DNA, 168 bp, Glycine max
  Peptide Sequence Number=SeqID_182937
atggttaatctggcagcaaagttcaattccatgggaatgcaagaaactcacaattcaagagacaaacaacctcttgatctcaataagtctttaaagaaagtacaaatgtttttctttcttttagagaaaaagatagaagatggagttcttagaagaatccttaattga

SEQ ID NO: 91253 - DNA, 654 bp, Glycine max
  Peptide Sequence Number=SeqID_182938
gaagtccgagctctaaagttaaagctagggaaggcgagactcgccaaggagaagttcaagtcagctgctacacacattcagaaggagtgcaccgagttacaagaggaaaacgcggccactgcaagagctcttgaacaagaaaccaaaagggctcgcaaggaggaacatggccgagagaaattccgaggagcattgtggggtagcaacaatgagctcaagctccgaagagaggagagggatcagtcacgggtacatggcatgatcttaaaagaagagttagttgcttgcgcgaggtccaaaaggagtttggctcaacacttggaagccacggagcaaagcatggctatcatagggcaatacaaggaagaattgaaccagtccatggcccatgaacaaaagctagtggaggattttgcacaagtgtatgccgaaaaagaagcaagagggagggtgattgatgcgctgcatcaagaagcgactatgtggatggatagattcgctttgaccttgaatgggagtcaagacctcccgcgtctgaatttcatcataactaagtgtcgcaacctacccttcggcgggagggcgacgcgagactcgcgggatgcgtgttccatgaaaggaatacgcgcggagtcgccaccaacgtttatttga

SEQ ID NO: 91254 - DNA, 294 bp, Glycine max
  Peptide Sequence Number=SeqID_182939
atgataggaagagccgacatcgaaggatcaaaaagcaacgtcgctatgaacgcttggctgccacaagccagttatccctgtgcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 91255 - DNA, 379 bp, Glycine max
  Peptide Sequence Number=SeqID_182940
atggtgaaagttggaacctcttacgtgccgatcaacgtctcattttcgccaaaagttggcccagggcttcccggtatcaacagggacaccaggatttatttattctgcgaagtgatcttcctggtcacagggggggcgtaccagtctttttcagcttccctccgttcagctactgacggggtgggtcacgacgttgtaaaacgacggccagtgaattgtaatactggactcactatagggcgaattggagctccaccgcggtggcggccctcagaactaaaaggtggccccggtgcgcaggaatatgatacaggatatattccgcttcctcgctcacctgatcgctacgctcggtcaagagttcgaccagccggaacat

SEQ ID NO: 91256 - DNA, 405 bp, Glycine max
  Peptide Sequence Number=SeqID_182941
atggggggtcattgttcagactcagtgaaaggtgacaaggtgtttgctaaatcagatggacattctaataaccataaatctaatggtaagaaccacaactccaccaatatgcctagtgatttgacaagtgcaagggatcatggactggacaacaaaaaacaagaagttgttgttgctgtagggaatggttctgataatttctatgatggacttgggtgctgtcatgttcagggttattacaaattaaactcaaacagattaaccactagtccactagatacacaaaaagaccattcttgcatctttacagcctgctccattattattagaacatttatctatttcagccacataaacatcactattaagagaaacaatataagcaacgaaaagaatgaagcctag

SEQ ID NO: 91257 - DNA, 79 bp, Glycine max
  Peptide Sequence Number=SeqID_182942
atggatgcaaaggctaataacattctaatggcttctaatctagcaactggagcattcgttgttcttcggtcttcaaccg

SEQ ID NO: 91258 - DNA, 384 bp, Glycine max
  Peptide Sequence Number=SeqID_182943
atggagaaagctatctctagaatatgtacattggatttaatgatgaaatatgtgcaatttcaggctaagcgcgcatccatcgctaagcacagttttagcgcgcttagcgtgaaagaagaatctggcagggcatcagcatcaaggccgtgcgctaagcgcgtgatcagtgtgctaagtgcagcaggtgtcttctgtagaagcaaagcttccaagcttattttgatgatgccaaagactcaagtcaagaatcaagattcaagtaagtttcaagaatcaaagatacattcaaaaagattaaagaaatcaagaagattcaagagaagactcaagatatgcaagaacctcaagataagtataaaaagaatttttcaaagaaaagattga

SEQ ID NO: 91259 - DNA, 745 bp, Glycine max
  Peptide Sequence Number=SeqID_182944
agggttgcacgccctcacctttagaggactacacgtcctcgccttcagagggttgcacgccctcaccttcagaggactacatgtcctcgccatcagaggattacgagtcctcgccttcagaggactacatgtgctcgccttcagagggtcatgtaccttcaccttcagaggactacacgccctcaccttcagaggactacacgtcctcaccttcagaggactacacgtcctcgccatcagagggctacacgccctcaccttcagaggactacacgtcctcgcctttagagggtcatgtaccttcacctttagaggactacacgccctcgccttcaaagggctgcacgccctcatcttcagcggactacctgtcctctccttcaaagggctacacgccctcatcttcaaagggctacacgccctcaccttcagaggactacacgccctcaccgttagaggactagacgttctcgccttgagaggactacacatcctcgccttcggagggctgcacgccctcgtcttcagaggactatatgtcctccctttgagaggactacacgtccttgtcttcggagggctacacgccctcgccttcagaggactacacgtcccccttttcagaaggctacacgctctcgcctttagagggcgacacgtcctggccttcggagggttgcgctctccctcgccttttgggggctatgcgtcctcacttttagtgggctccatatccacaccttaa

SEQ ID NO: 91260 - DNA, 863 bp, Glycine max
  Peptide Sequence Number=SeqID_182945
ggcgtgcgtgacatgagatcctgggttaggggtcagtggatcccgttcgatgccgactctatcagccagctcctgggatatccgatggtgttggaagagggccaggaatgcgagtatggccagaggaggaaccggtctgatgggttcgatgaggaggccatcgcccagctgttatgtataccggggcaggattttgcccggactgctgcagggaggcgagtgcgaatcatgcgcaccaatatgaccaccctgacccagatatggatgacgttgctcctcaacaacatcctgcccaccgatcataattccgacctccccatgcctaagtgtcagctggtgtacgccatcctgacacggatgagcatccatgtggctcagttgatcgctgatgccatatatatttttgcaggtatggcgcccactaggcaccctttggacccagataagtccaacagggccctgggattccccgcactgatcacaggactctgccagtcgttcggagtccccgttgcacctacccaaggcgcgcccccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagacac

SEQ ID NO: 91261 - DNA, 264 bp, Glycine max
  Peptide Sequence Number=SeqID_182946
atggatcattttaaggtccaacgccttaaaaggaccaccgtccaagtgctaataccttcctcaaacgtaaatacaactcccgaatctggaatattcttcatgaccggtttccttcagtttttccaacgttttccacaaataaacgttggtggcgactccgcgcattttcctcctttggaagacgcacctgtgagcctcgcctcgctcacccgcaaaagggtaggttgcgacagttggcgactccactggggactgtttttgtga

SEQ ID NO: 91262 - DNA, 168 bp, Glycine max
  Peptide Sequence Number=SeqID_182947
atgccgatctccccttgcggaagtatcagttgggatcacgcccacaagacacacagtggacctggagaagcccaacagggccctggggtttccagctctagttatgagcctctatcagtcctaacgggtgcccgtcccccccagcaaggtcacgccatcgtgacatag

SEQ ID NO: 91263 - DNA, 558 bp, Glycine max
  Peptide Sequence Number=SeqID_182948
atggaggaggaagttaatgagaaatctagtcgactagtggcattgggaaaagtgtatgagaattcttccaccatacacaatgtcccttatgcagatgatgtggttaggtattcacaaaagcatttggcgaaaccaattggatctgctgaaatggacaatatagtggttgtagttgatccgtcgggagaattggttaagaacttgtttggtgtttaccaaaagccaattaagttgtcatgggatggggtgaaatttgggataccgaatgtcaaagatgggtttttcatcacacacgtagatgtaactgagataattttaggatacaaatgtttgaacatatccatactatatttggggatgatccgaattgagctgtttggcaccaattgtggcgcaagacaaaagattattcgacgtttcggtaaggaatgtggaaaatacccaaatgggagggcaaaaagctcacctgggcgcttgagcgagcaaggttacttcaggttgaagcaacaacttgcttgggtgagctacagatcaaccaagtcccctcatttcctataa

SEQ ID NO: 91264 - DNA, 111 bp, Glycine max
  Peptide Sequence Number=SeqID_182949
atgacttcttctggtactggctcaccatcaatagcaaatgtggttaaggtggatgtactaaagaaggtgaaggttgagtggttggccaaggttgaggttgtggatgtttga

SEQ ID NO: 91265 - DNA, 165 bp, Glycine max
  Peptide Sequence Number=SeqID_182950
atggatgtgggtctcccatacattcaaatgaatgggatcttaaggttcaatacttctatcagaattaggggaaagagttgcttgttgatgtttagcaggctcacaagtttgttcattacgatctccaatcacaaaggtggtagtggctggtggtggatgatgtga

SEQ ID NO: 91266 - DNA, 2553 bp, Glycine max
  Peptide Sequence Number=SeqID_182951
atgacaggacctgctgttaatcatagtggcagaatggatctacagaaaactgaagctctgggtgcaaattatgcgggtgggaacagccatctgattgctttgattcctggtgcagaggaatatgagtctttcaatgaagcaaaccagtcaataatggattacccaagtcatgaagttgatcttgacaaggaggatctggatattccatggagtgaacttattttgaaggagaacattgggacagggtcatttggaaccgtccttcgtgcggactggcgcggttctgtgtgtttaggtgtgctaactgagccacatgctacaggacagtgtacggggagacggaggaacttggcttgtatggatgcacagcacgaagggcaacgatccaataaccgaggacgtagtgatgaacctgatgaggaggagaagtggacaagggtggtgagtagaaggtccatgaaagcggtgcagaagttctcaccaatgggaggacaactagaggcagggggcagaagtatacagcttagccgaaactggaggcatgaggctaatattacctccttttacttcacacacttccctgttgaagctaatgagaagttgctatggtggcacttcaaaaaatggggcgacgtccgtgaagtatatatcgccaaaagactcaacaaggaaggcaggaggtacgggtttgtgcgcttcaaggatgttaaggatgcaaaaggactggagctaaggctggataacattttcattaacgaacataagctttatgtcaaccttccgaggttcgacaggtcagcccgacaggaagcaccgcaggcaaacaaacttgctagggggaagaagacgatcgaagagagatgtagggatgcaacaaaccacgggcctcctcggaggtcatatgtggacgcagtgactatggggggatgtcaaggccacaagagggtagacgaaactcgatattcacccgtctacatcaacctagaagttacagggcgtgcatggtgtgaaggaacctggacgggtaaacttaagaagatgatggaggtagacgctctggaggatcgccttgcgtgggagcttgggtacagtgtcggttctcagttcctaggagacgatatggtgcttccccccgggttgtccgacgaaaaggctcgggcccttattcagtcggagacggaaagaggtgactccatcttctatgagttgaagaagtggtcgccgttgtccagacccagtaataggatcgtttggctccagttgtggggcttcccggtacaggcatgggagattcaaagcttcaggaaggtggtggctgctattggtgatattatcgagcccgacgatgacacagaggaccgtcgtcgtttcgacagagctcgtttactggtaaggaccccgctgccaccaacgataaggtcagccgtcaatgtccgtgtgggggagctcgagtacaaagtctggattgtggaagaagcaggttccgacggtggtctgaccaagagaagaccctcgccgtcggagggttggtcggagtcaataacgtccgacgacgacggggtgggctgcgatgaaggggatgacgttgacaccaacttttcattctcgccggagttatccaaccggagttcttccccgacgtttagccaacgggtacactgtaggactcatggttgcagcagagatggcgaacctctggttaatacccacactaacgaaaccttccaggataaggcaaatagtttggaggctactatgctggagtccatttccggtaaagtcagcctaggggacagctttgcagcacctcagaagacagcagcttatacgaaaagggatactggccaaaacataccacaggatggttgtaggcacagtcatcacacacaaggtaataatttgaatgttgaaaggaaagatgtagaaggccagacctgcattggggagctacagaaacaaatcatgcaaaccccctcccctattcctctggagcagaatgggcctcaacgtctaaagggcccattagagtcccaaggagggtgcaataaggaatttctctacccagtggagcatatgggtattaatgaaggtcagactcacaaagagggtcggccaagcgaaatcacaggcccattaatgtcagttgaagggtgccacagagaggagcccagctctgaaactcattctttaaaagtgaactcagacaagtttgttaaagtttactcccgacaaaagccaacttcccaatctggggcccggatgtctcaacctgcaatccagcactcttcaatccctctttgtagtctaaatccagcagccactcagcctgaggttcataatcagcctcccgtgaattctggtgggagattaagtagtgttattcaatgcagtgatgagttgaagtcagaggctcaacacctatggaatttgggaaaggaattgggcatggaaacaaaatcagatagttcagagtttcttcagaattatacttctatggagtgcagagacagagatgaagccaaggatttggggaataggagattttctcaatga

SEQ ID NO: 91267 - DNA, 723 bp, Glycine max
  Peptide Sequence Number=SeqID_182952
atgactagaacacgaggtttaggtcgtgctataggtagacttataggcagagatagacatgatgaccatgatgcaattgatgttcttgagaggcgtaggtctactgcctcagcccgtaggcaacaagttcatcagatgactgcggatgcacgtgatatgactgaggatgtccctgatctggctgaggaggcacctgagatgcgtgcggacgtacagggtgttgatggtgttgagggatcagatgctgatgatgttgagggatcccttggtgggccacgtgacccgtcagtgctgacatcatttgcggaccatgttgcacacgttgcttggagtggacaggaacgtcctgatttgaagttggtgtcacatgggaggaaggtgacattgattgggaggccagtgcctgagattgaaggactggttggtgccacaagattaagtccgctggtcgattgctcagttgttactggcaatcttggactgatatccgcatttgtggagaggtggcacaacgagaccagcaccctccaccttccagtaggagagttaacgatcacattggatgatgtgtcgtcactccttcatttgcctatcactggcgcgttgtacagttttcatgctctttctatggacgaggtgagatttttgctgacacagttacttgaggtgtctaccgaggaggctagagccgagacaacactgacacgtggggcatacgtatga

SEQ ID NO: 91268 - DNA, 795 bp, Glycine max
  Peptide Sequence Number=SeqID_182953
atggaaaggatccaaaagtccacttctagtgacaatttccaagggtggtttcatgtaactttactgaattctagagatatcatcctcttaggtgatacatcatggcaatcgggactatcagcggcaatgcatcaccaaaggaggaaaactctagatgaggcttcactgtttcaagcaagtcagagacccagcatgaccacagatcgacctccactccttatggctcacatagacccgggtataaggcctagcatctcaatgtgtgtgcgaggtgtaggcgccatgtacaaacacaacaacatagcaaagcctaactctctaacagtccctagtggagtcgccaactgtcacaacctgcccttcggcgagggtgcgaaaaggccaaaatttgataggccaaagcatttttctccaaaggagaaaacgagcggagtcgccaccaacgtttattccaggaaaacgttagaaaaaatcaaaaagacgcagggtgtttccctcactcctaagtatcctaaggtgttggaccttgaaatgatgtttgaaaagaaaagagaatcgttaaggcattggaccttgaaacaatcttctcaagttagaaaggcggagagaatcgttaaggcattgcaccttgaaggatctttcaagtttgaaaggcggagagaatcgttaaggcgatggaccttgaacgatcttttcaagtttgaaaggcggagagaattgttaaggcgttggaccttgaacgattctctcaactttgaaagggcaaaagagaccgttaaggcgttgaacctttga

SEQ ID NO: 91269 - DNA, 396 bp, Glycine max
  Peptide Sequence Number=SeqID_182954
atgtggtattcttggatgcatttcatgacctcagccaaactggaagctactcatggggagctattgcagtggtccatatattatcatgagaggaaaccacatgcttgccattggaagtctgggaaggcattaccagttttgacgtatcataagcggttggatagattgaggagattgatgatagacggatggacttctttgaatacctttgcattggtgggtcaaatttgtgttgctcctagacagtgtgcagtagactacatggagtggttctacatgatatctcatccctctatgagtctgacacagcctgaggatcctcctagacatccacccgtggttctacatgtatatgttcgatcgagacgaaggcgccagacgcatgaagattgttag

SEQ ID NO: 91270 - DNA, 372 bp, Glycine max
  Peptide Sequence Number=SeqID_182955
atgtcttcagtcatttatgatttcaaaaggactcaacgtcctttatttctatgctttgaaaaaaaaagagagagagaagaacttcaatgtcttcatgtttcctcagtttcacttccttggttttcgccagttgcctggtcgaatagcaaggcccttggctcgcccaagccagcctctggctcacctaggccaccagaaaacttaggggtgaagcgtgagggggcaaaggagaaggggtcagcatcatatattgagaggtttttggtgaaattagtgacaaggagaaacaaaaagacaaaaatgaggctgaggcactttcgaatcgcttccgtgatccattcctacactgttcttcattcatcgaccgattag

SEQ ID NO: 91271 - DNA, 327 bp, Glycine max
  Peptide Sequence Number=SeqID_182956
atgacccctacttgtggaaattgtgcagtgatcaggtcattagacgatgcattccagatcatgagactgactcagtcctgcagttctgtcattcttccgcaccgggaggtcatctgggtgttcaaaggacagctcgcaaagtgcttggctgtggcttttattggcccaccatctttaaagatgagtggaagatctgcagcacttgtgagcaatgtcagagagcaggaagtgcactcttactgtgaatactttgtaaaaggattttacaaagagagtggaaaatctcaagtgggttgcttaaggactggacgtaggcacaggaagtga

SEQ ID NO: 91272 - DNA, 582 bp, Glycine max
  Peptide Sequence Number=SeqID_182957
atggggagaaacatgttacctgagaggaaggtagagttctatcacactgagctagatgactttaaggctgaattggagaggcgtaatttccataaacgcctcacgaatttagtcgatggaagcatagacctggctttggtgaaagagttctatgcaaatttatacagttctaaggagtgtccaccaaagcagtccagagtcagaggtcatttggtgaagattgatgttgacagtctcaacacattcctggagacacctgtggtattagctgagggagagactctacccacatactccagatactacaggttgcctatagacttcagagagatagaggctgccttatgcatacctggccgagggttcatcttgaactctaagggccatcctgggaagattcacaggaaggatttgactacactagctcaggtgtggagtgtcctctcacacttcaacttggcccccatatcacatacctctgatttgacagtggacacagctaggctgatctttggcctagtctctcacctggatatgaacataggagcactaatctttggccagatgacctctatagcctaa

SEQ ID NO: 91273 - DNA, 453 bp, Glycine max
  Peptide Sequence Number=SeqID_182958
atgattggtacctcaaagccttacactggggcaatgaggggcatcgtgcatgagactcaagtggacataggggcagatcaaaaagggctacatgtcctcgccttcaaaggactacacatcctcaccttcagaggactatacatcctcgccttcaaaggactacacatcctcgccttcagagggctgcacgccctcactttcagaggactgcacgtcctcaccttcagagggctacacgccttcaccttcttaggactacacgtcctcacctttagaggactacacgtcctcgccttcagaggactacacgtcctcgccttcagagggctgcatgccctcaccttcaggggactacaggtcctcaccttcagagggctacacgccttcaccttcttaggactacacgtcctcacctttagaggactacacgtcctcgccttcagaggactacac

SEQ ID NO: 91274 - DNA, 111 bp, Glycine max
  Peptide Sequence Number=SeqID_182959
atgactgtgaaaaagaggctaagtcatgaagtgctaaaagtgacagttgagcttagctcatcagttgggctaactgcgcatccaccgctaagcatagcttcagcgcgataa

SEQ ID NO: 91275 - DNA, 285 bp, Glycine max
  Peptide Sequence Number=SeqID_182960
cttgggaggattgatggggacccggtgttgagagaaacgaggatatgggctacgtgggagtacgtgagctcagttggaggtgggcaacaggggatggagaccttggggacgtcaggtggggtgccattgcccaaaaccaagcttgaccaatcccgacccaacccgggcatagtcgctgtgaattttgtgtgtgggttgtggcctctggtaatcgattaccaagggcttgaaaacgaggtcaggaagctagggaagcctctggtaatcgattaccaaggggtgtaa

SEQ ID NO: 91276 - DNA, 2943 bp, Glycine max
  Peptide Sequence Number=SeqID_182961
atggttgccggccatcagggctacgtgctgatccagaccgataactggaacattgataccagcgtcaccggtctggccatcatcctgattctcagcctgctggtgattctgctggtcgagtggattctgcgtcgcctgttccgcaccggcgcccgcacccgcggctggttcaccgggcggaaacgtcgcagcgctcagcgtcacacgcaaagcgcgctgatgaagctggcggaaggtgattaccgtcaggtagaaaagctgctgtcaaagaatgccgatcacgccgatcagccggtggcgaactatctgctggcggcggaagcggcccagcagcgcggcgatgaaatccgtgctaaccagcacctggagcgcgcctctgagctctccgagaacgataccattccggttgagatcacccgcgtgcgactgcagctggcgcgtaacgaagatcacgccgcacgtcacggtatcgatcgcctgctggaagtggcgccgcgccatccggaagtgctgcgtctggccgagcaggcttatatccgcaccggcgcctggggcgcactgctggatatcctgccctcaatgcagaaggcgcagattaacgatgagaaccagcgtaacgcgctgcagcagcaggcatggctgggtctgatgaatcaggccatggccgatcagggcagcgaaggcctgaaaaaatggtggcagaaccagagtcgcaaaacccgccaggagaccgcgctgcaggtggcgatggctgagcatttgatcgagtgcgacgatccggacaccgcgcaaagcatcgtgctggaagggctgaagcgtcagtatgacgatcggctggtgctgctgatgccgcgtatcaaaagcggtgacccgcaggcgctggagaaagcgctgcgtcagcagatcaagcagcacggcgccacgccgctgttgcacagcacgctcggccagctgctgatgcgccacggtgaatggcagcaggccgcagaagccttccagcaggcgctggcacagcgtccggatggctttgactacgcctggctggcggacgtttacgatcgcctgcatcgcccggaagacgcggctaaaatgcgtcgcgaagggaatacggcatcaatccgtgaacggcagataaaaaaacacctgccagaagcaggtgtaagatcaggggctctgcatcattcccaggtttatgttgccttggcaaacataagaggtggaatgagcatctacgcagagattattgcacaaagcgtgccagaatggcatgaatcacgggaacggttacgatgtcgcgaaaacgcgacagaccggtttgaagctgtctccgctgagcgacaggctgtgcaaggaaagggacttgaaccctcacgaagtggggtggctaatgggactcgaacccacgacaactggaatcacaatccagggctctaccaactgagctatagccaccattactacttcttactcacgcgggcagcgctctatccagctgagctacgggcgcgtagcgccgttgcgggaggggatactacggatttacgccaatcctgtctagtgctttttcgcagaaatgttgcgtttgattacgctttgctcactcccgcgcacaaaagcgcactccgtagccccttttcgccgtttattggcgcgtttctacccgattttcaaccggatgatggaaatgcgcgtatccgggttgattcccatgccgaccagcacgcaaaccagaaaagcgatggtcagatagttcacatacgggaacatgatcgacttaaagctgtggtttttgatcgcttccttatgggcgcggcggaaatagagttggcttatcagcaccacgaaccacggcaccatgcccggcagcacgctcgcgctgtagacataaacgaaaacctgctccggattcgggatgatgtagttcagcgcggagcccaccaacaggcagccgatggtgacggcgatgcagttcaccggcacgccgctggcggaaagcttggtgagcgccgccggcagttggcggttcttggccagggcgtacagcatgcggccgccgctgtacatgccactgttgcaaccggagagcgcggcggtcaacaccacgaagttgatgatgccggcggcggcaacgatgccgatcttggcgaaggtcagcacgaacgggctgccggtggtgccgatgccgttccacgggaagatggtgacaatgacgaagatcgcaccgacatagaagatcaggatgcgccacaggatattgttgatcgcgcgtttcagcgtcacctgcgggttcttggcttccccggcggtgatgcccaccagttcaaccccctgataggacgccaccacgatgcacagcgcaaacaggaagcctttccagccgccggcaaagaaaccgccgtgcgccgtcaaattggcgaaaccgataggttcaccgccgttgccgaagccgaagaagatcacccccagccccaccagaatcatcacgatgatggtggtgaccttgatcatggcgaaccagaactccagctcaccgtacaggcgcaccgccgccaggttggccaacgcgaccatcgccacggcgatcagcgccggcacccactgcggtatttccgggaaccagaactgcacatacaccccgatggcggtgatttcagaaatgccgacggcaatccacataaaccagtagccccaggcggtcaggtaaccgaagtagggattcatgtacttatgcgcgtaaacggcaaacgacccggcgaccggctcgaggaacagcatttcccccatcgaacgcataatgaagaacacgaacagcccggcgatgatgtaagccagcagcaccgacggccccgcccatttcagcgtactggccgagcccataaacaggccgacaccgatggtgccccccagagcgataagctcgatatgccgggcctcaaggccccg

SEQ ID NO: 91277 - DNA, 456 bp, Glycine max
  Peptide Sequence Number=SeqID_182962
atggaactgttgagattaaatcaacacgaagaaaatgataagaaaaagaagagaattactcttaaagcctcattgtcaatccaagaagaaagtgataaggaagattcaattgacttggatgaagaagaagatcttagtctctttgtcaaaagattcaacaaattccttaggatgagaggaactcaaagaagacaaaacttcaaacctaaaagaatgactgaagaatcatcccaaactccaagatgctatgagtgcaatcaactagaacatctgagggttcattgtccaatctttaagaaaagaatggagaagttcgaaaagaagaacattggagaaaagaaggcaaaaaaggcctacatcacatgggatgataacgacttagaatcatctgatgattatgaaaaagaagtgattaatctatgtctaatgggcaaaaactatgaaaacgatgaagag

SEQ ID NO: 91278 - DNA, 367 bp, Glycine max
  Peptide Sequence Number=SeqID_182963
atggcatcgaaggatctggaaaagacaaccttcgtcactatatgggaaactttctgctacaaggtgatgtctttaaggctcaagaatgctagggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcacgagaaaaatgctgcaccg

SEQ ID NO: 91279 - DNA, 312 bp, Glycine max
  Peptide Sequence Number=SeqID_182964
atgacttccggcgcgtctcgagacttacatattgtgcaacaaagggtgccaagtatcttgaaacgaccaatcaaaggttgcatgtcatcaagtaataatccccggatgaaattaggctattctttagaaatccccaacaagggtgtgtggaagcaaagcttacaagcttattttgatgatgccaaagactcaagtcaagaatcaagattcaagcaagtttcaagaaccaaaaagtcattcaatcaagattcaagtgaagattcaagagaagactcaagatatgcaagaacctcaagaaaagcatcaagataa

SEQ ID NO: 91280 - DNA, 180 bp, Glycine max
  Peptide Sequence Number=SeqID_182965
acttatcaaggtaatccttgtggcgtctatcctgacttatcttccttcaccagaagtggcgtctaccctgacttatcttccttcaccggaagtggcgtcatccaaacctccgtagcctgtatcaagcaatccgcttctactcaggttcacatcatctggtatcagagcttcggctcttga

SEQ ID NO: 91281 - DNA, 213 bp, Glycine max
  Peptide Sequence Number=SeqID_182966
atgtatggatttcttgagccacagtctatacagagatctagccaatcgcagtttgaatttggggattatattaagaaatggatgcagaattcacaaagatatgtctacataggagcctccttgaatggtgctttgaagagattgaacgataataaaggaagtaaatccaaggcaactgttaaatggattccagttaaatatttactaatctaa

SEQ ID NO: 91282 - DNA, 540 bp, Glycine max
  Peptide Sequence Number=SeqID_182967
atggaatttggtgatattgttgttcattttaacattcttgatgccatgaaacatccatctgaggatcattctattttttgtgctgagataattgatcagattgttgatgattatatgtttgattttgatcctcttcatgataggaaacatccatttttatctgatttgcatacttgtcatttcttatgcattgactctgaacctgagtttgaatttgatcctgtatctgatttttatgctaagagtgaatttgaatttgagtctgatgttgtacctcttgatgttgattttttagagtcagaatgcacaaaccatgttgcaggaagtacatatacttctaactttctttatgaggtacaagctgaggaaccttcctcttctcctaccctagttcctcccactgttcagccaccacccacaccagagttgaagcctttaccagcaaccctcaaatatgcttacttggagttattattcagtgtatatgcctatatgttcttggtagaagtaggaatagtgggggcaagatacgcgggttag

SEQ ID NO: 91283 - DNA, 783 bp, Glycine max
  Peptide Sequence Number=SeqID_182968
atgggtcaacttcaacggcaagccttccgcaaagcctatggtaagatttgggacctagctagggtagaagtctccatggaaccgattgcatccctttcccagtattatgagcagcccctaaggtgcttcacatttgaggacttccagctagtgccgactgtgaaagagtttaaagaaatccggggatgcccactgggaggaaggaagccatatcttttctctgggttctatccctccacgacaagagttgccaaggaatggggtagtcggagtaccaaggaagtgtttggaggaaagggcaaaggccttggcaaatcaaggaatgggctttcttttattgacatcttggcgcttttgatctttggagttgtcatctttccgaatatggaagggttagtggacctagcagcgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtgtggctgaaggaaggaagaatcaggattctatcttcatgcgaaggatgtccaaatgttcccttgatgggaacaaggggttgtattaattataatcccgtcctcgccataagacagcttggctaccccatgagaggagtgccatcagacgaaagcatcacacctttcatcgcacggggtttcagtgaccacaacgcgagggtactccaaggagttcgcaaggcatgggatgcggcgtga

SEQ ID NO: 91284 - DNA, 518 bp, Glycine max
  Peptide Sequence Number=SeqID_182969
atggccccgaggaagcttgcctcaaagaggtccaggaaggataaagcggccgaaggaaccagttccgctcccgagtatgacagccaccgctttaggagcgctgagcaccagcagcgcttcgaggccatcaaggggtggtcatttcttcgggaacgacgcgtccagctcagggacgatgagtataccgatctccaggaggagatagttcgccggcggtgggcatcattggttacccctatggccaaattcaacccagccgtagtcctcgaattttatgccaatgcttggcctacgaaggagggcgtgcgagatatgagatcctgggtgaggggtcagtggatcccgttcgatgcggatgctatcagccagttcctaggatatcctttagtgctggaagagggccaggagtgcgagtatggccagaggaggaaccggtccgatggttttgatgaggaggccatcgcccagttgctgtgtataccggggcaggattttgcccggactgtgcagggaggcga

SEQ ID NO: 91285 - DNA, 632 bp, Glycine max
  Peptide Sequence Number=SeqID_182970
atgggggcaaatcaaaacagcaaaaggttttatcaagtcaaggttaaaggtctagatgtcactagcctcaaggaattgggacgattgatgggacccctccaaaggcaagccttccgcaaagtttacgggaagattctagatttgaccatagcggaggtatttatggaagctattgtatccctcacccaatactatgaccagtcgttgaggtgtttcacgttaggggactttcaaatggtgccaactattgaagagtttgaagagatattaggatgccctctcgagggggagaaaaccgtatcttttctccggtttcttccttccttgagcaagattgcagctgtgattggagattcagcaaaagagttggatcgcatgaagcaaattcggaacggcgtagtgggcctgcctcagaaatacttggaaggcaaggcaagggatatggcgagccaagagaagtggggcccgtttgcggatattttagctttgctaatttatggggttgtcctctttccgaacgttgacggtttggtagacttagccaccattgatgctttcctcgcatatcaccatagcaaggaaagtccagtggtggctatcttggcagatttgtttgacacctttgaccggag

SEQ ID NO: 91286 - DNA, 316 bp, Glycine max
  Peptide Sequence Number=SeqID_182971
gttgtttgcgcggaagatgacataaatctccgcgtgtcaacgggcttgttggccgcgattgacaaagggtgtctccgtatgccaccagactcttgggtcacggtaacaaaggtggggtggtcgacaaaagcagggcttttgctcccactgcgtggcgagaaagtcgctagcgcacaggattttgtcgacaatcaaagggagaggaccactttaggtcgtgggcaaggattgacattctcaccatgggtcaaggtttatggtaagttgggattttggctcaaggcttgtagaacgactggacatgatatatgtcagg

SEQ ID NO: 91287 - DNA, 231 bp, Glycine max
  Peptide Sequence Number=SeqID_182972
atggcagcagaatggagaaggaagagagagaggagatgccacttcaaggagaagatgagtctagaagaagctcaccaccataggaggccatggataagagcttggaggaagaaagagatgaatgaaaggagggggagagaagagcacgaaattttgtgctctaaaagagctctgaaatctgaacccactaatccaagatcaattccaagattctctactaagtgtgcttag

SEQ ID NO: 91288 - DNA, 131 bp, Glycine max
  Peptide Sequence Number=SeqID_182973
ataatttaatttttgtgaaacttaatgatgatgcacaatctgaggaagaccttgatgatgatggagatggtgatgaaagtgatgatattcatggagatgatcctattagaggatatgacatgcttctttga

SEQ ID NO: 91289 - DNA, 198 bp, Glycine max
  Peptide Sequence Number=SeqID_182974
atggcaagatatgctcctaaggtcagaaggaaaatgtggggtgagtcttttaatgatgtcgatgtggcaatatttggtcagacatatgatgactttctcccgatgaagggaccagtcactagagccatgagcaagaggctgcaagaggattgggctagagctgctgaagaaggccctagggttctcatgaacctcagg

SEQ ID NO: 91290 - DNA, 557 bp, Glycine max
  Peptide Sequence Number=SeqID_182975
tcttgtatacaatgcccttgggggtaggattgcatcaactattcaccacccaatgctgtacatgtgcccgacgagaacgccaaccactcctctcctgttccccttgaaagccaacaaccctgaacccaaagaccatgctctggctgacttcgagccttacctcggatatgtcattgtggggtcagcatttggtggcatgccccagcctaacacctcagaggaaaggctaatggccattgaggggattggagatcatccttttgctgacatggcagaactatgcctagtgcccgacgttgtcatcatatcccaagaaccacctgaagatgtactatcaaaagatagggctcaggtagcacctctaatgatggagagaaggaggataaaaatgatagtggacactttaccagtgttctactatgagaagatggtgggttacatgccttcgagctttacagatctggtatttgtgggtgaaaggattgaagtgggcctaagaaggggcaagttcgattacgttgcttcaacaagtgctggcaataggaggaccgatatag

SEQ ID NO: 91291 - DNA, 688 bp, Glycine max
  Peptide Sequence Number=SeqID_182976
gcggaatttgaaatccctgaagcttctgacaataggacaaagaagaaaattcttcagattgttggcgagaggtggcggcagtttaaatcggacttgactagtaaatgggccctttcagccgaccaagacggtgtggacgacactgtctgtgaaaaatacgacattagcaaggagaaatgggccaagttttgccagagacgcagagacccttcttgggaggatgtgcggaaaaaggcacagaccatccagaagcaaaacactgccccccacaaactggaggaagctgcccagtttggaaccgctgacggcgtcattgaccctccatctcccatcagacgccacgtgaagtggaagatggtctgcatcaagaaaactgggcagatgacgtctgaggcagcaaaggaaatcgctgagaagatcgcgtcacagggatcgttcgtccctcatggacgtcaggatgtcctgactgccgccattgggcgagcagagcaccctagtcatgtctgtggtgttggagctcgtgtcaccatcaagcaatattttggatcggctccacaaacccaaatgcaatcccagatgcaatctcaggggcttgcactgcctccagagcttatggttggtccctcaagtcctcatgtcatcacaaaggagagttatgttgatccctcagggaacgatcctgagacag

SEQ ID NO: 91292 - DNA, 258 bp, Glycine max
  Peptide Sequence Number=SeqID_182977
atgctttgtgtaatcgattacaaggatttgggtacatcctttgtggtacaagtagagggtacatctacttgggttgttgtaactgagaacaagaaagggtacatctcttatggatcagttctagtggagggtacatccactaggttgctcaaagagaacaagggagggtacatcccttgtggatctttgcttgtaaaggcttttacaaggttgaaaagaaatctcaaggaccgcaggtcgcttggggactggatgtag

SEQ ID NO: 91293 - DNA, 387 bp, Glycine max
  Peptide Sequence Number=SeqID_182978
atggcttccaagaagagaaagacttctgcttattcctctacccaagcaagatttgacagatctaggtttcattcccaagaagcttgggagaggtacactgatataattgtgcctaggaaattgcttccagagaggaatgtggaggaactcgagagaaggaaatgggatcaagaattgacaagcttcactaaaggtagtattgatgtagctattgccaaggaattctacgcaaacctctacgacccagaagacaagtcacctaagcaggtgagggtcagaggtcatctgatcaaatttgatgaggatactttgaacacttttctgaagaccccagtggttctggaagaggggaaaatctttgtgcttattctatatttgcactcttga

SEQ ID NO: 91294 - DNA, 273 bp, Glycine max
  Peptide Sequence Number=SeqID_182979
atgacattcagagggccaaggaaggccagaggagtccagccttctcctattggagggggtggggcctccgtaacccaagaacctgagtctgtcgagccagcagaggtgccaactattgaggatgatgagctcattcctcctgatcctgcttcaggcattgctcaggaggaagcacttgcatcagagatgattctagagccatctcctactcctatttttgaggacattttgccatcttcaccagccatggaaccagagcagcccactatctag

SEQ ID NO: 91295 - DNA, 585 bp, Glycine max
  Peptide Sequence Number=SeqID_182980
atgtttctctcattgtggtggtggttcggcggcaagcaacggtggccaccggtggtcgtgtgggtggtggagggagagttgtatggcttggttgggggtttggagagaaaaagagtgaaaatcatgtttttcacgctaaagaatgttggtccttctgctacttgtatcatcacaaaggaaagttgtgtcaatccctcaaggcaggacccaaacacgagtgactcagagaaatgtgggttgtatgtcgatgaaaatcctccccgcctagtttcccttggaagagtttatgaggggtcgaccatcatttacaacatccctttgggcaatgatcaagtcaaggtcgatgttgaggaagttcgaaatgttgatgctcgcattcctatatccactcaagaggttcagttagtggggcaaacacttaataccttccttgcttgggcgacacatcttgtaaagcatttgtcagaatatgataaacagaaaactgaagggccagcaaaacttgtagataggctggatcctgatgtcgatcccctatacctaatgacattgaccatctcgcagctttttctcaagctgttgtag

SEQ ID NO: 91296 - DNA, 237 bp, Glycine max
  Peptide Sequence Number=SeqID_182981
atggatcaccaaaagaggaaaactcaagatgaggcttcactgttatcaagcgagtcagagacccaacatgaccacagatcgacctccactccttatggctcacatagacctggtggagtcgccatcttttgcaacctaccctatgacgggagggcgaggcgaaaagccaaaggtgcgtcttccgagggagaaaacgagcaggagtcgccaccaatgtttattcgaggaaaacgttag

SEQ ID NO: 91297 - DNA, 435 bp, Glycine max
  Peptide Sequence Number=SeqID_182982
tcgcgggtgaccataagatatctccgcatgcaactgagtcgctgtccctggatgacaaaggtgcaaaattcgtctatgcgcgtttaccacccaacttgctgctcttgaatgataaaggtaaaaatgcgagaccaactggttcccgcatgtcatcgggcttgccgcctctggattacaaaaggtgcagaagacgacaaattgtctgtgcggaagatgacgtaaatctccgcgtgtcaacgggcttgttggccgcgattgacaaaggtatgatagaaattgtctgtgcggaagatgacgtaaatctccgcgtgtcaacgggcttgttggccgcgattgacaaaggtatgacagaaattgtctgcgtggaagatgacgtaaatctccgtgtgtcaacgggcttgttggccgcgattgacaaagggtgcagaagacaac

SEQ ID NO: 91298 - DNA, 1040 bp, Glycine max
  Peptide Sequence Number=SeqID_182983
gcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccctgatgaggatgtcccatatgttcttaagactggactgattcatttgcttccaaagtttcatggccttgcaggtgaagacccgcacaaaaatttgaaagaatttcacattgtctgctccaccatgaaatccccagatgtccaagaggatcacatatttctgaaggcttttcctcattctttagtagggagtggcaaaggactggctatattaccttgctccaagtacatggagagaagtatgatagatgctgctagtggtggagcccttggagacatgacccctgctgaagccataaatttaattgcgaagatggcttcaaactcccagcaatttagtgtcagaagtgatgttattgtcattagaggagtgcatgaagtagccacgaattcatcttcatcagctgagactaagaagcttgaaggtaaactagatgccttggttaacctggtaacccaactggccatgaataaaaaatctgcacctgtcgccagactctgtggtttatgctcctctgccgaccaccacacagacctttatctttctgtgcaacaatctaaagcaattgaacagcctgaagcttatgctgcaaacatctacaatagacctcctcaacctcagcagcaaaatcaaccacaacagaacaattatgacctctccagcaacaggtacaaccccaggtggaggaatcatcccaaccttagatggtcgagtccttcacaacagcaacaacaacaatag

SEQ ID NO: 91299 - DNA, 702 bp, Glycine max
  Peptide Sequence Number=SeqID_182984
agggctgcacgtcctcgccatcagaggactacacgtccctcgccttcagatgactacacgtcctcgctttcagaggactgcgcgtcctcgccttcagagaacttcacgtcctcgccttcacaggactgcaggtccctcgccttcagacgactacacgccctcacctttagaggactgcacgtcctcgccatcagagggccgcacgccctcaccatcagaggactacacgtcctcgccatcagagggctgcacgccctcaccttcagaggacttcacgtcctctccatcagaggggtacatgccctcaccttcagaagactacacgtcctcgccatcagagggccgcacgccctcaccttcataggactacacgttctcgccatcagagggttgcacgccctcaccttcataggactacacgtcctcaccatcaaagggctgcacgccgtcaccttcaaaggactacacgtcctcgcctttaaagggctacacgccctcatcttcggagggctacacgccctcgactttagaggacaacacgtcctcgcctttagaggactacacgtcctcgcctttagaggactacacgtcctcgtctttagaggactacatgtccttgccatcaaagggttatacgccctcgccatcagaggactacatgtcctcgccatcatagggtcgcacgccctcacctttagatga

SEQ ID NO: 91300 - DNA, 150 bp, Glycine max
  Peptide Sequence Number=SeqID_182985
atggactcgggaaggttccaagttagtgtactaggtaacagctacccactgggggtgatactgagggccttccgaagtgttttcaaggggtataccaccaactgcttgcccttcagtggcatatccgagccaaggctcgaagtcggctag

SEQ ID NO: 91301 - DNA, 255 bp, Glycine max
  Peptide Sequence Number=SeqID_182986
atgaaggttgaggaggagcctcagttgcttgttgtctttgttgtgactactattgttgctattgctgtattggaggaggaacatatggcttgcttggaccagcaacattctgaaaaggagggacaggctgttgttgttgcagaggacttgtccatcttagatttggatgattcctccaacctggattgtatctattgcttgaaaggtcataattattctgttgttgttggttttgctgctgaggaggtttattaa

SEQ ID NO: 91302 - DNA, 882 bp, Glycine max
  Peptide Sequence Number=SeqID_182987
atgcaagctgtcaacaacaatgaaggtgacatgtttttcctatatggatacggaggtacaggaaaaacatacatatggagaacattagcaagttcactgagggcaaaaaatcaaattgtgattatggttgcttctagcggcatagcttctctgttgttgctaggaggcaagactgtccattccaaatttaagatacctatgccaattttcgaagactcaacaagcaacatacttcaaggaatcaaatcaacatttccagatttatatcaacatcacagtaatcctgaattcttcaaatctagagcaatattagcttccaccaatgaaacagttgaaaaggtcaatgattatatactttccttgattccaggtgaacaaatggaatacttaagctctgattatatagagaagtcagaaaccattgacagttggcatttccaatcaatcacaactgaatttctcaattcactaaacacatctggtctaccaaatcatcgtatcaagctaaaaatcggtagtcctataatgttgctaagaaacttagaccaaacgcaaggactctgtaatggtactagattaatagttactagactagccaaacatgtcattacagctgaaatcatttctagcaaaaatgttggcgataatgtttacatcccaagaatgtcaatgtcaccttcacaatcaccatggcctttcaagcttttaagaagacagtttccaatcatgttatcttatgcaatgacgattaacaagtctcagggccaatcactttctatggttgggctttatttgccaaaaccagtctttagccatgggcaattatacgttgctttatcaagggtcaattcaaggcaaggattaaaagttcttatttcatga

SEQ ID NO: 91303 - DNA, 300 bp, Glycine max
  Peptide Sequence Number=SeqID_182988
atggcattcttaggagagacttcgtcccagacgatcgtgaactcgaggttgacattcatttttccaaatggaaccgtcattcacaacgagtgtggggtttattttcaaagttctagtccagtgcccatgcgagtaccaaacctatacgatttttcaactctcaaaagcagaatacacaacagccttcagctaaacaacaatcaagttgtggatgaaattcattaccggcgaccagtggaagatacaggtggaacatgccacgccaaaacaactttgtgggttacgcgttcaccggaataa

SEQ ID NO: 91304 - DNA, 371 bp, Glycine max
  Peptide Sequence Number=SeqID_182989
atgattgcacattcgattaaaggctgccgtcccttggggcggacgtgtggggtgctaataccttccccatcgcgtcttttccggtttttccgacgttttcctcaaataaacgttggtggcgactccgcgcgtattcctttcgtggaacacgcatcccgcgagtcacgcgtcgccctcccgccgaagggtaggttgcgacattatctgattgtaaccggagaacctatccatgaaggaaaacaaagcgaaattggtcgtattatccttgaggatatcaatgtgcgacagaggaaaattgtcctcgggactggctcgattcaggtcccaataatctacacacattcgcaccttcccatccttcttagggactg

SEQ ID NO: 91305 - DNA, 660 bp, Glycine max
  Peptide Sequence Number=SeqID_182990
atgaggtgcaagcaaatcgcaatgatcatgatgaaggactatgggaaaccaataatcatggcaacaccaccagcatcccctccgcagtccaatcagcagtcagaggcaatagattttagaagccacgcgcgtttgaaaaccttgccctacctcttctctttgtcatcctcctgcctcaaatcgctgttctctttctccttccgcccaaaatctgccggaaaccgctccgtcgacacccacattgtcgttggtcgaacccacagaaccccctacactgccggaaaacccacattgtcctcgctggaacccacagaaccccctacgctgccggaaaacccatattgtcgtcgctcgaaccccacagaacccacattgtcctgggtcgaagaaaaccctagatacagagttgctactagggtgctgaaacagtcgtcggtgctcaaaggtcaaacctttctctgcgaggctccgctgacaaacgtgtgttgctgggttctcttcatcaagagaatcaaccatgatttctgtagatggatccacagggttgttgaaattgcctgcaattgctttaacattttactgtccaacagagggggcttcactattgttgttttaacatattttttgtttcttgagcaagtaatgcttaagtatagataa

SEQ ID NO: 91306 - DNA, 138 bp, Glycine max
  Peptide Sequence Number=SeqID_182991
atgtaccctctcttattctcagttacaacaacccaagtagatgtaccctctacttgtaccacaaaggatgtaccctccaatgcgttaagacaaaggaaagggaagaatcaaaagaattctcagactgtgtctttctga

SEQ ID NO: 91307 - DNA, 332 bp, Glycine max
  Peptide Sequence Number=SeqID_182992
atggctccgaagaaactctccacaaagaggtctagaagagacgccataggagaagggtccagtgccgcccgcgagtttgatagtcatcatttccggagtgccaagcaccagcagcgcttcgaggccatcagaggatggtcgttccacagggagaggcgtgtccagctcagggaggatgagtatacagactttcaggaggagatagctcacagatgttggacaccgctggtgactcccatggccaagtttgaccctgagatagtcctagagttctatgctaatgcttggccacagaagacggagttcaaggacatgcgttcgtgggtgagggg

SEQ ID NO: 91308 - DNA, 60 bp, Glycine max
  Peptide Sequence Number=SeqID_182993
atggctcaaggaaaatttgttccaaatttggggcagttattatcaaggtatgaaagctaa

SEQ ID NO: 91309 - DNA, 536 bp, Glycine max
  Peptide Sequence Number=SeqID_182994
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccggtaactatcgtcttgagtccaacccggaaagacatgcaaaagcaccactggcagcagccactggacaagtttggtgactgcgctcctccaagccagttacctcggttcaaagagttggtagctcagagaaccttcgaaaaaccgccctgcaaggcg

SEQ ID NO: 91310 - DNA, 204 bp, Glycine max
  Peptide Sequence Number=SeqID_182995
cgaatgagactgtttcacagtctcgaccggaagacgctgacacctccaagaagggtgcaggtgacgacgttagtcactacttgctattcagactagcgaatgagactcggccggaagacgctgacatctccgggaagggtgcagcgaatgagaccttttcgcagtctcgaccggaagacgctgacatctccgtgaagggtgcag

SEQ ID NO: 91311 - DNA, 297 bp, Glycine max
  Peptide Sequence Number=SeqID_182996
atgaccgatcgtctcaatgagtcgatctcttgctttctcataagggtgaacccttggaggactacacgtcctcgccatcagagggctacacgccctcgccatcgtaaggctacacaccctcaccttccgaggactacatgtcctcaccttcagagggctaaacgcccccgccttcgtagggctacacgccctcaccttccgaggactacatgtcctcaccttcagaggactacatgtcctcgtcatcagaggactacacgtcctcgccatcagagggctgcacgccctcacctttag

SEQ ID NO: 91312 - DNA, 264 bp, Glycine max
  Peptide Sequence Number=SeqID_182997
atggccaaatatgaacctgagataatcatggagttctatgcaaatgcctggcccaccgaagaaggagtcatggataagcgctcctgggtgtggagacaatggatcccctatgatgaagatgctatcaaccagttcatggggcatccgttggtcctagaggaagggaagcattgtgagtacggcaagagaaaaagccaggtctcaggatttgatgagaaggccataggccaactactatgctcccccggacaggactttgcatga

SEQ ID NO: 91313 - DNA, 216 bp, Glycine max
  Peptide Sequence Number=SeqID_182998
atgggggttcaaatagcaacctggcacactagggccttccaggatgttcctccagaaggcggttgcttctggaggaagcaacctagctcgcctgggcgagctggaaaatccaagccgaggcgcttccgtaatgtttccgtgggtgatttcgcgaagattttcaatcgttcttcgacgttcttcgttccttcttcgtcgttcttcgatcttcaaccg

SEQ ID NO: 91314 - DNA, 310 bp, Glycine max
  Peptide Sequence Number=SeqID_182999
attccgctccaattaaactattcatcttcgtgcggtggtcctacgacaagcaaagacggctcgtggcggtcatcagtggtgagtggtggtggaggaggagcttgggggcattggggagggtttaggggaagaggaggaggaagaaaatggctgtttcacactgctagtttgaagaacttgggggaattagcgagtggtgactacccgacatttggtgcactcatttggcgtagggaactcatagacctcactttgttactcctaacgggctctgagagtatactttttggagttgggagcttggggatcg

SEQ ID NO: 91315 - DNA, 444 bp, Glycine max
  Peptide Sequence Number=SeqID_183000
atggtggaaagggaaaattttgatcatatagaagaaaggccgacaaccattaaaggaggtggagattatgcttttgctgatatggcagagctgtgcccagtgcttgacgtcggtattcctccgaagttcaaggtgccagacttcaataagtacaaggggactacttgccccaagaatcacttgaagatgcagtatcagtataattctgatatggctccggataaaatgcagctacagaacatgtgtaagagggagcatgaatctttcaaagaatatgcccaaaggatcgaagtgggtctgagaagaggcaaatttgaatatcctactttgatgaataggaagcctagggcaaatggagagaataagaaggagggaggaacccatgctatgactgtcattccttcatggccaaatttcccaccagctcaacaataccaatactaa

SEQ ID NO: 91316 - DNA, 240 bp, Glycine max
  Peptide Sequence Number=SeqID_183001
atgtcggagcagcccaaacaaagttctcagggggtctcttcttggggtggtgccgccagcggaattagcggcataggcgtgccgccactaacagaagcgagaaccgcagggggtgccgctattggcagcagcgggacaggggtgagcgagggtaccgccattggtattggcgggacatgcctacatgggcagtcccgccattggagctggcgggataggctttggtttaaaattatataa

SEQ ID NO: 91317 - DNA, 473 bp, Glycine max
  Peptide Sequence Number=SeqID_183002
cccagcttatctcagatgccatttaccagtttgtaggtatcatacctccaagacacccaatggacccaaaaaagtcctacagagcactaggattttcagctttgatcacagtactgcatgccaaggcaagcacagcagccaaggcaagactagcagcagcagctggccgcagacgcaccaccaccacctctacagcagccaccatctctagacatttggctgaccagcaggcggccaaccataggggccaggtgcagttgaatgacagcttctaccaatataccctacaccagcagcgccaggaccctagcccttacccatggcctactctcgagcagttcagggcaaatgttgcatggcttagggacaggcctaattttcaggcgggggcaggtcccatagaggccccaggagatgaagacgaagctgaggaagacggtgacatggaaaatgagatggatttcttcctttga

SEQ ID NO: 91318 - DNA, 303 bp, Glycine max
  Peptide Sequence Number=SeqID_183003
atgtgggccatcattgaccaatacaaggagaagctaaatctagtggcaacccatgaacaaaggcaagaagacgagtatgcaaaggtatcggttctgcaagcagaaagggaagtcagagaaaggttgatcgattcattacacagagaagcaatgatgtggatggataggtttgctttcaccttgaatgggagtcaagagcttccaagactgctagtcaaagctaaggcgatggcggacgtgtactcggtccccgaggaagttcatgggctcctcgattattgtcagcacatgatcgatttgatg

SEQ ID NO: 91319 - DNA, 318 bp, Glycine max
  Peptide Sequence Number=SeqID_183004
atgaccacattcaaggttcccaactgtacactcactatcctaaggaaaaattgccctaaaattagtacacacaaatggaagtttggtaacctattggaggctcccaacacacttccaatgaaaggcctttttgttacaaaacttgaaagcaatgaagtgcttcttagtccaatagctcttaaggtggttggccccttgcttcttgactcaaattcttcaagggatggcaccaatcgtcctttccaattccttatatggcaactcacaaacaaggaaacaaagagacaagcaataaccaaagacaaaaaaatgaattga

SEQ ID NO: 91320 - DNA, 357 bp, Glycine max
  Peptide Sequence Number=SeqID_183005
ggtgttacacctatcgtgagctctccatcagttcctctttgcgtcgctcagaggtctctttcgttcgtgctcgtcaatccaaacgcaaggcttagaagtcaagattaccttagagaagctacaaaaggaaggattgagggagttttctccaccgaatccttgaggaggattctgaggattccgctccgattacaacgttcttcttggtgtgtaggtttggcagcaagcaatggcagctcgtggtggccaccggtggtcgtgagttgtggagaaggaagtgttaggatctcacttagcgagcttgtctcactaagcggaagtctacttttcgcgcttagcgcgagtattcgcacttag

SEQ ID NO: 91321 - DNA, 186 bp, Glycine max
  Peptide Sequence Number=SeqID_183006
atggacctgtcttcaatctttacactcgagcgtcttgatggtacaagttatcctgaatggcaccaaaaaggaaaaaaggtggagtctcccaaggaaaactccaccgctgctactgaaattgttgctaagtcaggaacatttcaaccaatttgtggtttttctgttactactaagggtagtgattga

SEQ ID NO: 91322 - DNA, 210 bp, Glycine max
  Peptide Sequence Number=SeqID_183007
atgggtgccaagtacctcgaagcggtcaagcaaaggttgcatgccatcaaacaatggtcccggatgaaattaggaaaggatattttagatgatgttgcagaatctttagaacgaatgcatattcatggacaagattctaaagggaaagggaaaggaagcaatgaagatcctccaaaagaagccaaatcaaatgatgaacttccaaaataa

SEQ ID NO: 91323 - DNA, 186 bp, Glycine max
  Peptide Sequence Number=SeqID_183008
atgttccttgtattcaacagtgctttgaaagaacttgacgatactccacaacctaactccgaggttggggataggtggattgttgttaaatattttgatgatgttagaccattggaagcagagagattgaaggcgcttcgcatccaatgggcacagtattatctcaaagttagaaatcaaacttag

SEQ ID NO: 91324 - DNA, 93 bp, Glycine max
  Peptide Sequence Number=SeqID_183009
ggatcaagggttcccatagaccctaagagaataaaggttattcctgagtggcctactccaccaagtgttgagggaagaagcccagagttttaa

SEQ ID NO: 91325 - DNA, 219 bp, Glycine max
  Peptide Sequence Number=SeqID_183010
atgacgtggcatgacacgtggacgtgcctcttaaaagatgccacgtcattcgatgacaacaaaacgaaaaggaagagagagaggagacgccacttcaaggagaagatgagtctagaagaagctcaccaccataggagaccatggataagagcttggaggaagaaggagatgaatgaagggagagggagagaagagcacgaaattttgtgctccaaatga

SEQ ID NO: 91326 - DNA, 606 bp, Glycine max
  Peptide Sequence Number=SeqID_183011
atggccccgaggaaacttgcctcaaagagatccagaaaggataaagcggccgaagggaccagttccgctcccgagtatgacagccaccgttttaggagcgcggaacaccagcaacgcttcgaggccatcaaaggatggtcatttctccgggagcgacgcgtccagctcagggacgatgagtataccgatttccaagaggagatagttcgccggcggtgggcatcactggttacccccatggccaaattcgatccagacatagtcctcgaattttatgccaatgcttggcctacagaggagagtgtgcgagatatgagatcctgggtgaggggtcagtggatcccgttcgatgcagatgctatcagccaattcctgggataccctttagtgctggaaaagggccaggagtgcgagtatggccagaggaggaaccggtccgatgggttcgatgaggaggccatcgcccagttgctatgtataccggggcaggatttttgcccagactgctgcagggagacgagtgcgaatcatgcgcaccaacatgaccaccctgacccagatatggatgacattgccactcggcaacatcctgctcagcgatcataa

SEQ ID NO: 91327 - DNA, 249 bp, Glycine max
  misc_feature (86)..(86): n is a, c, g, or t
  Peptide Sequence Number=SeqID_183012
atggtcattctgcgccctttgtcattcaggagtagcgagtcgagtgataaacacgcggagacaaattatggtcattctgcaccttntgtcattcagggacagcgatcgtcttcgatggcacgcagagacaaattatggtcattctacgccttgccacccaggctcgatcgtgtccaagggcacgtagagaaaaattatggtcattctgcgccttgtgtcaaccaaaaggaacaaactcggcagtattag

SEQ ID NO: 91328 - DNA, 660 bp, Glycine max
  Peptide Sequence Number=SeqID_183013
atgaggactaatatgcttgccaatcatggaggctcgacgatgaatgcagtggaagaatgggagtctcgagggctgaagcatataagggatgtgtcgacttccaggtggttcatattggaagcattgcgcgaggccaatgtaattgaccttgacagtgacaaaggagatccgtgcttaatgcatccaggggcgtcgcacgatgtggaaacatgcccggtaactgaggagctactgcagggaatgataaacagggggcaaattgaaattcgtagctcaaagaaaaaggaaggggagacgcctgcacccttcccttacaagagtgataaggcaataccatgtaaatatggtgtacgggggcccgacgaaaggcaggacgtgttcgtcatacgtgttgggaatgacttgccatctgctaagattacaaatatttccggtacgagtggaatgactcatagtggacgtatttttactactcccgaactatcaacaaggtcaaaagacaaggggaaggcgaaggcggatataggcaagagggaaagggcggacccgacggtgaatgacgaggtccttgttggaaaaattgcagaggaaggagatgactttagaatgagggagatatcagctgaggaggtgactaaatttatgagaatcattcaatag

SEQ ID NO: 91329 - DNA, 396 bp, Glycine max
  Peptide Sequence Number=SeqID_183014
atgggcttgaaagtagagtctgtggctataaattcctcagcagatcgcttgaaaaagaagtggttaggagtgattgctgcagcaagttggaggactaaggttatgggccgatctgaatctgtcacaaaggtctatgttagaagaaaagtggtgctggctagtaggggacaggcccaatatcctaagagtccaactgtgaactcagttacgagcttacaatctgtttgcataccttcagatcaagaagaggaactggaaaggcaatatgccctggtaaaagacctggaattgacccatgggggtgctgcttcgaaggtccagcagttcatgaaggacatggacaccagagataacaaaatggcagttgagatgggcattaaaaagcagctgttatga

SEQ ID NO: 91330 - DNA, 414 bp, Glycine max
  Peptide Sequence Number=SeqID_183015
atggaggccatgaaagagcgaatggccataatgatggaggccatgatgagcatgaagaagataatggaggtcaatgcggctatagtagctgctaccagcaccattgctgaggtggacctgaccccccccccatatggtctcaaccaaataaatcatccaacctcagatatggtaggtctggaaggcaaagagttgggaggtacagacgaccctcatttagtgcgaaaaacaagcatgccttcctaccatatggcttgcctcccaactatacgacacccaatgtggtgtacactcccaatgaaaatgtcaataactccactcccatactcattgagagccgacaaccccaaactgatcatgcacatgtctctcaaaccgtgggggagacacatgaaattccccaccacaatctag

SEQ ID NO: 91331 - DNA, 147 bp, Glycine max
  Peptide Sequence Number=SeqID_183016
atgaccacaatgatggaaaccatgatgagtatgagacaattgatggaggtcaacatggctacagtcgttgccgcaagtactaccaccgaggtggacccgactcacccatctggcctcaatcaagtaaatcgtccagtctcagatatg

SEQ ID NO: 91332 - DNA, 411 bp, Glycine max
  Peptide Sequence Number=SeqID_183017
atgtttcttcttcatccgttgctcctctataacaattttttcctcctccttttgttgatgggcaggctttttggtttggacctttcccttctgctccctaaggatccttttaacctttatagcaaggccaaaagtttccaaagccttgtctttattaacaatagccttggccagtttcttctgcctcttttgctgaatgtcatcctagtttacaacactgaagtgttgttatctagtgatgaagctgcccttgttgataatggactgctaggagtcatcatccattcctttgaagacgtggaagacttagtattccaaaagaactttgttgatgaggtcggcatagtagatgtcatccactcctcccaaagtcttcatattcctcaagatgttgatttagattgtgtgtaa

SEQ ID NO: 91333 - DNA, 130 bp, Glycine max
  misc_feature (36)..(36): n is a, c, g, or t
  Peptide Sequence Number=SeqID_183018
atatgatggatcaggagaacaacgtctaggaccttntgcgctttttctgaaagagtgtggaattgttccgcaatacactatgccaagtaaacctagcatgaattgcagaatgacgaaaccaaactcttaa

SEQ ID NO: 91334 - DNA, 368 bp, Glycine max
  Peptide Sequence Number=SeqID_183019
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccagccagttacctcggttcaagagttggtagctcagagaaccttcgaaaaccgccctgcaaggcg

SEQ ID NO: 91335 - DNA, 485 bp, Glycine max
  Peptide Sequence Number=SeqID_183020
ggcacctgataaaatttgatgttgattccctcaacaccttcttggagactccaatggttgtggagcaaggggagagcttgccctcttactccaggtttgctagactgaggcctgatcctcaagagcttgcagcccggctgtgtatcccttggaggggatttgttcttaatgccgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggctttacgaacggggcggagatttcctggaagatgccaggaagaatacttaa

SEQ ID NO: 91336 - DNA, 480 bp, Glycine max
  Peptide Sequence Number=SeqID_183021
atggcttcccgtaagagaaaagcagcagcttcattgtcccaggctaggtatgatagatcaagatttgtatcccaagatgcctgggaccgctatgcagacaatgaccttggccagaagatcctcccagaaattaatgtgaagctgtacattacagaatttgatgaattcaggagagaaattgagaggaggaattggcataaggaactcactaacttctctgaagagagcattgacgtggcattagggaaggaattctatgccaacctttatgaccctaaagataaatcaccaaagcaggtgagggtgcgagggcacctaattaaatttgatgataacgccctcgacacctttttgaagaaaccagtggtcatcaaggaaggggagagcttgccctcttactccagacgggctgcctctgaagattttgaggaagaatcttactactcagggccagacctggagtgtcctatccttttctaa

SEQ ID NO: 91337 - DNA, 147 bp, Glycine max
  Peptide Sequence Number=SeqID_183022
atggccaccatgatggaggccatgttgagcatgaacaaaataatggaaagtaatgcggctgcatttgccactatcagcgctgccattgaggtagatccgactcacccatctggcatgaatcaaataagtcgtccaatcccggacgtg

SEQ ID NO: 91338 - DNA, 195 bp, Glycine max
  Peptide Sequence Number=SeqID_183023
atggggacgacatggcaagcttggtggagttcactgagaatcgtggaaggtttgggttgggttacgaggctgcacatgccgacaagaggaagccatgttgttgcaacctaccctttagagggaggcgacgcgaggctcacgggtgtgtcttctaagggaggaaaatgcacagagtcaccaccaatgtttatttga

SEQ ID NO: 91339 - DNA, 618 bp, Glycine max
  Peptide Sequence Number=SeqID_183024
atggttaaagaggagtgtaaggaggtaagtgtctcctccaagaggttagctaataaggaaagtcattttgcaataaagataaaaattaaagaaacttcccctcttagacaacctccacatcttttcctttgtaaaaagacacttgttagcactgccacacctcttgggcttgaggttattcctcaagtaaagaagttgttggataagggtttggttcataagagcttaaatccttgtgctttgttggtgcccaaaataggtatttttaggcaccaaatccctaatataagtgatatgatgaatgtgttgagtgttgcaaccctcttttgtaaaatcactcatgcacccaacatcttcatgattcatgtacattgggactcagtaggtagatttgttcttatttttggttttaatacaaacctaggtgctcatatgggataccctagtgatcagggggttcccacagaccctaagagaataaaggtcattccagattggcccactccaccaagtataagggaaatttggggctgtcgtggcgtaacaaacttttacaaaagggtgtttccctcgctgctatatatcctcgagtgtgatgaggaaatcagacctacatag

SEQ ID NO: 91340 - DNA, 1137 bp, Glycine max
  Peptide Sequence Number=SeqID_183025
atgacaggggaaaggtctatgttcctcgacctaaatctagttgaaggaggaacaatttcctttggaggcataggtatgggaaatattactggtataggtaaaattgatattccttctttagcttccatgaaagaacaaatgacgacaataatggaggcgatgatggatatgaggaagataatggaggttaacgctactgcagctgctactgcctataccactactaaaagggacctaactcacccgcccatttttaatcaagaaagtcacctagtgtcagatgtgggaggtcaaggaggtgtggcgggggtagttgcatacgggcctcaatacacccaaagccataatagatatatttttccaccatatggtctgcctcctaactatacaccacctatggttgtaccggtgcctgccgagaatgttactaatcttatccctgtttgtactgagaatcatcaaactcaacccgatcaaactcaagcctataactctaatgccatggaggaggcacaagaagctcccattgaccacactataactggtttcaagccccatccaggatatatcgctgaagggcatgcattttctggtgtccttgtgctgaacactcttggagcctctcaatatcgcccgttatcacaatccttgcatttcatgaggggagaaggggctcccgcagtatttgagaaggaaaagattgaacatatagaggagaggttacgtgccatcgaaggagggggaagttatggttttgccgacatgttagagctatgtttggtacccgatgtgactattcccccgaagttcaaggtaatgccccctatggcagaaagagagatgataacgatgataatggacacattgccagtgttctattatgaaaagatggggaagtttgattatgcaacttcaacaaattctggtagtatgaggcttgggatgaatggagtgaagaagagagagggagaagcccaagtcgtggctatggttcccacatggacaaacttcctgcaagccccttataaccccatggtattggatagaagactccaagaggattgggctagagctgctaaagaaggccctggggttctcatgaacctaagggtagattttttgagcccatgggccaag

SEQ ID NO: 91341 - DNA, 387 bp, Glycine max
  Peptide Sequence Number=SeqID_183026
atggacctaattcttgtacatcctccgcatttgattgctttagcttgcatatacattgctagtgtgctcagggagaaagacaccactgcttggtttgaagaacttcgtgttgatatgaacgtgatcacgttttggatattgatcaaacgaatccacgagataccatttgagaaagcccgtgcttcagcttccttaggagaggctgatccagttgcggtggttgtgatggggaggggtctttgttgtaagttgtctcgtggtagatgtgcttcgaggaagtgttgtgcgttgaacttgagaccattgggagaaatcattagatacctgcaagagattgaaaacaaaggagttcaagatttctacacgttccctgctattctcgatgag

SEQ ID NO: 91342 - DNA, 405 bp, Glycine max
  Peptide Sequence Number=SeqID_183027
atgagcgagatctatccatatataagtgctcctatgttcatgtccatcttcattactggcccacaaactaacctagccctgtcaagattaagatcagagagttgtaagatccttgctcaagagcttccatggcaagccctcaatgttaagaacaaatcctcttccaaggatacacagtcgggctgccagctcttgagggtctggcctcaacctgtagaacctagagtaagaaggcttaaaaagggcattatgaccttgaaggcgtgcttagcgccattctcgcgcttagcgcgaaagagacaaccgccttgcttagcgagctacatacgcgctaagcgcatgctggcatggacgaactctcttcaggcttatccatatgcgctaagccactgctgtctcacttag

SEQ ID NO: 91343 - DNA, 186 bp, Glycine max
  Peptide Sequence Number=SeqID_183028
atgggacaccttagtgatcaaggggttcccacggaccctaagagaataaaggtcattcctgattggccccctccaccaagtgtcgagggaaggagcctagagtatgaagaaccttgggatttgaggtcaaatcctttccaaggtggaggggatgatgcaatcctaccccccaagggtattggatag

SEQ ID NO: 91344 - DNA, 582 bp, Glycine max
  Peptide Sequence Number=SeqID_183029
atgcactatattattgttcgtattttacttttccgttcttctaaccttgctcaagccttcgaggaggatttgattcttatgtgggcttttcttaccagtcgtcagatcgactgggctcacttgattcggtaccggatgcataaggcattacgggccaatgcacctctcccttatcctcacctcgtcaccctttttcttcatcatttcaaaattcctttggaagatgaaccatttgttcaagtaaaaaggtcttttgctattggtgttggtgcgattatcttgtttggttaccgtaaggatgatgatggtcagtgggttcgaaaacaagacttacctcagccaatccctgacgaacgtactctttctcctccaccgcaaagggttgattcctcttcacttctgaacgatgttctctctgaactccacagtcttcgagcttttgtgggtgaccgatttgatgctatggatactcccctggatgccatggatgctcacttcgatgggatggatacgaggattactcgacttgaggacgatatgagcttcattaggcgttgcttcgatccaccagccaacccttag

SEQ ID NO: 91345 - DNA, 285 bp, Glycine max
  Peptide Sequence Number=SeqID_183030
atggatctagaaggaaaatgtagaggaatttgttttggtgctgtcgcaacctacccttcggcgggagggcgacgcgtgactcgcgggatgcgtgttccacgaaaggaatacgcacggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 91346 - DNA, 649 bp, Glycine max
  misc_feature (16)..(16): n is a, c, g, or t
  Peptide Sequence Number=SeqID_183031
gaagcggaagagcgcncaatacgcaaaccgcctctccccgcgcgttggccgattcattaatgcagctggcacgacaggtttcccgactggaaagcgggcaatcatcccggtgccggtgatgggcggtgtctctctgctgctgtacggcgtaatcggcgcatccggtattcgcgtgctgattgagtctaaagtggattacagcaaagcgcagaacctgatcctgacctccgttatcctgatcatcggcgtgagcggcgccaaggtgcacatcggtgcggctgagctgaaggggatggcgctggcgaccatcgttggcgtgggcctgagcctgattttcaagctgatctccgtgatccgcccggaagaggtggtgctggacgccgacgaaagcgaaaaagcatgcagccaacgcagaggcagcttgaaggatgacgtgtataatcgggcgaaggatcgcccggttctctcctggcagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 91347 - DNA, 348 bp, Glycine max
  Peptide Sequence Number=SeqID_183032
atgtcgacacattgtcgatatgttggtggaattactcgaggcatcaaagagcacgacaagtgttggatctacgagcatttctcatctgttggttccgccctagatgccgaggattatgacgagaggagaccgcgtgcatgccgatggacctctagcagggcactgcccgtgtcgacgtatcacaagggtctggacagactgacccctgacgttgtgtgttggatttcttgtggtgaccactattcatttagagaatttgagatcatctccttgtttttcgaccatctcagatggggttccttgacggtcattcaccgaccaaatagggttgtacgacagtttgggtag

SEQ ID NO: 91348 - DNA, 558 bp, Glycine max
  Peptide Sequence Number=SeqID_183033
atgataaggttcagtggacttctcacaacgtcgcgggcagcgaaccgctcacgtcgccgcaatccgaacacttcaccggaccattcaatcggtaggagcgacgggcggctgaggtctcgttcgttaacggaattaaccagacaaatcgctccaccaactaagaacggccatgcaccaccacccatagaatcaagaaagagctctcagtctgtcaatccttactatgtctggacctgcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 91349 - DNA, 161 bp, Glycine max
  Peptide Sequence Number=SeqID_183034
atggtagaatcgtcgaagaagcgaaagggatcatcctccaccaccgctgctgctggccatcgccgccacagaccatctgaagcacccacaacacctattcatccttccttatcatctccaagatcatccactttgttttcttctgatgatcaacgtctacg

SEQ ID NO: 91350 - DNA, 171 bp, Glycine max
  Peptide Sequence Number=SeqID_183035
atgcatcccgcgagtcacgcgtcgccctcccgccgaagggttggttacgacaaagtagtactgaatgaaaagataatacaaagcacctctggtgctgcctcccaaagccaagaccaagctgaaaacatagcctcttccatgactttcgatgagtcgaattggtttccttga

SEQ ID NO: 91351 - DNA, 261 bp, Glycine max
  misc_feature (240)..(240): n is a, c, g, or t
  Peptide Sequence Number=SeqID_183036
atgccgcgaaactttacaaattacctaacgatgggtgttaagtactttgaggtggtcaagcgaaggttgcatgccaccaaacaatggtccccgaacaaaattaggttcaagcggaacatcattcggccggtcaatatcccaaccagcggaacctgtcattcagaaagaaagaaaaggcatcagaagcgtcaacaaaacttcagtgtcttgaaagcgataaagtgggacaaccacgacatntccccacgccatcgaacttga

SEQ ID NO: 91352 - DNA, 573 bp, Glycine max
  Peptide Sequence Number=SeqID_183037
atggatgattacaagtttttgcaaactaagcttgaaattttcaaaaaggatcaccatgctgaatgtatgaaaatgcaaactaagctttcctaccttaaatatttttttggaaaattgaataaagaaaagagtgatcttaatcacatgctcaatgtgcaaaagcatactatagacaagactgacttggggtataacaagcaaacctcattttcaaagaaaactcaatttgtatcctcaaaaggggtgaacccaaccaaggtctcaaaaaagaggaacatggtgtattctaagataaatgcaaaaacatgtcattattgcatgaaaaagggttatacatcatataatttctatgtcagaaggtttgacattcagagaggacaatgcacgtggattccaaaagatttatttgtgaagattaaccccattagacccaacttaaattgggtatgcctaaaagccagagattcactacgatacttggatagtggctgctctaggcacatgatgggtgacaagtccaaactctccgactttgtgtcaaaagatggaggatacgtcacaaaactcagataa

SEQ ID NO: 91353 - DNA, 624 bp, Glycine max
  Peptide Sequence Number=SeqID_183038
atggcatccttcagccaccttcagtcgcagatgcaatctcagggacttgcagtgcctcctgagcctctggttggtcctggtccctccggtcctcgagtgagcacaaaggggagttgtgttgatccctcaggaaatgatcctgagaccggtgactctgacaggtgcggcttgtacatagaagcagatcctgcccgcctggttgccatcgggagagtttatgagggatccactgttgttcataacactcctttgttgcctggccaagtaaaggtgagtgtggaggaggttagagatgcagatgctctagttcctgtacccactgatgaggtttccttagtggggcaggcacttcacaccttcattgcttggccgacacatctggtagttgtgtctccgccaaaaccacctccgaagcccgatccggaggtcaatgatccgctttatcttatgacattgaccatcccagagcttttcttgaggccttatcaggttagatgggatgccaccgtgttcggggtcgttaatccagatttccccctgtacataaagcacgaagacctctccgaaatcgcacacggtggtcaatgtctcagcatatcagtgttacagttgtggattctgtaa

SEQ ID NO: 91354 - DNA, 259 bp, Glycine max
  Peptide Sequence Number=SeqID_183039
atggaacttcaacgtctcaaccaaaatgaagatactgacaaaaggaaaagaagcatagcactcaaggcctcctcctcaatgcaagaagaagaagaagaagaagaagaatctgatgatgaagaggacttctcactctttgtgaagaagtttcataaattcgtcataaatagaagaatggagagaagccataacttcaacaatgggaagaaatcccaagaagtttctcctacacttaaatgctataagtgtaatcaacctg

SEQ ID NO: 91355 - DNA, 600 bp, Glycine max
  Peptide Sequence Number=SeqID_183040
atggatatgaacttggggtacctcatctcctaccagatctctctaatttcacagcatgatacatccagacttggattccctgccttgatcgcagctttatgcaaggccagaggagaccagtcagattctagatccctggagaacttgagctctgccattaacttggcaaatattaagaagaactattggaatcttgatgatccaatagtgacatttagagggccaaggaaggcccggggtaagagatcagaggtccccactacttcagcaccaccagagacaccagctccttcttcttccatagctccagtaccttccttagctccagttattcctcctacatctacacagctaccaccttctccttatggagggggtaaggcccccacagcccaggagcctgctcttgaggagccagcagcaacagcagaaggggaggatgagctcacccttcctgagcccttttattttgatgtagatgcacacatggctcaagaggaagggacttccacagatcagatacatgagccatcttctgcacctgttcctgaggagacccagccatctacaccaatcatggagacagagcagcctatctag

SEQ ID NO: 91356 - DNA, 171 bp, Glycine max
  Peptide Sequence Number=SeqID_183041
atggtgattttcaaccgtggagttggagtggaaaatgaaggagaagagcatattccaagaatatgccaaaggcatcttagcatattccctttagatgccataagaatggaaggtgtgactctagcacatgggaaaggaatatgccacaagaatatgccaaggacatcttag

SEQ ID NO: 91357 - DNA, 147 bp, Glycine max
  Peptide Sequence Number=SeqID_183042
atggcttgcaccaacattccagtggaagcaaagatgattcacaagcgattctcctcaaatttcagccagtctgcattaattagactttgcaccttacgcttcaaggtcatacagtgctcaatggaatgtcctggaactcctttatga

SEQ ID NO: 91358 - DNA, 165 bp, Glycine max
  Peptide Sequence Number=SeqID_183043
atggtgcctttcattgccccagtgcaaggctttgaggcacaatcgttgtctttcgccatgaccttgcagcaaggaacctattgggtgagaacttctaatctgcccctagggcttagaggtaccaattattgtcttgttttcacacctcgtagtgaggaagaatga

SEQ ID NO: 91359 - DNA, 204 bp, Glycine max
  Peptide Sequence Number=SeqID_183044
atggcattaggaaaagtgtatgacagtttgtccaccatacacaatgtcccttatgcagaagatgtggttagggtgagtgttgtgaaagtttaccacagtgacgctcaacttccttttctgacatcagagattcagtttgtgaggcaagtcgttggcacattcgttgggtggtcgacacatcttatgaaacctgtatctaatgag

SEQ ID NO: 91360 - DNA, 231 bp, Glycine max
  Peptide Sequence Number=SeqID_183045
atggctccgaaaaagatttccaagaagagatctaggagagatgccgcggcgaaagggtccagtgtcgcccccaagtttgatagccaccgtttccggagcaccgagcaccagcagcgcttcgaggccatcaaaggatggtcgttccaccgagagaggcgcgtccagctcaaggagaacgagtatacatattttcaggaggagatagtgttggatcgagtgacctcagaataa

SEQ ID NO: 91361 - DNA, 1026 bp, Glycine max
  Peptide Sequence Number=SeqID_183046
atgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatg

SEQ ID NO: 91362 - DNA, 948 bp, Glycine max
  Peptide Sequence Number=SeqID_183047
atgagtgagctggcgatccggtatctccagcagaccacccacgatttccagacggtgggcatcgacggcacgtcgtgcagcgatgcgcgcatctgcgatctgccgggccttgacggcatgaatctgccaccgctggacgaagagtcgcaggcggatctcgacgatccttacgtgttccacgtcccggatggcaacgccacgctggcgcgcctgatggcgcgcaaactgatcccgacggtggcgccggccggccaagacatggacgacgtggtgctggccaaattcgactacggccagctcgatcggccggaatcgccggtgaagcatgcgtttgaacagcaccgggctgcatgcggccaacgtcggcgacaaggtggaagtcacctacatgaccggcgagaagatgaccaaggtgcgcgccgggcaggtggtgatggccggctacaacatgatgatcccatacctggtgccggagatgtcgcacgagcagcaggaggcgctgaagcagaacgtcaagtcgccgctggtgtacagcaaggtggtgatccgcaactggcaaccgttcatcaagctgggcgtgcacgagatctattcgccggccgcgccgtacagccgcgtgaagctggattacccggtgagcatgggcggatgatccgcgaacagctgcagggcatgctgggcgaggccggtttcgaccatcagcgcgacattcaggcgatcaccgtcaaccgctggtcgcacggttactcctacttcctcaacggactgtttgacgacgaagacgaggccacgaaaatcatcgaaacggcgcggcagccgatcggcaagatcgttatcgccaactccgatgccgactggagcccgtacgccaactcggcgatcgatcaggcgtggcgcgcggtgaatgaactggcctacggcaaggttgccgccaaggagggagcatga

SEQ ID NO: 91363 - DNA, 168 bp, Glycine max
  Peptide Sequence Number=SeqID_183048
atgtatatatgtgtggaaatggctccgaggaagctttcctcgaagagatctaggaaggaagccgcggccgtagggactagtgccactcccgagttcgatagccatcgtttcaggagcgctgagcaccagcagcatttcgaagccatcaagggatggtccttccactga

SEQ ID NO: 91364 - DNA, 411 bp, Glycine max
  Peptide Sequence Number=SeqID_183049
atggcatcgttcagccagatgcagtcccagatgcaatctcagagacttgcactgcctccaaagcctctggttggtcccttaggtcctcgagtaagcacaaaagggagttgtgttgatccctcaggaaacgatccaaagatgggtgactcagataggtgcagcttgtacatcgaagcaaatcctgaccgcctggttgccctggggagagtttatgagggatccactattgttcataacactcctttgttgcctagccaagtaaaggtgggtgtggaggaggttaaagatgaagatgctccagttcttgtacccactgatgaggtttccgtagtggggcaggcaattcacaccttccttgcttggtcgacacatctggtcaagtctttatcacagcagcgtgcctcaaattag

SEQ ID NO: 91365 - DNA, 627 bp, Glycine max
  Peptide Sequence Number=SeqID_183050
atgtatgagctttatgtgttggagttggggagaaaaggttgtgctgaagttactatcttcaaaactggttatattgtttttaaaggaggcactcaggaatgggcatatggttttaatgcagggatgtttggctcaaggtcagtgcctgcagttggtgtaagtctgggaattgaaagagtatttgccacaatggagcaaacaaaaggatcagcaacaaacagtcatcaacacatgaactcaaggagaaaaatgggcaaggcttggtctttggaggaaggacaatatcatattaaagacatgatatgtgacatgatattattttacggcggtgctggaactagtggcggtggcaatgacaaatcaattgttaaccatgcagcacagattgcacatattccaaatcagaatgctacatcgcaacaacaatttcagactcagcaaaggaaaatgagaattctaggggggaacttggaattggaacctttgagaaatattaatgtacaacctctagcacaagccatggtgaatgaaagtacaggagcaacaaatgttgtttcttcattaggaacacaaatccaaacagtagaaccatctaatgctatgtactgtacgcgacaaatgaaatga

SEQ ID NO: 91366 - DNA, 588 bp, Glycine max
  Peptide Sequence Number=SeqID_183051
atggaagatgacatactgagggaccagattggtgtacatggaactgagaaatggtacacgtatttgaattctgatttcaagaaaggaggatggtcactagaggaagacaagcttttatgtgagaaaacctgggtggtccaaagtttgagattggaacctactattgtaaaggagcaatatctccaacggttgatgggagaagttgaggcaaagtcaaactttctagtgcaagatcttcttcgtgtaggacaatgtcaaagtgttgtgaccaacggttcgctgcctgtttctccaatgctcccagttcaaggcaaagaaggctctaacatccctatcaactgcaaagtagacagctatcgctgtcagttgatagttatggagatatttgtggttgtgttgggcatattatggggtgtcagaggtgcattagttaaggctgagttcaacaatggtggcaatgttgataagttatggtttgcttccatggttggacctataggtgtgtggattagatggttcttagccagcctcaacggacgtggattgggaaagccagggttttttaaatggatccaattgatgatttga

SEQ ID NO: 91367 - DNA, 99 bp, Glycine max
  Peptide Sequence Number=SeqID_183052
atggcggtgaaggaagggtttgctctaagagagtggcgaaggcagaacgcgattcaattggaggtaaaggagaagaaggagacggagatgcggttgtag

SEQ ID NO: 91368 - DNA, 799 bp, Glycine max
  Peptide Sequence Number=SeqID_183053
atggcttcaagaaaaagaaaaagcacgactttcaggccctaacctaactatgatgcaaggaggtttacctcagaagaagcctggaatagatataccgacaacggagttggagaggcgcaacctgcacaagcgtctcaccaacttagctaatggcagtattgatgtcgtggtggtcaaggagttctacgcaaacctctatgaccctaaagataactcaccaaagcaggtgaaagtgagagggcacttgataaagttcaatgcgaacaccctcaacacatttttggggaccccagtggtattggagcctggggagaccatccccatagtggctcgcctctatattctaggaaggggatttgttctaaatgctgaaggcatgtcgtggaagctgttgaggagagacctcaccaccttagcacagacttggagtgtgttatcatattctaacctagcccctacatcacatacatctgacctgaacttggacagggcaaggttgggatttcctgccttgatcacaactctctgcaaggcaaggggagtcacttctgattccctctcttgtgaatcactgagcccaaccattaatttgacatatatcaagagaaattgctggaacctggatgaacctttggtctactttccagtgactcacatggctagggccagagcagctaagatcccttcctcatccactcctcaggaccctcttgtacccacttttgctctaccaccagctccagctcatccaggactttccatagaccttatcatggcgatgctccagagcttatactag

SEQ ID NO: 91369 - DNA, 201 bp, Glycine max
  Peptide Sequence Number=SeqID_183054
atgttgtaccatccccaaggaaatagcctaagcgtgtccacacgacactctcacttaggaaaactaggcagcctaggatattcttcatcaatggattcctttgcttcttggaagatgaatggcaacggaatggagaaggaagagagagaggagacgacacttcaaggagaagatgagtctagaagaagctcaccaccatag

SEQ ID NO: 91370 - DNA, 1188 bp, Glycine max
  Peptide Sequence Number=SeqID_183055
atgagtctggatactgaagtagtggaaacaagcattgcggtagagaaacccgcatggggcgcggtgttcgccatggcgtttggcgtcttcggcctgatcaccgcagaatttctgccggtgagcttgctgacaccgattgccgactcgctgcgcgtcagcgaagggcaggcgggccagacagtcacggttaccgcgctggtggcgctgctgaccagcctggtgattggtaacgtcacgcgccgcctcgaccgccgcctggtgatgctggcgttcacgttgctgctcatcgcctcggcgctactggtggcgtttgccgaaaatctgccgatgattttactggcgcgcgtgctgctcggcatggcgattggcggcttctggacgctgtcgaccgccattaccatgcggctggtgcccgccgatcaggtgccgcgcgcgctgtcgattgtgttcagcggtatttcgctggccaccatcattgccgcgccgctgggcagctatcttggcgggctgattggctggcgtaatatcttcctgctgaccggtgttttgggcgtgctggcgctgttctggcagttcttcaccctgccgtcgatgccgccggagaacaaagcgcgcagcggcggcgtgctggacctgctgcgtcagagcgtgatgcgctggggcatgctggcggtgatcatgatgtttaccggccattttgccttctttacctatctgcgcccgttcctggaaaccagcgcgcagctgaatgtgaatcagctgtcgctggtgctgctggcgttcggcgtggcgaacttcttcggcacctcgctggccgcgtggctggtgacgcgcagcgtgtcgctgacgctgaccggcatggcgctggtgatgagcgtgacggcggtgctgctggtgagctttggccacgtctcctggctggtggcgagcggcgtcgcgctgtgggggctggcgtttggttcaatgccgactggctggtcaacctggctgtcgcgcgcggtgccggacgacgccgaatcgggcggcgggctgctggtggccactattcagctggcgatcaccgccggtgcggcagccggtggctggatgttcgatctgcagggcgcgggcggcgtattccttgccagcggcgtgctgatgctgctggccgccatcaccatctttacccgcgtgcggcatcacggttaa

SEQ ID NO: 91371 - DNA, 150 bp, Glycine max
  Peptide Sequence Number=SeqID_183056
atgactaaagcacgtcaaaaggggggaaaagaaggagaagcttgccacccagctcgcccaggcgagctaggttgcttccggtgccttctggaggaacttcctggaaggcccaagtgggcctggttgctatttgcaccccctatttactaa

SEQ ID NO: 91372 - DNA, 404 bp, Glycine max
  Peptide Sequence Number=SeqID_183057
gcttccagcagggtccttataatcaacaaggacagtggaggtcgcaccctggtaatcagttcaacaaagactacggtggaccttcgaacaggccaatccaacaagggcctaacatctttcaaaggactactaagctggaggaaactttgactcattttatgcagcaaataactgacaagtcatccaacagttttgtggcaaatacaaaaaggaatcccaaggaggaatgcaaagttgtgatgacaaggagtaaaaggtttgtggaggctgaggatgaggagagtggtatgcataagaagaaagctgctgaaaagaaaggtgttgagggaaagagaaaggatgttagaggtgaaagcaatcaagaaaaagagaaacaaagaatggtcaagaaaaaaagaatttaa

SEQ ID NO: 91373 - DNA, 540 bp, Glycine max
  Peptide Sequence Number=SeqID_183058
atgtcatttttgggagaaacaagtagccagaccattgctaactctagattagccttcattttttcaaatggatcaatcactcacaaccaaactggtgtttactttcaaagtcccactccaacaccaatgcgagttcctaacgactgttcttttgatacactcaagcgtagaatgtacaacacccttcaactaaccaacgatcaattagtggatgaaatctactaccgacaaccattcataaatgcagaattattatgtaccattattagaacaccggatgctatactcaacctgcttcagtcaactatcactcctactcgtgatgcacttatgtattacaacgggaagtggaacataccacgtcaaggtaagtttttgggttactcctttactggaactaatccaataagatttggcattccttcgggatgtagtatggacaaactcaaggatttaatcaagcaagttgcacctatagagttccccctaatggaattcacgaatcccaattggttagacaattgttcttttgacaactag

SEQ ID NO: 91374 - DNA, 426 bp, Glycine max
  Peptide Sequence Number=SeqID_183059
atgggaacaaatcacactggaaaaagattctatcaagtcaagattaagggcctagatgtcaccagccttaaggagttggggcggttgatgggacctctccagatgcaagccttccgcaaggcgtacggaaagattttagatttgaccatagcagagatatccacggaagtcgttgatgtcctcttgggggaaggaaaccgtatcttttctccgggttgtggtaagggattcaacaagagagttcaattgtgtaaagcaaactcgaaacgacatagtgggcctaccacggaagtacttagaaggcaaggcaagggaaatggagaatcaagaggagtgggtcccgtttatggatgtattagcattgctaatctttggggttgtcctctttccaaacgtgcatggtttggtggacctagccgcaattga

SEQ ID NO: 91375 - DNA, 1014 bp, Glycine max
  Peptide Sequence Number=SeqID_183060
atggccccgaggaagcttgcctcaaagaggtccaggaaggataaggcggccgaaggaactagttccgttcctgagtatgacagtcaccactttaggagcgctgtacatcagcagcgcttcgaggccatcaagggatggtcatttctccgggagcgacgtgtccagctcagggatgacgagtatactgatttccaggaggagataggtcaccggcggtgggcatcactggttacccccatggccaagttcgatccagaagtagtccttgagttttatgccaatgcttggccaacagaggagggcgtgcgtgacatgaggtcctgggtgaggggtcagtggatcccgtttgatgcagatgctatcggccagctcctgggatatccgttagtgctggaagagggccaggagtgcgagtatggccagaggaggaaccggtctgattggttcgatgaggaggccatcgcccagttgctatgtataccggggcaagattttgcccggactgctgccgggagacgggtgcggatcatgcgcaccaacatgaccaccctgactcagatatggatgactttgctgctcagcaacatcttgcccaccgaccataattccgacctccccctgccgaagtgtcagctggtgtacgccatcctgacgcggatgagcatccatgtggctcagttaatcactgatgccatctatatttttgcaggtatggcgcctaccaggcaccctttggatccagataagtcgaaccgggccctgggatttcccgcactgatcacaggactctgccagtcgtttggagtccccgttgcacccaccaaggtgattcggccgcccatcacctgggcttttattgagaagtactgcacccagagacaggctcagggtgatgctccacaggccgcaggcgcgccaccaccacctcatcaggctggccaagctgggtcatttgacatggagcagtatttacgccatttggttcgccagcaggcggccaaccaccgggcacat

SEQ ID NO: 91376 - DNA, 81 bp, Glycine max
  Peptide Sequence Number=SeqID_183061
gtgacctgcgctcctgagttgatctccaagtttgttcaatcgaaaattactcgttctacacgtttggtgggggtgtcgtaa

SEQ ID NO: 91377 - DNA, 555 bp, Glycine max
  Peptide Sequence Number=SeqID_183062
atgtcttccacaaataaacgttggtggcgactctgcacattttcctcctttggaagacgcacccgtgagcctcgcctcgctcgcctgcaaaagggtaggttgcgacaacaagtcctccacaacaacaatagcctgtccctcctttccagaatgttgttggtccaagaaagccatatgttcctcctccaatacagcagcaacaacaatagcagtcacaacaaagagttagtgaggcaaatgaccatccagaatattcaatttcagcaagagacaagagcctccattcagagtctgacaaatcagatagggcatatggctactcagatgaaccaagctcagtcccaaaattctgacaaattgccttcgcaaactgtgcagaatccgaaaaatgtgagtgccatcaccttgaggtctggcaaccaaattcaagtgcatccaccagtagcagcacctacacctgaaaaaaaggatgagatatttgcacaaaagagaaagcttcctaacaaaaaattttatgcaggtcgaccttcttctagtaattccgacttacagtag

SEQ ID NO: 91378 - DNA, 336 bp, Glycine max
  Peptide Sequence Number=SeqID_183063
atgcctctatcagcagcagccgacagcttggcggttacatcacactgttgcagtgctggatgtcataccctaatttcgtccggggacctttgcttggtggcatgcaacttttgtttggtccttgtgaggtgcttggcacccatcattaggcaatttgtgaagttccgggacatgccggaaatcaaaagaagtaaaaatgggggtgcaaatagcaaccaggcccacttgggccctccagaaggctgttgcttctggaggaagcaaccctgctcccctgggcgagctgagcttgcctgggcgagctgggtggcaagtttctcccccaattttctataa

SEQ ID NO: 91379 - DNA, 651 bp, Glycine max
  Peptide Sequence Number=SeqID_183064
cagaagctcctggctgagaagaccaagaagaagctggaggaatgtgcacagtcaggaagcattgatggcatcatcgaccctccatccccggtcagacgccacgtgaagtggaagatggcctgcacgaagaaaacaggagagatgacgactaaggccgcaaaggaaattgctgagaagatcataagatccttcatcccccatggacgtcaagatgttctcaccgctgctattggacgtccagagcaccctggacatgtccgttctgctggagccgctgacccatcaaatcagggaccagctagaggagtccatcacagaaaacatgacgcgacaactcatggcatcgttcagccagatgtagtcccagattcagttccagatgcaatctcagggacttgcactgcctcccgagcctctggctggtccctcaggtgcggcttgtacatcgaagcagatcctaactacctagttgccctgaggagagtttacgagggatccactattgttcataacactcctttgttgcctggtcaagtaaaggtgggtgtggaggaggttacagatgcagatgctccagttcctgtatccattaatgaggtttccttagcgaggcaggcaattcacaccttccttgcttggccaacacatctg

SEQ ID NO: 91380 - DNA, 280 bp, Glycine max
  Peptide Sequence Number=SeqID_183065
atggaaaaatctgacaagaaaacctttaaagataagaaaggaaagaaaacttgtatcacttgggaagataatgacatggattcatcaggtgattcagaaaatgaagttgtaaatctaagtctcatggccaaaaactatgaaagtgaagaagaggattctttgaagcaaagctggtacattgatagcggttgctctaaacacatgacgggagatgcatcaaagtttactcatatttctcctaagaatagtggacatatgacctatggagacaacaacaaag

SEQ ID NO: 91381 - DNA, 345 bp, Glycine max
  Peptide Sequence Number=SeqID_183066
atggagcattttcttgagcaagtagcctggcctgaagctcaacttccattggtgagacccaacgaggctgctccgcctaagcccacacctgtgcaagttgttccagagccagctgacccacaatctctagtggtgaatccaccgtcttctcctgagcatgaagtagttcccccatctccacctctgattgtcatctccgatgcatcatcagatgaagcggttgcccctcctgattcaccagctagagaaacagctgaccctcctacttccccagttggaggaattgtcgatctttctgattcgtcatttggagaagttgttgctctcaccgattccccagtttag

SEQ ID NO: 91382 - DNA, 163 bp, Glycine max
  Peptide Sequence Number=SeqID_183067
atggagagggagttgataacgatgatggtagacacattaccggtgtcctactatgagaaaatggtgggttacatgccttcaagctttgccaattcagtgttcgccggtgaaagggtcaaagtgggtctgagaagaggcaaatttgattgtctcgctttgacaa

SEQ ID NO: 91383 - DNA, 261 bp, Glycine max
  Peptide Sequence Number=SeqID_183068
atgtcttctaatttgaactatatgcttaagggacgtgaggtcttgaaggaactacctcctgagattgtaaaactatatgaggagataaaaaccttgagagataaactaggcaaatttgttggtggtcatgaagcccttaacaaaattattaaggtgcaaagaaaccttaaagacaaatctatccatggtcatgaaactcacaagtgcaaggacctccatgaaaagggcaacccatcaaggggtctatccagtgcttactag

SEQ ID NO: 91384 - DNA, 381 bp, Glycine max
  Peptide Sequence Number=SeqID_183069
atgggtgccaagcacctcacaaggaccaaagaatggtcgcatgtcatcaagcaaaggtccccggacgaaattaggggggagattgtggaagcaaagcttcatgatggtgttttgatgataacaatgatgacaacgaaagatgatgacaaaggtgatgaacaaaaagctcaaagatcaaagaacaactcaagtgaatcaaagaacatctcaagtgaatcaagaacaagtcaagagttcaagaatcaagaggaattcaagactcaagaagaaagcctagaatcaagaatcaagattcaagattcaagatctcaagaatcaagatcaagattcaagactcaagattcaagaatgaagaaaagactcaatcaagataagtattaa

SEQ ID NO: 91385 - DNA, 399 bp, Glycine max
  Peptide Sequence Number=SeqID_183070
atgactagaggcaatccatctaacttacaaccctttgatcctgagatagataggacatttcatagattagttagacatcatttagtaccttttgagcatcctgagcattttgttattggtgattttgagcattattgttttgaacattctgattttgaacattctgagaacatgacacaacctccaccccgtgagaggactctaagggaaatggctgcacctgatttcacttatgaaaacttgttcattcaatatcctgatgagggtgttccatatgttctcaagactggactaatacatttgctgcccaagtttcatggtcttgcaggtgaagatccttataagcatcttaaggagttccatattgtttgctccaccatgaaaccaccagatgtctag

SEQ ID NO: 91386 - DNA, 81 bp, Glycine max
  Peptide Sequence Number=SeqID_183071
gattcgttggaggaccaggcctcacagggttcctttgtcgcccatggatgtcaggatgtattaaatactgccattgggtga

SEQ ID NO: 91387 - DNA, 117 bp, Glycine max
  Peptide Sequence Number=SeqID_183072
atgtggaccaccacgggggagaagcttgccgcccagctcgcccaggtgagccaggttgcttcctccagaagcaacaaccttctggaggaatcttccggaaggcccaagtgggcctga

SEQ ID NO: 91388 - DNA, 462 bp, Glycine max
  Peptide Sequence Number=SeqID_183073
gtggacccgaaaaagtccaacagggccctggggtttccagctctggttacgggcctctatcagtcctacagggtgcccgtacccccccggcaaggtcacgtcatcatagggatcgcgcctgcaagacacccagtggacccgaagaagtccaacagggtcttggagttgtcaagctctaaatacgggtctctatcagttcaagggagtgcctgttgcccccagcagggtcatcaggccccctaccaatcgagttttcatctagaagtgttgcgcccccaggcaggcgcagggcgagacaccacagcagcattgggatggacggtagcgggcaatagacacaccgccatcaccactaaagttcacctcagctcatccataaaaagtaggatgcacctagttgctcatgatcctggggatttaaataaaacaagcgcaagctcggaaggtagaaagataccttag

SEQ ID NO: 91389 - DNA, 423 bp, Glycine max
  Peptide Sequence Number=SeqID_183074
atggcggacaccgaactttccatcgcctgtgtggatcgtctcgaggccgccatggccaaactcgctgcaattcaaacttccattgctgcagaccaaacttccattacttccaaacttgatgccattattcggatattgaataccatggtacctaaacaaccctctccatcttctgcctctgcgaagtcaccacccatgccgcctctgcttcctaagacaaccaaccctacttcttcctctgctaagccaccaccaacagcagaaaccatgttgcctccccttcccatggcaactttccaccttcccgttaacaagcaccacgcactctccttcgaatccctcccggtcgccagtcatcggtcccacacaaagtcctctagtcatggcatccttccctctgacatccacttctccctttctgtt

SEQ ID NO: 91390 - DNA, 138 bp, Glycine max
  Peptide Sequence Number=SeqID_183075
agctggcgatatgcacaagccatagggaaccgccagtcaaactggcgagttccaatagctgagggcagcaggcctagttcctgccatggcagtgcagcagagaggaaatcgccattggtgcaggcgatttgcaggtga

SEQ ID NO: 91391 - DNA, 657 bp, Glycine max
  Peptide Sequence Number=SeqID_183076
atggcaacaataagacttcatggaaaccccttctcaacagccaccatgcgagctgctgcttccctacacgagaagcagcttgaatttgagtttgttctcattgacatgaaaaatggtgaacacaaaaaggaacccttcatttcccttaatcctttcggtcaagttccagcctttgaagatggagatttgaagctctttgaatcaagagcaataactcagtacatcgttcacgagtatgctgataaggggactcaactgataagcaaggagtccaagaagatggcaaaattgaggttgtggttggaagtagagagccaacactacgatcaaccagcttcaaaacttgtatgggagctcatggtaaagcctatgtatggtctccctacggatccagcagctgtggaagagaatgaagggaagctaggcactgttcttgatttctacgagaaaacattgtctcagtccaaatacgtggcgggtgagtgtttcaccttggcggatctgcatcacctcccaacgattcattacttgatgaaaacacagagcaagaagttgtttgaatcacgaccccatgttggtgcatgggtggctgatattacagcaagaacagcttggtctaaggtccttgccatgcagcctttgctaagtagtaaatag

SEQ ID NO: 91392 - DNA, 2931 bp, Glycine max
  Peptide Sequence Number=SeqID_183077
atgatgttttgtaataatgctctatttgtcggtggcttaaaatggggagaagagaactgtttggaattaatctttttgttattcatgcttctccagaatcctcatgtgtgcatgactgaacctatcttcaccgttggtcaaggtcaacattgtaatttatggcttaaagatcccaccattggtagtgttttgtgcaagttgagccacatagagcgtggaagttcatcgggtgcattactggaaatcacagggagcaaaggttctattcacgttaatgggaagacttatagaaagaatgcctgtctaattttaagtggaggtgatgaggttgtctttggttcttctgccaagtatgcttatatctttcagcagctgacgaatagtatcattagtactgctgatatagcttcttctgtgagtatcttggaagcccagagtgctccaataaatggaatgcaagttgaagccagatctggagacctttctgctgttgctgaagcatctatattggcatctttatctaataatatttgtaaagaattatctctcctaccacctgctgctaaaactggcaagaatgtgcagcagaacactgacatttcatcactacattctggctgcggggatgatatcacagacaatgaaatgagtgataccaccaataatgatgaaccagctggagatttttctgctgataaaactgttcttggatcctctaccactgttaacgaaaatcctaaccttggctcagcagaagtcgataccaatattgatgcagatgttgggaagatgactactgctacatatgagttgaggccattactgcgcatgcttactggatcatgtcctgaatttgatttaagtggtagcatttccaagatattggaagggcaaagggaattaagagaacttcttaaagatgttgataccccaacagtattggcatcaaccaagcgactagcatttaaggacagtttacaacagagaattctcaaagctgagaagattgatgtctcatttgaaactttcccatattatctaagtgatacaacaaagaacgttttgattgcttctacatttattcatttgaagtgcaaaggctttggaaaatatgcttcagacctcccatcagtgtctccacgaatagtgttatctggtcctgcaggttcggaaatatatcaggagactttgtccaaggcacttgtgaagcattttggtgccaggctactaattgtggattctctttcactgcctggtggatcaccatcaaaggaagttgattctgccaaagaaagttctggggctgaaaaaccatctgtgttttctaggaagagaaatttccagactgccatgttacagcataaaaaaccagcctctagtgttaatgctgaaattattggtggacccatgctaatttctagtgcatcatcgaaaggcgctactcttagaaagggtgatcgagtaaaatttattggtagctttccttcggctgtctcatcactaccaaattatatttcaaggggaccaagttatggctcccggggcaaagttctcctagcttttgaagataacgggtcttcaaaaattggggttaggtttgataaatcaattccagatggaaatgatcttggtggcctttgcgaagatgaccatgggttcttctgttctgcaaatcatttactacaagtagacggctctggaggggatgatcttgacaaagttgcaattaatgaaatctttgaggttgcctctaatcagagtaaaagtggtgcactcgtgttgttcattaaagatatagggaaggcaatgattggcaactacgaaattttaaaaagtaaatttgaaagcttgccaccaaatgttgtggtagttggttctcacacccagttggataatcaaaaggagaaggctcaacctggcagtcttctgtttaccaagtttggaagcaatcagacagcactacttgatcttgcttttccggataactttagtagactgcatgatagaagcaaagaaacctcaaaagttatgaagcaacttaatcgcctttttccaaacaaagtgaccatacagttgcctcaggacgaggctttactctctgactggaagcagcagttagatcgtgacattgaaactatgaaagctcagtccaatgttgtcagcattcgcttagttctcaacagaattggattggattgccctgaccttgagactctctgcatcaaagaccacaccctaacgactgagagtgtggagaagatcattggatgggctttaagttaccattttatgcattcatctgaagcttcaatcagagattctaagcttgtaatatctgcagaaagcattaagtatggacataaaattctacagggcattcaaaatgagaacaagaacatgaaaaaatcacttaaggacgtggttactgagaatgaatttgagaaaaaactacttactgatgttattccaccgactgatattggggtcacatttgacgatattggagctttagaaaatgttaaggaaaccttgaaggaattggtcatgcttcctcttcaaaggcctgaattgtttggcaaaggacagctggccaagccttgcaagggaatattgctttttggcccccctggcacaggaaaaacaatgcttgcaaaggctgtggcaactgaagctggagcaaattttattaacatttcaatgtccagcattacatccaagtggtttggtgaaggagaaaaatatgtcaaagcagtcttttctctggccagcaaaattgctccaagtgttatttttgttgatgaggttgctaagcacttggggaacccacccttaaaagatagttgttcagggaggagaaccaagcacttaaatactccaccaagcacttggggaatcccatactactcgatatggggattaggtgccccataa

SEQ ID NO: 91393 - DNA, 846 bp, Glycine max
  Peptide Sequence Number=SeqID_183078
atggaaggcattttaaagatggaagatctttttaagaagtggactgagtatcttgacagcacacaatcaagggtcagtcacccacgaccgaagttacacccttacaatcaatatgaagaagaaagaactcctaaccttaagggtgtgtttgcgaatttcatggcataccatgctagctctacagccaatcaaaactcaatgcaaaaccaggaaattcagattggcaagagctactccatcgaaaattatcagtgggagcaagagttacaaccatacaatcaaatagaagaagaaagaatttctaatctagataatttgttgatgcaattcaaggaaacaactgaatctactcaacgggcatttaaaagtctagaaattcaagttggtaagctagcaaaagaaatggctaaatttgtggccataagggaagaaaactttgtagaggttgaagctcaagaggaaaggcctgtaaaagagaatgattcaagagaaaaagatgaagaaaaaattaaggacaaagcacaacaatgggagaagtactcacaagaagaaagacatggagaacaagagaaagccttaagtgtccttctttcctcgatcactagcacttctcttgcaatgatatggaaggtgcttccagaatacatgagtttcatggagtctctagctaaaaggcgaaaatataagaaagatgtgttctatgtgacctttatgccacttggaagacatttgacccatcaagctaatgctgttaaaaaaggctcaaacactggaaatgttgcataccaattttatggaaatgttggttccatgaaggcaagcgtcagttcaagtattggagtatga

SEQ ID NO: 91394 - DNA, 1059 bp, Glycine max
  Peptide Sequence Number=SeqID_183079
atgatgaatggttctccaaattcaaaacagagaacatgtgactattgcgggagcttcacggctcttctgtactgcagagccgattctgcgaagctttgtttcttctgtgaccgtaaagttcacttcccaaaccagcttttctcgaagcacaagcgcgcgcagctctgtgatgcgtgtggagattcccctgcctcggtgctctgttctgcagaaaactctgttctgtgccaaaactgtgattgcggaaagcaaaaacatttggtgtctgaggcgcaccaacggaggccactcgaggggttctcggggtgcccttctgtgactgagttgttaacaattctgggtctcagtgaaaaatctctgctttcaaatgagggaacttcccagattgatgatgacctttcggatttgcacgtgtggagtgctccttctattaatggtcttgaagatttgatcactaccacagcttcttctcaaaagaaacgtaagggtgcgtgcgggagacacaaagaagagattcttagtcaactccgtgagctaataaagttggagcccgacttgattcatgctgaacgacaagggcaatttggaaatttgcctactgattttgaacgagacgtggaggctaatatatttccttcatatgaggtaggtgtgttttgttggcatggagaaagcagtgatcctagaaatcaaattgttccttccgatacgtcaccattgagagattatggcgatatagtttcagctgaagatggaagttttacgatcactgtgactcacgccaattttaacaaccaagggaaaccatcaaattcttttaacgctgaaaacttatctcctactcctaaagctactccatacgagttgacaagtcatgaaagagattcagcattattgcgatacagagagaagaaaaaatccagaagtgcaactaaaaccaaggacagcagctgtatgatggtgaaagaacttctatgtactgcgaatgcttcagaatattatgctgaaaagcctcaattgagggctttttataaagaaccaaaggtccaaaacagatga

SEQ ID NO: 91395 - DNA, 1176 bp, Glycine max
  Peptide Sequence Number=SeqID_183080
atggcggttgcactatcgagttgcacttccttatcctccgtgctgttctccacagttaaattccgctactcactcagacacagacccatcgtcgcctctttccattgcaataatcacccactccgagtctcctcctcctcctcctcctcttcttcctccaaatccaatcgaaaaaaggaaggtgcagggcacaagaagcagtcaaaagatgagagacctgcaagagggaatgtgctcgaatcccaaccaacttcttctaaaccttttggcattcagaggaaaaataaggaccttatcttcgactccaaggatcagcaggttgaacagagtattttacaagattcggctttccttaatgcagttgtgaaggtatactgcacccatactgccccagattattcacttccttggcaaaaacagagacaatacacaagtactggaaggcaagattttgaaaaccttgactgtagagtagtcaaagtcaagaaaagaggggatgactcaaaatatgtggctaaggttttggcaagaggtgttgattgcgatatagctttgctttcagtagaaagtgaggagttttggagagatgtggaacctctcagattaggacgtttaccacatcttcaggattctgtaactgttgtgggatatcctcttggaggagacacaatttcagtgacaaagggagttgtatctcgtatagaggtcacatcatatgctcatggatcgtctgatttgttgggcattcaaattgatgcagcaataaatcctggtaatagcggagggccagcattcaatgaccaaggggagtgcattggagtagcatttcaggtcctcagatctgaagaggctgagaatattggatatgtgattcctacaactgttgtatctcattttttgaccgattatgaaaggaatggcaggtatactggtttcccttgccttggagtacttatacagaagctagagaatcctgcactacgtgcatggttgaaagtacagtctaatgagggtgtattggtacgtagagttgaaccaacttctgatgcaaataatgtattaaaggagggtgatgtgattgtcagctttgatgatgttcgtgttggtagtgaaggaacagtcccattcagatcaaatgagcgaattgccttccacttcctcattagtcaaaagtaa

SEQ ID NO: 91396 - DNA, 1230 bp, Glycine max
  Peptide Sequence Number=SeqID_183081
atggcggagggtaaggaagagagtaaatctagcgaggagagcgtgaagctgttcgtaggtcaagtgccgaagcgcatgtcggaagacgaagtgcttgcaatgttcaaggagctcgctttggttgacgaggtcaacatcatcagagacaaagccactcgtgcctcccgaggttgttgctttgtaatttgtccgtccagggaagaagcggataaggcggtcaatgcatgtcataacaagaaaacgctccctgggtactattctcctgattgggaagcatcctattttttgtgtccaattcaggcatctagtccgttacaagtgaagtatgcagatggcgaattggaaagattagaacacaaactctttatcggaatgcttccaaagaatatttctgaagatgaggtctccaatcttttctcaaagtatggaactataaaggatttacagattttaagaggttctcagcagacaagatgtgcatttttgaagtacgaaaccaaagaacaggcctttactgctcttgaagcaatcaatggaaagcatacaatggagggttcaagtgttcctttggttgttaaatgggcagatactgaaaaggaaagactagctcgaagggctcaaaaaacacagtcccgagtttctaatgcgccgcatgctgatcctcaacacccctcattatttggagccttgccaatgggttatgttcctccatataatggatatggttatcaggctcctgggggttatgggctcatgccataccgttttccaccagtgcagaatcaaccaggcttccataatatgaaccaagcaaatgcagtgaggcctgatcttggtcacagtatgaaccctagaaattatcctgcgcctcctgcaagttacattggctcttaccctgctgttccaggtgggaatagcaactcttcatcttcaggtgccagtaaaagttccagtggtcagattgaaggaccacctggtgccaatctatttatttatcacatacctcaagaatatggagaccaagagctcacaactgcatttcaaccgtttggtagagttttgagtgctaaaattttcgtagataaagtaacaggagtaagcaaatgttttgggtttgttagttatgatactccagaagctgctcaagctgccattagtacgatgaatggttgtcaattaggtggcaagaaattaaaggttcagcttaagagggataacaaacagagttaa

SEQ ID NO: 91397 - DNA, 1596 bp, Glycine max
  Peptide Sequence Number=SeqID_183082
atggaggaagcaagagttcagaagaacttcccggtgaagccgaagctgaaatcgatggccagaaccccaaagcaaacccctgaatcgaagtactggtcctccttcaagacccaacaaatccccaacctcatctccgtcccctccctcaccttctcccccacaccccctcactccttcgccgccgcacactccgcctccctcactctttacagctcccagaccctctcccccgctgccaccatctcctccttctccgacgccgtctcctgcgcctccttccgctccgactcccgcctcctggccgcctccgacctctccggccttgtccaggtcttcgacgtcaaatcccgcaccgccctccgccgcctcaagtctcatttccgccccgtccgcttcgtccacttcccccgcctcgacaagctccacctcatctctgccggcgacgacgccctcgtcaagctctgggacgtcgccgaggagaccccggtctccgagttcctcggccacaaggactatgtcaggtgcggagactcctcccctgtgaattctgaaatcttcgttacaggctcctatgaccatgtcgtcaggctctgggatgctagggttagggattcgaaatcgtcggtgcaggtgaaccacggcgcgcccgtggaggatgttgtgttcttgccgtccggagggatggttgcgacggcgggtgggaattcggttaaaatttgggacttgattggtggagggaagcttgtgtactccatggagagtcacaacaagactgtcacgtcgatttgtgtcgggagaattgggaaggattatggtgaagaatcatcgaatcagtttaggattatgagtgtggggttggatgggtacttgaaggtgtttgattatggatcattgaaggttacacattccatgaggttccccgcgcctcttttgtcggtcgcctactcgccagattgttccaccagggtgattgggacatccaatggagtgatctatgctagcaagaggaagatgaaggaaaaagagaaggaggaggaggagagtgaggctagcttggtttggagaactgctcctgtggagaatactgagaagaaagcggtgaggccttcgcattttaggtattttcatagagggcagggaaccaaaccgtctgagggggatttcttggttatgaagcccaagaagaagaagtgggctaagcacgacacgctgttgaacaagtttgagcatggagaggctctggtgtctgtgttgggaactatgaaccctgggcatgtggtggctgtgatggaggaattggtggctaggaagaaatttctcaagtgtgtctccaacttggatgtggagaagttggaactgctcttggaattcttgcataagtattgtaccatgcctagatattctagtttgttgatggggttcgccaagaaggttcttgaaatgagggcggatgatattagagcttctgattctgaagccatcaagagtcatatcataaatctcaagcgggctgttgcccaggagattcagattcaacagtcattgcaagagatacagggtataatttctcctttgttgaagattgctggaagatga

SEQ ID NO: 91398 - DNA, 330 bp, Glycine max
  Peptide Sequence Number=SeqID_183083
atgttgttttgggggaaatgtctgatatgttgttttttgttggcggggagaaagggttttttggatgatcagttcagccagcttcagaaactgcaagatgagagcactccagattttgtgattgaggttatcactatgttctttgatgattctgagaatctcctaaaaaacatggcacgttgtctagaacaagtgccagctgatttcaaacaaatagatgctcatgctcatcagtacaagggaagcagtgccagtattggtgctgctagagttaaaaatgtgtgcgccaccttcagagctttttgtgaggctaagaaccaggaagggtga

SEQ ID NO: 91399 - DNA, 788 bp, Glycine max
  Peptide Sequence Number=SeqID_183084
gcaagaccctcttctgccccacacccacttctccaccatgctcaagctcctcaacaagaacctccgcctcctcctccgccgtctccggtggccaattcgccgccgctcaaagtccaaagtagtagtgatcaacaagctcgggaagaacgccctaaaagcccaaaccgaagcaagcacgaatttttcctccatggttcatcccaacgcgcaattgggtactccgaaacccattcgggtcgcgaccttcaacgccgccctgttctccatggcaccggcgctcccgaaacccaaacccacgttcgaggaccaaaacggggtcgcttcgaaccccgaaaacctgaattcgcgatccaagtccacgaaggagcgtcccagaagcatactgaaacaatcgcaatcgcaatcgcagtcgcagtcagtgaagaacagagtaaacgacagcgacaccaacgtggggagcagacaagaggcggcgaggttggcgaaatcgaagatgagggtttccataaatttaccagacaacgagatatcgctgctgcgaagccgacaatcgagcttctcggaacacgacaaggcctcctcgaagtggacgctgatgttttggggctgcaagatgtgaaggccgaggaagagaatgggatgaagccattgtcggatttggcggcggcgctgggaatgaactacgtgttcgcggaaagctgggcacctgagtacggcaacgctgtcttgtccaaatggcccatcaaacgctggaactctcacaaaatctttgatcacactgatttcag

SEQ ID NO: 91400 - DNA, 408 bp, Glycine max
  Peptide Sequence Number=SeqID_183085
atggaaaaaataatagttagtgttcaaatgcacgagaggtgtgatgggactcaagaaatctcggggtaccgcacctatttgtacttgttccaacatgggcttcattggctaggggtgatgatggtgcaagccggcgcatctcatatagtgggttgggtcggttggtcaacatccaacccgataggcaaggtgttggctttgaaggtggtgcgctactgctctgctgttgtgcttatttgtggtggtgcttgtgtatctgacatgtcaaaagggggtgtgtcccttggcattgccatgcatgcctgtttgtcgaaaagcactgttattcccggtttggtgacctggccaggggatcatctgtcagttgtattgaccaaatgggacaaggcttctgtaagcgcttgttga

SEQ ID NO: 91401 - DNA, 3813 bp, Glycine max
  Peptide Sequence Number=SeqID_183086
atggtgagacctaattgcatatcatttggttacatattccttctccttctttggattattggaagacaacttgtcgagagaacaaaaagacagctttggcttccattgaaagtgtatgcaattttggtgtttatcttcatatatagcttgagcagcttctcaagcctagagatgtggttgtccaaattaatagatctctacttttatctgggatatgactcaaaagcatcttctttcgacaatgtttgggaatctctggcagtcttaattgttatgcaactttatagctatgagaggaggaagaacaagcagaacaggcaggatcacttggatcagttagaaccaggggcacttgggtttatcaggcgatttattatctggcacagccagaagatcttgttcattgctctgttttatgcatctttaaactcaattagtgcatttggtttcttgtatctggttggcctcatcttctgctccattttaccaaaaacttctagtatcccatccaaatcattcttagcatacacaggttttttggtgacagctgagtatgtttttcagatgtggggtaagcaggctaaaatgtttcctgggcagaagtattctgatatatctctctttttgggtttccacgtattccagcctggcttttggggtctagaatctggattgaggggaaaagtgctagtgattgtggcttgtactcttcaatacaatgtcttccgttggctggagaggatgccaaatacagttctaagcaaaggacagtgggaagaaccttgtcctttgtttgttcccacagaagatgtattcattgatgatgctatgtgcaatgaggaaagtaaatcatcatataattcaaatctgccgtctgcaataaaagaaggggtgtcaggcaagtcactgcaaattattacctctggtctttcccaagcacttgatactccatcctctaaaacaggagattcttctgacagtagcagtaaaaagtattcatttgggtttatttggggaagttccaaggagagtcagaagtggaataaaaagcggattgttgctttgagaaaggagcgatttgaaacacagaaaactgtcttaaaagtatatttgaaattttggatggaaaatacatttaatttatttggacttgagataaacatgatatcattactactggtaagctttgccttgttgaatgcaatatccatgatgtatattgcactgcttgctgcttgtgttcttctgaatcgacatattatatgcaaagtctggcctatatttgtctttttgtttgcttccattctcatcctggaatacttagccatctggaaggatatgttacctttgaattctcatgcttcaagacttattgttgatgatcccaggatgttgattagctactttgtggtattcatgctggcttgcttcaaacttcgtgcagatcgcctgcctagcttttcaggatcatcaacatatcgtcagattatgtctcaacgtaggaacacatttgtttggcgagatctatcttttgaaactaaaagcatgtggacctttgttgactatttgaggctttactgttattgccatctgctagatcttgtcctgatattaatattgattactggaactcttgagtatgacattttgcatcttggttatctagcctttgctctgatattctttcgcatgagacttgaaatactgaagaagaagaacaaaatattcaagttcttacgcatatacaactttgctgttattattatttctcttgcttatcagtctccttttattgggggaccaagtgctgggaagtgtgagacagcaaataacatttatgaaatgattggtttttataaatatgattatggttttcggattacagcaagatctgcaattgtagagatcatcatttttgtgcttgtatcacttcagtcatatatgttttcctcgcaagagtttgattatgtatgccgctacctagaagccgagcaaattggtgctattgtgcgtgagcaagagaaaaaagctgcatggaaaactgcacaattgcaacaaattcgtgaaagtgaggagaaaaaacaacagcgtaatatgcaggttgagaagatgaaatcagaaatgcttaacctgcaaacacaactccatagcatgaacacatccactaattgtattgatggattttctcacaacaatgagggtctgagaaggagaaggagtgtttctcttgcatcaaataatgacattggaatccctgataaagaagatcaggttttgggtagactagatcatacaataagagaggattctgtttatcctattaatctgcatgaaccatctgtttgtacaaatgtggaaactccatcaacagaggagtatatgaagcattcagtggattctgatttttgtgaaattactgaagtagacattgatactacttctagtgattcaggaaaaagggaaaaatttaaagggcaagcaaaagaaaaccctctcaagtctgctgtacaattaatcggtgatggtgtttcccaggtacagttcattggaaatcaggcagtcaataacctagtgagcttcctgaatatttcaccagaagattctgattcaaatgaacactcaaacattgaggacagcatatatgacgagatggagagtcagaaaactcagcatatatatatggatcgttcttcatctgtgcagtcagataagagttctgatgccgcaaggctgcagttgggaaggatctttcgttatatatggcaccagatgtgttccaataatgatgttgtatgttactgctgctttgttcttgtgttcttatggaatttcagtttgctatcaatgatgtatcttggggctctcttcttgtatgctttatgtgtaaatactggtccaagttacatcttctggattatcatgctgatctatacagaactttatattttacttcagtacctgtaccaaattgtcatccagcactgtgggttgagtatcgatcctcacctattacgagaattaggttttccaacacacaaaatcacatcttcatttgttgtcagttcattacctctctttcttgtctatttatttaccctcattcaaatctccataacacctaaagatggtgaatggatgtcttctactgacttcaagtttaagaggactgatctccatgcaaaagatgatcgtactagttataactggcaagatagagcatgggatctgctaaatcaggttattaacatggtaaaactgataatcataagcttttttaggtattggaaatcactcacacaaggagcagaatctcctccttattttgttcaggtgtctatggatgtcaacttctggccagaggatgggattcaaccagagagaattgaatctggaattaatcaggtgctcagaattgttcataatgataagtgcaaggcaaagaacccaaatctttgctcttttgctagcagggttaatgttcaaagcattgaaagaaaatggaataagtctttaactccagcatctgatgtggccaaggaaatcctcaaagctcagcgtgctggttttgtggaagaaatgggattcccttaccgcattctttctgtaattggtggaggcaagagagaaattgatctgtatgcttacatattttgtgcagatctgattgtattctttcttgttgccatattctaccagtctgtcataaaaaataaaagtgagtttctcgaagtgtatcagcttgaagaccagtttccaaaagaatatgtctttatgttgatgggcaggaagagtttttccataatatataaataa

SEQ ID NO: 91402 - DNA, 393 bp, Glycine max
  Peptide Sequence Number=SeqID_183087
atggggactgcatctggagaagttgtccctattaacttggaaattgaagccacttgtcggcgtaacaacgctgcaagaagaagaagggaacaagacaccgaaggaagcagtcacacatcacctcctctttctccacagcacgctgaaatggacggggaaccggcacgaagagtcaccttagaggatttctccaacaccgccactcctcagttcttcacgagcattgcaagaccggaggtgcaagccgcaaatatctcctacccgcattcccttattcagttaatccaaggaaatcttttccatggtcttccaagcgaagatccatatgctcaccttgcctcgtacatcgaaatatgcaacaccgtaaaaatcgttgaagtcccagaagatgcg

SEQ ID NO: 91403 - DNA, 1377 bp, Glycine max
  Peptide Sequence Number=SeqID_183088
atgaatatcttcaaatccgttttttccgaagacccggatcctccacgacccggatccaaccatgcatcgccagacaaagcaccggatccccattccccgccccgatcgaatgccaccgagtccgctgccggaggaggcggcggcgacggttggaacttcggcggcctcatcaaaacccttacatcgaaatcggaatccataattgagacctaccgtcgcgatctgcaggaattcggcaccggtttgaagaaagagatcgaggtcgcgcagggttctctcgggaccgtgggccacgtcatcgatgagttcggaaacaccgtcgtgaaaggaacggctcagatcatatctcaaggtaaggacgccatcctcgccgtcaatctcgattccgattccgatagtaacagcgccaatagaaagagcctcgattcggttcggtacagtaggttcgacgctcaggttcgtgctattcagggtgatgttagcacttactccgaggagcccgaggatttgaatgagttcaatgagtggaaattagggttttcgttggaggggaagggtgaggaaatggaggggcttttcagagagaatgatgctatggagagtgtttacaaaaaggttgttccaaatagtgttgataatgaaactttctggtataggtattattataaggtttataagctcaagaaagctgaagatgttagggttaggcttgtaagtggaatatctggggaagatgaggatttgagttgggatgttgaagacgatgagaatgacgatggtgggattagatgtgatgccaaacctgtgattatgaataaagaggttggtggtgaaaatgtggataatacccacttacatgttgatggcaatgaagagggaacaaagagattggatgtggaagaggagtctaaggaacaaaagaaagacaatttattggaaagtgaggaagttggcaacaaggtggataagtctgttgaagaatcacaagttgagaaatctgaatctgttggtgacaggggtggtgttgatgaggcatcgaagtcaaaagcggatgatggtgtgagcaagaatgattcgacaagtgaatccgatgagaaggtggtaaaggatagggaggttggtgatgagaaaacttctggtaaaggtaatgagtctttcacggttgaaattcagcaatcggcaaataaggaggaggaggaccttgggtgggatgacattgaggatcttagcagtattgatgaaaagaaaacaatgcagagtggtggcacaagcaaagttgatttgcggaagcggcttagtgctgcagaagaagacgaagacttgagttgggacattgaagatgatgatgatgagcctgctaaggcttcaagtgtttaa

SEQ ID NO: 91404 - DNA, 1245 bp, Glycine max
  Peptide Sequence Number=SeqID_183089
atgattccttggggtggcctcagttgctgtttgagtgccgctgctctttaccttctcggcagaagcagtggcagggatgctgaaattcttaaatccgttacaagggtcaaccagttgaaggaactaggtttgtgtctttttcgggagctgaagcctctactgtccccacacttgggggtgggggaactcttgcggcatgaacttggggttgagtttggtccaaactcaaattctaagatggtatcagaatctatgttagcagttgttattaaaccctatcaggcctcacactatcggactattatcaaaccacatgcttgttgggcctctcctagccagctgttggatatcccacttgactgcttccaggggccaaatgttgttggtttctggctagaaagttctatgtggttatggtttctgatcatgcttgggattccttacttttcagctcaactattagatgcagaaatattacccttgattgttacaatttctggaagagttagctctgaaaccccaattaactgcgagttcagtggtttaagaggtgtaatagttgaagaaacagcagagcaacattttcttaaacacaatgatgctggttcctggatacaagattctgctttgatgctatcaatgagtaaagaggttccttggtatctggatgatgggactgatcgtgtgcatgtggttggagctcggggtgctgctggttttgcattacctgttggaagtgaggcatttgaagagtcgggtcgctcacttgtacgtggaactttggattatctgcaaggtctcaagatgcttggagtcaagagaattgaacgggtacttccagttggaacttccttgactgttgttggtgaggctgctaaagatgatgttggggcttttcgaattcagcgaccccacaaagggccattttatgtctctcccaaaacaattgatcaactaattgcaaatctggggaaatgggcaaggtggtataagtatgcttctatgggcttgacagtgtttggtgcttatctgatagccaagcatgctattcggtacatattggaaagacggcgtcgcagcgaacttcaaagaagggttcttgctgcagctgctaagaagtcgggacaaaataatgatgttgaaaaggctgacggcttatcagatggtgttaaaaaggatcgcttaatgccagatttgtgtgtaatatgccttgagcaggaatataatgctgtttttgttccgtaa

SEQ ID NO: 91405 - DNA, 321 bp, Glycine max
  Peptide Sequence Number=SeqID_183090
atgagattgctcaatgatcttttggttatgtatgacggctatgattttgaagagtggctaaagaaatgtaaaaaggtcatgattgatacatttcctcgggaggatccattcagtattcttgttccaccaggatttgagtcattcgacatagataaggtggatgaattactgcaagaggttcgttctgaagagagtgaagtacataatgaaccagggtttgatgctgaatctgttgcaaatagattgaaacaacaggagaagcaacaaacaatacgccaagtagaagctctgctagatttagccattggtttgaactggtaa

SEQ ID NO: 91406 - DNA, 330 bp, Glycine max
  Peptide Sequence Number=SeqID_183091
atggccaaaaaatacggggtcaaatcaaagcatgaaggagatgaggatgtgtctgatttggaccaggcttctagagagaaggagaagagaaaaattgcatggttgcctcttaggactctgttattgaaaaatgctccagtaacaagtttttggatcaagcctgcagtatatcgttggaggtcacaaattgtggaaaacgctgaagttctgctggatgttcctctgataattcagaggacactctggaagttgttggatgaagattttggatcatcaacaaggagtgtgcaggtgaaagcagaaaatggtcttctagctctcaatcattaa

SEQ ID NO: 91407 - DNA, 129 bp, Glycine max
  Peptide Sequence Number=SeqID_183092
atggaggtaattgacgcaagtgttggtgatgcttatccgcgctataggggttgtataacacaatgtcaggaaactggatgcgttgggcaaagatgctttccaaactcttccgccatgtgtggtggttaa

SEQ ID NO: 91408 - DNA, 1479 bp, Glycine max
  Peptide Sequence Number=SeqID_183093
atggctgattcaacccatctcctactctaccaccaaaactcatctgattcaatcgttcatcatcaagattatgatgcacacaacctttcatctcttagctccacaatagacaagtgcattggagataaactcaactggacccaattcctccaagctcttctcatctcatgttcatggttctttgatggtcaacaagcattcatcactatcttcacagacgcacacccatcatggcactgcatcgacaatccatgcaactcagccaccaccaacatgtgcacccttcccaagtactcatgggcctgggatgggcccacgcatgcctccatcatctcagaatttgggctggagtgttcgagctccttcatcatgggccttccagcctccatgttcttcgcgggctgcttcgttggtgggcttgtattctccactctggctgactcctcattcggtcgcaagaacatgctcttcttttcatgcctcatcatgtccctctcttccttccttgccactttctcagccaacgtttgggtttactcagctctcaaattcctcagtggctttggccgcggcaccattggaactgtgacacttgtgttggtctctgaactcgtcgctaaagggtggcgtggcaagcttggtgtcatgggtttctcctttttcagtatagggtttctgaccctctcacccttggcctacataaaccaaggattttcatggagaaacctatatctatggacttctcttccatctattttatactgcggattagtccactttttcgttcccgagtctccaaggtggcttctcataaggggcaagaaagaagaagctatgaaaatattgaaaaacatcaatacatcaataactcatagtagcttaaagttcgctatatcacgcctgtcccttgaggaagaagtttggaatgcagatttgttctcggccctcaagattatgttgcaaaagaaatggtcttcaagaaggatattaacgattacagccatggggttaggcattggattggtttattatggcatgccactaggtcttggaattttgtcattcaacctttacctgagtgtcacatttaatgccttgtctgagattctatccgcattcctcacctacgtgcttctagacaagttcaataggagaagtatgatcttcattctcaccatcataagtggggtttcgagtgttttagcaaccatggaaggggtgataataatgagaaggctgcaaattgtgtttgaattgatatctttctcttgtgcttgcaccgcgtgtgatgttgtcctgatatacaccaccgagttgttcccaacttctatacgaaactctgcattgtcattggtgaggcaaacggtggcgttgggtggtgcatttagtccgagaccaaaggcaaagcattttgtgataccatggatgaagaagaaagcaattgctactagtgtactggttgagatgattttcgtatag

SEQ ID NO: 91409 - DNA, 394 bp, Glycine max
  Peptide Sequence Number=SeqID_183094
gccctttcgtctcgcgcgtttcggtgatgacggtgaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggtagtgcaattggtttgaattatggtttggtgtttggagtaggtggtggtgcgttttggactggtgatggtttcgttagacaaatgttgaaggaaaagaagataggagaagggtag

SEQ ID NO: 91410 - DNA, 759 bp, Glycine max
  Peptide Sequence Number=SeqID_183095
atggaaagtccaatttatgaaatctgtccatggaacgatgctccatataaggatgcagcagagaagactgatatgggctatatctctctgaacggatttctgtctcagacattacttgaaccacaacgtagcttggctaatttgattgacattggatataacggcaatcctactgcagcactccgtgtcactcatagaagatcagtagatcacaagaagcaaacaacagaaaaaaatgtgttccaatgctatgtttttggttctaaacatgctgggaaatctgctttgctgtattcattacctgggaaggtaactaggaaaattctcatattgcacgagatacctgaggatggactattgcaatttttgtcaaatcaggattgtttggctgcatgtgatgtagctgttttctgcgggacatatgaatcttcatggaagaaatccagagatttgcttgagaaggttgttagacaaggagaactaactggttatagaaccccttgcctccttatcgctgctaaggatgatttagctccattcccaaggacagtactagattcggttaaggttactcaggcactgggagtattcacaacaccctcatttgagcattccagaactcagactgcacagagaaagaagcaacaccaccagcttcttcaccactctcttatttttgccttagttggggctgctatggcagttgccggtttgacagcttgtcgtgtgcgtgcagtgaagaagaatactactgcttaa

SEQ ID NO: 91411 - DNA, 1629 bp, Glycine max
  Peptide Sequence Number=SeqID_183096
atgggcatggatcaggttcaggaaatatttagatccaaattgatcaatgttaatcagtttggagagcaaaactccgctagcggcggtggcggcggcgatatcaacgcgctcagcgacaagcaaataggcgcggtcttgaatcagggacttcaacgagcatgcagcctcgtagagcttgccgccgctggcttcgttgctagcgaggacgacgattccgacccatttggagacggccctgtcgatcaaagccaaggcgtcggtgtcggcgctgagaacctcggcgggatcgagttggaggacgagagtggggaccttgagctcgggcctcttgtagccgccggggaagagggttcggggctgcggcgggtcgcggggccggaagagttgctggttgaactgggaggaggagccattggagagcgagtttatgggaaaagcacgtgcgcggcgaaggggaagagaggaagagcgagagaagaagtgaacggtgacgaaggggatgtgacggaacaaggtaccatggattcgggaggaagagagatagggggatgggattggattgcgttttcggactccaatgttcctccttctacacactttgccactcatgctgccttcagcatcagtgccagtgccgccgagaagaagaaggtgctcatcgtgaataccaacagcggcgggcatgccatcattggcttttactttgccaaagagcttcttggtgctggccactcagtcaccatactcactgttggtgaagaaggctccgacaagatgaagaaacctcctttcaacagattctcagaaattgtgagtgccggagggcgcacggtgtggggaaatcctgcagaagtagggagtgttgtaggaggggaagtgtttgatgtggtcttggacaacaatggcaaggatcttgagactgtgaggccggtgattgattgggccaagagttcaggtgtcaagcaattcctgttcgtcagcagtgctggaatctacaaaccaacagatgaacctccacatgttgaaggcgatgttgttaaagcagatgctggtcatgttgaagtggagaaatacattgaagaaacctttggaagttgggcagtgttccggccacagtacatgattgggtctggcaacaataaagactgtgaggagtggttttttgacaggattgttcgggacagacctgtgccaattcctggctcgggactgcaactcagtaacatagctcatgttagggacttgtcctcaatgcttactctagctgttgagaatccagaagctgcaaatcagaccattttcaactgcgtaagtgaccgtgcagtgactctagacggaatagccaaactatgtgctcaagctgcagggcgccccgttaacattttgcattatgatccaaaagctgttggagttgatgcaaagaaggctttccctttccgcacctatcacttctatgcagaacctagagcagccaaagctaaattgggatggcaatcaaccacaaacctccctgaagacctaaaagaacggtttgaggagtacgtaaagattgggagagataagaagtccatccagttcgagctagatgataagatattggaggcgttgaaagttccggtgactgtgtga

SEQ ID NO: 91412 - DNA, 1140 bp, Glycine max
  Peptide Sequence Number=SeqID_183097
atggagtttagtaaagtcactctggagatcttctccaaactggagcacaaatggctctctcattgtaaagctaccaacaaaacccgcattctcagcattgacggcggaggaaccaccgccattgtcgccggcgaagctctcatctacctcgaggatcagatccgtctccacacctccgatcctcacgctcaggtagccgatttcttcgacatcgtcgccggcaccggcattggcgccatcctcgccgccatgatcaccgccggcgacgccttcggcaggccgctctacaccgccagggaagccgtccgtctcgtttcggagagaaactccgaactctacaagctgaaatccggcggaatcttccgccggcgccggagattctcctccagtagcatggacaacgcgttgaagcaagtgttccggagaaaggaggacggacggttgttgaccttgaaggacacgtgtaaaccggtccttattccttgcttcgacctcaagagttccgcgccgttcgtgttttcgcgcgccgacgcgtccgagtctccgagcttcgacttcgagctctggaaggtgtgccgagccacgtcagcgacgccgagccgcttcaagccattcgacttagcttccgtcgacggcaagacctcctgctccgccgtggacggcggccttgtgatgaacaaccctacggcggcggccgtcacgcacgtcctccacaacaagcgcgatttcccgttggttaacggcgtggaggatctcctggtcctctccttggggaacggatcgtcgaacgcaaaagcgtgcgagagtcgcacgtgctcaacgccgtcggtggttgacattgtactcgacggtgtttccgagaccattgaccagatgttggggaatgccttctgctggaaccgtacgaactacgtcagaatccaggcgttcggcttgggaaatgaagcaatgaagaaggaagagtttctccaagagaggggactcgaatcgttaccgtttggcgggaagcggttactgacggagactaatggaaacagaatagatagcttcgtgcaacgtcttgttgctaccggaaaaccaagcccgccgtcaagtccctgcaaggattccgccgtcaaccctctcgctaatggccgctag

SEQ ID NO: 91413 - DNA, 76 bp, Glycine max
  Peptide Sequence Number=SeqID_183098
atggctaatcttcatcccgtgttctccatgaattaccatatcagcacaacacaaaagaaacaccagcagccaaaag

SEQ ID NO: 91414 - DNA, 1584 bp, Glycine max
  Peptide Sequence Number=SeqID_183099
atgagagatgagaactcgaagaaaagcaagctttcatggcccaaaacgttggtcatgaagtggttcaatattaagagcaaaaatgaggactttcaggcagatgatgtcctctacgcaggtgtcaatgaagagtggaggaacaactgttcacagagggatgaagacgctatcaagagaaccaaaacagagagagcaaagaagagacactcagatagaatgcggcgaggtaaaattgaccgtgatgcagctcaggttacagatgtgcataactatagaatctttgctgccacttggaatgtagctggaaaatctcctccaagttatttgagtctggaagattggcttcactcttctgctcctgctgatatctatgttcttgggtttcaagaaattgtacctctcaatgcgggtaatattttgggcacagaagacaatggccctgccagaaagtggctagctcttattaggaagaccctgaatagtcttcctggaacaagcggggaatgccacactacttcaccgcttcctgaccctattgtagagttagatgctgattttgagggatcaatgaggcagaagacgacctctttcttacatcgccgatcgttccaatccttgagtcatagtatgagaatggacaatgagatgtcactaccccaagcatgccttgatcgtcgtctcagtgtctgtgatagaatgatgtttggtcacaggacaagtgattatgaccccagttatagatgggcttcctcggacgatgaaaacggccctagcgactccccagtcgtaacacattattcaccaatgacatatagatgttgtttctctatggaggatagagatagacagacagggaagtcaagatactgtttggttgctagtaagcaaatggttgggatatttctaacagtttgggtgaaaagtgatataagagatgatgttctcaatatgaaagtgtcttgtgttggcagaggattaatgggatatcttggaaacaaggaaggtgatgagctaaggagaaattcagatgtaatggagattctcagaaagacaaggtttccccgggttcaaggcatgggtgatgagagttctcctcagacaattctggatcatgatcgaataatttggctgggggatttaaattatcggatagccctttcttaccgtgcagcaaaggctcttgttgagatgcataattggaagctacatatagagcggagacaaggtcgggtctttgaaggatggaatgaagggaaaatatatttccctcccacatacaagtattcaaacaattcagatagatatgcaggtgatgagagacagtcaaaacaaaagagaagaactccagcatggtgtgatcgtatcttgtggtatggaagaggcctccgccaattatcgtatgttcgtggggagtcaagattctcggatcatagaccagtttatagcatgtttctggcagaagttgagtctattagccgtaaccgaataaagaaatgctctagttgctccagttcaaggattgaagtagaagagttgttgcctcattcacacggttacagttacactgatctgagtttcttctga

SEQ ID NO: 91415 - DNA, 5685 bp, Glycine max
  Peptide Sequence Number=SeqID_183100
atggatgccaaggtgaagcaaatgattaagcttattgaagaagatgcagattcctttgccaggagagcagaaatgtattataaaaaacgcccagagcttatgaaaatggttgaagagttttacagggcatatcgggcattggctgagagatatgatcatgcaactggagtgatccgccacgcccataagaccatggctgaagcatttcctaatcaagttcctatgatgttgacagatgatttacctgccatttctcctacggagactgagccacatactccagaaatgcgacacccttcacgtgcatttcttgatccagatgaaccacaaaaggatgcttctgctcatttccatgctatcaaaagaaatggtggttatactggtgaacctgattctcctttgaacaaaaccggtttgaaacagctcaatgatctctacatccctggagaacaagaaaatcttccaaagtttgctagaagggggctcaatttttttgagacgcaggaggagagtaatgagcaaaacagtggaagcaacaacactttgtctgagtctgaatgcgtgacaaaagctgagacagaaattttggccttgaagaaagccattgccaaattagaagatgaaaaggaagctggcttgcttcagtatcagcagagtttggagaaaatgtctaatctcaagttagaagtgtctactgcacaagagaattctcgaagactcgatgagcgagcaagtaaagctgaagctgaagttcaagccttgaaggaagcccaaatcaaattacaggctgaaagtgaagctagtcttcttcagtaccaggaatgcttggagaaaatatctaatctggagaaaaatatttcttctttgcaaaaggaagcaggagaacttaatgaacgagctactaaagctgaaactgagactgagtccctaaagcaggaacttgctagagtagaagctgaaaaggaagctacccttgttcaatataaccagtgcttggagacaatatcaaaactggaggagagaataaaagaagctgaggagaatgcaagaaggattaaggagcatgccgatatagcagaaaaagaaatcgaagctttggaattacaagttactaaacttaatgaagaaaaggaagatgctgctctccattatcagcaatgcatggagataatttccagtttggagtataagctctcttgtgctgaagaggaggtgcataggctaaattccaagatagttgatggggttgaaaagttacagagttcagaacagaaatgtcttctcttggagacatcaaatcacactctgcagtcagaattacaatctttggcacaaaaagtggggtctcaaagtgaagaacttaatgagaagcagcaggaattgggtagactttggggttgcatacaagaggagagactgcgattcattgaggctgaaactgctttccaaactcttcagcagttgcattctcagtctcaggaagagcttagatctcttgcttctgaacttaacagtaaagtggaaatactggggaatgtggaatctcgtaagcaggctttagaggatgaagtacacagggtgagtgaggaaaacaaaattctaaatgaggtcaaaatttcttcatctttgtctataaaaaatttgcaggatgagattttgaatttgagggagacaatagagaaagttgaacaggaggtggagcttcgaattgatgaaagaaatgctcttcagcaagaaatttactgtcttaaagaggagcttaatgatgtgaataaaaaacatgaagccatgatagaggaagtccggtcaactgacttagacccacagtgctttggatcatctgtgaaaaaattgcaagatgagaacttaaagctgaaggaaacatgtgaggctgacaaaggagagaaagaagctcttttggtaaaattggaaaccatggagaaacttctggagaaaaatactgttttagagaattccctttcagacttgaatgctgagctggatagcgtcagaggaaaggtaaatgtgttggaagaaacatgccaatctctactagtggagaaatcaaatcttgctgctgagaaggccaccttgttttctcagttacaatccacaactgaaaagctggagaagctctcagaaaagagcaacctattggaaaattcactatttgatgtgaatgctgaacttgaagggttaagggtgaagtccaaggtattagaagacacatgtcgatcacttgaccatgagaagtccagtatctgtcaagagaaagaaaccttagtttcacagttgaacataactcatcaaacactgaaagatcttgagaaactgcacagtgaattggaattgaagcatttggaactaaaaggagaaagggagtctgcacttcaaaaggtagaagagctactagtttccctatattctgagagggaagagaattccagagttttgaaattgaatgaagatgaattggctgagaaggaattacaaattcttattctacaagaagatgcaaattgcaagaaaaaggaatatgaggaggaactggacagagctatacatgctcaacttgaaattttcatcttgcagaaatgtattgatgatttggagaaaaagaacctctcccttctagttgagtgtcagagacttttggaggcttccaaaatgtcggacaaaatgatatctaaattggagactgaaaatgttcaaaagcaggttgatgtgaattctctgtctgagaaaattaaaatactaaggattggcttgattcaggtgttgaagactcttgacaataacagtgggcatttcggtgaggatatgcttgaagaagaccaaatgctcctgaaccacatatatggaaaacttcaggagaggcagaaatcttttgacacaattttcaatggaagccaacaaatggccattgagaattcaattctgattacattcctagagcagttgaaactaaaggtggaaaatcttgtgacacaaagagacacccttgatgaggagttcaatatccagtctaagcagttcttggcattgcaaatagaggtccaaaagatattgcagaagaatcaggagttggagttgacaataagcaaaggagaagagagaatggaagtaatgacaattgagacagacaatctacgaaagcagttgtcagacttggaaaagagtcacaacaatttacaggaggatagttgcaagatattggaagagaagaagtccttgacaagaagatttctagatctgggtgaagagaaaagtaacttggaagaagaaatatgcgtcatgatccatgaggcaatagctcaatctaatctttccctgatttacgagaatattatctttgaaaaactcatggaacttaaagagctaggtgaagatcttgataaacattgttcagcaaataatgaccttgatgagagattaagagtaatgatgtgcaaattagaaaatgcagaaatggaaaattcacatcttaaagagtcattcgtaaagtcaaatgttgaactacatttagttgaatctatcaatggtcaattgagctgtcagattagggatgaaagggagatgttgcatctaaaggaaaatgaacttttggaagcagctgagatgtttcatgttttacatactgagaaaacagaattgcaaagaatggtggaagatctgaagattaaatatgatgaagctagggtgatgcttgaagaacaggctaatcaaattttgaaattgtcctcagacaaggatcatcaaaatgaagagctcctatgcctgtctgaagtgaatcagaagttggagtctgaaatggggtacctacgtcaagagcttggagaaactaaactgagggaaaagaagctaggtgatgaagtacttaagggaacaaatgagattgaacaatgggaaactcaggcttcaacactctttgctgaactgcagatttctgctgtcaatgaaacattatttgaaggaaaggtctgtgaactaaatgagatgtttcgtgttttacatactgagaaaacagaattgcaaagaatggtggaagatctgaagactaaatatgatgaagccagggttatgcttgaggaaaaggctagtcgaattttgaaattgtcctcagacaaggatcgtcaaaatgaagagctcatatgcctgtgtgaagtgaatcagaagttggagtctgaaatcgggtacctacgtcgagagctcggagatactaaactgagggaaaagaagctaggtgatgaagtacttaagggaacaaatgagattgaacaatgggaaactcaggcttcaacactctttgctgaactgcagatttttgctgtcaatgaaacattatttgaaggaaaggtttgtgagctagctgatgcatgtgagaatcttgaacgtagaaactactccaaagacatggaaagtgagcatctgaaagaaagagttagcgagctggaagttgaaaatggaagactgtgtgaacaattaattgcttatgtccctgctgtcagtgctttgaatgattgtataacatctctggagatgcagactcttgcacatgaaaagcctcatgaccatgaagaatcaaaggtgaatagtttggtgaataatgaatgcactgaaaatggtcaacaaacagatgaagatcggactgttgtggcaccagacgcactcccttacttccaagacatgcagagaaggatcaatgcaattgcaatggcagttaagcaattaaatgaaagttttaaatctaagcatgtagagaacatgcaagcaagcaagcatgttactcaagcagatcaagcaaggccagataccccggttaccgagattgaagttctgccaaaagacatcatgcttgatcaaatatctgaatgttcatcatatgggataagtaggaggagagaaattcttgaggctgatgatcagatgcttgagttgtgggagacagcagataaggatgccgcaattggcaagcaagctgaaaagacacagaagatggttgctgaagctgctggcaatcatcaaagaggagcaaccatggaactcagaaataaatatccttcaacagattccttggtggaaaaggagttgagtgtggacaagttagaggtctcaagaagattgacactaccacgcgaagaagggaaccagagcaagattttggagagacttgattctgatgcacagaagttgacaaacctccaaatcaccgtacaagatttgatgaagaaggtagagattaatgagaggagcacaaagggaaaaggtgttgagtttgatgaggtgaaagggcagcttgaagcagctcaggagaacatcacaaagttgtttgacaccaaccgcaagttgatgatgaatatggaagagggtaccttgtcttctgttgggaaggatgcagcagagtcgggtgaaagtggaagtgtcagcagaaggagagtttcagaacaggcacgtagagaatcagaaaaaataggacaactgcatttggaggtgcaaagactgcagtttttactgctgaaactaggtgatggaaaagaaatcaaagagaaaacaaaaatgactgatcgaagtccacgagtgcttttgcgagattatatctatggtgggatgagaaccaacaaccaaaagaagaagaaaaagctacccttttgtgcatgtgtgcgacctcccaccaagggagattga

SEQ ID NO: 91416 - DNA, 690 bp, Glycine max
  Peptide Sequence Number=SeqID_183101
atgggtagctcgagggatttggcagtggggactgtggcggttggatcgcttctgatgggttcgatgttgagtaatgccgttgatcccaatgaagacccaaagctttacctccacctggctttcacagctacattatttgctggtgtttttcaggctgccttgggtctgtttaggttggggttgatcgtggattttctgtcacatgcaaccataatagggttcatgggaggagcagccacggtggtgtgtctgcagcaactaaaatcgattcttggccttgagcatttcacccatggagctgatatcatatcagtgatgcgctctgttttcacccaaactcatgagtggaggtgggaaagtgctgtgttaggatgtgtcttcattttcttcctccttagcacaagatacttcagcaaaaaacgaccaaggtttttttgggtgtcagcaatggcgccattgacgtccgttatattgggaagtctcttggtttatttcactcacgccgagaagcacggtgttgaagtgataggagaactgaagaagggtttgaatccaccatcactcacaaatctggtatttgtgtcgccttacatgactacagctgtcaaaactggcattgtcgttggcatcatatcacttgcggtgagtgtacctctcaaactcaattactttgtcggaatgcatgcctaa

SEQ ID NO: 91417 - DNA, 246 bp, Glycine max
  Peptide Sequence Number=SeqID_183102
atggcacctcagacaccttataaggataagctacttaaccatgagggttccatagagaaggatggggttgtgtcagacgagctggcggaccattatatcattgttcagaggtggcgtcccttcttccttataaatgctgagaaggtcaataaagtggtttgtggatcagaatccctaggttacctattgaactctgcaatgataggttcttggggaggattggttcaacattcgggaccttactaa

SEQ ID NO: 91418 - DNA, 1224 bp, Glycine max
  Peptide Sequence Number=SeqID_183103
atgttccctgcagttatgtccaattccaattccttgtccgaagaggccactgtctcctgtggtacaagaatcgctggactcaatcacgttatcacaacaaccatttctccagaacaacctctaaagatcaagaaaaagagaaacctccctggaaaccctgacccagatgctgaagtgatagctttatcaccgaagactcttctggctaccaatagatttgtgtgtgagatctgcaacaagggtttccagagagatcagaaccttcagcttcataggagaggacataacctcccgtggaagctgaagcaaaggagcaacaaagaggtgaaaaagaaggcctacgtttgccctgagccttcatgcgttcaccacaacccttcaagggctttgggggacctcactggaattaagaaacactactgcagaaaacatggggagaagaagtggaaatgtgaaaagtgctcaaagatctatgctgttcagtcagattggaaagctcactctaaaacctgtggtactagagaatatagatgtggttgtggaacccttttttccaggaaggacaacttcataactcacagagcattctgcgatgcattggctgaagaaagtgcaagactctcagcaaaccaactagccaccaacaccacaaatccattagttcaatccctcttccttttcccaacccaacaacacaacaacaatttcatcaatccatgggaccctaaccctaaccctaaccctaaccctaaccctagcaaccttaccactctccacaacaacatcaaacctgaatctcacaacttccacatccccaacaccaccaccacctccactgccaacaacaacatttcttcttcattccttcatcatcatcaacaccccaataagagcatgataacctcacccttccgtgacctccacgagcgcacgcaacccccctccaacgctgccacgtcagcacacctctcagccactgcgttgctccagaaggccgcgaccgtgggtgccgccgccatcacgggacccactcacgtgactcagctcagcatggccgagctaggaaccgagacgactcatctggactcagtgccattgccgcccgatcaacgctacatgagcatgagaggcatcaatagtaacaatgacgcctcacgagggactttctcggcctcaccaacggcggcgcggttgacgttagcatcgacgtcaaggatatgctga

SEQ ID NO: 91419 - DNA, 1248 bp, Glycine max
  Peptide Sequence Number=SeqID_183104
atggaacacaacctcacaatgaagtgtcgtagaaatgaaaaccttctaaccagtggcactcatttgccagaaagccctcgagtaccaatggagtttctgtcaagatcatggagtgcctcttctcttgaggtctctaaagcccttacacttccaccacctccacctctttcttcttacataccttccaagcctcctaatgcaccctcttctgtgactaactccatttccgaagaaacttcagaggaattctcaaccatgtgtggcaaccagttctcttttgcttcctctgccacctcacaacttgtccttgaccgcataatgtcacagtccgcaagagaggaagtgtctccattaacgtcaggtagattgtctcatagtagtgaacctttgaacggtggtgcttctttaaccggaacggatagtccaccaatttctccttctgacgagtttgacgatgttgtcaagttttttcgagcaaacaattcgattcaccccttgttcaatggtggacgagccatgagtggtgctacagggaatgccactccttgctccggacctaaaacagttggaagatggttgaaagacagaagagaaaaaaagaaagaagaaaacagaacccacaatgctcaactgcatgcttcaatttctgttgccgcggtggcagctgcagttgcagccgtcaccgcggcaacagcagcctcatctgcagctgacaaggatgacaagatggccatggctgtggcttctgcggccacgttagttgctgctcagtgtgtggaggctgctgaagcaatgggagctgagagagatcaccttgcttctgtggttagctctgctgtcaatgtccgttctcatgatgatatcacaacacttacagctgcagctgccacagctctacgaggggcagcgaccttgaaagcaagagcattgaaagaggtgtggaatattactgcagtgacgccaattgagagtggcatagggattggaatatgtggtaaaggcaataacagtaattctagtaccagtgatagtggggagattatcaatggtgaaatttttttgggtgcctgcagccaagagctccttgctaggggcactgcattactcaaacggacacgtaaaggcgatcttcactggaaaatagtttcagtttatctacatcgaacaggccaggtgatgctgaaaatgaagagcagacatgtagcaggaaccattaccaaaaagaaaaagagtaagctattagcctag

SEQ ID NO: 91420 - DNA, 5880 bp, Glycine max
  Peptide Sequence Number=SeqID_183105
atgtccacttcaatcctcactcctcttcctctcaagcccatctctgtcaacaccctcaataaaggaacactcaaacccgcttttcaatccttgaccctcctttctactcacccactcgcaaccccctcacgtctcgaacacgcgcattctctcctcctcgacctctgcgtcgccgccaaagccctcccacaaggccaacagttgcatgcccttttgctaaaatctcacctttcggcgtttctggccaccaagctcgtgctcatgtacggaaagtgtggctctttgcgcgatgcagtgaaggtgttcgatgaaatgagtgaaagaactattttcagctggaatgccctgatgggtgcgtttgtgtcaagtggcaaatacctcgaagctattgagctgtataaagatatgagagttcttggggtggcgatagatgcttgtacttttccctctgtgcttaaagcgtgtggtgctcttggtgaaagccgcttgggggctgaaatccatggtgtggcggttaagtgtggatatggtgagtttgtgtttgtgtgcaatgcacttattgctatgtatgggaagtgtggtgatcttggtggggctagggtgttgtttgatgggattatgatggagaaagaggacactgtgtcttggaattctattatttcggcacatgtagcggaagggaattgtttggaggcattgtcgctttttagaaggatgcaggaggttggtgttgctagtaatacgtatacttttgttgcagctcttcagggtgttgaggatccctcgtttgttaaactgggtatggggatacatggtgcagtattgaaatctaaccattttgctgatgtctatgttgccaatgctttgattgctatgtatgcaaaatgtggtcgaatggaggacgctggaagagtttttgaaagtatgctttgcagggattatgtgtcgtggaatacattgctttctggtttggttcaaaatgagctgtatagtgatgctctaaattacttccgggatatgcagaattctggtcaaaagcctgaccaggtgtcagtgttaaacttgattgcggcatctggccgatcgggaaatttattgaaagggaaggaagttcatgcctatgcaataagaaatggattggattctaatatgcagattgggaacacgttggtagatatgtatgccaagtgttgttgtgtgaaatatatgggccatgcttttgaatgtatgcatgaaaaagacttgatttcttggactactatcattgctggctatgctcagaatgaattccatctggaagcaataaatttgttccggaaggttcaggtgaaagggatggatgttgatcccatgatgattggaagcgttttgcgggcttgcagtgggttaaaatctagaaacttcatcagagaaatccatggttatgtttttaaaagagatttagctgatataatgctacaaaatgccattgtcaatgtatatggagaggttgggcacatagattacgcaaggcgtgcatttgaatcaattagatcgaaagatattgtgtcttggacaagtatgattacctgttgtgttcataatggacttccagttgaagctcttgaacttttctactctttaaaacaaactaatattcaacctgattctatagcgatcattagtgcactctctgccactgctaatttatcttcattgaagaaagggaaggagattcatggatttctgattaggaagggtttcttcttggagggaccaattgctagctctctggtggacatgtatgcttgctgtggaactgtggagaactcaagaaagatgtttcattctgtaaaacagagagatctaattttatggacttctatgattaatgctaacggaatgcatggatgtggaaataaggccattgcgttattcaagaaaatgactgatcaaaatgttattcctgatcacattacctttttggctttattatatgcatgcagccattcagggttgatggttgaaggtaagaggttttttgaaattatgaaatatggatatcaattggaaccctggccagagcactatgcctgtatggtcgatctcctcagccgttctaattccctggaagaggcttaccattttgtgagaaacatgcctatcaaaccttcttctgaaatctggtgtgctcttcttggggcatgccacattcattctaataaagaattgggagagcttgcagcaaaggagctcttacaatcggatacagagaattcaggaaagtatgcactgatatcaaacatctttgcagcagatggaagatggaatgatgttgaagaagtgaggttgagaatgaagggaaatgggttgaagaaaaacccaggatgcagttggattgaggttgacaacaagattcacaccttcatggcaagggacaagtctcatccacagactgatgacatttatctaaaattagctcaatttacaaaacttttggaaaaaaaagggggctatatagctcaaactaagtttgtattccacaatgttagcgaagaagagaaaacacagatgttatatggacatagtgaaaggttggcacttggttatggtctgcttgttacaccaaaagggatgccaataggttccatcattttgaaagaggactctgttcatgtggagatttctggtgaataccttgattatgtgaaaatagattatagcacacttctctggttccttcctgttactggcagtttgagatggcttgaaatctcatgcaagatggttaatcttctgcctgttttacaggctagtctgcaagaatcatcagagatccatggtggtcgtggcggtgaaacattcagagattggcaaatggaactctcagaagaatggaagccattcttcccaactggcgcatccaccgtatctcctattcttcaatcccattcccgtaattctctccctctcggtcccctcgtcttcaaccctaaccctaaccccaaccctaattccctctcccttctcttctcttccccctccctcttgccctctctccatctccctccccatctcttaccctcccgcttcctcctcacttcccaccctcattccattcccccctccaccgcttcctctgtcgcctccctcttctcttcccccaatcaaaacgacgccgcttccctcctcctctgcaaccgcctccacctcctgcattaccctaacagtccaaacgccatcgttttcttccccaccggcgccaacgacgacaaactcggcttcttcattctccgcgtcaaggattcgcgcctcgacattcagctcgaagccaacggcgacgttttttgtgtttacaccggctccgcgcatcgtatcttgaacatttcggtgaatcccgtcgccgaattcgatcgcttagatgattctaatgttatcgggtatttgttggcttccactctctattccgttcattggtttgcagtgaagcacaattccattttggatcgacctagcgtgttttatttgggtggtaaaacgtttaagacttgccctgtggctcatgcttgttggagtcctcatgtaatggaagagagtctcgttttgttggaaaatggacagttattcttgtttgatttggagtctcatgacaccacaggtactgctttcaagggaactaggttgaaagtaccttggaatggtttgggtttttcgggaaacaacatggtgtggttgagttgtgagtttagttggcaccccagggttttcgtcgttgcgcattccaacgctgttttcttggttgatttgaggctgaaggagtgtagtgtgagttgcttgatgaagattgaaatgctgcggatgtatgctccgggtgcaaatgagcgatttcttgcactgtcaagggctggtcctgacgacctttacttcgctgtggcttctaccagtttgttgcttctctgtgatgtgaggaagcctttggtgccggtgttacagtggatgcatggtattgaaggaccttgttttgtgtctgtattgagcttgtctgatttgaggtcccactcgagggatgatgcttttaagttggcttctgaatctgggttttgtattatgttgggatcattttggaattgtgagttcaatatcttctgctatgggtctatattgccgtttcgtaaaggatccattacttcgaaggttaacccaaacgtctgtgcttgggagcttccatttgaaatcaatttatctggtcatgagtgtcattgtgggagttgtctcttaaggaaagaattctcaaaggatgctcttcctgagtgggttgattggcagctaaagaaagagatagttttgggatttggggttttaagcaatgaccttgctgcgttactgtgtgaaccagatgaaaatgggggttttacacttataaggctaatgtcatcaggaaggtttgaattgcagagatatcatgcctgttggacgaaggctagaaacatgaaagattgccatgatcaagtgttttgtttggacagacacttactgtaccctgagagtgatgagaaatacaaatttccgaaatattttcactacttaaaattgaattacctttatgcatatgcaaggggtgatctttcccgatttctggttaaaaaactagagaagaactgtatgaatgctcaggaccaggagcccttttgtgatgaagtgcatgagttattgtgtgagaaattaaatgcttgtgggtttagccaatcaaaatcatgtccagcagttacttctgtttttaatgatgtcaagctaccagcaagcttacatgaggttgctttgagaagattgtgggctgacttacctatggaactattacagttggcatttttgagttatgttgaatgtcataaagttgttggagacctgcaccaaaataaggtagctttggaattcttagctgttccagaccttcctcaattgcctccattctttttaaggaaatcatcaccccacagcaatgatgacattgtgggtccagttattccttttcctgttctacttgtgcttaatgaatttcgcaatgggtactcaaatttggaaggagatgaattttcagtagaagcagagcttggcctcaaatacaaagaagtcatgcaggtggctggtgagatcgctgattcagcttatggccctgcacaccttgatgatcatgtagtctcccttgccgaggatggagaggaaacctgggttggttcttcgaaaccaaaatcttttttgttataccatccagttgcattcaactcatctgccaccgaccttgcacaggaaaagtttgtttatagcaatacaatttatgatacattcatttctcatgttccagagaagaagtccaatgagaagactgagtctgttggacaagagatatttgatgatctttgccctgttgagttgaggtttgatgcttctgtgaagaagcttgaacctcaagttatggaatctggttttgggaagctccctatttttgaagttgaagctacaattgatattgccttggactgcatggcatctttattgaagaaagttgaggctaatcaagcttcattctgctcagctagttgggtgactatgatattcccttttctggtgtctgatgctcatcctgaagaattaggcatgttggttgaagttttgaaaagtggaatggttaccagtgcttcaggatcccaatatcgactttcccttgatgcaaaatgtgattatgggaatattggtggatcctgggatgatggtggggacttggaccaatcttcattcaatgtttacattaaggtgtttacgtacctgatgcatgttgtaactgctggagtatctgacaatgctattaatacaatgaagttgcatgcaatatatctgacatag

SEQ ID NO: 91421 - DNA, 1083 bp, Glycine max
  Peptide Sequence Number=SeqID_183106
atgaaggatgtggagcttgatcaattgtatgtcaagagaagggagcaattgaaaaagcttgttgctagcataatcactccaaaaattgtacagggaaagactctaaacgggaaggagtttgtctcctttctggagcagatacttgaagccttgaacaaaggagagattccatcaacaggctctcttgtggaggttttcaacaagaatattcttgagaaatgtcttaagttatacagtgaaaagatggcgaaattagttctacctcttcctgagaaatctctgcaaggggcccatgataggtctagagatgaagtcacaaaagtctttgatcagcagcattttggtcgtcaccatgctaagaaatcatttatgcagctggatgaagaaatacaacaggtgtataagaatgttgttttgcaaaatgagtatcaatcttcaaggctctgtgaagcgctgtacaccagatgtgaggacaaaatggatcagcttcaagttctcaaacttccttccttggcaaaatttaatgcagatgatggggaagtctcggtctctgtttataaaggagtacaatcacaggctcttcaattggttggtggccttctccctggttatgagtcactttactataacccagtttggcattttatagttgcaacttgggaaactgttgtttacagcccaatcctggatcttgacaggacttcaagaagacagtgggcaatgctgggcttctcatatggagaaatatttctgtcgcttggtgctactgctgctctgatagggccaaaggatttaccaatcatatgcagaacagcaggaaggctagctggtcgagctattggatgtgtacaattggctcgtggtcagtttgacactgttatgcagcaatctcaagctcgccgggttcataaggaactgcaagacacaatggctcagctagatgccattcatcatgaaattcgaagtgtatcaatcataaatgctggccctttgacgcggaggcttgtggataatcctgaccagacatctatctcagatgctattatttacatgatttgttttggaatttggattatagagtag

SEQ ID NO: 91422 - DNA, 186 bp, Glycine max
  Peptide Sequence Number=SeqID_183107
atgaatgaacattcaaaaagtcacacgtcggaatggaaaagaataagagttaagaggaggcgccacttcaaggagaagatgagtcaagaagaagttcaccaccatgaagtcatggataagaacttgaaggtaggagaagatgagtggagggagaaggagagaagttgtgcctcaaaagaggtctga

SEQ ID NO: 91423 - DNA, 471 bp, Glycine max
  Peptide Sequence Number=SeqID_183108
atgcgaggtagagagagagagagagagagagtgagagatagagagagaaggttagacagagggggagagagagggaatgtgagtgagacagagacagtcagggtgagggagaacaccaatcggagggaaacaccgagagtgagtgattctgtgagagagaggaaccttgccaacgaccgtttcgttaagtatgacgaagcgcctacaagagctaacgtatatgagtggcaaactgtgagccataggaagcatagaggtgcggccaaacagacacatggcgggaacggacgtcggcagcagtatcaccggagaaactggagggatgatgcagacattacctccttttatttcaccaatttctcagaggaggtaaccaagatggagctatggagccacttcaatcagtggggggaagttaaagaggtcttcatccccaatcggaggaacaaggaggggaagagatatggtttt

SEQ ID NO: 91424 - DNA, 2415 bp, Glycine max
  Peptide Sequence Number=SeqID_183109
atggctgaggtggtgggtacttttattttgatgttctgtgtgtgtggaatcactgcaagcacacgattccaaaatggtgcagtgggccttctggagtatgcagctacagcaggattaacagtggtggtgattattttctctatagggccaatatcttgtgcgcacgttaacccagctgtcacaatagcctttgcaacaattggtcaatttccatggttgaaggttccagtttacataatagcacagacagtaggttctatgtcggcaacatacgtaggtagccttgtatacggcataaaatcagatgctatgatgaccatgccactccaagggtgcaactctgccttctgggtggaggttattgcaactttcatcatcatgttcctcgttgcagctttgacatctgaatctcaatcagtgggccatttatctggctttgttgctggaatggcaattgggcttgctgtactaatcacaggcccagtctccggtggatcaatgaatcctgcaagatcattaggtccagcaattctctcatggaaattcaagaacatatggatatacatggtagcccccagtggtggagctatagcaggagctgcaatgtttcgtttcctacgccttcgagaccaacattctagtactttgtcctccccaaacatcattgatgttggtcgttccatacccttttgctcaaagtataatggcaagcccacattcacagagatcgtggtggcttcctctattgggttgatatttgccgcagcaatgcattatcgcgttaaaacaaatagggatcgacagatcatgccacgtctgagaaaatcaaaggcaaaccaaaccccaaagcttgaaaagttctctcattacgtagctaggcaaatggggttgaaagacaggagaagttgtcctcttctttgtaaattggcttctgaatacataaggaattcagaggattgtgaagatgatctctacgccttcttcgagaacgaaccagatgcggattcactttcagtcaagcttgtggaggagtttgagagatgcattcttagttactttgcattccattggacccatggtgatgttttgataagtcaggtgtttagctctgaagttgaaccaaaagcgaagctcaggcacatagttatggcggcaactagggaacaaaggttcgagagagtgaccaagaatctgaaggtggctagagttttcaacacattagtggaagagatgaaagcaatgggacttgccacaaatgatgactctcaatgcacagaggtgatggctccagtagcacactgtgataggagcccagtgcttcttttcatgggtggtggcatgggagctggcaagagcactgtgcttaaggacattctcaaagaacctttctgggcaggagcagcaggtaatgccgtaatcattgaggcagatgccttcaaagaatcagatgtcatctataaggccctcagtgcaagagggcatcaggacatgattcgaacagctgaactggtacaccaatcatccactgatgcagcctcatccctcctagtaacagcactaaatgaggggcgtgatgtagttatggatggcacactctcctggttaccatttgttgtgcagacaataacaatggctagaaatgtccaccgccgccgttaccgcatgggacctggctacaaggtaaacgaggatggaactgtgaccgaaaactattggcagcgaattgagggggaagggccagaactagttggaggcaaaatgagaaaaccatataggatagagctggttggagtagtatgtgatgcttatcttgcagtcattagaggcataaggagagctatcatgtgtagaagagcagtaagagtgaagtcacaattgacatctcacaagagatttgctgatgcatttctgacttattgccagcttgtagacaatgcccggctatacagtacaaattctttggaaggcccacctaagttgataggatggaaagatagagacaagacattgctcgttgatccagatgaaatagattgtttgaagaggatttctacgttgaatgaaaaggccaacaacatatatgaactttacaagcaccccaacccaacttgtgaagctggatcgatatggaaagacattgtactatctccttcaaggttgaacatccaacaagagctgaagtattcaatccaaaagccttacccttgcatatgcaaagaggctgttttcggattcgaacccatgaccaacaagtcaccaaggcacaactttaccgctgcaccagggctcgccctcaaaaacttcgtaccccattgcccagaggctcttcgctatgcgaaggtatgggggagggatgttgtacgcagccttacccttgcatatgcaaagaggctgtttcctgatttgaatccatga

SEQ ID NO: 91425 - DNA, 621 bp, Glycine max
  Peptide Sequence Number=SeqID_183110
atgttgtttcatgagtttggtttcatagctgctgggatgtctggggaagtttttgatggacaagatgcaggctatgtgcctgagaaccctgagtttccacaaaaccattctgatgaacacgatggaggaaatgtgattgatgactctgggttcccgcagctgcagcctgatgaacatgatgctggagggtttccgcagctgcagctgcagcctgatgaacacgaaggcggcaatttggctgaggatgccaatcatcctgaacataattttgacgggaatgatgttgaaggtttgcctggacctgattttcctcctcaagagcatgcagaggaacaacatgttggaggagacgtgactgagaattttgcctctgaggaaaagcaggaacctgaggaggatttgaaaggaggtgaagtaaagaagtggccagggtggcctggagagaatgtttttaggatgttggttcccgtgcaaaaggttggcagcattattggacgaaaaggagagtttattaggaaaattactgaagagactaaggctcgtataaaaattcttgatggtcctcctgggactgcagaaagagctgtgagtatactcttcagtttcttgttattcacgtag

SEQ ID NO: 91426 - DNA, 675 bp, Glycine max
  Peptide Sequence Number=SeqID_183111
atggtttactccttctatgacaaaacctcttcttcttctggctccgatatttcggggttgttcaatcctactttgcataaccttggagcttgcaatgacttgtcatcatcaccacattctttggtatttgagagtgataagggagagctggtgaagtgccttgcagctgcaaaggtagggaagagtgagatttgtgaggccaaagctttggctgctttgaagaaccacagtgaagcagagaggaggaggagggagagaataaacggtcatcttgcaacactacgtggccttgtgccatccactgaaaagatggataaagccactttactggctgaagtgattagccaagtgaaggagttgaagaaaaatgcagcggaagtaagcaagggttttctgattccaaaggatgctgatgaagtgaaagttgaaccatataatgatcatgaaggaggagaaggatccatgtcttacagtgcaactatctgctgtgatttcagacctgaaatactatctgacctaagacagacccttgattcccttccactgcatctagtcaaggcagaaatttcaactttggcaggcactatgttctgtgatggaaaaggcttctgcctcactggatttctcaccaagaacatcacatgcaagcaagaggagaagactatgctttattga

SEQ ID NO: 91427 - DNA, 312 bp, Glycine max
  Peptide Sequence Number=SeqID_183112
atgtatatgtgtgtggcgatcatttccaactatcatccacatgattatgtaagaccatcaagacttgggaggattggtggcagaggttggaccctaatagctggtgtctcgctaagcgaggcttgtgcgcttagcgagaatcatgcgctaagcgaggcactcagcccgcttagcaagttgggagaatctggaggagaatatgagaagcacttacgcactcagcacgtcatcagctcgctcagcgaggcgtttgtctcttcctacgttaagcgcacccagctcgctcagcggatatttactaactcatgctaa

SEQ ID NO: 91428 - DNA, 1131 bp, Glycine max
  Peptide Sequence Number=SeqID_183113
atggatccaccctcaaaaaaaagtttagactcaaggaagacaacgactcttactacatttcccatgaatttctctaaggatcttcaagaggatatattctcagccagtcgcatgaccatcgaagagcaatccacggaatgtgttcaaaatgtcagacctgatttagaaagtaacctatccccgcttatctcacaagcaacaatggatgaaatgtatgtttttttcaacaattactccgtgccaatgagtgtctatgatgatttaatggcacgactatgtaatgacaatgatattttgcaactgggagagaactctttcaatgagcaaattcctttagatgatatttccttggaagtccttaaagcagtggagggactaaccaatgacacaaattcaactactcttttgacctcaaattcattagaggaagtggaaatttcaattccacctgcagctggggtagttgtatctgaagcattcactccatttcaatcaccaagcttcccattgcatcctaatggttatgctagtgctggtgctagtccaagtgttggtgttagtgctcttgttgctgctagtgcaggtgctaatgctagtgttggtggcattgcttgtgctagtgttaataccaatgctagtgttagcacaacagttaggttagcaacttttgatccacaacatcctcctcaaattggcacttcatttggaaattttgtgtttccaaatactatgggaaacccattcactcagtttcaatcatgttcatcatctgcaagcttcccaatgcttccctatgatagtagtagtagtagcagcagttaccaacaatctccaaggtatcttccgttcctaatgactgggattggtccacaaggtatacctgcaacgatgcctcagtttaatcagggaaatttttggcttcgcccaccacctctcacggattttccaaactttgtgcatgcatgggagggaagtttgatcggaagaattcactcatgtcgccaattccttagtaaagcaagggttgtgaggaaaccaacatcacttgtcatgcttactgctcaatggaagcctaggctggagattgtcctcttcttacccacaaatgctgttaactatacaatgcagtaa

SEQ ID NO: 91429 - DNA, 171 bp, Glycine max
  Peptide Sequence Number=SeqID_183114
atgcctaattcaacgacagtcgacaaccgatgtatagtgatagagagtagaaaaatgacaccaaaaaattttaacgtgaaaggaattaatgaaacattgggcttaatccggattttggttgtggacttgaagagggcaaataaaatagcgcttaccttagttaatttctaa

SEQ ID NO: 91430 - DNA, 291 bp, Glycine max
  Peptide Sequence Number=SeqID_183115
atgtgtataattgatcttattttgtgcattagtggattctcaattagttctcttcttgttgtgatgatgagacaccttgtccctactgatttgactattggccatttttttatgttatctgcaaaaggattaagctcagtgcagagaaggctatttttgttttcatcaaaacaatctgcctctaattgttgttttaaatgtttatcaggggagctcaaggtgggtctaacacggtgttggtggcttgagagattaggaagcagtgcagtcaaaaagcattctatggactga

SEQ ID NO: 91431 - DNA, 183 bp, Glycine max
  Peptide Sequence Number=SeqID_183116
atgggtgccaaattcctcgaagtgcgtcttatcgccgtattcaaatacttatccaatatattgcccccccccccccccccaaccccttttttgggccccggttttatgttagcaatttcatcccacatctcttcaactggccccattggggatcaaaacccccgtgcttttagccctaaatga

SEQ ID NO: 91432 - DNA, 231 bp, Glycine max
  Peptide Sequence Number=SeqID_183117
atgtcgaaaaacctttcgtattgcgcgacaactgtaaagataaggacactaatttcgttcgagcgatcttgctattcgatcgggcaactggcgaaaaccaagggagtgaaactgagaaaacatgaggacatagaaacagaggacatcgagttctatgaagcacaaacaaggacaaaagacattgaagtctttgagatgaaaatgaagacattgtcgtctttgaaagcgtaa

SEQ ID NO: 91433 - DNA, 195 bp, Glycine max
  Peptide Sequence Number=SeqID_183118
atgggccaaaagcatttgtctccatgggagaaaacgagtggagtcaccaccaacatttattcgtggaaaacgatagaaaaaccaaaaagacaaacgtctgcaaaatttgagaataagggttcaggagttgtttacgcacggggaagggtcgacaaggatattgcccttgctcctacgtatcctcaggtgcgatga

SEQ ID NO: 91434 - DNA, 324 bp, Glycine max
  Peptide Sequence Number=SeqID_183119
atggataatggagacatagaaaatgagagttcattggaggattgcagtgttaaagttgttgaacctctgcacggtgatgtggagcaagatgagcatattgttaatactaggtatacccctaccataaatgagcacaccattgtcttaacaactcttaaacctattgaagtgtatgctgatcaagatggaaagcataaggcagattttgttggagagtttcatgccaaggttcgagccaacattgagaagaggaatgagcaatatgcaaagcaaacaaataaggattgtgtcaaagtgatttttgaacctggagattgggtttga

SEQ ID NO: 91435 - DNA, 180 bp, Glycine max
  Peptide Sequence Number=SeqID_183120
atgaacttgctaagcgagcatgttgcgctaagcaactgtcgcaacctacccttcggcgaaagggcgacgcggggctcacgggtgcgtcttccatgggaggagaatgcgcggagtcgccaccaacgcttatttgaggaaaacatcgaaaaaaatggaaaaggtgtggtctacaaactttaa

SEQ ID NO: 91436 - DNA, 735 bp, Glycine max
  Peptide Sequence Number=SeqID_183121
atggaattgcttgaacagtacatgcaattcaaacaagaggcagaaaaagatggaaagaagaacaacttgtggaagaatgcatcgaaaaatacctctcttcagatggctgctttagagcaaatgaaagctgatgaaaatgttatgaaactggctgaagatcaaaagaggcaaaaagaacaactccatgctaaaatcattcagcttcaaaaacaagttgatatgaaacaagagctggagttggagattcagcaattaaaaggttcattaactgtgctgaagcacatggaagatgacaaagatgcagaaattctgaataaggtagatacactacaaaagaatttaagggacaaggagcagtcacttcaagacttagatgcattgaaccaaacactaatcattaaaaagcgtgagagtaatgatgagttgcaggaagctcgacaagcattggttgatgccattaaagagttacaatctcatggaaatattcgtttcaagagaatgggggaacttgatactagaccattccttgaagcaatgaagcaaagatataatgaggaggatgctgaagagagagcttcagaactgtgttcattgtggaaagaatatctaaaggacccagattggcatccattcaaagttatcatggttgaaggaaaagaaaagatgaaaacaattgcttctgagatgatgtactgggggatcattatgttttgcttaatggctgaagggtattaa

SEQ ID NO: 91437 - DNA, 504 bp, Glycine max
  Peptide Sequence Number=SeqID_183122
atgtttcaccaactagatcaactttggagcagaaatttgaattcgaagtacaggggttggagagtcttggaagaggggacaccaaagcagcatttctctcactggtggtctgacttgaggtccattaaccatcatagaagtgtggctgatgtctccaagcagttcatttggaagctgggtaagggtgatcaaattctgttctgcgaagactcttgggttgatggtgggataacccttaaaggaaaatttccagaattatatcaaatttcatctgaaaaacttcagacagtggcagatatgggctccttttgtgaaactggatgggaatggaagttttcttggaggcgaaatatgttcgacaatgagatggggatagcttcattttttattgatcaaactgctgctataaacttaaatgctagtttgaaggatacttgggtgtggggagctgatcctacggggatcttttctaccaaatctgcttatctttgtattaaagcttag

SEQ ID NO: 91438 - DNA, 468 bp, Glycine max
  Peptide Sequence Number=SeqID_183123
atggccatagctcgacattcacactgcaaatgccaatatcaactcactactaaaaaatatacatttaacatcgccatgttaacatcggtttccggaaaaaccgatgttaacaaaagcacggtggcatacttgttatttgtcctcctgaagctgccatttctgttcgtgttcgagttggagttcgcaccagttcccattcgagttggtgttcaagttcaagtacgtgggcaaaccaacttctttctgtgctttctggtcataaatcgtgtcatcatttcccccattgtagagttgaccctggacctcagcagctctggtcctttgagggtttgtgtttacagtgaccctggagctcacctatcagtgaagtttccatcaaagaaaaatgatttgctgaaagatacgggttggtattacaaggaattgctcgagaagtgtgggtggaacggtgttgtggaggttatatag

SEQ ID NO: 91439 - DNA, 210 bp, Glycine max
  Peptide Sequence Number=SeqID_183124
atgaagaaaacacatcaatgggaagctaaaaactcaaggattgaatacttacttgttggacgatgttctccgctggaccagcgtcgggaaggggtgacgattggtcggtcgcgatcctatcctccattcgcctctatccctaagtacctgcaagtaggagacaaacaatatgcggccaatcgtgaccagtcatcgtcttatcttggttga

SEQ ID NO: 91440 - DNA, 492 bp, Glycine max
  Peptide Sequence Number=SeqID_183125
atggcacctaccaggcaccctctgggatttccagctttgatcacaggactctgccagtcattcggagtccccgtcgcacctagtaaggtgattcggccacccatcacccgggcttttattgagaagtattgcacgcagagacaggcccagggtgatgcaccacaggccgcaggtgcgccaccaccacctcatcaggctgacccaactgggtcatttgacacagagcggtatttgcggcactcgatgcgccagcacgcggccaaccacatggaactggggcagatgcagaggcagggcttcgcttcttttccgtgccctactccagaccagttcaaggcagaggtcgcatggcccgaggattggcctgaggattggcccgaggcccaggcaggggaggcactcgcagaggctcccgacgatggagaggaggccgacatggatgaggagatgtcagatttgctcggcttcttgggagggagtggagccacatga

SEQ ID NO: 91441 - DNA, 171 bp, Glycine max
  Peptide Sequence Number=SeqID_183126
atgaccaagagcaagggcaaggatccccccactgaagaacttggaggacttatgacaagggctagacaaggaaagccaaggaagctcttcaacaagtgctgtccatactatttgaatacaagcccaagtttcaaggagaaaagtccaaggttgttagtgggtcattactaa

SEQ ID NO: 91442 - DNA, 270 bp, Glycine max
  Peptide Sequence Number=SeqID_183127
atggtgggttacacatcttcaagctttgcggatttggtcttcgtcggtgaaaggatcaaagtgggtatggaaagaggcaaatatgattatcttgctttgatgaatgcgaaaattggggcaaatgaagagggtgagaatgaaggagaagcccatgctgcgactgccgttcctacatggaaactcccccaccagctcaacaacatcattactcagccaatatcagcccttcacattacccaccacccagtcatccataaaggccatccctaa

SEQ ID NO: 91443 - DNA, 204 bp, Glycine max
  Peptide Sequence Number=SeqID_183128
atggctgcaagtgacattgctattctcagagatagagcccacataccaacaaagaaaattcttttggaacttacatcacaagatgcattgttggcacagaacaagttgttgtccaagaaattggaagcattgaccgaaacactaagttgcatggtgtgccatctgtggtggagctcacaattctggctgatgtatccccaatga

SEQ ID NO: 91444 - DNA, 234 bp, Glycine max
  Peptide Sequence Number=SeqID_183129
atggcttcattggctaagcaaatggataagttgcaaagaaatgttgagaggaagatgggagagagatttgatgagatagaaagaagcactcaagagttgagtgggagaatggaagacatagagaggaggaggcatcataggtcacctcattcttctcaaggaagtgatgatggctatgaagaaggtagaaggcatatacataggaggaatagggatggaatgaatgatgtgaag

SEQ ID NO: 91445 - DNA, 180 bp, Glycine max
  Peptide Sequence Number=SeqID_183130
atgaagattacgactttcagcctccagttccttttaatggaagaactttcatgggcagtgaccttgtcgaagaatgcttgggccatgatcattggttatctatggatatctcatcaaagttcttggcctggccggcttggagagtcaagtcttgtatgcaaccacgagtcacgactttaa

SEQ ID NO: 91446 - DNA, 210 bp, Glycine max
  Peptide Sequence Number=SeqID_183131
atggagtcaggtgatgggcgggggtaccctatggtcatctgcacctttcgtcaaccgaggcgaacgaattcgacggtttttactctcgtcatccagagacattccagcccgacgacgcacgagattcttctctgctgggcgagggcgatcgagtgtgatggcgtggggaagtttcgtggttgtcccattttatcactttcaaggcactga

SEQ ID NO: 91447 - DNA, 450 bp, Glycine max
  Peptide Sequence Number=SeqID_183132
atgaaaagaggcaaattaatcaccttgcttggacgaatgagaaaaactggggcaaataaagaggatgagaatgaaggagaaacccatgctgtgattaccgttcctacatggaaacttcccaccagccaaacaatgtcattactcagccaatatcagtccttctcactacccaccaccaagtcatccacaaaggccatccctaaatcaaccacaaagcctgtctaccacacttccaatcatgaacaccaccttttgcaggaaccaaaacaccaacgaaggaaggaatttcgcagcgaaaaagcctatagaattcaccctaattctgccataacccctgctaggtttcctcaacctccatttttccgaggatacgacttgaaacgcaacatgtgcatatcatggagtagccctggggcattccttggagcattgtatgaccctaaagtgtaa

SEQ ID NO: 91448 - DNA, 163 bp, Glycine max
  Peptide Sequence Number=SeqID_183133
cttcgacgcctgccgtgaagcggacctgaaggacctgatttgggaggatattcaggtgaaatttgatatcctagaggcttctgacagtaggacgaaaaggaagttactacagaccgtgggggagagatggaggcatcttaaatcagacctcacgaggaaatag

SEQ ID NO: 91449 - DNA, 387 bp, Glycine max
  Peptide Sequence Number=SeqID_183134
atggcgacaggaaatacaaccatacaaaaacctagggatcaatggagtgaggaggaaaagagattagttcaatacaatttaaaagccagaaatataattacttctgctttaggaatggatgagtactttagagtatcaaattgtaaaagtgcgaaatatatgtgggataccctacaggaacatgaaatggaattgttgagattgaatcaacgtgaagaaaatgataagaagaagggaatcgctcttaaagcttcatcttcaaaccaagaagagagtgataaggaggatacaattgaaatagatgaagatgatgatcttagtctttttgtaaaaagattcaacaaattggctaagagtcagaggaaatcaaaggagaccaaactttaa

SEQ ID NO: 91450 - DNA, 228 bp, Glycine max
  Peptide Sequence Number=SeqID_183135
atgtctctttctactttgtttggaaagttacaggaacatgaaatggaattgatgagattgaatcaacatgaggagaatgataagaaaaagaaaggaattgttcttaaagcttcatcatcaacccaagaaggaagtgataaggaggattcaattgaaatagacgaagatgatgatctcaatctatttgtaaaaagattcaacaaatttcgaagagtcagaggaaattaa

SEQ ID NO: 91451 - DNA, 461 bp, Glycine max
  Peptide Sequence Number=SeqID_183136
atgaggccctatctgtactgggaggtcgatctctctccttacctctcagcggctgccatggaaggcacagaccaccatggaactcagcctcaggtgggaggcgttaaatggcaacttctccaacatgctcttgggcatcatgatttcctcttcaatgaaagtgaggtaattgttggctgtgatgttattgcgattccctcaaagccttctacggacatgtcttgggctacagctcatgagaagctccagaagggagactctagtcggggtcttattgagttgttcaatgacttcgatctcgctttgttggataatacggaggaactcgctagcctcctcgagccagggggtgcaaacatgcgaccactgcgggttatgtcgttcagcccggtgatgttggttactttggccgataatgagccgatatgggtagcttcttccttcctaccgcccagaggggc

SEQ ID NO: 91452 - DNA, 484 bp, Glycine max
  Peptide Sequence Number=SeqID_183137
atgctgggtgcaccagcaataatgctaggtgcacctagcaacactctaacggcgatagaagaggaagcccgaaaacggagcttcagggcccgacggagtgagatctttgggttttattttgggcaattgctaggggcacccagcaacattgctgaatggtgtaagcgtttcagattcgacccaagaaattttcttccggcgaagacattacaactgcggaacaaaaaaacttcttccgtggaatctcgtggaagacgtcttccgcgagactccacggaaaaaggtttcttccattgtttaaattacacccgcgagcactcatggaagaagctgtcttccgcagttgtgatgtcaacagcggaagaaggcttcttccgtggagtgatagttatagtttgtattaagatggtcgaagatcaatgggcatattacagtgtgatgtccgaagaagttgatatggattttcaagatgaagaagattgtg

SEQ ID NO: 91453 - DNA, 312 bp, Glycine max
  Peptide Sequence Number=SeqID_183138
atgtctcctccacctctagaacctcacaatcactcacaaactcatcttcagctctcaggacaacttcctcttcaagctctgttctctgtaggtggccttgttggtgcttgtctgcttaacgcaaatctggatcacttagcgcgcattagtgaattttggcttaacgtgtgtcttctcgctcagtggatggattcaagcggtgcgcatagcaggatgagccctcgctcagggaacatgcacaactcatccttcttccagattcttcctcgtgctcacccaagggaatggtgcgctcagcggatggctcgctaa

SEQ ID NO: 91454 - DNA, 427 bp, Glycine max
  Peptide Sequence Number=SeqID_183139
gtacattgagcaactgactgaaatgcctcaaaatgttctttacgatgccatgggatatatcaacggtgttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtcgcacatacaccctggtacacgttcctcggcgctgagggcatccccgaagagctggggattttgtga

SEQ ID NO: 91455 - DNA, 945 bp, Glycine max
  Peptide Sequence Number=SeqID_183140
ctgctgaaagaggccggcctgccggacggcgtcttcaacgtggtgcagggcgataaagagtccgttgacgtgctcctgaccgacccgcgcgtgcaggcggtgagctttgtcggctccacgccgattgcggaatacatttaccagaccgcgtccgcccacggtaagcgctgccaggcgctgggcggtgcgaaaaaccactgcattttaatgccggatgccgacatggagatggcgaccaacgccatcatgggcgcggcctacggcgcggcgggcgagcgctgcatggcgctctcggtggtgctggccgtgggggattacaccgccgatgacctctgcgcccggctcgaaaaacagattgccgcgctgcgcgtcggaccggggctcgaccagacgccggaaaacgaaatggggccgctcatctcctccgcgcaccgcagcaaggtgctgggctacatcgacagcggggaagcgcagggggcgacgcttcgcgtggacggccgcgggtttagcgtgaagggccacgagcagggctattttgtcgggccgacgctgttcgataacgtcaccccggagatgaccatctataaagaagaaatttttggtccagtgctttctgtggtgcgcgtagcagattacgccagcgcggtggatctgattaaccgccatgaatatggtaatggctcggcgatcttcacccgtgacggcggctgcgcacgccgcttctgcgaagaggtgctggcgggtatggtgggtgtcaacgtgccgatcccggtgccgatggcgttccacagcttcggcggctggaagcgttctatctttcccgcgctcaacgtccacggcaacgacggcgtgcgtttctacacccgaatgaaaaccatcaccgcgcgctggccggaaatgcagcaggagaccggcgctgcgttctccatgccgacgctgggctga

SEQ ID NO: 91456 - DNA, 96 bp, Glycine max
  Peptide Sequence Number=SeqID_183141
atgtgggtttcaaatgggcgggagggcgacgcgaggctcacaggtgtgtcttccaagaaaggaatacgcgcggagtcgccaccaccgtttatttga

SEQ ID NO: 91457 - DNA, 52 bp, Glycine max
  Peptide Sequence Number=SeqID_183142
acaaactttgtggttgatttagggatggcctttgtggataactgggcggtgg

SEQ ID NO: 91458 - DNA, 303 bp, Glycine max
  Peptide Sequence Number=SeqID_183143
atggtagaaaagctacaggaggaaatgaaagggagtggtttgcgtctcaagggcatcacgaggggtttgattagagttgtcaaggagatggacaaggagaataatgtaagtgtacacatctggtctgcagcccgtactttccctcaaactcgtcatctccacaggcaacaggaagttgcccctgttgccgaggatgagcctgtggtagctgcagacgtacatgcacctgttgcagatgatgagaatcctgaaactgaccaaatacaggctaaaggcccaagtggagaaggacaaaggccctag

SEQ ID NO: 91459 - DNA, 594 bp, Glycine max
  Peptide Sequence Number=SeqID_183144
atgggattgtgtaatgtatactattgtcatgaatcagatgctcggaagtcctatgtattcccttggaagatgatgcttataggaaaactcctttggaagaccatcccttattgcagagctttgtggatggagatgatgcttataggaactcaagatttaagctcataccatatatttctaaggtacatttctactaaaaatgtgacatggatcatggttttcctaatgcaaagtgttggaaagaaagcatgtttagtggggcaagcgctagaaatgctttatatccgtgggaagaactatctagagattgatatcgacgttggatcttcaatcgtggcaagaggggtgcctagcctagttcttggatacctgaacaatttggtggtagaaatggcatttttggtacaggggaagcctttaagctttatatatggtagcaagcagttcaaaatgaaagggggtctggcagctagaaatgccgcaagcaatgtgttccgtagtgctggttacaagtgtgcaatgagggcacttcaatcccaatgctacagcccaaatgaagtgatatttggtcctgattttttgacagcacaataa

SEQ ID NO: 91460 - DNA, 321 bp, Glycine max
  Peptide Sequence Number=SeqID_183145
atggcgtgtggtggtaacccggggtcgttgaatcacaacatcagttttatgaccgtctttgaagggcggcttttctacatcggttgtctagctacaactgatgtagtatgggtaggtttctacagcggttctaaggctaaaaccgatgttgaatgggtaggtttctacatcggttatcagccaaccgatgtagaaaatgaaagtttctacatcggtcttcaatcaaccgatatagaatttgaagagtttttatatcgtttatcgcctaaccgatgtagaatgaggatattttctacatcgtttataattgaaccgatgtaa

SEQ ID NO: 91461 - DNA, 572 bp, Glycine max
  Peptide Sequence Number=SeqID_183146
atgggaacaagagcttctccaagggttcttgacgatgtcgaggccgagggtgacgacattgctgatgttgaaggacttgatgacacggtggctttgggatcggagagagaagttcaacctttgtatggcttttcctctgtactctctcaatctagaacctttgaagtgaaaatgagtgagcgcaggcaaagaggcgcgagcagtgtgtgggacttaatgtccgttactgtggttccaaaagggatgaagtactcactcctttattaccattttgaagaccaaatgacaagcccaacgcttcatttgttagagataagggagcaacatgatgaacaacctaaatgctgcttgaagctcaaggaaaagcttgaagaagggtatttgactcctgtcgcaacctacccttcggtgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacagggaag

SEQ ID NO: 91462 - DNA, 465 bp, Glycine max
  Peptide Sequence Number=SeqID_183147
atgtggaggaactcgcttgcatcctctagcgatacttctttcttgccacagccctcctttttctccgaaaaacctttcattagaatattctcgtttggagcagggatcactttgtcattttgttcttctgctatcttcgcgctcccattagcgtttgcgggttgtgttggcagccgacaacgagctgatgttggtggcttcttccttcctttcgcttggaggcgcataccgccacggaactgcgtggctgttttgggactcgtagataaaccttatgggggtcatcacgtctttcaaaggtttggacctacgcggcttacccttctcgacggcattaaccgctccccctccatgattagcgagcgggtttgtttttacgttgggccgatcttcttgaaacgtcagccatccgacttctatcaaactttgggctttgtgtttaaaggccaggcactgttcggttga

SEQ ID NO: 91463 - DNA, 744 bp, Glycine max
  Peptide Sequence Number=SeqID_183148
gaaggaaatgagggagttctcttctcatgtggggactacccaaacatcccgttgatagggatgaggggttgtattaactacaatcccgcacttgctataagacagttagggtacaccatgaagggagcaccggcggaagaaagcctctctcctttccttgtgagagatttcggaacgcaaagtttcaagcttatacaaagagtccacaaggcgtgggaaagcccgttaaggaaagataaagaacttaggggcatccgtaatggcatcatcggtggttatcatgaatggctgaaagagaacttcgaagctccggaagaggatgaagaaacatccggaaagagtgtgccgagttacaagaagaaaatacggctaccgcaagagcccttgaacaagaaaccaagagggctcgcaaggaagaacatggctgagacaaattccgtggagctttgtggggcagcaacagtccaagagaagcttgtctcagcgtttatgagagacagagaccaacatgttagccatcatcagcaagctagaggaagggtgatcgacttgttacatcaaaaggcaacaatgtggatggaccgatttgctcttaccttgaacgggagtcaagaacttccccgattgctagccaaggccaaagcaatggtggacacctactccgcccccgaggagatccacagacttctcagctattgtcagcatatgatagacttaatggcccagataattagaaaccgctag

SEQ ID NO: 91464 - DNA, 114 bp, Glycine max
  Peptide Sequence Number=SeqID_183149
atggatcacagtctttacttaaatagcacaagttttcaaggtttggaaaaccagaaaacttcagaaagcttttggtacaaagaagaagaagaagttcaaagagagtcaaggctt

SEQ ID NO: 91465 - DNA, 117 bp, Glycine max
  Peptide Sequence Number=SeqID_183150
atgaatagctcaagagtgaatcagaaccatggtcatggtgtaaaatgtggtatttatggtgccaattctgcagaatggattatgagcatgcagttggatttttgtagtccttattga

SEQ ID NO: 91466 - DNA, 327 bp, Glycine max
  Peptide Sequence Number=SeqID_183151
atgacccaaaagctggtagcccgcggagacaccttacggttatccgcacctcgtcattcagtgaccccaagtgtgattgacgagcgggggccaatgtggtcatctgcaccttttccggaggtgtcagcattttccggtggagactttttcaagtctcacaagttatctagaactacacacagtcgtgtccgatggcacgcagagacaaattatggtcattctgcacccatttcgtcaatcgcggccgacaagcccgttgacacgcggagatttacatcatcttccgcacttacaagatctgtcatactgacttttgagtcacgctga

SEQ ID NO: 91467 - DNA, 483 bp, Glycine max
  Peptide Sequence Number=SeqID_183152
acacttgctagcattgccacacctcttgggcttgaggttattcctcaagtaaaggagttgttggatgagggtttggttcgcaagagcttaaatccttgtgctttgttggtgcccaaaataggtattattaggcaccaaatccctatgataggtggtatgatgaatgtgttgagtggtgcaacacttttttgtaaaatcactcatgcacccaacatcttcatgatttctatacatagggactcattaggtaggaataatcaacatgaaaataaagaaaaaggtatgttttattccattactttccttaactttttaaatagtgatcaagggcttcccatggatcctaagagaataaaggtcattcctgagtggcctactccaccaagaagaattactgagtttcaagagcctctggatttgaggtcaaatccttttcaagggggagggaatgatgcaatcctaccccccaagggtattggatag

SEQ ID NO: 91468 - DNA, 636 bp, Glycine max
  Peptide Sequence Number=SeqID_183153
atggcggaacacctgcgttttgccgcctgttactggcacacgttctgctggaacggtgcggatatgttcggcgtaggtgcctttgatcgcccgtggcagaaaaatggcgatgcgctgcagctggcgaagctcaaagcggatgtcgcgttcgagttcttttacaaactcaacgtgccttattactgcttccatgatgtcgatgtgtcaccggaaggtgattcactgcgcagctaccaggaaaacctggcggtaatgaccgataagctgctggaaaaacagcaggaaaccggcgtcagattgctgtggggcaccgcgaactgctttacgcatccccgctatgcggccggcgcggcgaccagcccggatccggaaattttcgcctgggcagccagccaggtgtgcagcgcgatgcaggcgacgcagacgctgggcggtgaaaactatgtgctgtggggcggacgcgaagggtacgaaacgctgctgaataccgatttgcggcaggagcgcgagcagatcggacgcttcatgcagatggtggtggagcacaagcataaaatcggtttccaggggatgctgctgatcgagccgaagccgcaggaaccgactaaacaccagtatgactttgatgtcgcgacg

SEQ ID NO: 91469 - DNA, 180 bp, Glycine max
  Peptide Sequence Number=SeqID_183154
atggaacacttacttgttggtgatgaacaaaagcgcaaaacggaatcaaaaaacgcgaaaaatgatgacactggggctgcaaattcgtcaatctcgtgggggtggctcgcccaggcgagcccagctcgcccaggcgagcccagctcgcccaggcgagcccagctcgcccaggcgagctaa

SEQ ID NO: 91470 - DNA, 315 bp, Glycine max
  Peptide Sequence Number=SeqID_183155
atgtcattgcctagcgctgttcatgtgtcctccaccttcgagtctggagccccgcgaatgtcattgcctagcactgttcgccaattctccattctccactttttctcggatccccatgaatgtcattgcctggcgttgttcatgcatcctccaccgaaagagtttggagctatgctttatgattgcctaagggtggaccctctagtgcaatcctccattctccactttttttcggagccccgtgaatgtcattgcctagcgctgttcatgtgtcctccaccttcgagtcttagccccgcaaatgtcattgcctag

SEQ ID NO: 91471 - DNA, 179 bp, Glycine max
  Peptide Sequence Number=SeqID_183156
atgaaggatggcaagaggtcttcgtacatcattgggatcggggtgaattctggggttggcctcgggggaaaattccttatcacgttggaaccagcgccaaagtgggcattgccggccggtccccggcgcgagccgagaagctcgggtgatgttgcgcgtactgatgggttccgagagag

SEQ ID NO: 91472 - DNA, 333 bp, Glycine max
  Peptide Sequence Number=SeqID_183157
atgactagaggcaatccatctgacttacaaccctttgatcctgagatagataggacatttcatagattagttaggcatcattttataccttttgatcatcgtgagcattccattactggtgaatctgtgcattctgtaattggtgattttaaacatcctaattttgagcattacaattttgagcattctaattttgaacattctgagaacatagcacaacctccaccctatgagaggactctaagggaaatggttgcactgatttcacctacgaaagcttgtgcatccaatacccttatgaggatgtcccatatgttcgtaaaactggactga

SEQ ID NO: 91473 - DNA, 387 bp, Glycine max
  Peptide Sequence Number=SeqID_183158
atgaccctcgtgagtcatgacatgcggggttaccatatggttacccgcacctttggtcaaccaggggcagacgtgcccgttggcgcgcggagactaacatcatcttttgcaccttttgtcgtcctgacccgtgaagtgacatgcggggttacgttatggttacccgcacctttcgtcaacaaggggcaaagcccgttgacgcgcaaggagactaacatcgtcttctgcaccttttgtcatcctgacccgtcaagtcaagggatatgcgggggttaccttatggttacccgcacctttcgtcaaccagtggcaaacaagcccgttgacgcacggagactaacatcgtcttctgcaccttttgtcgtcctgacccgtgaagtcaggtga

SEQ ID NO: 91474 - DNA, 201 bp, Glycine max
  Peptide Sequence Number=SeqID_183159
atggtgtggcgtctccaatcatctttcttccttcttcattttgctgccattgatcttcaagaagcaaaggactccattgatgaagaagatccaaggcctaccagctccacatggagctacatcatgtggtatcaagagcatcttcgtctaggtgatgttcttttgcttcctctatctttttgttcggtcaattcactttaa

SEQ ID NO: 91475 - DNA, 240 bp, Glycine max
  Peptide Sequence Number=SeqID_183160
atgggggtgcaaatagcgaccaggcccacttgggccttccacgatgttcctccaaaaggcgattttcaaccgttctttgtcgttcgtcgttcgttcttcgttgttcttcggtcttcaaccgataaaaacaacttaaccaaacactttgttctcaaagaactacgtaggtctgatttccttatcacaattgaggaatacgtaggagcaagggaaacaccctcgtcgaccacaaaaagataa

SEQ ID NO: 91476 - DNA, 413 bp, Glycine max
  Peptide Sequence Number=SeqID_183161
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcgctccctcgtgcgctctcctgttcctgcctttcggtttaccggtgtcattcccgctgttatgggccgc

SEQ ID NO: 91477 - DNA, 483 bp, Glycine max
  Peptide Sequence Number=SeqID_183162
atgtgggcttttcttatcggtcgtcagatcgactgggctcacttggttcggtaccgaatgcataaggcattacgggccaatgcacctctcccttaccctcaattggtcactctatttctccgtcattttcaaattccgcttgatgatgaaccatttgttcaagtcaagcgttactttgctattggtgttggtgcagtgacttcttttggataccgtaaggatcagaatggtcaatggctgaagaaagatgcacttcctcctcaagatgagcgtactccttctcctcctcttcagcgagatgattcaacccacatgactgaagttctttccaagttacggggtcttcgtacttatgttggcgaccgttttgattctctggataatcgctttgctggcatggatatccgtctcacacaacttgaagaagatgtgggttatattcgtcagagcttcgaccttccaccaccacctccaccttcttag

SEQ ID NO: 91478 - DNA, 124 bp, Glycine max
  Peptide Sequence Number=SeqID_183163
tgctttgaaaggagttgacgatactccacaacccaaatccaaggctacaagtactaggtggattgttgttaaatgtgataaacaaaaaggaagcactgagtgtggctattacgttatgcattag

SEQ ID NO: 91479 - DNA, 285 bp, Glycine max
  Peptide Sequence Number=SeqID_183164
atgaatgttttgagtggtgcacccctcttttgtaaaatcactcgtgcacctaacatcttcatggtgtgtgtacataaggacccattaggtagtgatcaaggggttcccatgaaccctaagagaataaaggtcattcctgagtggcccactccaccaagtgttgagggaaggagcccagagtatgaagaacctcgggatttgaggtcaaatcctttccaaggtggagggaatgatgtaatcctatcctgcaagggcattgggaagactccaagtagattgagctag

SEQ ID NO: 91480 - DNA, 969 bp, Glycine max
  Peptide Sequence Number=SeqID_183165
agggctacacgtcctcaccttaagagggctgcacatatttgccttaagaggctacacgtcctcgccttaaaaggactacacgtcctcgcctttagtggactgcatgtcctcgactttagagggctacacgtccttgccttaagaggactgcacgtcctcgccttcagagggctacacgtcctcgccttaagaggactgcacatcctctgttttagtgggctgcacatccttgccttcagaaggctgcacatcctcgcctttatatggctgcacatcctcgccttcagatggctacatgtcctcgacttcaaaggactcgacgtcctcattgttaaaggactgtatgtcctcgccttcagagggttgcacaccctcgcatttagaggactgaacgtccttgcctttagaggactacaagtcctcgcccttagaaggccacacatcctcgccttcaaagggttgtacgtcctcgccttcagagagctacacgtcctcgccttcaaagggttgtacgtcctcgcctttagaaggcttcatgccgtggccttcaacggactgcacgtccttggtttcagagggctgtacacccatgctttcagaggactgcacatcctcgcctttagaggactgcatgtcctcactttcagaggactccaagccctcaccatcagagggcagcacgtcctcgccttaagagggctacaccctttagccttcagaggactgcatgttctcaccttaagaggaccgcacgtcctcaccttcagagggcagcacgccttcgccttcagaggactgcacatcctcgcttccagaggacaacacgtcctctccctcagaggactgtacatcctcgccttcagaggactccacgtcttggcttttagaggattgcacgtcctcgccttaagagggctacacgtcctctccatcagaggactgtacgtcttcgccatcagaggactgcac

SEQ ID NO: 91481 - DNA, 339 bp, Glycine max
  Peptide Sequence Number=SeqID_183166
atgtcattgcctagcgctgttcatgtgtctcgttatcagtgcgaagcttctggtgactgggaagcacgttattctgttgttttccagatcggttcctttgccaagtataagaaaaaaaaagaagaagtagagatgagagtcgtcattgcgaaaagggcaggacggacgaaattagtgtcctatctttgctttcctcttatctccgatgagaggcttgcgtgttccgtgaaattcggtaatgtggcggaagtcgaaaagaggaagcaacctggctcgcctgggcgagctgagctcgcctgggcgagctgggcggcaaacatctcccctattttgctataa

SEQ ID NO: 91482 - DNA, 240 bp, Glycine max
  Peptide Sequence Number=SeqID_183167
atgaatgaatccgagtatcgaacacagggaactaatgcgagcgaggcgaggctcacgggtgcgctttccaaaggaggaaagatgcgcggagtcgccaccaacgtttatttgtggaaaacgtcgaaaaaaccgaggaaactggtaaaaatgaaaattctaagttcgggagttgtatttacgtttgaggaaggtattagcacctctcacatttgtctcaaaggacaacaacctattttttag

SEQ ID NO: 91483 - DNA, 117 bp, Glycine max
  Peptide Sequence Number=SeqID_183168
atggggaccaccacgggggaggagcttgccacccagctcgcccaggcgagcaaggttgcttcctccagaagcaaccgccttctggaggaagaatctggaaggcccaagtgggcctga

SEQ ID NO: 91484 - DNA, 282 bp, Glycine max
  Peptide Sequence Number=SeqID_183169
atgagttcagtggacaggacgatcgatgtgaggcctaggccaactgatcgaggggaaatttcattctcctttcttcatgagaaaaggcaccacccagacaggacggaagctatagtcataacatcgccgaaaacaaccatcgactggcaagatactgcccgggagcagaaagagtcagggggtgaagcctacgctagcatgcctaccgcccccactctctactattggtggctaataggccccttcgcgtatcctgtcttttggttggccagtaaggagtag

SEQ ID NO: 91485 - DNA, 627 bp, Glycine max
  Peptide Sequence Number=SeqID_183170
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 91486 - DNA, 942 bp, Glycine max
  Peptide Sequence Number=SeqID_183171
atggcccagaagaagagtgctccaatcactcctgccacatccagaagaagcaaggttgctatcccctccaagaaaaggaaagaaatttcctcatccgatactgatgatgatgtcgaactagatgtctcgacatctaagagggccaagacttcagggagaaaggtgcctggaaatgttcctgatgcaccattggacaacatctctttccactccattggcaatgttgaaaagtggaaatatgtgtatcaacgtagacttgccttggaaagagaactgggaagagctgccatggattgcaaggagatcatggacctcatcaaggctgctggactgctgaagactgtcagcaagttgggagattgctatgaaggcttagtcagggaattcattgtcaacattccctctgacatatcaaacagaaaaagtgatgattatcaaaagagtgtttgtcagaggaaaattgccaaggaaatcactgccaaacaagtccagcattggccaaagaaagggaagctttcagcaggaaagctaagtgtgaagtatgcaattctgcataggattggagctgcaaactgggttcccaccagtcatacttccactgttgccacaggtttgggtaaatttctgtatgctgttggaaccaaatccaaatttaattttggaaactatatctttgatcaaactgttaagcattcagaatcatttgctgttaaattacccattgccttccctactgtgttgtgtggcattatgttgagtcagcatcccaatatgttaaactacactgactctgtgatgaagagagaatcgcctctatccctgcattacaaattgtttgaggggacacatgtcccagacattgtctcgacatcagggaaagctgctgcttcaggtgctgtgtccaaggatgccttgattgctgaactcaaggacacatgcaag

SEQ ID NO: 91487 - DNA, 519 bp, Glycine max
  Peptide Sequence Number=SeqID_183172
atgtcagtctctggatgctattcaggctttttcgtcttacagataggcaaaagaatggtttatacggataaccactcgggtatttccgcccgtcagcgtgactcaaatgtcagtatgacagatcggtttgagttacccgtggaagatgaagaaaacgaagaacgaacgatgaatctgttgaagaacagtcgaaaaccttcgcgattactcacggaagaccgtgactcaaatgtcagtatgacagatcttgtgtgcgcggaagatggcttcctccagaagcaaccgccttctggaggaatctccgcacagcaaaagaatgtttatacggataaccactcgggtatttccgcccgtcagcgtgactcaaatgtcaaagacgacgttagtctctgcgtgctatcaggcttttcgtcttacagacaacaaaagaatgtttatacggataaccactcgggtatttccgcccgtcagcgtgactcaaatgtcagtatgacagatcttgtgagcgcggaagatgac

SEQ ID NO: 91488 - DNA, 875 bp, Glycine max
  Peptide Sequence Number=SeqID_183173
tgctcttggggtagtcggtttggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaaccttatattccctgaggaggaaactaccggtttcgcttggtgggccgggaatgcccgacttatcaatttatccggcaaactactaggagcccatgtagcccatgctggattaatagtattctgggccggagcaatgaacctttttgaagtggctcatttcgtacccgagaagcccatgtatgaacaagggtggattgttagtgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttagaacctctaaggggtccgaatggtttagacttgagtagactgaaaaaagatatacagccttggcaagaacgccgttctgcggaatatatgactcatgctcctttaggttccttaaattccgtgggtggcgtagctacagagattaatgcagtcaattatgtttctcctagaa

SEQ ID NO: 91489 - DNA, 654 bp, Glycine max
  Peptide Sequence Number=SeqID_183174
cgggccgaagccagaggaaactctggtggaggcccgcagcgatactgacgtgcaaatcgttcagtctgacttggtttccctcaggatagctggagcccgcgggcgagttctatcggaactggcgatgcgggatgaaccggaagctgggttacggtgcccaactgcgcgctacctagaccccacaaaggtgttgtcgattaagacagcaggacggtgtcatggaagtcgaatccggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaaca

SEQ ID NO: 91490 - DNA, 171 bp, Glycine max
  Peptide Sequence Number=SeqID_183175
atggcattcaacctaaacaaacacaagcaaacagcaaaagcaagagtgtatgttgcactacactacaatgatatcaactcgatgacaagttatggttacccaactttcgaagtaaaccctagtcctttgggattaacatgggctaatggagttcccacattaggtctctga

SEQ ID NO: 91491 - DNA, 958 bp, Glycine max
  Peptide Sequence Number=SeqID_183176
atggaggaacaaggacaataccagcaacctgctgcagtagctcacaaagacactaatcaggaggggggaagagaggcgaaaatagggagggagaggcaaaagtattacatcaccgaaaggaaatatgaaatggttgagttagtactggatagggagaatgaaggacctgaagatggcaaagtgagattaagatacataagagaatatgtggtgctcatttctagcattgatgaagaccagttaaagagatggacaaggcaaggaaaagagattataggaggagttccacttcatgtatggaatgggcattgcttcgaacagttggtggggatgatgggaagggctccaaaagaaaatgagcctaatcagaaggttgacctgtcgcacaatgaggaaagtggaggaaaaaaaatcgactctgcaagaaagatcaacgaagggaagggggatatggactctatttatctaaagcatactaagcaacacttgggagtctcttatgatgttggttccatcagatgcactattattgttctatcaggattaaaaattagacttagccaagcctctacttcttttctcttcctttttgacctcgaacttagaggaattagggagaatgatgctatattggtagtagacaatgtttattgtccagttgatttaggtcaaataggaaggccaagagttgcatcaatagattcctcatttctaaagagtggatcgatgtatgtgattgattggggcccaaaaccgtttagagtgcttgattgttggcacaatgataaatcttttgagggtgtggtggagatgtgttggaggaagatgaaggtgcaaggcaagtaccatgagatttctagagaaaataatatacatgacgtaaaggaggaagataggtgtttcgctctccgggattgtgtggatgcgaaatctatcggcaagtgcaccgggtcgtcaa

SEQ ID NO: 91492 - DNA, 390 bp, Glycine max
  Peptide Sequence Number=SeqID_183177
atggcattaaaagttgtaaactataataaactcccctcacctatcgtgagctcttcttcagtttctctttgcgtcgctcaaaggggttcgacggcaagcaacggcggctcgtggtggccaccggtggtcgtgggtggtggaaaaggaggtgttaggatctcgcttatctctctaagcgggagcccacttttctcacgtagcgcacaaattctcactcagcgcaacttcctctgcactatggctcgctcaccaagccaattctcgctcagcgcaattccttctcgggttggaattgatcttagcgcgcccttcgcgcttagcgagacatccattttttttattttcaaaatcccaaccgttagactgttcagaaatgtcttaggaagttga

SEQ ID NO: 91493 - DNA, 522 bp, Glycine max
  Peptide Sequence Number=SeqID_183178
atgtcttccaaggttactttgatgatgccaaagaatcaagatttaagcaaattgcaaagaatcaagattcaagaatcaagtttcaagaatcaagattcaagaataatcaagatcaagattcaagaatcaagagaagactcaatcaagataaggtacatcctttgtggtacaagtagagggtacatctacttgggttgttatactgagaacaagagagggtacatctcttgtggatcaattcaagtggagggtacatccacttggttgttcaaagagaacaagggaggctacatccctagtggatctttggcttgtaaaggattttacaaggttgaaagaaatctcaagaaccgttggttgcttggggactggatgttaattaggcaagctttgaaaaatgttgtttttcactttctcgctaagccaatccactggcttagcgagcgtccgctaagcgcaaggaagaatcgggaagaagatgagttgtacatgtgctctaagtgcaccgcttcatcttactaa

SEQ ID NO: 91494 - DNA, 186 bp, Glycine max
  Peptide Sequence Number=SeqID_183179
atgggacaccttagtgatcaaggtgttcccatgaaccctaagagaataaaggtcattcctgagtggcccactccaccaagtgttgaggaaaaaagcctagagtttcaagaacctcgggatttgaggtcaaatccttttcaaggggtagggaatgatgcaatcctatcccacaagggcattgggtag

SEQ ID NO: 91495 - DNA, 426 bp, Glycine max
  Peptide Sequence Number=SeqID_183180
atggtttcgggggtacgctcaattgcttttcatcctgatggacagatcctatttgctggacttgaggatagtttgaagcttatagagccatataatggtggcttggaaactgagaaaaaggaaagcacaaaacagaaacttagtctccagggaagacaaatggagaaagtagaagctggtgtgggaccgccttttgggttgtgcagtatgtctgttgacaatgagtcaaaagagataaagaatatatatatagacttgtggacagcaaggtcaatgtctggagctaacaaaaagatgattgaggcactagctgctaggaagaaggaagagtatctaaagaaggaggagtacctgcaacaatttaagatgaattgtcataagttccattttcaaagctttcatccaatatatgcatgttttcaataa

SEQ ID NO: 91496 - DNA, 342 bp, Glycine max
  Peptide Sequence Number=SeqID_183181
atgtatgaatatcctaggagaacccgcgcattaacgcgtaagcattccttgcaaaattcgtatggatattcatgctctgttggaaaaagggaaatggctccgaagaaactctccacgaagaggtctagaagagacgccacaggagaagggtccagtgccgcccccgagtttgatagtcatcgtttccggagtgccgagcaccagcagcgcttcgaggccatcagaggatggttgttccacagggagaggcgtgtccagctcagggaggatgagtataaggactttcaggaggagatagctcgcaaactttggacaccgctagtgacatgcgttcgtgggtga

SEQ ID NO: 91497 - DNA, 296 bp, Glycine max
  Peptide Sequence Number=SeqID_183182
atgacacaacctccaccccgtgagaggactctaagggaaatggctgcacctgatttcacctacgaaagcttgtgcatccaataccctgatgaggatgtcccatatgttcttaaaattggactgatccatttgcttacaaagtttcatggccttgtaggtgaagactcgcacaaacatctgaaagaattccatattgtttgctccaccatgaaacccccagatgttcaggaggatcacatatttctgaaggcttttccttattctttaaagggagtggcaaaggactggcttcaacg

SEQ ID NO: 91498 - DNA, 178 bp, Glycine max
  Peptide Sequence Number=SeqID_183183
gtttatggagaaaccaaagacacctcacttcttggcagcaaagaggattctgaggtatatgaaaggaacattggatcttggcattttatatccttacagtcacaagaatatagaaggagaagtgtttggttatagtgattcagattggtgtggtgataaggatgaaaaagcctgctga

SEQ ID NO: 91499 - DNA, 350 bp, Glycine max
  Peptide Sequence Number=SeqID_183184
atggtgatgatcctggacatttgagggcaaatgttttccaagaaggagggaatgatgagaatcatgaaactggccaaatagaggctaaaggcccaagtggagaaggacgaaggcccaagtggagaaggacgaaggcccaagtggagaaggacaaagcccccgagtggagaaggacttatcaaggtaatccttgtggcgtctaccctgacttatcttccttcattggaagtggcgtctacccagacttatcttccttcaccggaagtggcgtctaccctgacttatcttccttcaccggaagtggcgtcatccaaaccttcgtagcctttatcaaacgatccgccccgtaa

SEQ ID NO: 91500 - DNA, 378 bp, Glycine max
  Peptide Sequence Number=SeqID_183185
atgttatccttcagccagatgcaatcccagtttcagtcacagatgcaatcacacatacttgcactgcctccggagcttaaggttggtccgtcagctgctcgtgtcaacacaaaagagagttgtgttgatccctcaaggaatgatccaaacatgagtgactcagacaaatgtaggttatacatagaagaaaatcctcctcgcctggttgccctaggaagagtttatgacggatccacaaccattcacaacatccctttgttgcattatcaagtgaaggtcggtgttgagaaggttaaagatacagatgctccctttcctgtacccactgatgagggaactgtgagacccacaaaacctgcaaataggtcggatcattag

SEQ ID NO: 91501 - DNA, 316 bp, Glycine max
  Peptide Sequence Number=SeqID_183186
acgctccgcaccaggaagcgggcaagccgctgatgcaatcgctgaagatcctgctggcgctgccgcgctttcgattgtggggagtgtcccagttcctgtatgtcggcgcgcagggggcaaccgagcattcggccacctactggctgctggccacgctggtctgttactcggccggcaaggtggtcaccaccgcgctgatgaaaaagttcagcccggcgcggttgctcggcgggttctgttcggtatgcgtgctgctgttgctgctggccgtcaacatccaaagcctgctggcggtggtggcgatcatgggcgttaa

SEQ ID NO: 91502 - DNA, 252 bp, Glycine max
  Peptide Sequence Number=SeqID_183187
atgacgttcaaatgcaccggttgcggcgccgaagtcacggtcaataccgagagtacgatgacggcgcgctgccactggtgccgccacgtcttcggcgtcaacgagcagatcgccaacggcgcggtgcccgatgcggtgctgcccttccatatcaagaaggacgatgcggtcgcgcgcatccgccagttcgtcgacaagcgccgcatgttcgcgctgaaggcattcaaggaccagttcaccccggaaaacgtg

SEQ ID NO: 91503 - DNA, 375 bp, Glycine max
  Peptide Sequence Number=SeqID_183188
atggaacacaaggcatattgggctctgaaatttctgaactttgatgagaaggcgtctagagagcacaaaaagatacaattgttggatcttgaagaaattaagctgaagtccaaatggtttgaaccctttgttatcaaggaagttcaatcttatggtgcaatagagctatgtgacccacaatctcagaatcctgacaggacatgggtagtaaatggccagagtgaggaagggactgaaaaatggcttagaaaacattttctgaaaaatagtcctttcgctaagcgcatgcctcgcgctaagtgcacttttggtcatgcgctaagccgcgattctcaagcgcttagcgataaaccctggcatctaaggctgatttga

SEQ ID NO: 91504 - DNA, 324 bp, Glycine max
  Peptide Sequence Number=SeqID_183189
atggaaatctttattcaatcaattgatcccggtgcatggaatgctattgttaaaggtccatttataccaattaaaaatgtaaatggtgaattggtatgtaaagaatgggatgaaatgaaatatgatgagaaaagaaaagtgcaggatgatcaaaaagctaaaaacattttaacttctggtttatcttctgatgaattctttcatactgcaaggtgcaaaagtgcaaaggaaatatggaaaatacttgaagtcactcatgaaggcacatcagatgtaagagcaagaaaccacactctgtatccgaatatgaagctttccgaatga

SEQ ID NO: 91505 - DNA, 56 bp, Glycine max
  Peptide Sequence Number=SeqID_183190
atggaaggctctggtaatcgattactaggaagtgtaatcgattaccagaagacagg

SEQ ID NO: 91506 - DNA, 279 bp, Glycine max
  Peptide Sequence Number=SeqID_183191
atggtagccataaccctagccaaggttcatcaacctccatttcttcgagaatacgactcgaacgcaacgtgtgcttgtcacggagaagccccggggcgttccattgagcattgtagggctctgaagcgtaaggtgcaagtgcaagccattggtctgtttgctcaagcgacctgtgctcctgagtttggacttccaagaccattcaatcagagattactcgtcttgcacgttggtggggctgccgtaaaacaacaaagagaagtgagttatcaagaatag

SEQ ID NO: 91507 - DNA, 225 bp, Glycine max
  Peptide Sequence Number=SeqID_183192
atggtatgcgcaagttgcgtcagggtcataccactttgggaaaagaggttggtagatattcccgggagatatcacagccatctggttggcgatgagggacggcaaaaggtcttcgtacgtcattgggatcagggtgaattctggaattggccacgagggaaagttcttcatcgtgttggaatcgatgccaaagggggcattgccggccgggcgagtcgtggttag

SEQ ID NO: 91508 - DNA, 259 bp, Glycine max
  Peptide Sequence Number=SeqID_183193
atgaaggaaggcataggtcacatcttagacctcactcccataggagagaaaaggaaagaaagcctcaaggaaaatgtagaggcttacttagattggagaataaggatagagcaacaacttaaaaggaagtctacttcaaaatcttatggccctcactcttatccaaagaaagacaagggtcaaggcatcttagggatgacatcttctaagcccaaagatgataaggggaagacaatagaaaagcaacctcctaaggcta

SEQ ID NO: 91509 - DNA, 603 bp, Glycine max
  Peptide Sequence Number=SeqID_183194
atgagtatcagaaagtgtttgtcagaggaaaatgtattagattctccccctgctgtaatcaacaagtatctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattgggactgcaaactgggtacccaccaatcatacttccactgttgccacagaatcttttgctgtcaaattacccattgccttcccaactgtattgtgtggcattatgttgagtcaacatcctaatctcttaaacaacattgactctgtgaagaagagagaatctcctctatccctgcattacaaactgtttgaggggacacatgtcccagacattgtctcgacattagggaaagctgctgcttcaggtgctgtgtccaaggatgatttgattgctgaactcaaggacacatgcaaggtgctggaggcaaccatcaaagccaaacacagagaagaaaatggagctggaacgcctgatcaaaagactctcagacaatggcattga

SEQ ID NO: 91510 - DNA, 483 bp, Glycine max
  Peptide Sequence Number=SeqID_183195
atgcaattcaaagatacagtagattcaatgcaacaagcctttacaagaactgcaactcagattagtaagttggtggatgacatggctaacactgcggccagacaagaggaagagtgggcagagattgaaacacatgaagaaagaatttttaaagttacctcaatccatcatcagatgaccactgaagagaaaacatttgaagtctccagtactccaaaatattcctgcccagccagtgctgactatgttggaggaacagagaaaggtagattggaactcagtgaggaagaggtggaacaggaaatagtattatcagcttcaaccatgatacaacagattcctttggaaaaagaattgggtgatgagatagacagcttagtcgataatgaaaagtgtgatgatccgaaagacaattgcgttgatcatgtggtttttgaagaattggagaaaatgagaccaccagaaaagccaatcataaactag

SEQ ID NO: 91511 - DNA, 483 bp, Glycine max
  Peptide Sequence Number=SeqID_183196
atgaccccgaggataaatcacgtaagcaggtttgcactcctgaggcctgatcctcaggagttggctactaagctctgtatcccagggaggggatttgagctaaatgctaatggtcagccgttgaagatattgaggaagaaaatgaccaccttagctcagacatggagcgttctttccttctctaagctaattcctacctcccacacatcttatgtcaccttagatagagccaaattaatttatggcatcattatgaagatggatatgaatgtggggtatctcatctcccaccagatctctcttattgcacagcatgatacatccagacttggattcgctgccttgatcacaactctatgcaaggccagaggagtccaatcagattctagatccctagagaacttgagccttgccattaacttggcatatattaagaagaactattggaatctagatgatccaatagtgtcatttagatattag

SEQ ID NO: 91512 - DNA, 573 bp, Glycine max
  Peptide Sequence Number=SeqID_183197
atgactagaggcaatccatctgacttacaaccctttgatcctgagatagataggacatttcatagattagttaggcatcattttataccttttgatcattctgagcattccataactggtgaatctgtgcattctgttattggtgattttgaacatcttgatcttgagcattataattttgagcattctgattctgagcattctgattttgcacattctaagaacatggcacaacctccacctcgtgagaggactctaagggaaatggctgcacctgatttcacctatgaaagcttgtgcatccaataccctgatgaggatgtcccatatgttcttaaaactggactgattcatttgcttccaaagtttcatggccttgcaggtgaagacccgcacaaacatttgaaagaatttcacattgtctgctccaccatgaaacccccagatgtccaagaggatcacatatttctgaacgcttttcctcattcattagagggagtggcaaaggactggctgtattaccttgctcaaagtccatcacgagctgggatgaccttaagagagtattcttag

SEQ ID NO: 91513 - DNA, 606 bp, Glycine max
  Peptide Sequence Number=SeqID_183198
atggaagatggattttctcaaggatcagttcccatcattctaggtagaccctttatgaaaattgctagaactaagatagatgtttatgcaggcacactatccatggagtttggtgatataactgttcattttaacattctggatgctatgaaatacccatctgaagatctttttgtatttcgtgctgaaataattgaccatgttgttgatgaatacatgactgatctttactctaatctgcatgcctctcactcttcatgcattgagtttgaaattgtacttgatcatatgtctgaatttgatgctgagagtgaatctgagagtgatattgattgcatgtctggtggtggtgttttacctctcgagattgattttatagagtcagataggactaaccatgtttcaggaagtacacatacctctgactttctttatgaggtaaatcttactactgtttccttgatggtttttctggttatatgcaaattactattgctcctgaggatcaggaaaagaccacattcacctgcccctttggcacttttgcctataggaggatgcctttcggcctgtgcaatgcccctggtaccttccagcggtgcatga

SEQ ID NO: 91514 - DNA, 168 bp, Glycine max
  Peptide Sequence Number=SeqID_183199
atggaattcagctccaaactcgaaaatggaggacacatgaatgacaacgcaattcattcatggggctccgaaaaagggtggggtgggatattgctagtcgagaatgatttcgaatggcaatctggcttgaagtatattcttctaaggtgtggatatggagcacactaa

SEQ ID NO: 91515 - DNA, 357 bp, Glycine max
  Peptide Sequence Number=SeqID_183200
atggctccgagaaagctttccgcaaagagatctaggaaggacgccgtggctaaagggactagtgccgctcccgagttcgacagccatcgtttcaggagcgctgagcaccagcagcgtttcgaggccatcaagggatggtcattccaccaagagagacacgaagagatagctcgccgacgttggacgtcgctggtcactccaatggccaagtttgacccagatgtagtcctagagttttatgccaatgcttggcccacagaggagggcgtgcgggacatgcggtcatgggtaaggggccagtggattccttttgatgcagacgccctcagccagttcctgggagacccgctagtgtag

SEQ ID NO: 91516 - DNA, 147 bp, Glycine max
  Peptide Sequence Number=SeqID_183201
atggatgagcgccaatcaaggtcgcgaagggcctgggtgatggtgttggaccgagtgatgatcccacctccatttgggttgacaatggtttggggtggtggagcagagagttgcgaggatgattgtgaggttggaggaggagattga

SEQ ID NO: 91517 - DNA, 444 bp, Glycine max
  Peptide Sequence Number=SeqID_183202
atgcagtcattagaagagaaagaacatgaaattagaattatgactgaaaatgttagtcagtttgtcagattgagtgtgaaggaatgcgttaaccgtaacccggtgaaagagagcatcattcatagaaagaatcttggttcaaggcaaattccaaatttgttccaaatttgggggagttatgtttcaagtcaaatttgtcccaaatttgggggagttatgtttcaagtcaaatttgtcccaaagttgggggagttactgggtgaaagtgtgaaatgtgaccctgaggctttgggtaatgatcattccttgatatctaccatgctgatgcaatcctaccccgtaaaggcattggctagaagactccaagtagattgggctagagatccaaggaaaggccctagggttctcatgaaccttagggtagatttcaagcccatgggctaa

SEQ ID NO: 91518 - DNA, 327 bp, Glycine max
  Peptide Sequence Number=SeqID_183203
atgagtgaaatagaggaggtgcaagagcagatgaaggctgacctggaggccatgaaagagcaaatgaccgcaatgatggaagccatgatgagtatgagaagaatgatggaggtaaacatggctatagtcgttgccgcaagtaccgccactaaggtggacctaactcatccatttggcctcaatcaagtccctcaacccatgggggagacacataaagtaccccgagaccacactttagccgcattcgaacctcccctcggatatgccacagaggggcaagcatttggtggcatacccctgccaaacactttagagggccctcagtag

SEQ ID NO: 91519 - DNA, 459 bp, Glycine max
  Peptide Sequence Number=SeqID_183204
atgaggtaccaaatgatggaaaaggtgattcatattagccaagaagtcaatgacaaagttgatgagttggctcgactggcaacttctcctaaacctggtcaactgaaaatgttcatactccattcggttcctgaacccagtgtcttggaaaaagaatgtttacaggttgaagaaaacccttcgggatggaagaacaagatagtcaaatacttgaagcataaggcactcccaatagacaagagaaaatccaaaaagctaagaatgcaagcttccaggctgactatgtgcttcaagaactacatgaaggtgtctgcggcatgcattttgggagagaacaatggccataagagtgttgagggtcgagtactattgaccaactttgaggacagattgttcaagctttgtagagaaatggctccaatgccaaaagcatgggaatttgatacatcggctgactga

SEQ ID NO: 91520 - DNA, 210 bp, Glycine max
  Peptide Sequence Number=SeqID_183205
atggcataccaaattgcattaccctcatctctttctaacctttacaatgtctttcatgtgtctcaactctgtaagtatctccatgatccatctcatgcaaacaaagcacttaagaggaaaagagattttgttggtcaaggtgatctggggaggtgcattagaagaagacgccacgtgggagctagagtcaaatgcgagaagcctatctag

SEQ ID NO: 91521 - DNA, 809 bp, Glycine max
  Peptide Sequence Number=SeqID_183206
atggtgatgtacgtcaagtccacccagtataggatttggctaatcatcactaatagggatatccttattcccagacatgaagatgaatggacagatgtcgatctggccactatggagcacaacacaaaagccagatatactctgacatgcgccctatccaagaaggagaaggctgagactctgaccaaacactatgaaagcttcaccatgaaggatgaagagtcagtagatgatattttcaaacactcctctaaatgtaaagattcaagatttaaaaagaaaaacatggagaaaatcaatgaaatcatctactttgtgtgtaggaagcttggaaacatgaaggatgacttagacaatgaaaaaagtagcagttcatacaatgaacaagccaacatctatctcatggcagatacaaacgataaagttgaggtaaaaactttctctaaatctaatacttgtgctttatcagatgatgaaaaggatatgccttatgatgaggaatctgaagggaatttgtcacgcaggcacgcgctcagcacatcatcagctcgctcagcgagtcgtttgtcaccttctaggcttagcgcgagtttggcgttgagcgaaaattcacttactcgcgctaagcgcgacgtcaaggagcttccttgctatggaaggctaaatcctcagttggggattcttgcttgtcgcaacctacccttcggtgagagggcgacgcggggctcatgggtgcatcttccaagggaggaaggcgcgcagagtcgccaccaacgtttattcgaggaaaacgtcgggaaaaccggaac

SEQ ID NO: 91522 - DNA, 201 bp, Glycine max
  Peptide Sequence Number=SeqID_183207
atgtggctccgaaaaagggtgagaatggaggattgccttgagggtcctcacttaggcaatcatgaaacacagctcaaactcggaagtggaggacacatgaacagccctaacgcaataacattcatgtggctccagaaaaggatgagaatggaggattgccttgagggtcctctcttaggcaatcatgaaacacagctctaa

SEQ ID NO: 91523 - DNA, 324 bp, Glycine max
  Peptide Sequence Number=SeqID_183208
atggggatgaggggttgcattagttacaatcccgtcctcgccataagacaacttggctaccctatgagaggggcactattagaggaaggcctcacacctttcattacgcgaggcttcaatagcaccaacacgggggtgcatcagagggtctgcaaggcatgggaaatggtggaaaagaaggacgaggaacttaggggaagtagcaacgggcccatcggcgattaccataggtggttgaaagcctatgcacaaggtctggattggctcctgaatttgagaactactcaagaggtggagggtgaagctccggaagaagacgaagag

SEQ ID NO: 91524 - DNA, 312 bp, Glycine max
  Peptide Sequence Number=SeqID_183209
ggttcctctcagtatggggttgcaacggagaacaacggcggtttgtggtggccaatggtggctgtgggtgatggagaaagtgcttgggacgttagaaatggctttggaagaaagaaagaagaagaaatgatgttttttctaagctacacaaaagcaaaggctgaaaacgctcaagtgagaaatggtctcggacacggaaatgtcgcgcacactccagacatcttctcaaagatcccaacgacagctcatgtagcttcctcaagaagtttcattaagaggcttcctcaagaagcttcctcgtggcttctttga

SEQ ID NO: 91525 - DNA, 411 bp, Glycine max
  Peptide Sequence Number=SeqID_183210
atggcgtacactcccagtgagaatgtcaataactccactcacatactcattgagagccgacaaccccaaacggatgatgcacatgtctctcaaaccatgggggagacacatgaaattccccaccacaatctagtcgactttaagccttgcctcggatatgccactaaagggaaagtagttggtggtaaaaaccctcatgccatgacagaaatgggagagttggatcatctagaggaaaggctcaaggacattgaaggaggcgaagattatgcctttgctaacctagaagagttgttcctagtacccaatatcatcacccctcccaagttcaaggtgtcggacttagacaagtacaaggggattacttgccccaagaaccatctaaagatgtattgtcggaaggacctaatg

SEQ ID NO: 91526 - DNA, 427 bp, Glycine max
  Peptide Sequence Number=SeqID_183211
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttcccctggcggctccctcgtgcgctctctgttcctgctttcggttaccggtgtcattccgctgttatggccgc

SEQ ID NO: 91527 - DNA, 279 bp, Glycine max
  Peptide Sequence Number=SeqID_183212
atgcaacccaccaggtaccctctagacccggataagtctaacagggccctgtggtttctggcattgatcacgggcctcagccaattgttcggggttctcgtcacccttagtaaggtgatccgaccgccgatcacccgggccttcatcgagaagtactgcatgcctaggcaggcgcagggtgatgcgcatcaggccgtagatgctccgccaccacctcatcagactgatcccgctggatcactaggcatggagcgttatctacagcacttggttcactag

SEQ ID NO: 91528 - DNA, 303 bp, Glycine max
  Peptide Sequence Number=SeqID_183213
atgattgaaaatccacaaattattggaaacaatcatacatatcaagttattgatgaggaatatcaaggtaatgttgaacaaccggttgagcaacaagttcctcaagaaattgatgaggtaacattaggaagatctactaaagtcaaaaggtcagcaattcctagtgattatgtagtgtatctgcaagaatcggactacaacattggagctgcaaatgatcttgaaacgttttcacaggccatgagttctaaagaatcaaacttatggcacaatgacatgaaagatgagatggattctatgtag

SEQ ID NO: 91529 - DNA, 207 bp, Glycine max
  Peptide Sequence Number=SeqID_183214
atggagaactcacctggtaatcagttcaataaagaccagggtgggccatctaacaggccacaacaacaagggcctagtctttatgacagaatgatgaagttggaagagactctttctcagttcatgcaagtatctatatccaatcaaaagagcacagagtcagccatcaagtgtgacatcctggaaatttctacccggaatttttga

SEQ ID NO: 91530 - DNA, 195 bp, Glycine max
  Peptide Sequence Number=SeqID_183215
atgtggaccaccacggttgaagaccgaagaaaacgaagaatgaacgatggatgtcgaagaacggttgaaaaccttcgcgtaattactcacggaaacattacggacacgttacggaagcgcctcggcttggattttctacacggaaacaattttcctcaacaatttcgagagaatacgaagtgtcaagaaggctga

SEQ ID NO: 91531 - DNA, 591 bp, Glycine max
  Peptide Sequence Number=SeqID_183216
atgggtgatcaagaggagacacaggaacagatgaaagccgacatgtcggctttgaaagagcaaatggcttccatgatggaggccatgttaggaatgagacaactcatggagaaaaacatggccaccgctgccggtgttagttcggctgccgaagcagacccaactctcctagctaccgcgcactatgcccccccaaatgcggtaggacgagaaaggagcacactggggcacaccagcaaccctcatttgggatacaaccgggtggcttatccttatggattaccacctaattacacgccgccagtcatgcatgatgaccccgatgaggtccatgaagatcatcgagagtatgcccaaggggatgttgatttctacccctcgatccccgtcgaggggtcggcacccaacacattgcctcagcacaacctcacagcacaaccaatattcttgtccacaaaaggaccacccccggcagcggaagaaagaaggaaactcgatctcctcgaggagagattgagagctgttgaaggctttggtgactatccgttcacggacatgacgaatctttgcttggtaccggggatcctctag

SEQ ID NO: 91532 - DNA, 472 bp, Glycine max
  Peptide Sequence Number=SeqID_183217
atggccccgaggaaacttgcctcaaagagatccaggaaggataaagcggccgaaggaactagttccgcacccgagtatgatagtcaccgctttaggagcgctgaacagcaggagcgcttcgaggccatcaagggatggtcatttctccgggagcgacgcgtccagctcagggacgatgagtataccgatttccaggagatagttcgctggcggtgggcatcgctggtcacccccatggccaagttcgatccagacatagtcctcaaattttatgccaatgcttggccaacaaaggagggcgtgcgtgatatgaggtcctgggtgaggggtcagtggatcccgtttgatgcagatgctatcggccagctcctgggatatcctttagtgttggaagagggccaggagtgccagtatggccagaggaggaaccggtctgatgggttcgatgaggaggccatcgcccagttgctat

SEQ ID NO: 91533 - DNA, 867 bp, Glycine max
  Peptide Sequence Number=SeqID_183218
atggctccgaagaaactctccacgaagaggtctagaagggacgccactggagaaggctccagtgccgccttagagtttgattgtcaccgtttctggagtgccgagcaccagcagcgcttcgaggccatcaagggatggtcattccatagggagaggcgtgtccatctcagggaagatgagtaccctgacttccagggagagatagatcgcaggcattgggcacaactagtgacccctatggctaaattcgacccggagatagtcatagaattttatgccaatgcttggcccactgaggagggggaagaccaacagtgtgaattcagccagaggaggagccaggcagacaatttcgatgaggaagccattgcccagctgctgtgcataccggggcaggatttcactcggaccgctgcagggaggcaggtgtggatcatgcgcaccaacatgactaccttgacccagatatggatgacactgttgctcagcaatgtcttgcctagaatggcgcctactaggcaccctctggacccagagaagtccaacagggccctggggtttccggctcttatcacgggcctctgccagtcctacggagttcttggtgacgcacatcaggatgcgggcacaccgccgccacctcggccggccgatttggctgggccactaggcgtggagcattatctacagcatttggttcgccagcaggtggccaaccactgtggacaggtcgcatggcctggagactggcccaatgcccaggcaggggaggagcctgcaggatcccccggtgaggcagatgaatcctgtatggatgaggatatgactgacctactcggtttcttgggagggaccggagccatatga

SEQ ID NO: 91534 - DNA, 607 bp, Glycine max
  Peptide Sequence Number=SeqID_183219
atgtcccgcagctcttcctccctgcctcctgaagaattgcagcagctgacccaacaaatcagggaccagctagaggagtcgatcatcgaaaaagtgactcggcagctcatggcatcgttcagccagatgcagtcccagtttcagtcccagatgcaatctcaaggacttgcattgcctccggtgcctcaggttggtccctcaggtcctcgagtaagcacaaaggagagttgtgttgatccctcaggaaatgatcttgagacgggtgactcagataggtgcggcttatacatcaaagcaaatcctgcccacctggttgccctggggagagtttatgagggagccactgttgttcataacactcctttgttgcctggccaagtaaaggtgggtgtggaagaggttaaagatccagatgttgcagttcctgtacccactgatgaggttttcttagttgggcagacaattcacaccttccttgcttggtcgacacatctggtcaagtctttatcacagcaggtcacatgggatgccaccgtgttcggggtctttaatccagacttcccgctctacataaagcatgaagacctctccgaaatcgcacatgatg

SEQ ID NO: 91535 - DNA, 291 bp, Glycine max
  Peptide Sequence Number=SeqID_183220
atggctccgaaaaagctttccgcgaagaggtctaggagagatgccgcgactgaaaggaccagtgccacccccgagtttgatagccaccatttccggagcgccgagcatcagcggcgctttgaggccatcaaaggatggtcgttccacagagagaggcgcgtccagctcagggaggatgagtacacagattttcaggaggagatagctggccgacattggacgtcgctagtgactcccatggctaagtttgaccctgagaggagggagtgcgagacatgcgttcatgggtga

SEQ ID NO: 91536 - DNA, 853 bp, Glycine max
  Peptide Sequence Number=SeqID_183221
ttggcccagcgctccccggtatcaacagagacaccaggatttatttagtctgccgaagtgatcttccgtcacagtggcttctgtttctatcagctgtccctcctgttcagctactgacggggtggtgcgtaacggcaaaagcaccgccggacatcagcgctggcaagtgtagcggtcacgggcgcgtcccattcgccattcaggctgcgcaactgttgggaagggcgatcgctgcgggcctcttcgatattacgccagctggcgaaagggggatgtgctgcaaggcgattaagttgggaattggattacaaaaccttgagaatggtacagtgatgattacttctcaaaaccatggctttgcagttgatgaaagcaccttaccttcaaacttaaaagtaacacatcgttcattgtttgatggtacaaaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 91537 - DNA, 118 bp, Glycine max
  Peptide Sequence Number=SeqID_183222
ggatcgggcccacaagacacttagtggactcggagaagtccaacagggtcctggggtttccagctctgattacgggcctttgtcagttctacggagtgaaaagccagcacgcttttga

SEQ ID NO: 91538 - DNA, 674 bp, Glycine max
  Peptide Sequence Number=SeqID_183223
ggctacacgtcctcgccttcagaggactacgcgtcctcgccttcagagggctacacgccctcgccttcaggggactacacgtcctccccttcggaggagtacacgtcctcgccatcagagggctacacgtcctcgccttcagagggctacacgccctcaccttcagaggactacacgccctcaccttcagaggactacacgtcctcgccttccgagggctacacatcctcacctttagaggactacacaggactacacgtcctcacgttcagagggctacacgccctcgtcttcagaggactacacgccctcaccttcatagggctgcacgccctcgccttcataggactccacatctacgtcttcagagaactcaaggtcctgggccaccccctaatattggagggcgaccaactgtgcgagcacaaccagagagggaggctatcgtgcagctactatgcatacctgggcaagatttcacccagccgctgcaaggagacgagtgtggatcatgcacaccaccacaactccgatctccctttgccaaagtgttagttggtctgtgccgtcatgacatagggatcgcgcccacaagacacccagtggacccagagaagtccaacagggacttggggtttccagctctggatatgggcctctgtcaatcctacggg

SEQ ID NO: 91539 - DNA, 422 bp, Glycine max
  Peptide Sequence Number=SeqID_183224
tgaatggtgaattggtgcctaaagaatgggatgagatgaaagatgatgagaaaagaaaagtgcaagatgatcaaaaagctaaaagcattttaacttttttcatactgcaaggtgcaaaagtgaaaaggaaatatggaaaatgcttgatgtcactcatacaggcactacggatttcttcaaaggaagattgcaaagaaagttctagtgatgacgaagatgcaaagaatttaagcctaatgatgaagaagtttggaaaatttctcaaaagatccaaagacataaaattcgctaaaccttcaaagaagatagaaagcaacaacaacaccttcacatgcctcgaatgtggaaagcaaggtcacatcaaatttgtgttcttgatggtagatttgatggatgactcctcgaccattgaagaaactgag

SEQ ID NO: 91540 - DNA, 444 bp, Glycine max
  Peptide Sequence Number=SeqID_183225
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtccatgtctgcaggaagtcaaatcccgtga

SEQ ID NO: 91541 - DNA, 680 bp, Glycine max
  Peptide Sequence Number=SeqID_183226
ccgccattgatgctttcctcgtatatcaccatagcaaggaaagtccagtggtggctatcttggcagatttgtttgacacctttgaccggaggtgtgagaaaaacagtgcacggattgtctgttgtttacccgctctctgtgtgtggttggtttcacacctattccaacaagacacaagacacccgtgtccgcttcaaagttatcgctcatgcgcccgaaaaaggaagagtcgattgggaccaacatttggctgggataggaggcagcgcaatcaattggtttcctcgatggaaggaaggcaaggaaggagttcttttctcgtgtggggactaccctaatgttccgttgatagggacgaggggttgtattaattataatcccgcactcaccataagacagctagggtaccccatgaggggagcgccaacaaaagaaagtctctcgcctttccttgtgagggatctaggcgcacaaagtctcaaggtgatacaaagagtccacaaggcgtggagaagtctgttgaggaaagacaaggagcttagaggcatccgaaatggcgtcatcggtgctccggaggatgatgaagaagtccgagctctaaaattagagctagggaaggcaagactcgccaaggagaagttcaaatcagccgctacacacattcggaaagagtgcaccga

SEQ ID NO: 91542 - DNA, 519 bp, Glycine max
  Peptide Sequence Number=SeqID_183227
atgccaatctcccctgcggaagtatcagttggtctgtgtcgtcatgacatagggatcgcgccaacaaggcacccagtggactcagaggtgtccaacaggccccgggggtttccagctttggttacaagcctcggtcattcctatagggtgcccgtcccccccccccccaacaaggatcgcgcccgcaagacacccagtggacctggagaagtccaacagggtcatggggtttccagctctgattacgggcctttgtcagttctacggggtgcccgtcgccgccagcaaggcgtagggcgagacaccacaacagcctggagatggccggcagcgggcaacagatgcaccgccaccacctctaaagcccctcagctcatctacaaaggctggagcgttgcctatgactcgtggtcgaccagcaggcgaccaagtccaaagtcaaaggtaagaaaaagtactaggtccgtgaccaacaagtcatcacgcgtccagctcaagacattaaagaagcgctactaa

SEQ ID NO: 91543 - DNA, 594 bp, Glycine max
  Peptide Sequence Number=SeqID_183228
atggtgaagaagtttagaaaatttctcaaaagatcaaaagacaaaagattctctaaaccttcaaagaagacagaaagcaacaacaacaccttcagatgcttcgaatgtgggaaacaagatttaatggatgactcttcaaccattgaagaaattgaggtaaattctgaatttgaaaaagttttggaagcatttaatgaaatgcatgaaaaagcgcaaaggcttgctgtttcaaacaataagctgagaaaggatctaaaattgcatatctcaaattggcttcaacacaaaaaaatgaacaaaggaaagagtgatcatagtcacttgctcagtgtgcaaaagcctactaccaataagattggtttagggtataacaagcaaactaccttttctaagaaaaccaagtttgcatcctccaaaaagatgaacccaaacaaagtctccaaaaagaaaaacctagtgcattctaagcctaaaacaaagacttgtcattattgcatgaaaataggacacatatcttataaatgctatgttaggagattttacattcctagaggtgtgactaaaagcaagagactcgctattgtacttggatag

SEQ ID NO: 91544 - DNA, 534 bp, Glycine max
  Peptide Sequence Number=SeqID_183229
atgccctttcgcatgcgagtgaggcgaggctcacgggtgcgctttccaaaggaggaaagatgcgcggagtcgccaccaacgtttatttgtggaaagcgtcggaaaaaccgaaggaaatcggtcaaaacgaaaattctaagttcgggagttgtatttacgtttgaggaaggtggtcattttaaggcgttgaaccttaaaaatggtccatttacttgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 91545 - DNA, 732 bp, Glycine max
  Peptide Sequence Number=SeqID_183230
atgtttacctatggaacatctttccatagacaaacgtggagctctccgcaggcatgttcgatgaattttacggagagctccaacggatgcaccggcactggattctcaccaaactctcagagaagcaaatcgacgtcgctttggtcaaagaattctactccaacatttatgacccagaggacggccatcgtggcagcactgtgcacaaccggaggtggatttgtcctgaatgcctctgggtccccatggaagctgttgcggaaggatctcaactcgcttgctcaaacatggagcgtactttcttgctttaaccttgtccctacctctcacacttctaatcttaatgttgagagggcaaggttgatatatggcttggttatgaagatggacatggacttgggcagcttcattttggggcaaatcacacagatcgtccagtctagcacctcttggttagggttcccgggggtcatttttgacaccccgacctttgagtcactaagccttgtgattaacttggcctacataaagaagaattgttggaacctcgccgacccgtccatcacctttgtagggcctcgtcgtgcccgagccagagccacagcaccagatgccccacctctagcacaacctcctccaccccctgcctctcgccgccagtcaccatccacctcattccatctactagggtcagcaggttattgcttggccaggagtccagtcctctactaa

SEQ ID NO: 91546 - DNA, 240 bp, Glycine max
  Peptide Sequence Number=SeqID_183231
atgctgatgcgggccaagctagaggagcttcagaatgatctaatcaccatcgagaactatgacttcggtgagagtctgtcactgttgcaactgtcaatggcagagtgccacaatttatgtccgcgttgcatggacatgttctacaatgagaagcttctgatgcatagcgatttggacatggcgttcgcgaagctcgacatgcacacgaaaaagatcaatgagatatacaagacgagatga

SEQ ID NO: 91547 - DNA, 1251 bp, Glycine max
  Peptide Sequence Number=SeqID_183232
atggcaccgaaaaagctttccgcgaagagatctaggagggacgccacggctgaagggaccagtgccgcccccgactttgatagtcaccattttaggagcgccgagcatcagcagcgtttcgaggccatcaaaggatggtcgttccacagagagagacacgtccagctcaaggacgatgagtacgctgattttcaggaggagatagctcaccgacatgggacgtcgctggtcactcccatggctaagtttgacccagacatagtcctggagttttatgctaatgcttggcccacaaaagagggagtgcgggacattcggtcatgggtgaggggtcagtggattccctttgacgcagatgccctcagccagttcctgggtgacccactagtgttggaggaaggccaggagtgcgagttcaatcagaggaggaacagggccgacgggttcgatgaggaggccattgcccaactattgtgcacaccggggccggatttcgcccggatcgctgctgggaggcgggtgcggatcatgcgcaccagcatgaccaccttgacacagatgtggatgaaattgctgcttagcaatatcttgcctagtgatcataactctgaccttcctctgccaaagtgtcagctggtgtatgccatcctgacatggatgagcgtccatgtggctcagttgattgttgacaccatctatttatttgcaggtatgccacccaccatgcaccctctagacccggataagtctaacagggccctggggtttcgagcattgatcacgggcctctgccagtcattcagggttcccgtcactcctggtaaggtgatccgaccgccgatcacccgggccttcattgaaaagtattgcatgcctaggcaggcacagggtgatgcaccacaggccgcagacgcgccgccaccacctcatcaggctgatcccgctgggtcattaggcatggagcggtatctacagcacttggctcgccaacaagcggccaaccaccggggacaggtgcagattcaagagtgtctctaccagctcagcctcagtcagcaggtccagggttttgccccttttgcatcccctacttcagatcagtttagggctgaggccgcatggctcgaagattggcccgaggcccaggcaggggaggcgcctgcaggagctcccggtgatgccgaggaggcccgcatggatgaggagatgacggacttgctcggtttcttgggaggaagcggagccacgtga

SEQ ID NO: 91548 - DNA, 486 bp, Glycine max
  Peptide Sequence Number=SeqID_183233
atggcatcaagaaagagagcgagaactaaggacatcccgtcatcatccaacccatttacttcgacaacagtcatggaaccagatgcccaacaagcacattctttaattcctatgttgcaaaacttattcaggggacaattgatgattgtatacaaccagcaggagttggctcacaacaagccaatcatatctatggaccagtttctggaaaaagtggcatggcctgaagctcaactccctctggaaagagcccataaggttgttcctcccagacctataccagctaggactgagccgacagcagctgaaccacaacctcctgtagtagatccacctgcttctttggaacttgagacattgtctcctccggcaccacctctgataatcatccctgatgactcagctgatgaagctgctgctcctcttgattcaccatcatgcaacatagacaatggttctgacttttctgactggatggactgctga

SEQ ID NO: 91549 - DNA, 186 bp, Glycine max
  Peptide Sequence Number=SeqID_183234
atggagcttaatacaaagatagttaagagccctatggcagctcaccctcattatagtaatgtcatcatccccattaaaaggctcatgggtagagattggaattgcattgtgcaacatgtttcccacgaggaaaatcaaagtgtgaatgttctagctaaaatgggggctgagagtggagatctttga

SEQ ID NO: 91550 - DNA, 645 bp, Glycine max
  Peptide Sequence Number=SeqID_183235
atggtttttcacttaaggcttgtaatgagcttcaaaacaaagaaaggggaacataggctcaaaggggctatcaaaggaattaattcaaggaagcatcaacaagaatcaagccaaggctattgtgcaagcaatcaatggggcgaaacacaccaaaagattatgatgatggatggctcaaattctcacaaaggtaacaggggcattgcacaggccgaaaggcatcctcctataggcaaaagtgccgaaggggcaggtgaatgtggtcttttcctgatcctcaggagcaatagtgatttgcatataaccagaaaaatcatcaaagaaacaatagtgagatttaccagccaggcgttcaagcatctggtcaatgaatggcagaggaaaatggtcctttttggtaacctggttcagcctcctatagtcgatgcagactctccaactgttctgcacccaagtaggaatcaactcttccttctcattttttatcacggtgaggccggttttctttgggactacctggacgggactcacccattggctgtcagagagaggataaatgattccagcttgcaaaagcttggttacctccttcttcactacatcaagaatcattgggttgagtcttctttgtggctgtcttactag

SEQ ID NO: 91551 - DNA, 150 bp, Glycine max
  Peptide Sequence Number=SeqID_183236
atggaggagaagggatggaaaaaaggaacagaaaatgatgaaagaaagaattccctaagggagagttcacaggtttgggttgttggagtggacttaggtctgcgtgctcacgcttggcgcgagtgcttgtattcgcgcgctactcgctga

SEQ ID NO: 91552 - DNA, 459 bp, Glycine max
  Peptide Sequence Number=SeqID_183237
atgacggagaccctcaacaagctccctcaacatttacaagcggtaagtccctctcactcttcactcatgcaaataaggggatgccacatctgcgatggagcacatgaaccagggaaatcaatagcccaagtagattcttatagggaggtgaactacatgggagctcagaaaccgccacagattccaaggctacaaccaaggaggaccgctgggattcaatcaagggaggaatttcacacagggctaaagctggaggaatcattcggggaaccaaccaacaagcttgaggggacactgaatcagttcatgcatatattcatgtccaaatataggagcacagagttatccatcaagaagctagagatacaagtgggacaattagccaaacaaatggctgaaagacccactagtagctttggagccaacacagagaagaacccgaaggaggaatgcatggcg

SEQ ID NO: 91553 - DNA, 246 bp, Glycine max
  Peptide Sequence Number=SeqID_183238
atgtgggtgcaaatagcaaccagacccacttgggccttccaggatattcctccagaaggcagttgcttctggaggaagcaacctggctcgcctgggcgagctggaaaattcaagccgaggcgcttccgtaacgtttccgtgggtgatttcgcaaagattttcaatcgttcttcgacgttcttcgttcgttcatcgtcgttcttcggtcttcaactgatttctaaaaagcctaaaatcaatatgtaa

SEQ ID NO: 91554 - DNA, 159 bp, Glycine max
  Peptide Sequence Number=SeqID_183239
atggaagcggtactcccatttgaagtagagatcccttccctgaggatactagctgaatcgggcttagaagaatcagaatgggctcaaacacgctatgaacaactcaaccttattgaagggattcctgtccgatgtaattgtctcgtcgcagttatttaa

SEQ ID NO: 91555 - DNA, 824 bp, Glycine max
  Peptide Sequence Number=SeqID_183240
atggctacctcaccaaaagaaacttccgctccaggttcacccgctgtacgatcatctccgcaccaggaacaaccagaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcggtattgtgagtagcattctgaaagatgcttctgtgcctgatgctgagaaagatgttccaacatcttccaccccagatgtttctgtgcctgatgtcaataaagatgttccaacatcctccgctccaaatgctgaagccatcccttcacccagtgaagaggaatcaacagaagaagaggatcaagcctcagaggagacccctgcaccaagggcaccagaacctactccaggtgacctcattgacctggaagaagtagaatctgacgaggaacccattgccaacagattggcaccaggcgttgcagaacgattacaaagccggaaagggaaaactcccatcaagaggtctggacgaatcaagactatggcccagaagaagagcactccagtcactcctgccacatccagaagaagcaaggttgctatcccctccaagaaaaggaaagaaatttcctcatccgattctgatgatgatgtcgaactagatgtctcgacatctaagagggccaagaaatctggaagaaaggtgcctggaaatgttcctgatgcaccattggacaacatctctttccactccattggcaatgctgaaag

SEQ ID NO: 91556 - DNA, 705 bp, Glycine max
  Peptide Sequence Number=SeqID_183241
atggaagggttagtggacctagcagtgattgacgctttcctcgcctttcatcatggcaaggaaagcccggtcgtcgccattttggccatgtacgacacgttcgaccggggatgtgaaaagagcgacgcaagaattttttgttgtgcactggctctctatgtgtggctggtttcacacccttttctatccgctacaaggtcaccgctcgaagggagaatcaggattctatcttcatgcgaaggatgtccaaatgttctcttgatgggaacaaggggttgtattaattataatcccgtcctcgccataagacagcttggctaccccatgagagagtgccatcagacgaaagcatcacgcctttcatcgcacggaggtttcagtgaccacaacgcgagggacagagagcttaggggaagcagtaatgggatcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaagtccatagccatcaaggcagcaatagtgagctcaagctccgaagaggtgaaaggaatcatcacgggtcaaaggcatgatcttgaaggacgagctaaaggcttgccttag

SEQ ID NO: 91557 - DNA, 207 bp, Glycine max
  Peptide Sequence Number=SeqID_183242
atggagagggaaatgatattggacacattaccggtgttatactatgagaagatggtggattacatgccttcaatctttgcagatttagtatttgtgggtgaaaggatcgaagtgggtctgggaagaggcaaatttgattattctgctttgatgaataggaagcctggggaaaatggagaaaataagaaggaattttacaccaactag

SEQ ID NO: 91558 - DNA, 393 bp, Glycine max
  Peptide Sequence Number=SeqID_183243
gaactacgagatcaccccaaggacgccttcggcatccaggggtcgcggaccgaccatagaaccctgttcaaaaagcggaacgcattagctatccgctctcaggttggacaaggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccgtga

SEQ ID NO: 91559 - DNA, 471 bp, Glycine max
  Peptide Sequence Number=SeqID_183244
atgacaccgaccatcccacaactttttctaaagtcgttgcaagttatgtgggatgctattgtgtttgggctatttaatgaaaacttctctttgtacataaagcatgaagatctatctgagataacacacggtggtcaatgtctcaacatttctcttatacaattgtggattctgcatatgattgagacaagtatgcgagcggggaaagccaatgtgtatggattcctcgagtcacagtccatacgaagatctgggcaatcgagcagtcgcgctcagcggaccatttgggctcagcgcacatccgacgctaagcacaacttcagtgcgcttagcgtgacaagggaatctagaagagcacaagaatcaaggccacgtgctaagcgcgagatcagcttgctaagcgagacgtttgtctcttgccaggctcaacacacgactagcgcccagcccaaatccacttactcacactaa

SEQ ID NO: 91560 - DNA, 253 bp, Glycine max
  Peptide Sequence Number=SeqID_183245
atggttcttcatttaaggcttgtagtgagcttcaaaacaaggaaaggaaaacaaggctcaaaagggctatcaaaggaattaattcaaggtaagtccatttggctagaagcttataagaacaaaattgcctcaatcatttccaaatatgcatgtgaattaggaagcatcaacaagaatcaagccaaggctattgtgcaagcaatcaatggggcaaaacacattatgatgatggatggctcaaattctcacaaag

SEQ ID NO: 91561 - DNA, 288 bp, Glycine max
  Peptide Sequence Number=SeqID_183246
atgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtgttaaggaaaaaagcccagagtttcaagaaccctgggatttga

SEQ ID NO: 91562 - DNA, 231 bp, Glycine max
  Peptide Sequence Number=SeqID_183247
atgcccttcgcaggcgagcgagggcgaggctcaagggtgcgctttccaaaggaggaaaggtgcgcggagtcgccaccgtttatttgtggaaaatgtcaggaaaaccgaaggaaaccggtcaaaatgagaattctaagttcgggagttgtatttacgcttgaggaaggtcgacaaaagcggggcttttgctcctacgtaccctcctttggagaggaaatcagacctacgtag

SEQ ID NO: 91563 - DNA, 153 bp, Glycine max
  Peptide Sequence Number=SeqID_183248
atgcgtccagctcaagacgttaaagaagcgctactaggaggcaacctagtagaaggataccttggatatgcatgtagcaagataccttggacacgcatgtatgtagcaaaatatctcatgaaaaaagagagagagcgagcaagaaaagaataa

SEQ ID NO: 91564 - DNA, 504 bp, Glycine max
  Peptide Sequence Number=SeqID_183249
tacccaaagcactggagtggtccagtagccgggaaggggcctagaagtgcctactactacaccacactacactcggctctacacatttacagagctcctgtccagtccttggcagagttaagggggcttccatccttattccctatcccctcgcccaggctaacggggccttattcagggggggagagtggagccccgagaagcactgttgagaggaagatccttggcccctcctcattctctacaggagggatggagaaagtggacaaaacagactcgcatttcccagtcgaaaagatggaggcaagtgaagttggtgagccgtatgatgggcaactatctcctgcggttcggagaggactcagctgttcaaagaaagggtgggcagaagttcgccttccaagagaggagacaggagactcatggcacttgtggctgttgagggccatccagttgcttgcttatgagagcaggaagctgaacggagccgagaggccctacgca

SEQ ID NO: 91565 - DNA, 1271 bp, Glycine max
  Peptide Sequence Number=SeqID_183250
cgccacgtcgcccggcaagaccaccaccgagacgccgcggttgaggatcgccttgcgcatggcgatctccagcacgcgcggcagctgttccgggttggaaaccagctcgcaatagtggctgcattcgcgaaacagctcctgcggatgcgtttcctggaagtagccgctgccgatttcgctggaaggaatgtgtgcggcgatcgccagcaccggcacatggttgcggtggcagtcgaacaggccgttgatcaggtgcaggttgccggggccgcaggaaccggcgcacaccgccagctggccggtgagctgggcttcggcgccggcggcgaaggcggccacctcttcatggcgggtgcccagccattcgatggtgcccatgcggtgcaggctgtcgctaaggccgttgagcgaatcgccggtcacgccccaaatgcgttttacgccggcttgatccagcgttttggcgatcagtgtggctacgatgcggtcaggaagggtaaagagcgtaggacgggggaaagtgtaaccgggcggggaggggggaacttgccgataaatgccccatcgcagagatggggccaagggcgtcatggtgctggtggtgatgtagtcgccctcgaggatgcgggttttgcacgagccgcacaccccggcacggcaggcggcgttgaccggcagggcattggtctccatcgccgccagcagcgtgctgccgaccggcacgcggaattcgcgcagcgggcgggcggcgcggccgcaggtcatcaccgtgcgttcggcgatatccggcgccgcctgccgcagcgtctgctcatcgatgcggccgctgaggtagccgggttgcagatcccgctcggccatcagcgtcaggcgcagctgcggatgggcggcgcacagcgcacgccactgatcggcgaaaatcgtgtcggcgggggtgcgcacgttaaagatcacggcgatatcgcaggccggacggttggcggtcagccagcggcacatcgagacgatcggcgtcacgccgcagccggcggccagcatcagataacgatcggccgggtggcgctcgcagctgaactcgccctgcgcgtcggacagccacagcgtgttgccgggcttgacctcttgcgtcagccagcgcgatccgatgccgtccggcaggcagcgcacgctgatgctgagaaagcggctctggccgggcgaggaggagagcgtataggcgcgcagcgtctcctcgctgttgcggatgctgaccagcgcggggatcctctaga

SEQ ID NO: 91566 - DNA, 153 bp, Glycine max
  Peptide Sequence Number=SeqID_183251
atggcggaaaatcttcacggaatcacccacggaaatgtttcggatgcgttacagaaacgcctcggcgtggattttcttcacggaaatgattttttcactaatttcaagaaaatgagggaggagcttgccacccagctcgcccaagcgagctag

SEQ ID NO: 91567 - DNA, 387 bp, Glycine max
  Peptide Sequence Number=SeqID_183252
atggcggcgcagctaatccatgatcgagtggagatggagtgcctagagggagcttgggagaccctcgaaggcaacgtgaagtgccgattttggggcacgattcgattcacggctacttctttggtgcatccagatgaacccgtgcgcacgcttcagctggagccagtccaagtgattgaggtaacgtcgtccgaggaagaccctgaggaggatcttgaggagctacctctcgagcctgctggggatgctcttgactttctagagggtgatgaggacccactccctgaggtggattctcccgaggaagtcatgtcggcatatgaggcagactctacggaggatagtggcccgagagagatggcgaccagtggaggctcttcatcatag

SEQ ID NO: 91568 - DNA, 120 bp, Glycine max
  Peptide Sequence Number=SeqID_183253
atggagattattgatcgtgctggcatgtcttcttacccagtgcaacaggtgtgcttattcatgcatgacccaaaggatgagcacatgcaagctctcaagtgcatattgcgctacatttag

SEQ ID NO: 91569 - DNA, 372 bp, Glycine max
  Peptide Sequence Number=SeqID_183254
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccgcccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaaggggatgtgctgcaaggcgattaa

SEQ ID NO: 91570 - DNA, 249 bp, Glycine max
  Peptide Sequence Number=SeqID_183255
gtaatcgttgtggcgtctaccctgacttatcttccttcactggaagtggcgtctaccctgacttatcttccttcaccggaagtggcgtctaccctgacttatcttcctttaccggaagtggcgtctaccctgacttatcttccttcaccggaagtggcgtcatccaaaagactctacaacctgtatcaaacgatccgctcctacttaggttcacgtcatttggtatcagagctttagttcttgatacag

SEQ ID NO: 91571 - DNA, 195 bp, Glycine max
  Peptide Sequence Number=SeqID_183256
atgaccaaagtgaacagaggagccatttctaggcttgggaggattgatggggacccggtgttgagagaaacgaggatatgggctacgtgggagtacgtgagctcagttggaggtgggcaacaagggattgtgggtttatgtgcgatttgtggatgtggaaaacttgttgtgcaccatcgcccgaccgccacctag

SEQ ID NO: 91572 - DNA, 257 bp, Glycine max
  Peptide Sequence Number=SeqID_183257
gagatttcaatccttggaagcctggaaccgatatacatgtcataccctaatttcgtccaggtaccattgtttgacggcatgcaacctttgtttgaccacttcgaggatgttcctccagaaggcggttgcttctggaggaagcaacctatctcgcctgggcgagctgggcgtttccgtaacgttttcgtgggtgatttcgcgaagattttcaaccgttcttcgtcgttcgttcttcgtcgttcttcgatcttcaaccg

SEQ ID NO: 91573 - DNA, 684 bp, Glycine max
  Peptide Sequence Number=SeqID_183258
atggcccgcaacgagcgcctggactactgcctggtgggcgagccgtccagtaccgaagtggtgggtgatgtggtgaaaaatggccgccgtggctcgctgacctgtaacctgaccattcacggcgttcaggggcacgttgcgtatccgcatctggctgataacccggttcatcgcgctgcgccgatgctgagcgagctggtggcaattgaatgggataaaggcaacgagttcttcccaccgaccagcatgcagattgcgaacgtcaaagccgggaccggcagcaataacgtgatcccgggggattacttcgtccagttcaacttccgcttcagcacggaactgaccgacgagatgatcaaggcgcgcgttatcgccctgctggaaaaatataacctgcgctacaccgtggactggtggctttccggccagccgttcctgacacagcgcggcaagctggtggatgcggtggtcaacgccatcgagcactataatgaaattaagccacagctgctgacaacgggtggcacctcagacggacgctttatcgcccgtatgggtgcccaggttgtcgaactgggaccagtgaacgcgaccattcataaaatcaatgagtgtgttaatgcggcagatttacaactgctggcccgtatgtatcaacgtattatggagcaactcgtcgcctga

SEQ ID NO: 91574 - DNA, 393 bp, Glycine max
  Peptide Sequence Number=SeqID_183259
atggttctatcagctgtccttcctgttcagtctgaacggggtggtgttatccgtccaattcgcacacaagcataccgagccggaccagcgcataggcaatcagggactgtcgcaactgttaagaacggcaacgcggggatcgagtgcgggcctcttcgctattacgccagctggcgtaaagggggatgtgaactgcaaggcgattatagttgggtaactggcagggtcagtgaatttcccagtcacgacgttgtaaaacgacggccagtgaattgtaatacgactcactatagggcgaattggagctccgcggtggcggccgctctagaactagtggatcccccgggctgcaggaattcgatccatgcaggcactaaaagtatgttcggatag

SEQ ID NO: 91575 - DNA, 1188 bp, Glycine max
  Peptide Sequence Number=SeqID_183260
atgcaacaaagtggtgaagtgaacttaatttattgtaagtctaaagatcaactggctgacatgtttacaaagtcactacctatcaacaaacttgaactcaaagaattggagtttgcagttccaaaagcaaggaggagtgttgaagatatacttttgtgtctgaatgtattatatgtgggcgatacgttgtgtgtaaaaacgcaaactacggacaatgatgtttgtgagttgggaggttcacctggtcctgtgtctccaaaaaatcatcagctgaagtctcctttgagttcacataggaaagcttccatctctttgaataggttgaggtcttcaattgctgagttgttacattctgacaagcctgtctctgtagattctaatccagaaggattcactgcaatgactaagttgcatatatggaaaaatgtcatttcacaagtactggagcagacagaaactaaaatttgttcacttgagaatgaactggagccactacaatttgaatttggggatggaatgccatgttacaatacaaaatcctgtgataaagaaattggagactatcataaggttactcatcgtccagaactgtcacaaattggcccttccaatgacgacaacaacatagagaagatgatgcctctttcagctaacttgcatggtatgcatgatactaccaaggaaaatgatatcaatagtcctgggacaacaacaccgaaatttgtagaagcgcaacctttgataaaaatggtttcttctcttggtggtggtagttcattttcgtcattaatgggaattgaagatgggatgaaagctcacactagcataagcttttattccagtattcacgatgatactttgcctaacactattatttcttccaatagagaaactgcacaaagtgcatatataatatttaagaaattctcgcataacaaaactggcaagattatcagtaatgttggagttagcagtagctcactctctcatgttggtgcattcattaaagacaaattagcagagaaaaacaggtttgcaggatttaaggagaaagttttaacaattatgtataaagcccttgatcatctatggaagagagatatgtgcttaagatatccgaggaaatgcacccgaacctctcctagaaatctcaaattgcgtctcaaagctgtcactaaccgatgttaa

SEQ ID NO: 91576 - DNA, 720 bp, Glycine max
  Peptide Sequence Number=SeqID_183261
atgaggatgagggaagcacaaaccatcatccaaggcaagtgccccataagagtaaaaataacagccattataaaaaatgctgtttcaatcccaaaaacaaatgagaacttccgcctgctctatgacactaaaggccgattccgtcttcattccatcagggatgatgaggcaaagttcaagctctgcaaggttaggtcagtgcagtttggcccgaaaggtatcccatacctaaacacctatgatggtcgcacctccattacccgaaccctctcatcagggctaatgacactgttaagctggatctggaggaaaacaagattgtcaatttttatcaaatttgatgttgggaatgtagttatggtaacaggtggaagaaacagggggcgtgttggagtgattaagaatagggagaagcataagggtagctttcatgtgcaagatgccactgggcatgaatttgctacttgtatgggcaatgtgttcactattggcaaggggacaaagccatggatatccctgcccaagggtaagggtattaagctgggttcaaattctgttaacattcatgttcctatagattgtagtcctaaagggatgttggttgagatgaacactcagtgtgcacatgcagacaatggatgtggaagttgcagttgtgaagataatgccatgaatgagcctatacttaatagcaaacttgaagctgtaacatatgtatga

SEQ ID NO: 91577 - DNA, 270 bp, Glycine max
  Peptide Sequence Number=SeqID_183262
atgatacctagcgttcgagggctaggtgtcgcaacctacccttcggcgggagggcgacgcgagactcgcgggatgcgtattccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 91578 - DNA, 177 bp, Glycine max
  Peptide Sequence Number=SeqID_183263
atgaccaagagcaagggcaaggatccacttgaaggacttggaggacctatgacaagggctagagcaaggaaagctaaggaagctcttcaacaagtgttgtccatactatttgaatacaagcccaagtttcaaggagaaaagtccaaggttttacactcagccattaagttcttttaa

SEQ ID NO: 91579 - DNA, 393 bp, Glycine max
  Peptide Sequence Number=SeqID_183264
atggggcagcccaaattcgagcaaaaactctcacaagcaagtcctaattttcatgcttttctaatactaaaaccaaattttgggttcctagccatgagtatgttttcttgcattaaagctgaaaagtttgtgttcctaagcttgaaattgcattcccaccatcccaattttgcaaaaccatattcatatatcgttggggcatttcaccgagcacttggtgggtgcacgtttggacataaattgcaagagaatgggggcaatgtggcatgccccattgcttcagaacacaacataggcctaaggccttctcattcaaatcctcaactcaagaaatcaagcataaaaaacaacccaaaactgccccacaaatataagcacgttctcacaatttag

SEQ ID NO: 91580 - DNA, 468 bp, Glycine max
  Peptide Sequence Number=SeqID_183265
atggttcgatattggtgtttggagatggtgtcaacagctacacaggaacttcaacacctgaggagtgagcgagaccgcattgagaatgaaatgcatcatctaaacaagtttctcaggccaatttggggaagtatatcaagcaacttctctaaattagggtttggcagcaattgtgggcaagaaccattgtgcacacacgattcttggcacaccaaaatttatggctccaaaatggtgacagtagagattccttatagtgaatatgacaatgttgctaagatatacaagaaggtgtcttctggagttagacctgctgccttgaacaaggtcaaagatcctgaggttaaggctttcattgagaagtgccttgctcaaccaagggctaggccttctgcaactaagcttgtcagagatcctttctttgatgagattgttgatgatgatgactgttcttgttcatatcaatag

SEQ ID NO: 91581 - DNA, 847 bp, Glycine max
  Peptide Sequence Number=SeqID_183266
ggagaaagattctttcggattagaagaacatagtggaatagatctgagtggtaacactgatccagaacatgatatatccaacaacactcaaggttccagtgaaggggttgagcatcaaactagttctgttggtgacatccataggactcatgttaatgaatctattggtgacatccagaaaaatgcatccaagaaacaagtggaaagtcctaacaaaaacattgaagctgaagatgtaaaggaaatttcacatgttgtgttcaaggagacaggaaaggcttcagaagttgaagtaaaagatgtgaaattgaatcatccagaggaaggtagcaacgcagccaagactaagaacaaatcaatgctacctacttctaaggcatccccaatttcaacaccaaaaagttcaaagcctgcatcaaaaactcctaacaaaacagtgacacctgcttcttcaactagaaagggaagctctccatctttgactatgaggcaaattacttctgttgaagacaaatctatgataaagaagcagggacttagtgtatctttctgtaatcaaacaatgacaatggcagtgagatctaaaacaatggcagtgagatctaaaacaatggcgcggagacttgaagctttcctcgtacctcgatcagaaacaaagaagaagaagaagaagaagaagaagaagaagaagacaacaaagactaaggtccttgtggttacaaagaaaaagaagaagaagaagacaacaaagactaaggtccttgcggttacaaagaagaagaataagaagaagttgtacctaggtaacgtggctacgtgtcacggtcgcaaagaagctgtacaatga

SEQ ID NO: 91582 - DNA, 546 bp, Glycine max
  Peptide Sequence Number=SeqID_183267
atgtggtttgctggctatgcacaagcactttcgcacctgtcaggccaatacaatgtttctaaagcaggagatcagttaagcttagttccaacatctgagatgataaattatacaagccaactgctttcaaaaccccaagatgaagttaacagaaaaatcttgaagatgccagcattaattttggatcaaaaggataaaatgttttcaatgttcaattctagtaatgagctggtagaagatccattggctgttgagagagaaagggctatgatcaactgttggacatcagaggagagaaagattttctcggagaaattttcagcctttggaaaagactttcgaagaattgcttctttcattgaccacaagacaactgctgactgtgttgaattctactacaaagatcataagcccaattgtttagagaaagataagaagaaaaagaacaagaagaagggttgtaacagtcagaagtcgaaaacattgaaaactatcgtgaaaggattgggtaaaaaaggaaatcgtaaagcaaatgttgattcatag

SEQ ID NO: 91583 - DNA, 483 bp, Glycine max
  Peptide Sequence Number=SeqID_183268
atgtgggctttccttaccggtcgtcagatcgactgggctcacttggttcggtaccgaatgcataaggcattacgggccaatgcacatctcccttaccctcgattggtcactctctttctccgtcattttcaaattcctcttgatgatgaaccttttgttcaagtcaagcgttcctttgctataggtgctggtgcagtcacttcttttagttaccgtaaggatcgtaatggccaatggctgaagaaagatgcacttcctccacaagatgagcacactccttctcttcctcctcagcgagatgattcagcccttatgactgaagttcttttagagttgtggggtcttcgcacttatgttggtgaacattttgattctttggataatcgctttgcaggaatggatatctgtctcacacagcttgaagaagatgtgggatatattcgtcagagcttcgatcttccaccaccaccaccaccttcttag

SEQ ID NO: 91584 - DNA, 411 bp, Glycine max
  Peptide Sequence Number=SeqID_183269
atgcatagtagcagtgtgatagcctccctctctagttgtgctcgcacagttggccctcctccaatatcagggggtggcccaggaaccgttaaaaggaaactactggtgtggatatggagcccactgaaagtgaggacgcgtagtcctctaaaggcgagggcgtgtagccctctgaagttcaggacgtgtcgcctttcgaaggcgagggagtgtagtcctatgatggcaaggacgtgcaatcctctgaaggtgagggcatgccccccttttgaaaatgggggaacatgtagtcctctgatggcgaggacgtgtagtcctctaaaggtgaggacgtgtagtcctctgaaggtgagggcatgtagccctacaaaggtgaaggcacatgacccctttgacggcgaggacgtgtag

SEQ ID NO: 91585 - DNA, 492 bp, Glycine max
  Peptide Sequence Number=SeqID_183270
atggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggtattattaggcaccaaatccctaaaataggtggtgtgatgaatgctttgggtggtgcaacactcttttgtaaaattactcatgcacccaacatcttcatgatttgtgtacatagggactcattaggtagggttcccatgaaccctaagagaataaaggtcattcctgagtggcccgctccaccaagtgtgttaagggaaggagcccagagtatcaagaacctcaggatttga

SEQ ID NO: 91586 - DNA, 498 bp, Glycine max
  Peptide Sequence Number=SeqID_183271
atggttaaggaggactgtcaggaggtaagtgtctcctcgaagaggttagctaagaagggaatccattttgaaataaagacaaatattcaagaaacttcccctcttagacaacctcctaatcttctcctttgtaaaaagacacttgttagcactgcctcacctcttgggcttgatattattcctcaagtaaaggagttgttggatgagggtttgattcgtaagaacttaaatccttttgctttgttggtgcccaaaataggtattattagacatcaaatcactaaaataggtgatatgatgaatgtgttgagttatgcaaccctgttttgtaaaatcactcatgcgcccaacatcttcaagattcatgtagatagggactcattaggtagtaatcaagggattcccattaacactaagagaataaaggtcattcttgagtggcccactccaccaagtataaggaaattttggtgcttccatgagttaacaaacttgtag

SEQ ID NO: 91587 - DNA, 375 bp, Glycine max
  Peptide Sequence Number=SeqID_183272
atggcttacgaacggggcggagatttcctggaagaggccaggaagagacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaa

SEQ ID NO: 91588 - DNA, 54 bp, Glycine max
  Peptide Sequence Number=SeqID_183273
atggccgaccagcaggctaccaagtccaaagccaaaggtagagagataccttag

SEQ ID NO: 91589 - DNA, 249 bp, Glycine max
  Peptide Sequence Number=SeqID_183274
atggcgatacatttatacaaaacttctaccccaagcacacgcaatggagccgtagacagtcaagtaaaatccaatccacgaaatcatttgatctatggacagcatcgttgtggtaaaggccgtaatgccagaggaatcattaccgcagggcatagagggggaggttttacggcgaaacctagaaatcgatcactgatccaattggagtacctctacagggatagacctcaacagaaaactgaagagtaa

SEQ ID NO: 91590 - DNA, 347 bp, Glycine max
  Peptide Sequence Number=SeqID_183275
atgggggaatacgcaaaagatgaggaattgctaatacattccttccaagaaagtcttactgggtatcagtacaattttgatatggttccggataggatgcaactacagaacatttgcaaaaagggggacggatctttcaaagaacacgcccaaaaggtggagggatctggcggcccaggtggtacccccaatgatggaaagggagacgatgatcgtgatggcaaatttgatcatcctactaggacgactgagaaaactggggcaaatgaagagggtgagaaagagggagaaacccatgctgtgactgccattcctatacggccaagtttcccaccaaacccaacaat

SEQ ID NO: 91591 - DNA, 339 bp, Glycine max
  Peptide Sequence Number=SeqID_183276
atggctctctctctctctctctctctctctctctctctctctctctctctctctctctctctctctctctctctctctctcatgcatagttgtaaaatttggtttgtcctgatcgatcggactagtccaacaaggacctattggcataatcgaggaacttgctgcaccaacctcaccgctggaaacacggacgaagacgtcgacgacctgggaggggtcgaacttcgacaacattgtgaagtggtaatcatcaaagaagaggcacaatgcaacaggaagagacatagcaggaagaggcgcaatacaataggaagagagggttatacatattgggattaa

SEQ ID NO: 91592 - DNA, 210 bp, Glycine max
  Peptide Sequence Number=SeqID_183277
atgaatccttcattccctaacaagggaagtccaccaatagagggcatacccttgaaagctaagggtagccaatggaatttttctctcttcgctaatatgatggtgtcataccctaatttcgtccggcaaccatctgttgttgggatgcgaccctcgtttgaccactttgagaaaattcctccagaaggcggttgcttctggaggaagtaa

SEQ ID NO: 91593 - DNA, 252 bp, Glycine max
  Peptide Sequence Number=SeqID_183278
atgacttccaagattattttgatgatgccaaagaatcaagagttaagcaagttccaaagaatcaggcttcaagaatcaaagaacaagagagggtacatctcttgtggatcagttcaagtggagggtacatccacttggtttttcaaagagaacaagggagggtacatcccttgtggatctttggcttgtaaaggattttacaaggttgaaagaaatctcaagaaccgttggttgcttgaggactggatgtag

SEQ ID NO: 91594 - DNA, 765 bp, Glycine max
  Peptide Sequence Number=SeqID_183279
atggacagaagtatgatagatgcagccagtggtggagcccttggagacatgacccctgctgaagccagaaatttaattgagaagatggcttccaactcccaacagtttagtgccagaaatgatgccatagtcattagaggagtgcatgaagtagccacgaattcatcttcagcagttgaaaccaagaagcttgaaggtaaactagatgccttagttaacctcgtaacccagctagccttgaatcagaagtctatatctgtcacaagagtctgtggtttatgctcctctgtcgaccaccacacagacctttgcccttctgtgcaacaatctgaagcaatcaaacagcctgaagcttatgctgcgaacatctacaatagacctcctcctcctcaacctcaacaacaaaatcagccacaacagaataactatgacctctccagcaacagatggtcgaatccttcacaagagcagccacaacaacagccttattttcagaatgttgctggcccaagcaaaccatacgttcctccaccaattcagcagcaacagccccaaaaacagccaacaattgagactcctccgcaaccttcccttgaagaactcgtgaggcaaatgactatgcaaaacatgcaatttcaacaagagacaagagtctccattcagagcatgactaatcagatgagacaattggctacacagttaaatcaacaacagtcccagaattctggtagattaccttctcaatctgtccaaaatcccaaaaat

SEQ ID NO: 91595 - DNA, 241 bp, Glycine max
  Peptide Sequence Number=SeqID_183280
gccttgaggattacttcccaaaactgtttgatgaaattgaaattcaaaccatccaggctaggacttttatctccctcgcaagcccaaactgcagacttgatttccagctcagtgaatctatcaacaaggctttccttctgcctttgatcaagggaagagaactggatcccttccaaggttatcatagactacttttaattgacattgttgttgaaggtcgttcgggttatagcaactccag

SEQ ID NO: 91596 - DNA, 273 bp, Glycine max
  Peptide Sequence Number=SeqID_183281
atgaaatcgctcacggaaacgtctcggaagcgttacggaagcgcctcggcttggattttcttcacaaaaacaatttttctcactaatttcaagagaatcctaaataccagaagggctgaacgaaattactctgccctctttcccctatttatagggaaaaagagggaggtggttgccgcccagcttgcccaagcgagcgcagctcacccaggcgagctgggttgcttccaccagaaggcaccgccttctgtcggaaccgcctgtaaggcctaa

SEQ ID NO: 91597 - DNA, 645 bp, Glycine max
  Peptide Sequence Number=SeqID_183282
gaattagaccacagaaagcaagtcgaaaatggggtggttggagtaccaaggaaatgtttggaagcaaaagcaagagtcttggcaggtaaaggcgaatgggccccgttcatggacatcctcgcacttttgatcttcggaggggtcctctttccaaatgtggatgggttggtggacgaagcagcgattgacgcttttctcgcctttcatgatcgcaaggaaagcctcgttgtcactatcttagccgatctatatgacaccttcgaccgaagatgtgaaaagaacagtacaaggattgtttgttgtacttcggccctctacgtatggttggttttgcaccttctctgccaagagcaagcaaataaggagcatctgacaactggttccctcgatggaaagaaggaagaatcgggattcttatttcgtgcagaggatttccaaattagcaccaatgcggaggcacttcagaaggtccgcaaggcatgggagatggtgcaaaataaggaccaggaactcagaggcagtagcaacgggcccatcggcggctgccataggtggttgaaagcctacacgcaaggtctggattggctcccgaatttgagaaccactaagggggtggaagttgaagttacgaaggaggacgaagag

SEQ ID NO: 91598 - DNA, 768 bp, Glycine max
  Peptide Sequence Number=SeqID_183283
atggattgggaccagctcttggtcgggataggaggtagaacaatcagttggttcccccgatggaaggaaggaaaagaaggagtccttttctcatgtgggagatacccaaacattccgctggtaggaacgaggggttgtattaattacaatcccacgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcgttcgtaatggcatcattggtgggtaccacgaatgggctgaaatcgtcagcgaagagaattttgaagcaccggaagaggacgaaggaagtccaagctctcaaaagcgagttaggaaaggcaaaactcgccaaggagaagttcaagttggctgctacacacgttcggaaggagtgtgccgggttacgggaagagaatgcaattaccgcaagaggcccttgaacgagagaccaagagggctcgcaaggaagagtatggccggaacaaatttcgcggagctctatggggtagcaatagtgaactcaagttgcgaagggaagaaagggaccgagaccaacatgttagctatcatcgccaagtacgaagaagagttgggtctagccacggcccacgagcatagaatcgcggatgagtatgcccaagtatatgcggaaaaagaggctagaggaagg

SEQ ID NO: 91599 - DNA, 426 bp, Glycine max
  Peptide Sequence Number=SeqID_183284
atgagtcttcatttttcgtctagtgttaatggtgagggttcaactcctaagaaccccttgtataagatattagatgagttgagatcccttaagttgtggaaagaaaaacaagagagaaaagaaaaagataatgttgaggcctacttagattgggaaatgaaggttgaacaactctttgcttgccatcatattagcgaagagagaaaagttccattggctacccttagctttcaagggtatgccctctattggtggacttcccttgttaggtgtcataccctaatttcgtccggggacctttgcttgatgacatgcgacctttctttggtccttgtgaggtgtgaaattctgataccaatcccagatgtcgtacaggatgtcacgacatcatgcttcagaacatgcagattatatctgagtgtatga

SEQ ID NO: 91600 - DNA, 231 bp, Glycine max
  Peptide Sequence Number=SeqID_183285
atgcttgccgcccagctcgcccaggcgagcagggttgcttcctccagaagcaacagccttctggaggaatattctggagggcccaagtgggcctgggtgctatttgcacccccatttttactaagtgttgaggaaagaatccctgagtttcaagaacctatggatttgaggtcaaatccttttcaagggggagggaatgatgcaatcctaccccccaagggcattggatag

SEQ ID NO: 91601 - DNA, 849 bp, Glycine max
  Peptide Sequence Number=SeqID_183286
atggacagagccaggttgatctttggcctggtctctcatatggacatgaacattggcgctctcatctcaggacagatgacttccattgcccagtctaactcttgcagacttgcgtttcctactttgattaccgtcttatgccgagcccgaagggttgtctctgacagcctcacatttgagtgcctgagcccggccattaacttggcctacatcaggaagaattgttgtaacattgatgatctaatagttgctttccggggggctaggagggcgagggcgaggccaactgatattccatctacttttgcagcttcagcacctactctagcatctacttctgtagctccttcagtcccagctcatgttgacactcagcgctttgaagccatgcttcaaactattcatcagggacgaattcttttgctgcatagtctacaggtggtagctcctccacgatccatcctatcaatggcgcagttcttagagagggaaggtgaaggttccacagcccaggtaccccaacaagtacaggatgcttcatctgagaccaccattccagagccattcactcttcatcatgaggcaggtgaagaacaggtgagactagagactgctgctactcctgagagatcacttgagggcacatcacagcctcctactcttgtggcagacctctcctcaccacagcctacagctgacccttccactcatttacttgacataccagaggacccgaccacaccagtcctagcattgaacacctctcctccagctactccagtacttcacttgacagatgaggaggatgctcagactcaggatacacaggatcgatctcaggaattttaa

SEQ ID NO: 91602 - DNA, 105 bp, Glycine max
  Peptide Sequence Number=SeqID_183287
atgaatgttgaaaatgaggaagatgctggcgttaaagtagaacacattgattgctcttatgcctttaatacttctcagttgtttgctagtcgtgatgaagtttaa

SEQ ID NO: 91603 - DNA, 474 bp, Glycine max
  Peptide Sequence Number=SeqID_183288
gatcccactcagttggtgtacgccatcctgacacggatgagcattcacgtggctcagttaatcgctgatgccatctatctatttgcagtccccgtcgcacctagcaaggctcagggggatgctccgcaggccgcagacgcgccgccacctcatcaggctgacccagctggatcatttgatacagagcagtatttgtggcatttggttcgccagcaggcggccaaccaccgggcgcatgtacagacccatgattgtctttaccagttgagcctcagcctgcagagccagggttttacttcttttccgtgccctactctggatcaattcagggcagaggtcgcgtggcccggagattggcctgaggcccgggcaggagaggcaccagcagaggctcccgacgaggcaaatgaggcccgtgaggacgaggagatgaccgatttacttgatttcttaggagggagcgaagccacatga

SEQ ID NO: 91604 - DNA, 46 bp, Glycine max
  Peptide Sequence Number=SeqID_183289
atgacttgccggaagcgggatttgaagcctgaaacaggtccaggag

SEQ ID NO: 91605 - DNA, 567 bp, Glycine max
  Peptide Sequence Number=SeqID_183290
atgagcagaggccaatgtggtcatctgcgccttttccggagatgtcagcattttccgatggagacttttaaagtctcacaagttatccagaactacgtagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggaaataccttactggttatccgcatacctcttttgctatcagcagaggtggcgggcgctga

SEQ ID NO: 91606 - DNA, 186 bp, Glycine max
  Peptide Sequence Number=SeqID_183291
atgggacaccttagtgatcaaggggtatccacgaaccctaagagaataaaggtcattcctgagtggcccactccaccaagtgttgagggaagaagcccaaagtttcaagagcctctggatttgaggtcaaatccttttcaagggggagcgactgatgcaatcctaccccccaagggcattggataa

SEQ ID NO: 91607 - DNA, 264 bp, Glycine max
  Peptide Sequence Number=SeqID_183292
atggaatcacaatttgaatcaaaagattatattaagaaatggatgcataattcacaaagagatgtgtacctaggagcctacttgaatggtgctttgaagagattcaacgacagtcaagcaagtatatccaaggctgctgctagatggatcgtagttaaatattctactagtcaaagaccattggaaccaaaaagaatgaaggatatttgcattcagtgggcaaaatattatttgaaagttaaaaatcaaacactaggagtttaa

SEQ ID NO: 91608 - DNA, 677 bp, Glycine max
  Peptide Sequence Number=SeqID_183293
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgttatgggccgcgtttgtctcatttccacgcctgacactcagttccggggagggcagttcgctccaagctggactgtatgcacgaaccccccgttcagtccgaccgctgcgcctttatccggagttagtcttgaagtcatgccgccggttaaggctaaactgaaaggacaagttttggtgactgcgctcctccaagccatcgaattcctgcagcccgggggatccactagttctagagcggccgccaccgcggtggagctccaattcgccctatag

SEQ ID NO: 91609 - DNA, 765 bp, Glycine max
  Peptide Sequence Number=SeqID_183294
atgctccactcggctcggggggatatagctcagttggtagagctccgctcttgcaattgggtcgttgcgattacgggttggatgtctaattgtccaggcggtaatgataggatcttgtacctgaaccggtggctcactttttctaagaatgggaaagaggaccgaaacatgccactgaaagactctactgagacaaagacgggctgtcaagaacgtagaggaggtaggatgggcagttgggcagatctagaactacgagatcaccccaaggacgccttcggcatccaggggtcgcggaccgaccatagaaccctgttcaaaaagcggaacgcattagctatccgctctcaggttggacaaatcagtcggggcctgagaggcggtggtttaccctgtggcggatgtcagcggttcgagtccgcttatctccaactcgtgaacttagtcgatacaaagctatatgatagcacttccatttttccgattcggcagtttgatctatgctatgatttatcattcatggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctggtga

SEQ ID NO: 91610 - DNA, 256 bp, Glycine max
  Peptide Sequence Number=SeqID_183295
atggctgaagaacatcaacatagggttacccttgaagattactccagtagttttgtgctgcaattctttacaagaaaagccaagaagtggctccatttattcaaaggcaacagtctgaagacgtgggaggaagttgttgagaaatttctgaagaaatacttccccgagtcaaagactgcaaaagggaaggctgctatttcatcattccaccagttccctgatgagtccttgagtgaagcattggagagatttcatg

SEQ ID NO: 91611 - DNA, 927 bp, Glycine max
  Peptide Sequence Number=SeqID_183296
ggcctgaaatcgctcaccgattactacctgactcacaacctctccagtgacgaagataagcgcctgaccgagctggcctttgccaatattcagcgcgtgagggagcggctgccggcgtttctcactgcctcgcgcgcgcatcagaacgccatcagccttgatctgatcgaggggcagaacggcattggtgccgccattcgccagctggtcaccaattaccagcagcagctgatgctgaatatttctatcggcgatgagttacgcgccaccaacctcagcaccttccatgaagtgctgtggaccaccattaccggcgtgatagccacagtgattatttttggcctgttcgccctgttcaccgtgctgcgcattcgtcgcagtctgtccgatgtcggcaaagtcatgatgcacgccagcgaaaatctcgacctgacgctcagcgcagacgaaagccttcgcgatgaggtgggcaatatggcgcgctcctttaatcagctgatgcgcagcgtggccggttcgctgagtgccgtgcgcagcgcgtcgcattcggtgagcagcgcatcggtgcaaatcgccgccggcaatgaagatctctctgcgcgtaccgaacagcaggccgcctcgctggagcagactgcggccagcatgactgaactgagtgaaaccgtacgtcagactgccgataacacgcgtcaggccagccagctggcggctaacgccagttcgctgtcagaaaaaagtggtacctcgctcagcaccatgctctcgaccatggatgatattcgtggcagctcgcgcaaggtcacggacatcgtctcaatgatcgaaggcatcgctttccagaccaatatcctggcgctcaacgcggcagtcgaagccgcacgcgccggtgagcacggcaagggctttgcggtggtggcgggtgaa

SEQ ID NO: 91612 - DNA, 228 bp, Glycine max
  Peptide Sequence Number=SeqID_183297
atgtccccacttgaaagggatatgatatcaacaactattcattctacacaaagtcacaggatgatagaagtagcatgcagaacagtgagtgcatcagataacaacccaattcgagaatccatgccttactttggagtgattaaagaaatatgggagcttgattatagtgaatatagagtgtttgtcttcaagtgtcagtgggctaacagaaatattgatgtgcgttaa

SEQ ID NO: 91613 - DNA, 174 bp, Glycine max
  Peptide Sequence Number=SeqID_183298
atgggccccaaatctaccctaaggctcatgagaaccctagggattgcatcagttgcatggcatggagataggcccagttttcaggcaggggcaggacctgcagaggccccaggagatgaagatggagctcaggaagacgatgacatggccgatgtgatgaacttcttcctttga

SEQ ID NO: 91614 - DNA, 411 bp, Glycine max
  Peptide Sequence Number=SeqID_183299
atggttaaggaggagtgtaaggaggtaagtgtctcctccaagaggttagctaagaaggaaagacattttgaaataaagacaaatattaaagaaatttcccttcttagacaacctccacattttctccattgtaaaaagacacttgttagcattgccacatctcttaggcttgagtttattcctcaagtaaaggagttgttggatgagggtttgcttcgcaagagattaaatccttgtgctttgttggtgcccaaaataggggttcccatgaaccctaagagaataaaggtcattcctgagtggcccgcttccaccaagtgtaagaaaaatttggggcttccaagacttaacaaacttttacaaaaggtgttgaggaaaaaagcccagagtttcaagaacctcgggatttga

SEQ ID NO: 91615 - DNA, 1070 bp, Glycine max
  Peptide Sequence Number=SeqID_183300
acgtgctcaccttcataggactacacgccctcgccatcagtggagcacacgtcctcgccttcacaggactgcacatccttgcctttagagaactacacgtccttaccttaagaggactacacaccctcgccctcataggactacacacccatgccatcagaagagcacacgtcctcgccttcagagggctacacgccctcgccttcagaagactacacgtcctcagcttcagaaaactacacgtcctcgccatcagaggaatacacatacttaccttcagaggactacacgtcctcgccatcagaggattgcacgtcctcgccttcagagggctacatgccctcgccatcaaaagactacatatcctcgccttccgagggctacacgccctcgcctttagaggactacgcgtcctcaccatcagagggctacacaccctcgccttcatagggttggactccctcgccttcataggactagacatgcttgccttctgcaggcaatatgcctcacctttagaggagtacacgacctcgacatcagagggctacacgccctcgcctttagaggactacacggctacacgccctaacctttccttgagagggcaacacgccctcgccttcataggactacacgtcctcaccttaagcgggctagacgtcctcaccttcagagcacaacacgtccttaacttcagaggactacacgtcctcacgttaagagggctgcatgccctctcctttagaggactacatgagatcttgcacctcctcgccataagtgggctagacgtcctctccttcagaggactaaacgcccttgccttcagaggactagacgtccttaccttcagaggactacacgtccttgccttcagagtgctgcatgtcgtcgcctttagaggactacatgtcctcttgcacgtcctcgccttcagagggctacacgccctcgccttcagaggagtacacgccctcaccttcataggactacacaccctcgtcatcagaggagtacacgtcctcgccttcagagggctacacgccctcgccttcagaggactacac

SEQ ID NO: 91616 - DNA, 138 bp, Glycine max
  Peptide Sequence Number=SeqID_183301
atggtgatttttatccatggagttgcagcgcaagataaaggagaaaagcctaacatatgggaagcttccttgagaagcaaggaagaaagcttccttgagaagctagagaggggttgcttatacccctccaatagctaa

SEQ ID NO: 91617 - DNA, 1071 bp, Glycine max
  Peptide Sequence Number=SeqID_183302
atgcggctggtcgagatcgggtccagcgccgaggtcggctcgtccagcagcagcaccgacgggcgcagggcgacggcacgggcgatgcacaggcgctgctgctggcccaccggacaggcccagtgcgctctgccccagcttgtccttcacttcgtcccacagcgcgccctggcgcagcgcctgctcgacgcggtcggccatgtcggccttgctcagtttctcgtggtggcggatgccgtaggcgacattctcgaagatggtcatcgggaacggcaccggcttctggaacaccatgccgaccttgctgcgcaggcggttcatcgggtacttcggcgacaggatgttctcgccgtccagcagcacttcaccgcgcgcttccagcttcgggtacagcgcgtagatgcggttgaagatgcgcagcagcgtggacttgccgcaaccggagggaccgatcagcgcggtcacgcgcttttccggaatctccaggttgatgcccttcagggcgtggaacttgtcgtagtagaagtccagtccacgcgcagccagcttccggacggcgtgtgcaggctctcgtgcgaggacggcacggcgatgcgctgcatcggcacggcgttggaaaggtcgttcatggcgttatccacggaaaggtcagtcatgggagatacggttgcgcagcaggatgccgcgggcggcaaggctgaccagcaacacgaagacagtcagcaccagggcaccggcccaggccagcacctgccaggattcatacgggctgccggcgaactggttcatcaccaccggcaccgaggccatcggctggaagatgttgttgttccagtactggttgccgaaggcagtgaacagcagcggcgcggtctcgccggaaatgcgggccagcgccagcaggatgccggtgatgatgccggccgatgcactgcggtacagcacctgcacgatcaccttccactgcgggatacccagcgacagggccgcctcacgcatctgcgagggcaccaggcgcagcatctcgtcggtggtacgcaccaccaccggcagcacgatgaaggccagtga

SEQ ID NO: 91618 - DNA, 297 bp, Glycine max
  Peptide Sequence Number=SeqID_183303
atgtctcctccacctctagaacctcacaatcactcacaaactcaactcaagctcttaggacgacttcctcttcaagctccgttctctgcaagtggccttgttggtgcttgcacgcttagcgcaactctggctcgcttagcgtgcattagtgaatttcggcttagtgctcgtcttttcgctcagcggatggactcaagcggtgcgcttagcgggattagccctcgctcaacgaacatgcaaaactcattcttcttccaggttcttcctcgcgctcagccaaaggagtgttgcgcttag

SEQ ID NO: 91619 - DNA, 815 bp, Glycine max
  Peptide Sequence Number=SeqID_183304
ggagtgcaccgagttacgagaggaaaacgcggccactgcaagagcccttgaacaagaaaccaaaagggcccgcaaggaggaacatggccgagagaaattccgaggagcattgtggggtagcaacaatgagctcaagctctgaagagaggaaagagaccggtcacgggtccaagaggagtttggctcaacacttggaagacacggagcaaagcatgctagctatcatagggcagtacaaggaagagttgaaccagtctgtgacccatgaacaaaagctagtggaggattttgcacaagtgtacgccgaaaaagaagcaagagggagggaacagatgaaggccgatctatcggccttaaaagatcaaatggcttccatctcggaggtcatgttaaaactccagaaaactataaaggataaagccataacaaccgcctccagtatagttagggaagcggagccggtgctgcagcccgccttaaatctgggccgagacagaaacatgacagtgtttggtcagaggtatagtccgcaagcttacccctatggcttgcctctggacttcactccccgtgtcgccctggaagatttaagccaagcccatactttcgaggggcaactcccaccttatgacgattatcccgggcaagacgatgaggaaggagatacctatctcgataagggaaagattgaggcgcttgaggagaggttgagagcagtcgagggcctcggcaattacccattctcggatctagcggacctatgtctcgtactcaatatcgtcattcctccccaagttcaaagtaccggactttga

SEQ ID NO: 91620 - DNA, 1009 bp, Glycine max
  Peptide Sequence Number=SeqID_183305
atttccgaacccgggacactcccctgccccacaccagcacaaactggcagtcggcattgacctgggcaccaccaactcgctggtagcaacggtacgcagtggcatgagcactgttttgcatgacgaacatggtcatgcgctgctgccttctgttgtgcgttacctggatggcgccattgtggttggccacgaagctcaagccgcgcaaagccaagacccggtcaataccatcgtgtccgtcaaacgctttatgggacgtgccttacatgacatcaccgacagggctcatatcccttaccatttcgtggagaatgacagttcacaaggcatgctggaactcaaaaccagagccgggttaaagagtccggttgagatctccgcagaaattctaaaaacacttaaaatccgcgcagaaaaagccttgggcggagagctcactggtgccgtaattaccgtccccgcctattttgatgatgcccagcgccaagccactaaagatgccgcccgcctggcaggcttgcacgtactgcgcctgctgaatgagccgacagcagccgctgtggcttatggcctggataatgctgctgaaggcgtctatgtcatttatgaccttggtggcggcacctttgacatttccattttgcgcttgagcaaaggcgtgtttgaagtattggccaccaatggtgactccgccctcggtggtgatgactttgaccaccgtatttattgctgggtactagatcaggtgcgcggcaaaaccaaacacttcaagccactcactgaagaagatacccgtctgctactgaccaaatcacggcaagccaaggagtggctgacagacaaccacgaagccaatattgtgtgcaaactgagtaatggcgcactggtggatgaaacactcaccgtcaaccagtttgtctcactgaccgaacacctggtgatcaaaaccttaagccccacacgcaaagcgatgcgtgatgccggtttaaccgttgcagacattaaaggc

SEQ ID NO: 91621 - DNA, 321 bp, Glycine max
  Peptide Sequence Number=SeqID_183306
atgaaggcccaagtggagaaggatgaaggcctagaggcagagacactatcaagactattgattgttgctgaaggcccaagtaatccttgtggcgtctacccggacttatcttccttcaccggaagtggcgtctacccagacttatcttcctccactggaagtggcgtctacccagacttatcttccttcactggaagtggcgtctacccagacttatcttccttcatcggaagtggcgtctaccctgacttatcttccttcactggaagtggcgtcaaccaaaaactctacagcctgtatcaagcgatccgtgccccgtaa

SEQ ID NO: 91622 - DNA, 219 bp, Glycine max
  Peptide Sequence Number=SeqID_183307
atgcatcaacattcaccagaattatcaggatcaccgtgttgctcaatagtctacaagagaacacactcccaagccaagctcatggataagtttgaagagcgtaatgaaaagctgaggagtgatgttgatcaattaaagcaacaaatgacacagattcaagagatattacaagctctcctgaaaaagatgatggaactcaacaaaccaagaggggggtga

SEQ ID NO: 91623 - DNA, 762 bp, Glycine max
  Peptide Sequence Number=SeqID_183308
atggcagagaacaagaacaagaacaagaggatgaaaagcatttggcacaaaccaattgccccaaggatgaagaaggagaaggaaccaacaaagaatgttaaggcttcagaggtgtggataactgaactttcttttcaaaggttaatggtttaccagttaggtctcaaggaagttggaatcacattcaacaaggttgacatgtacaagtctttgatgaagaattcttctacctatattgttgttgttacaaaagcaaagggaagtgagtgctttggtattggacatttgatgttggagcacaagcttttgggctatgtggttgcttggattatcactctcaaggggagcaatcatgctcaattgatagaggaggatcttctccttagttgtctcatgcacgggaaattgaagattaattgggtcaacattattattgataacatgatgaagaccaagatgattaggtcttttatgtgtccctatgcaatgttgatctcaagaatccttgattacttcggagttgatacccaagaagaagtctttgcttttgttgaagttgaatttaagaaaaacaaagaggatcaaacaacacaacaagatctagaggagaagcctatgagccccttggagcagatgatgctagccaagagggacaagctcttgaggatgcataaggaggactatattgagcttaaggagtgctttgaaactatctatggaaggttggatgttataggagcaccatatgtggatgatatctaa

SEQ ID NO: 91624 - DNA, 756 bp, Glycine max
  Peptide Sequence Number=SeqID_183309
atgtttgaagatgaagagctggacatcaagattttaaattgtcttacaagaacttgggaaccaaagattacaacaatcaaggaatccaagaatctagctactatgacaatggaagctctcttctgtaaattgcttgcctatgaacatgaactgactcaacagaaaaccaaggacataaaattctctaaatcgtccaagactgagaacaacaataacaacaatagctacacatgtttcaaatgtggtaaacaaggtcatataaaatccgagtgtcctatctaccttagaaaacatggtgagaagaaaggaaagaaggacataaaacaaaagaaagcctacatagcatgggaagatagtgcgtcaacaacctccgactcttccagtgatgaagaaattgcaaatgtatgcttaatggcaatgtccatgaatgatccatcaacaaatgaagaaattgaggtaaatcatgattttgaagaaattcaagaagcatttaatgaaatgcatgaagaagctcaaaggcttgttgttttaaataaaaagccaaaaagcaaactgaaagtacatatcactaaattggcttctacacaaggtaagttgaatgaattaaagaaagaaaatgaaaagcttgtttcaagatgtaaagccactgcttgtgatgatatctctacttcctttaacatggatgattacaattttttgcataaagggctaggggggtcaattatgtggaagcaatgctttccaagattattttga

SEQ ID NO: 91625 - DNA, 759 bp, Glycine max
  Peptide Sequence Number=SeqID_183310
atggcagccaatgaccatgccatattgcatgataggactcacatttctacaaagagaagtttgttggagctcacatcacaggatgctttgttggcacatgcaagagataccaagaaagaagggcaaaagggtcttttccatggtttcctggatcctagctcacccgggctagcctttggctcacctaggccactaaaagacttcaatgttaataaaccagctcgcctggctactattgccccaagtgcctattttcctataaataggcatgctagggaggccgaggaagggttccatggttcaaaggtggagagaattgagagaattaagaaagaagaagaagaaagaagtggaaatgaagctgaggcgctaccgaatcgcgaccgtgatcattccctacatcgtgtagaagcaaagcttcatggcgaatcaaagaatcaagaagaattcaagactcaagaagaaagtttagagtcaagaatcaagattcaaggttcaagatctcaagaatcaagatcaagattcaagactcaagattcaagaatcaagagaaggcttaatcaagagaaagggtacatcctttgtggtacaagtagagggtacatctacttgggtttgactgagaacaagagagggtacatctcttgtggatcagttctagtggagggtacatccactaggttcaaagagaacaagggagggccactcgatccaacccatcgttccttgttcggtgttcttcgtgcgactgtcggttag

SEQ ID NO: 91626 - DNA, 382 bp, Glycine max
  Peptide Sequence Number=SeqID_183311
atgactagaggcaatccatctgacttacaaccctttgatcctgagatagataggacatttcatagattagttaggcatcattttacaccttttgatcattctgagcattccattactggtgaatctgtgcattctgttattggtgattttgaacatcctgatcttgagcattataattttgagcattctgattttgagcattctgtttttgcacattctgagaacatggcacaacctccaccccgtgagaggactctaagggaaatggctgcacctgatatcacctacgaaagcttgtgcatccaataccctgatgaggatgtcccatatgttcttaaaactggactgattcatttgcttccaaagtttcatggccatgcag

SEQ ID NO: 91627 - DNA, 534 bp, Glycine max
  Peptide Sequence Number=SeqID_183312
atggaggccataaaagagcaaatggctacaatgatgaaggccatgatgagcatgaagaagataatggaagccaatgcggttatagttgccgctattagcgctgtcgctaaggtgaacccgatgctcccatctggcctcaagcaaatgaatcacccaacctcaaatatggtaggcaaagatttgggaagtacggatgaccccatgatgtgcaaattcaaaacgagcacgccttcccctcatatggcttgcctcccaacctatacaccacccaatacacatgaaattccccaccaccatctagctgacttcgagccttggctcggatatgccactgaagggcaagcagttggtggtataccctttgaaaatgctttggagagccctcagtttcgcccacaaccacaaccattgcattttgcggtgggaagatcccctcctgctatggccgaaaaaagaaaggcgaatcatctaaaggaaaggctcagggccattgaaggaggtgaagattatgcctttgctaaaagttgttcctaa

SEQ ID NO: 91628 - DNA, 243 bp, Glycine max
  Peptide Sequence Number=SeqID_183313
atgtccccagtggagtcgccaactgtcgcaacgtgcccttcgcgggcgagcgggggcgggggtcacgggtgcgctttccaaaggaggaaagatgcgcggagtcgccaccaacgtttattcgtggaaaacgtcagaaaaaccgaaggaaaccggtcgacaaaagcagggcttttgctcctacgtaccctcctttggagaggaaatcagacctacgtagttcttccttatgcgtggatcaagtga

SEQ ID NO: 91629 - DNA, 180 bp, Glycine max
  Peptide Sequence Number=SeqID_183314
atgaagaatgttccagattcgggagttatatttacgtttgaggaagggtcgacaaaagcagggctcttgctcctacgtaccctccaacgaagaggaaatcagacctacgtagttctttttaagggtgaatcaagcgattctttttacttggaaggtgatcatttaaggcgtggaccttaa

SEQ ID NO: 91630 - DNA, 438 bp, Glycine max
  Peptide Sequence Number=SeqID_183315
atgccaatctccccctgcagatgtatcggttgggatcgcgcccacaagtcacccagtgggcccgaagaagtccaacaaggccctggggtttccagctctggttacgggcctctgtcagtcctacagggtgcccgttcccccagcgaggaatcacacccacaaagacacccaatggacccggagaagtccaacatggccctggggtttccagctctggttacgggcctctgtagtcctacagggtgcccgttccccccggcaaggtcacatcatcatagttctacgaagtacctattacctccagcaagggcatcaggccccctactaatcaagctttcatcaagaagtactgcgtccccaggcaggcgtagggcgaaacaccacagcagcctggggatggccagcagcgggcaacagacgcaccgccatcacctctag

SEQ ID NO: 91631 - DNA, 267 bp, Glycine max
  Peptide Sequence Number=SeqID_183316
atgttgctaagtagcaacgtcatctatatctgtgtaagagtggtcatgttggtgtgcatgatccacactcatctctttgcagtggcacgggtgaaatcttgccccggtatgcacagtagctatgcgatagcctcctcctctggttgtgctcacatagttggtcgcccttcaatatcagggggtggcccaggaactgataaaaggaaactatggccccttaaccgggagtgcaagtcttggttaagcattaagggtagaggaccttaa

SEQ ID NO: 91632 - DNA, 315 bp, Glycine max
  misc_feature (229)..(229): n is a, c, g, or t
  Peptide Sequence Number=SeqID_183317
atgaagaatggtggaaaaccttcgcgaaatcgcccacagaaatgtctcggaagcgttacgaaagcgcttcagcttggattttcttcacggaaacaatttttctcactaattataagtgattctcagatagcaggagggttcaacatttttgttctgccctccttcccctatttatatgggacaagagggaggtggttgccacccagctcgcccaggcgagctgggatgnttccaccagaaggcaccgccttctgttggaagatcctagaaggcccaagtgggcctaattgctatttgtacccccctgtgtactaa

SEQ ID NO: 91633 - DNA, 195 bp, Glycine max
  Peptide Sequence Number=SeqID_183318
atgggggtgcaaatagcaacaaggcccacttgggccttccagattcttcctccagaaggtggttgcttctggagaaagcaacctggcttgcctgggcgagctagaaaatccatgtcgaggcgcttccgtaacgtttctgtgggtgatttcgtgaagattttctatcgttcttcgacgttcttcggtcttcaaccg

SEQ ID NO: 91634 - DNA, 161 bp, Glycine max
  Peptide Sequence Number=SeqID_183319
atggtgaaaggtttcggctattttgggcaaaaaacatgttttcgtgaagaaaaatcgagtcgaagtgcttccgtaacgctttcgcaagcgattatgtggaaattcttcatcgttcttcgtcgttcttcaccgttcttcgttcgttcttcgttcttcaacgg

SEQ ID NO: 91635 - DNA, 411 bp, Glycine max
  Peptide Sequence Number=SeqID_183320
atggctcaacctctacctcgtgagaggactctaagggagatggctgcacctgatttcacttatgaaagcttgtgcattcaatatcctgatgagggtgttccatatgttctcaagactggactaatacatttgctgcccaagtttcatggtcttgcaggtgaagatcctcttaagcatcttaaggagttccatattgtttgttccaccatgaagccccctgatgtccaggaagatcatatctttctaaaggcttttcctcattctctggagggagtggcaaaagattggctatactaccttgctcctaggtccatttttatttgtatgagtactgggaaagattcaagaaattgtgtgcaagctgtcctcaccaccagatttttgagaactccttcagcagggatgctctag

SEQ ID NO: 91636 - DNA, 225 bp, Glycine max
  Peptide Sequence Number=SeqID_183321
atgaccgcctgggtgccatttgagcagcagcgcaatgaactggagacgcgcatcgaagagcaggaagcacgtttcagccatgaaaaggcgctggcacagcaactgatgaccaggcgcaaggacattagccagcaggctgacgttgccgacctgcaacagcagcttgaacaggcgcagcagggcgatgtgctggttcaggtggatgtgacaccggggatcctctag

SEQ ID NO: 91637 - DNA, 321 bp, Glycine max
  Peptide Sequence Number=SeqID_183322
cacgccgggaacaagttccgaggggctctttgggccagtaacagcgagcttaagctccagagagaggaaagggaccaatcacgagtagacggtttgatcttgaaagatgacttgaagaccaacatgttagctatcgtcagcaaataccaagaagagctaaatctagccatggcccacgagcataaagtggcggatgagtatgcccgagtgtacgtggaaaaagaggctagaggaaaggtgatcgactcgttacatcaagaggcaacaatgtggatggaccaatttgctcttaccttgaacgggagtcaagaacttccttga

SEQ ID NO: 91638 - DNA, 348 bp, Glycine max
  Peptide Sequence Number=SeqID_183323
atggcaattcaggatgatgaaagtagagctgatgagaaggaagttgtggaagatgaagatgaccaacaagagagagagacaccaataaaagaaatgatagacattgaagaagatgctgacattcccttaattcttggaagaacttttatgtccaccgcaagctgtgtggtagaaatgggaaagaagaaactacaaatggccatagaagaccagcaaatcagtttcgatatgtttcatgaagagaaagctttgcttgaccaaaatgtttgtttgaaggtgaatgtgattgaggaaaagagactagagaagaaggttctagaagttggaaccttgttggacccaggataa

SEQ ID NO: 91639 - DNA, 495 bp, Glycine max
  Peptide Sequence Number=SeqID_183324
atgactcaagagctggtagcccgcggagacaccttacggttatccgcacctcgtcattcagtgaccccaagtgtgattgacgagcagagaccaatatggtcatctgcgccctttccggagatgtcagcattttccgatggagactttccaagtctcacaagttatccagaactacgtaggtctgagttcctcattggaggatacgtaggagcaagagcctcgcttttgtcgaccacaccgccttttgttgccatgacccaagagctggtagcccgcggagacaccttacggttatccgcacctcgtcattcagtgaccccaagtgtgattcacgagcagagaccaatatggtcatctgcgccctttccggagatgtcagcattttccgatggagacttttcaagtctcacaagttatcaagaactacgtaggtctgaattcctcattggaggatacgtaggagcaagagccttgcttttgtcggccgccccataa

SEQ ID NO: 91640 - DNA, 135 bp, Glycine max
  Peptide Sequence Number=SeqID_183325
atggtacatccattctggatcttttctggtaaaggattttacaaggttgaaagaaatctcaagaaccgttgtttgcttggggactggatgttgattgtgaaggaatgcattagccgcaccccggtgagagtgtga

SEQ ID NO: 91641 - DNA, 933 bp, Glycine max
  Peptide Sequence Number=SeqID_183326
atgcggaggaactcgcctgcctcctctagcaatacttctttcttgccacatccatcctttttctccgaaagacctttcactggaatattctcattcggagtggggatcattttgtcattttgttcttccgctatctttgccttccctttaacatttgcgggttgtgtcggtaggtcagggggtgcgaacacgcgaccgctgcgggtcacgccgctcagccccgtgatattagttaccttggctgacaatgagctgatgtcggtggcttcttccttcctttcgcttggaggcacatacctccacggaactgcatggctgttttggtatgaaaacgaaataggtttaactaccgaggggtatcggggcgtttggggagctgcgtctctgataaacctcctgggggtcgtcacgtccttcaaaggcttgaacaatgcgtggcctacccgacttgacgacattaactactccccctccatgattagcgagcgggttcgttttcatgttgggctggtcctcttgaaacgtcagccatcagacgtctatcaaatgttggaccttgtatttaagggccagacaacgttcggtggagtggcccggggttttcccatggtatgcgcaggttgcgtcagggtcataccactttgggaaaggaggctggtagatcttcccgggagatatcacaaccatctggttggcgatgagggacggcaagaggtcttcgtacgtcattgggattggggtgaattctggagttggcctcgggggaaagttccttatcgcttggaaccggcgccaaagtgggcattgccggccgggcgagtcggggttggagccggaacttggggggcctccctctggatgggcgtgggcgccctagcttgtatgggtgctgagttaggagagtccccggcacgagctgagaagctcgggtga

SEQ ID NO: 91642 - DNA, 429 bp, Glycine max
  Peptide Sequence Number=SeqID_183327
atgaattgcgttttcgttcacgtgtcatccaccttcgagtttggagccatgcgtagtgattgcttagtgcaattctccattctcaccatttttcggagccccatgaattgcgttttcgttcatgtgttctccaccttcgagtttggagccatgcgtagtgattgcttagtgcaattctccattctcaccatttttcggagccccatgaattgcattttcgttcatgtgtcctccacctttgagtttggagccatgcgtagtgattgcttagtgcaattctccattcttacccttttgcggagccccatgaattgcgttttcgttcacgtgtcctccaccttcgagtttggagccatgcgtagtgattgcttagttcaattctccattctcaccatttttcagagccccatgaaatgcgttttcgttcat

SEQ ID NO: 91643 - DNA, 267 bp, Glycine max
  Peptide Sequence Number=SeqID_183328
atgtcgacggtatcgataagcttgatatcgaattcctgcagcccgggggatccactagttctagagcggccgccaccgcggtggagctccaattcgccctatagtgagtcgtattacaattcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 91644 - DNA, 480 bp, Glycine max
  Peptide Sequence Number=SeqID_183329
atggataatttgtcgatgcaatacaaggaagtcactgaatctactcaacgagcatttaaaagtctagaaattcaagttggtaagctagctgaaaaagtgactaaatttgtggccagaaaagaagaaaactttgtagaggttgaagctcataaggaaagccttatagaagaggatgactctaaagaaaaagatgaagagaaaagtgaggagaaagcacaacaatgggagaagtacccacaagtaaaaattcaacaagaaagtattctccaagtcaatacccctcctcatcaactgattgtcaaggaagaaaggcatagagaacatgagaaagccttaagtgtcattctttccttgatcgctaccacttctcttgcaataatgtggaagttgcttccacaatatatgagtttcgtggtgtctctagctaaaaggcaaaaatacaaggaagatgtgttttatgtgaccttcatgccaccttga

SEQ ID NO: 91645 - DNA, 204 bp, Glycine max
  Peptide Sequence Number=SeqID_183330
atgcacggagtcgccaccaacgtttatttgaggaaaacgttggaaaaaccggaaagatgtggtctacgaactttaagtgtgaaaggttcgggagttgtatttactcatggggaagggtccatgtttatcgataaaagcaaagaggaccgtttaaagcgttggaccttaaaacggtttttagtgatttttgcggacaaagcttga

SEQ ID NO: 91646 - DNA, 99 bp, Glycine max
  Peptide Sequence Number=SeqID_183331
atgggtaaaaacaatgacaatatatattttgatgaagatgaatctgcaattgacaagtggaatgaacctgaagatggagttctagaaaaggatgtgtaa

SEQ ID NO: 91647 - DNA, 282 bp, Glycine max
  Peptide Sequence Number=SeqID_183332
atggaaaaatacgacaaaaggaatttcaaagaaaagaaagcatacatcacttgggaagataatgacataaattcttcaagtgattcagaaaataaaatcataaatctgggtctcatggcgaaagactatgaaagcggagaagagttggaagttgggagtggaagttggaagttggaagttaaaattggaaattggaagcagaagttggaagttgggaatggaagttggaagttggaagttgaaattggaaattggaagcggaagttggaagttggaagttga

SEQ ID NO: 91648 - DNA, 225 bp, Glycine max
  Peptide Sequence Number=SeqID_183333
atgattttaagccaaacctacctcaataaaacaatgatcccagactctttatcccgcatacaccctgatgtagcttcatgtagagcttgtaggccttggatctccttcatcaatggagtcattttcttcttgcagatcaatgacagcggaatggagaaggaggaaaggttattggagatgccacttcaagcagaagatgagtcaagaacaagctcaccaccatag

SEQ ID NO: 91649 - DNA, 249 bp, Glycine max
  Peptide Sequence Number=SeqID_183334
atgaccgactctctcgatgagtcgatctcttgctttctcataaggatggaccctcggaggactgcatgtcctcaccttcagagggctacacgccctcgccatcagaggactgtgtgtcctcaccttcagagggctacacgccctcgccatcagaggactgcatgtcctcaccttcagagggttacacgccctcgccatcagaggactgcatgtcctcaccttcgtagggctacacgccctcacctttag

SEQ ID NO: 91650 - DNA, 686 bp, Glycine max
  Peptide Sequence Number=SeqID_183335
atgaactcgctaagtgcgcttactgcgctaagcgagttcatcttttgtggatgaacattcatcttcctgatgagatacctgtggctaaccccaggcttagcgggcagtcgctcgctaagccgattatcggaccatgtctcgctaagccgctgatggcctccaggaagcataagagcattggggcaaggccaattgctcagtgtgacactagatggttccattcacttgatgcttggaaccgttatatagataacgtcttaggaaggagaattttgccagagaggaaggtagagatataccacgcagagtttgatgacttcaagacagagttggagaggcgtaatcttcacaaacgcctcaccaacttggctgatgggactattgatgttgctctggtgaaagaattttatactaatctctacagctctgaggatccttcaccaaagcaagccaaagttagaggccatgtggtgaagatagacgttgacgacctcaacacatttttagagactcctgtagtcctagaggagggggagacattacccacctactctaggtactgcaggttaccatcagaccatagagagattgaggctgctctttgcataccagggagggggttcattttaaatgctaagggccatccggggaggattctcaggaaggatctgactaccttgacctag

SEQ ID NO: 91651 - DNA, 317 bp, Glycine max
  Peptide Sequence Number=SeqID_183336
tattggagtagctggaggaaaggtgtttagtgccagtactggtgtggtttggtcctctggtatgtcaagtaaaggagtggaagggttagctgcaagctatggagaatctggcagagcatcagcatcaaagccgcgtgctaagcgcgagatcagtgcgctaagcgtagcaagtgtcttcagccaggctcagcgcatgactgacactaagcccgaatccacttactcatggcacaaaattccacagcagccacagtgcccatttcgggaaaagagccctggaagcagcaaagaggaacaacttttgcagagatacctag

SEQ ID NO: 91652 - DNA, 591 bp, Glycine max
  Peptide Sequence Number=SeqID_183337
atgtccaaatcttgtgaatttgggatgaccggccctctcgatgagtcgatctcttgctttctcataaggttggacccttgggtactagtacctatcaccttcagaggactagggatacacgccctcaccgtcagaggactacaagtcctcgccttcagaggacttcacgtcctcaccttcagagggatacacgccttcgccttcgtaggactagacgtcctcaaattcagaggactgcacgtcctcgcctttaaagggctatatgccctcgccttcagaggacaacacgtcctcaccgtcagaggactatacgtcctcaccttcagagggattcatgccctcaccttcagaggactacacgtcctccactttagaggactacaagtcctcaacttcagaggacttcacgtcctcaccttcagaggactagacgacctcaaattcagaggactgcacgtcctcaccattagaggactgcgcgtcctcgcctttaaagggctatatgccctcgccttcagagggctacacgccttcgccttaagagggttgcgtgccctcgccttcagaggactatacgtcctcaccttttga

SEQ ID NO: 91653 - DNA, 297 bp, Glycine max
  Peptide Sequence Number=SeqID_183338
atggctactcagttgaaccaagctcagtcccaaaattctgacaaattgccttcacaaactatgcagaatccgaaaaatatgagtgccatcaccttgaggtctagcaaccaaattcaagtgcctccaccagtagcagcacctgcacctgaacctgtcaagctttattctaaacctgaaaaagaagatgagatagttgcacaaaagaggaagcttcctgatcagggagctaacaaaaattttcatgcaggttgtcataccctaatttcgtctggggaccatctgtttggtgggatgtga

SEQ ID NO: 91654 - DNA, 228 bp, Glycine max
  Peptide Sequence Number=SeqID_183339
atggccatgatcatttcaatgcatacgattgcaatcaatctacaagagattcagtcaaagtctactaaaggggtagagaaggcttcacatagggctaaagagccatcaacacctcctcttatccatttcatccttgccacctccttggatagggagtacgtggtcctccaaacgagctgggcattaataaggctgcacaagatgaacaaaactaaaaatgcaagttag

SEQ ID NO: 91655 - DNA, 504 bp, Glycine max
  Peptide Sequence Number=SeqID_183340
atggacaagaaaatccgcggtattgtgagtagcattctgaaggatgcttctgtgcctgatgctgagaaagatgttccaacatcttccaccccaaatgtttttgtgcctgatgtcaataaagatgttccaacagcttccggcccaaatgctgaagtactctcttcccccagcaaagagagatcaacagaggaagatgatcaagccgcagaggagactcctacaccacgggcaccagaacctgctccaggtgatctcattgacttagaagaagtcgaatcagatgaggaacccattgccaacaagctagcacctggcattgcagaaagacttcaaagcagaaagggaaaaaccccccttaagaggtctggacgaatcaagactatggcccagaagaaaagcactccaatcactcctaccacatccagaagaagcaaagttgtaatcccctccaagaagaggaaagaaatttcctcatccgattctgatgatgatgtcgaactagat

SEQ ID NO: 91656 - DNA, 165 bp, Glycine max
  Peptide Sequence Number=SeqID_183341
atgggtgccaaataccttgaagtggtcaaacgagggtcgcatcccaacaacggatggtctccggacaaaattaggcaaatgagtgtgtgcgggttaccatatagggcgtctccgcgtgccgatggactcacaggtcgtgatagcaaaagatggggtggtcgataa

SEQ ID NO: 91657 - DNA, 276 bp, Glycine max
  Peptide Sequence Number=SeqID_183342
atgtcatgtaaatctagagaaatcatcaactatgacaagagcataacatgtcgcaacgtgcccttttgcgggcgagcgagggcgaggctcacgggtgcgctttccaaaggaggaaagatgcgcggagtcgccaccaacgtttatttgggaaaacgtcgggaaaaccgaaggaaactggtcaaaatgaaaattctaagttcgggagttgtatttacgcttgaggaaggtattggcacctctcacgtttgtctccaaggacaacagtctattttttag

SEQ ID NO: 91658 - DNA, 300 bp, Glycine max
  Peptide Sequence Number=SeqID_183343
atgacgtatgaacatggcccaaagcaagtgccaaagaccctggaaggtcagtgcacttcgccccccacgaacatacacaacatccaacgtatgaacgtggcccaaatcaagtgccaaagaccctcgaagggacagacaattatcctcatagctagattccctgaccctaactatggtgttaaaacggtaaattttataataaactcccctcacctcattgtgaaaagctatttaaatgttttagaaagcatgaatcgattacacatggcttgtcaaatcgattaccttcaaagattatga

SEQ ID NO: 91659 - DNA, 810 bp, Glycine max
  Peptide Sequence Number=SeqID_183344
gaagaggaaatccacagcctcccaactcgggaactctatgataccacccggtttggtttcgaggttgcttgggagtgttattctcagaacattcactccgggaacatccttccagagaggaacattaacctcttcgtgactgagtacgatgagttcaggcgagagctcatccggcggaactggcataaggcgctgacacagcatatggatgggcacatcgatgtggccctagttaaagaattttacttgaacctgtatgatccagaagataaatcaccaaaacagattcgagtcagagggaagctaataaattttgaagctgcgttgttgaatgctttctgggaaacaccaccagtcattctgccaggggagcagtacccctcatattctattttctgtagggcgtggacacaccctcaggagcttgcctccaagctttgtattctaggacatggatttgttcttaatgttgaaggagcgccctggaggctcctgaggaaggacttgactaccttggccaagacatggagtgtgctctcatactccaacctcgcccccacctctcacacgtctgattttaatatggacagggcgaggttagtctatgggccggttatgaagatggacatggacgtgggcttcctcatttcacaccagatgtcacagatggccaagttcaactcctgcaggcttggttttcctgcattgatttcagcattgtgcatagccagaggagtcatctcagattctctgactttcgagttcctcagccttgccattaatttggcatacattaagaagaactgctag

SEQ ID NO: 91660 - DNA, 159 bp, Glycine max
  Peptide Sequence Number=SeqID_183345
atggcttcctatggtgtggcatctccaatcatccttccccttctccattccgctgccatcaaactttacaaagcaaaggactccattgatgaagaagatccaaggcaaacaagctctacaggagctacttcatgtggtatcaagagcatcttcatctag

SEQ ID NO: 91661 - DNA, 234 bp, Glycine max
  Peptide Sequence Number=SeqID_183346
atggaatcttcatcgtcatgtccatcacatattaaaattaagtctgcctccatcgatggtatacgtgtggatggtttaccattaatcggtccaacaaatcttgattgggctgatttatgtgagaaattattgggagtcagaccacaagaaggtgaaattaaaggtagtgtggttaaattaagttggctggctcaccattttgcacaaataaataacgatgacgtcgaagaacaa

SEQ ID NO: 91662 - DNA, 366 bp, Glycine max
  Peptide Sequence Number=SeqID_183347
atggaaatctctgaagatactgacatccctgtaatattgggaacgccattcatgttgaccgcaagctgcatagttgatatggggaagaagaagctggagctaggtaatggagggaggtcaagaggttctgaaagtaagaaccaaaacataagattacctagtgagggtttcaatttcttggaaaaaggactgaaaaataacttagaaaacttttttctgaaaaatagtcctttcgctaagcgcaagcctcgcgctaagcgcatctctgttcatgcgctaaacttcgagtctcaagcgcttagcacccaacccttgcatctgaggctgatttggttcgctaagctggccaaggttgagctaagctaa

SEQ ID NO: 91663 - DNA, 327 bp, Glycine max
  Peptide Sequence Number=SeqID_183348
tggttcttccggaaacattccggaagaaggggttcttccggaaaggtcttccagaactttgaaagttcttccggaattcttccggatgaaccacttcttctggaaagttcccggaagaggttttccgggagtcttccggaagaagtgttcttccggaagacgttaaattacttccggaagaacacttcttccggaaactttccggaaaaggttcttccggaagactccgtcgtcagccttttgcgccattttttccagcgtcctctcgtcttctcccctctcgtcttctaccctaatgttccgtcttctaccctaaggttccactaa

SEQ ID NO: 91664 - DNA, 213 bp, Glycine max
  Peptide Sequence Number=SeqID_183349
atgaccaagaagagagtgttgaaagagcctaacaagactttcctaaattggtttaaagattcaatctttggtgatgataatgcttatgaaacgtgtaagtgggttgatagcaatatcaatgtgcaaatcgatgattttggatttactttggtagatctgaagaagctcgcttatcagattaagcctttcatcatggcaaaacaagctaaacag

SEQ ID NO: 91665 - DNA, 249 bp, Glycine max
  Peptide Sequence Number=SeqID_183350
atggcgacaacgactatggacgaagcacctgaagatgcacatgctgatgtagaccagtttcgacatgtagtggaggcttgccaagcaataactgaaaggttggaaaggctgcttaacctaagcatagtgactgaaggaataaaagcatacactatcaccgaagaatgcccgaggatcgcaagaggtgtcactacgcaacagaatgtctacattagatcgagacgaagacgacgtatagaagacacatga

SEQ ID NO: 91666 - DNA, 192 bp, Glycine max
  Peptide Sequence Number=SeqID_183351
atgacatcatcaggctcaggaggggtgagctcatcctccccctctgttactgctgctgctggctccttaggagcaggctcctgggctgttgaggcaccaccccctccagaaggagaaggctgggctcttggacaagccacctgcgcatcaaactcatctatgctcataatggatggcaagcccaagccctaa

SEQ ID NO: 91667 - DNA, 312 bp, Glycine max
  Peptide Sequence Number=SeqID_183352
aaccaagccaattcatattgttgttgaggttatacgaaccggctctccacgcaatcgagagaatgttgctgctgtcttgtggtcactatgcaccggagatccactgcaattaaaactagcgaaagaacatggtgcagaagcagcactgcaggagttgtcagaaaatggaattgatagagctaagataaaagctggaagcatattggaactcttgcagaagccaagactctatttggtggagggacctgctatcaagtcagcagcaacaacagaaccaggtagtcaaaacggaaagaaattggaaggtgggag

SEQ ID NO: 91668 - DNA, 255 bp, Glycine max
  Peptide Sequence Number=SeqID_183353
atgagggacatcttcaaggacatagccagcatttccagtgatgatgttgtgttcagaattggacatggtgatgatggtggaaatggaatcagagaaagtagaatttgttgtgtgttggagagaactcagagcaaacgaatctggttgaaacagaagatgaaatggaagagttccattgagggggtgatgtgtttgtttatggccgttgatgatgaatccgacggccaaagacacacgtggtttgattcaccttaa

SEQ ID NO: 91669 - DNA, 876 bp, Glycine max
  Peptide Sequence Number=SeqID_183354
atgttagggaatatctcaaattcatactgggcttataatgatgctgaaagtgagaggcatgaaggagtggagaacttctacagaaaaaatcacacttaccaatcaattgatttcgtgaagaaaatgagagaggagtacgcaaaattgaacagggtagagatgagcatatgggaatgttgtgaactccttaatgaagtggtggatgagagtgaccctgacttggatgaacctcagattgaacacttgctccagacagccgaagctataaggagggactaccctgatgaagattggttgcacctaactggccttatccatgataggaaattgcaagaaaacttccacttataccacaagcatttaccaatttgcttcaatgcagatcttggcaaggtgctgaatttgcctagttttggaggacttcctcaatgggctgtagtaggggacatattccctgttggttgcagatttgatgagtccattgttcaccacaagtattttaaggaaaatccagactacaacaatccagcatacaacactaaatatgggatttactcagagagatgtggacttaacaatgtgatgatgtcatggggacacgatgactacatgtatctagtggcaaaggagaatgatactacactgccctctgcggctttgttcattataagataccattcattctatgcattacataaggaaggagcctataagcacttgatgaatgatgaggattttgagaatctgaaatggctccatattttcaacaaatatgacctttacagcaagagcaaaattcgaattgatgttgaaagggtcagaccgtactatctgtccctcattgaaaagtacttccctgcaaagctgaagtggtga

SEQ ID NO: 91670 - DNA, 759 bp, Glycine max
  Peptide Sequence Number=SeqID_183355
atgcggtcatgggtgaggggtcagtggattccctttgacgcagatgccctcggccagttcttgggtgacccgttagtgttggaggaaggccaggagtgcgagtttagtcagaggaggaacagggccgatgggttcgacgaggaggccattgcccagctattatgcacaccgggccaggatttcgcccggaccgctgtagggaggcgggtgcggatcatgcgcaccagcatgaccaccttgacccagatgtggatgacattgctactcagcaatgtcctgcctagtgatcataactccgaccttcctctgtcgaagtgtcagctggtgtatgccatcctgacacggatgagcatccatgtggctcagttgattgctgacgccatctatttatttgcaggtatgccacccaccaggcaccctctagacccgaataagtctaacagggccctggggtttctggcattgatcactcctagtaaggtgatccgactgccgatcacccgggtcttcattgagaagtattgcatgcctaggcaggcgcagggtgatgcaccgcaggccgcagacgcatcgccaccacctcatcaggttgatcccgctgggtcattaggcatgaagcggtatctacagcacttggtttgccagcaggcggccaaccaccaggggcaggtgcagatacatgtgtctctaccagctcagcctcagtcaacagggccagggtttcgctccttttgcgtgccctactccagatcattttag

SEQ ID NO: 91671 - DNA, 480 bp, Glycine max
  Peptide Sequence Number=SeqID_183356
atgaggcaccaaatccctatgataggtggtatgatgaatgtgttgagtggtgcaaccttattttgtaaaatcacccatgcatccaacacctttatgattgacatacatagggactcattaggtaggaataatcaacatgaaaatacaaaaaaagcaccactcattcagttggtgaggaaccatgttacctcatgggaagatgcccaggaaatgggttttcagaccttaccttactccaacataccaaacaccactaatatatatgtttttattctttttacatgtgttgagggaagaagccttgagtttcaagaacctatggatttgaggtcaaatccttttcaaggggtagggaatgatgcaatcctaccgcccccaaaggcattggatagaagactccaagaagattgggccagagatgcaaaagaagaccctagggttctcatgagccttagggtagattttgagcccatgagctaa

SEQ ID NO: 91672 - DNA, 243 bp, Glycine max
  Peptide Sequence Number=SeqID_183357
atggcaattctgattgccaatactttgacacatttcatagagatgaaagactcgggaattcgtatgctatgcatggaaaatgtaattatgagattgagatgcccgaagaaacatcatttcctagttagccacgtgtcgcaacctacccttttacaggcgagcgaggtgaggctcacgggtcgacaaaagcggggctcttgctcctacgtaccctccatcgaagagaaaatcagacctacgtag

SEQ ID NO: 91673 - DNA, 406 bp, Glycine max
  Peptide Sequence Number=SeqID_183358
tttgatcttgaaggatgaatttaggatttgcctaaggtccaagagaagcttgtctcagcagttatgtgagatcgagaccaacatgttagccatcatcaacaagtaccaagaagaattaaatctagccacggcccacgagcacaaagtggcggacgaatatgcccgagtgtacacggaaaaggaggctagaggaagggtcattgactcgtttcatcaagaggcaacaatatggatggagcaatttgctcttactttgaacgggagtcaagaacttccccgattgctggccaaggccaaggccaaagcaatggcggacgcctactccgcccccgaggaaatccacggactcctcaactattgtcagcatatgatagacttaatggcccatataattaggaaccgctag

SEQ ID NO: 91674 - DNA, 292 bp, Glycine max
  Peptide Sequence Number=SeqID_183359
tgcaaagagaaagctaaatctagcggcgactcacgagcaaaggctagaggatgagtacgccaagatatcagcagaaagggaagcaagggaaagggtaattgattcattgcaccaagagacaacaatgtggatggaccaattttctcttactttgaacaggagtaaagaacttccccgattgctagccaaggccaaagcaatggcggacacctactccgcccccgaggagatccacagacttctcagctattgtcagcatatgatagacttatatatgattagaaaccgctag

SEQ ID NO: 91675 - DNA, 651 bp, Glycine max
  Peptide Sequence Number=SeqID_183360
atggcatccttcagtcacatgcagtcccagcttcagtcgcagatgcaatctcagggacttgcagtgcctcctgagcctctacttggtaccttcggtcctcgagtgagcacaaaggggagttgtgttgatccctcaagaaatgatcctgagatgggtgactctgacaggtgcggtttgtacatagaagcagatcctgcccgcctggttgccatggggagagtttatgagggatccgctgttgttcataacactcctttgttgcctggccaagtaaaggtgagtgtggaggaggttacagatgcagatgctccagttcctgtacccactgatgaggtttccttagcggggcaggcacttcacaccttccttgcttggtcgacacatctggtcaagtctttatcacaacaggtagttgtgtctccggcaaaaccacctccaaagcccgatccggaggtcgatgatccgctttatctgatgacattgaccatcccagagcttttcttgaggccttatcaggttagatgggatgccaccgtgtttggggtctttaatccagatttccccctctacataaagcacgaagacctctttgaaatcgcacacggtggtcaatgtctcagcatattagtgttacagttgtggattctgtaa

SEQ ID NO: 91676 - DNA, 216 bp, Glycine max
  Peptide Sequence Number=SeqID_183361
atgccgaaaatcaaagggaagtattgctacgcaatccaaaaagaatcacaaaaaagcaaagggggtgtatttagtaaaaagggggtgcaaatagcaaccagacccacttggaccttcgaggatgttcctccagaaggcggttgcttctggaggaagcaacctggctcgcctgggcgagctgggtggcaagctcctcccctattttcctataaatag

SEQ ID NO: 91677 - DNA, 355 bp, Glycine max
  Peptide Sequence Number=SeqID_183362
taatgaaaagggagaactagatcctagggctgtcaaggatgtcactttcaacgaacaagaaagctacttcaaacaacctcatcttcagggggagaatgtaatagaggaagatgagcctctaatgcttccgaatatgacatttggacctgaaattgggacaactagcgctgctgtacctgaaactgaaagaagtccagattcagcagagcaatccccagattcaacagcaagatctatacctcaacctgagactaatggtgggaaatttgggaaaaatctggtatattcaaggagagaaaaggtcattccagattctatccatgtccaagaatttgatccaccatcattacatgag

SEQ ID NO: 91678 - DNA, 1112 bp, Glycine max
  Peptide Sequence Number=SeqID_183363
cccacgggcgccgggctgctcggccagcgcctgaacaggcgcgcctggctgggcttgctgctgggattgctgggcgtgatcctggtcacgcgcgatgccctggcctggggcgggacgccgctatggacctacggcctgccgttgctgggcatgctgtcgctggcgctggccaccctgtggcagaagcaggccgattcccccgcgtccatggggctgctgtccaatctgtgggtgcaatgcgcgatttcggcggtggccttcgccgcgctggcgggcagggaaggcagcctgctgccggttgccagcgccgggttcgcgctcagcgtgctgtggacagcggcgctgtcgacgctgggcggctacggcctgtattggatctgcctgcggcgctcgtctcccacccgtgtcgccagcgtgctgtacctgagcccggcggttaccctggtgtgggcctgggccatgttcggcgagccgctgtcctggctgatgctggtgggcacggccgtgtcggcgtgcggcatctggatggtcgtgcggaacgaaccgcgctagcgcttgcttcgcgcgccgacaaaaaagccggccccggaggggccggccattcccgggcggcgccaggcgcgcttcagcggatcaggctgaggaactcggcgcgggtcgacgggttgtcgtggaattcgcccagcatcaccgacgtgaccatggacgaattctgcttttcgacgccgcgcatcatcatgcacatgtgctgggcctcgatgaccacggccacgccggcggcgccggcggcgggcgtacatctcgacgatgcgcgccaccttggacaggcccagcaccttgccgttgggcaggtaggccacatgcgccttgccgatgaagggcagcatgtggtgctcacagagagaatacagctcgatgttcttgaccagcacgatctcgcgcgtgtcggaggtgaacagggcgccgttgacgatctcttccaggttctggttgtagccgcggcacaggtggcgcatggccttggccgcgcgcgccggcgtgtccgcgaggccttcgcgggatgggtcttcccccagtgcttcgagaatggcggtgtagtgattttccaatga

SEQ ID NO: 91679 - DNA, 246 bp, Glycine max
  Peptide Sequence Number=SeqID_183364
atgggtgaagtagagaaggtgcaagagcagatgaaggctgacatggaggccatgaaagggcaaatggccacaatgatggaggccataataagcatgaagaagataatggaagccaatgcggttatagttgccgctactagcgttgttgctaaggtgaacccgatgctcccatctggcctcaagcaaatgaatcatccaacctcaaatatggtagcaaagatttgggaagtacggatgaccccatga

SEQ ID NO: 91680 - DNA, 177 bp, Glycine max
  Peptide Sequence Number=SeqID_183365
atggctcttaggttcgatggtcttcaaacctttgttggtgaaaggtttgatgctttggagttacaagtggacatgcgattcgatgagatggattcaaggatcaccaaggttgaaggagatgtctcttacatccgcacatgctttgatctaccaccaccgccaccgccatcatcttag

SEQ ID NO: 91681 - DNA, 336 bp, Glycine max
  Peptide Sequence Number=SeqID_183366
atggtggctgtgggtgatggagaaagagcttggaacattggaaatggttttggaagaaagaaaggagaaggaatggcatttttcctaagctacttggactacaaggctcaaaacaaacaagtgagcaatgctctcggaaacagaaatgtcgcgcacactccagacatcttctcaaagatcccattgaccaaatttcgagaagatccaatggttaacgaaggttgggcatcgtttttaccgagacagctccatgtagcttcattaagaggcttcctcaagaagcttcctcgtggcttctttgagaagctttctcaagaggcttctttgagtagctaa

SEQ ID NO: 91682 - DNA, 402 bp, Glycine max
  Peptide Sequence Number=SeqID_183367
ggttgtcatcatcaaaaagggggagattgtagaagcaaacttcatgatgatgaatcaagaagttttgatgatgactaagatgatgacaaaaagcccaaagaatgatttcaagattaagttcaagatcaagattcatcaagaagattcaagattcaagaataatcaagatcaagattcaagactcaaagattcaagaatcaagagaagacttaatcaaaataaggtacatctacttggggattgttatactaagaacaagagagggtacatctcttgtggatcagttcaagtggagggtacatccacttgggttttcaaagagaacaagggagggtacatcccttgtggatctttggcttgtaaaggattttacaaggttgaaagaaatctcaagaatcgcag

SEQ ID NO: 91683 - DNA, 561 bp, Glycine max
  Peptide Sequence Number=SeqID_183368
gacagagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcagagcttgaaagagcccgagtagtcgaagagaagttcaagtccatagccatcaaagaatcatcacgggtcaaaggcatgatcttgaaggacgagctaaaggcttaccttaggtcgaaaagaaatttgtcccaacagttaagcgagactgaagggaatatgtgggccgtcatcgatgagtgcaaagagaagctaaatctagcggcgactcacgagcaaaggctagaggatgagtacgccaagatatcaacagaaagggaagcaagggagagggagtcaagaacttccccgattgctagccaaggccaaagcaatggcggacacctactccgcccccaagaagatccacggacttctcagctattgtcaacatatgatagacttaatggaccatatgattag

SEQ ID NO: 91684 - DNA, 192 bp, Glycine max
  Peptide Sequence Number=SeqID_183369
atgagcaaggcaaccacgagatttgaagggctggtcatttttgttttggggattcggcagatacatgcacaagaaattccaaaacacatggcaagaaatttcagagatattcgcgtgattcaaatttgtcaccatgagcaagtaagggcaatcacgggatttgaagaaattataaccctaagcggcatatga

SEQ ID NO: 91685 - DNA, 477 bp, Glycine max
  Peptide Sequence Number=SeqID_183370
tgtatgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggtgaagacccgcacaaacatttgaaagaatttcacattgtctgctccaaccatgaaacccccaagatgtccaagaggatcacatatttctga

SEQ ID NO: 91686 - protein, 135 aa, Glycine max
  Coding DNA Sequence Number=SeqID_1
  Homolog annotation: Hit_ID=A7PFZ2; Match level="QueryCoverage=100%, HitCoverage=14%, E-value=4e-31, Identity=57%"; Hit description =Chromosome chr6 scaffold_15, whole genome shotgun sequence
EQTKGQKFPVNASDQEMMEIVMDRDLGIMGCLCPTSSSLDAWWRSGLPMGISALKGSAKLGTWELMHPIQNLLNGELVRAILIQVQKLKLDTETAMLELNQILRANEINFAVLTALPAFFLSLLLMMLVRGWFKQ

SEQ ID NO: 91687 - protein, 141 aa, Glycine max
  Coding DNA Sequence Number=SeqID_2
  Homolog annotation: Hit_ID=A9P238; Match level="QueryCoverage=60%, HitCoverage=71%, E-value=4e-14, Identity=43%"; Hit description =Putative uncharacterized protein
MKCCSRFHLGIKSEALVGGGRWEQTFISMERSWDKVVFNSWILPGSLLMAEATSSRQIASGSAQNEVLKEWQDAWDERDKDFEKQGINQQDSFWSKLKSEAARKVGAEEAERFCKSFQQIHKKLVNEELSLDAARSFLNSS

SEQ ID NO: 91688 - protein, 155 aa, Glycine max
  Coding DNA Sequence Number=SeqID_3
  Subcellular localization annotation: CTP_CleavageSite=36; ConfidenceScore=5.57e-01
MIVIVAAGSARRRWVAPTRSTNPRFVPHRPFSVVPSAGRVSDLGTSELNKRERQRFRAGCGGLPGEMVHRLRLPNTHDEIGDECLEATVEVGDGRLEVAAEFATEEETWKISFRCDLPSPKASTTLAFLTVATMCKERLHDILNEEIDHARENLE

SEQ ID NO: 91689 - protein, 292 aa, Glycine max
  Coding DNA Sequence Number=SeqID_4
  Gene Ontology: Mol. function=peptidyl-prolyl cis-trans isomerase activity; Biological process=protein folding
  Homolog annotation: Hit_ID=A7PR17; Match level="QueryCoverage=23%, HitCoverage=15%, E-value=2e-26, Identity=83%"; Hit description =Chromosome chr6 scaffold_25, whole genome shotgun sequence
  Pfam annotation: Domain name=Rotamase; Domain location=194-273; Score= 11.0; E_value=0.0001; Accession=PF00639.12; Description=PPIC-type PPIASE domain
MGHPLSQLPNYLKDGAACFLDVGTLTSGCDGAPLLPLLFIIVNIGFNIALLHLLKISSAVVSCLASTFSGTANITPGSKGIKEQKQDQEVQKQDQQVQIAEKPKRKVLALEASFNSAPNMLPPLFQQALWLGPSSSFWAYSFMLVPLQMVPRANINSNSSNVNVEISLSVKASYGTGASAAAEGDRPREILVQHLLVKEDDQKLLLDIQQRISSGSVFVRSGEDLSDLAVEYSLCPSKEEGGMLGWVRKGQMAVLPLSDGKDTVTVNFLWEEEADEVPEFEEAAFTAPLNKV

SEQ ID NO: 91690 - protein, 250 aa, Glycine max
  Coding DNA Sequence Number=SeqID_5
  Homolog annotation: Hit_ID=A7NUN2; Match level="QueryCoverage=56%, HitCoverage=36%, E-value=5e-07, Identity=29%"; Hit description =Chromosome chr18 scaffold_1, whole genome shotgun sequence
  Pfam annotation: Domain name=DUF296; Domain location=55-180; Score =18.8; E_value=1.5e-05; Accession=PF03479.6; Description=Domain of unknown function (DUF296)
  Subcellular localization annotation: CTP_CleavageSite=36; ConfidenceScore=5.43e-01
MENSVHEPFFCLPSQNGSTSNNSTNFTTLFESSHVVGFNKSHLSFDNINSSNNFLEPIVLIVPPGIDIVNAIINFSHDQDVDISVHHASGLICEINLCNPLSTSDDLCFLGTFHMISLTGFYTNNNLSASSPPNNIPYPSFAIQFTRGSPPKLFGGRIGGKLIGVEPVHVMASIVKKHEYHKPNVQPVIKSTRGANHYVDITNNTDNNHLGFSNIGPSSSSPINIQTTTTPYAPTDANMHALSEQPHQSG

SEQ ID NO: 91691 - protein, 75 aa, Glycine max
  Coding DNA Sequence Number=SeqID_6
MEFVVERRSCCVVRVRWGEEGELSGVDLDFSLSEKEGKTNNFSASSSVSASSAAIVATTTVTLAFFHRKKKFWFE

SEQ ID NO: 91692 - protein, 482 aa, Glycine max
  Coding DNA Sequence Number=SeqID_7
  Gene Ontology: Mol. function=sequence-specific DNA binding; Cellular component=nucleus; Biological process=regulation of transcription, DNA-dependent
  Homolog annotation: Hit_ID=A7PQZ6; Match level="QueryCoverage=79%, HitCoverage=88%, E-value=9e-97, Identity=47%"; Hit description =Chromosome chr6 scaffold_25, whole genome shotgun sequence
  Pfam annotation: Domain name=Homeobox; Domain location=14-70; Score =69.4; E_value=1.2e-17; Accession=PF00046.20; Description=Homeobox domain
ELQSEENKVSNEKNKKRKLKTPAQLKALEDFYNEHKYPTEEMKLVLAEELGLTEKQISGWFCHRRLKDKRLMKDEAVANGRQDRSSGVIQDRGSGLGQDSCGSSKHADHRYLDPKEVESHGLYNHELSVADMTHRRRNHYPENVSGVDDTSSESSSFLQERFSQGQDPYDMEPSRHLTPNGALPPLNPKGAVKMGHKPSGYLKVKGEIEHAAITAVRKQLGRHYLEDGPLLGIEFDPLPPGAFECQTADTANDSHMEGADFGSLHESDFQDKQDKKACQNIKQRQSLYGYTNNFPGRNTFPDLYEDSTGEASAYNSNKSHRMSTKHGVEGMRSDSASNHSDHYEEKLTVKQKTLMLHGYDNINPKNIQRSEHVKSKPSSSIHNSRVPMDTEERGLSARMAKEEMFKGNRKAKNTYCDVEGAGMLSNEIMVAKRAKVDMLQQYNVKKSPVAEMELKKIQRSVAEMPSSFSEDETADTSSSLDY

SEQ ID NO: 91693 - protein, 175 aa, Glycine max
  Coding DNA Sequence Number=SeqID_8
  Gene Ontology: Mol. function=binding; Biological process =mitochondrion organization and biogenesis
  Homolog annotation: Hit_ID=A7PQY6; Match level="QueryCoverage=82%, HitCoverage=83%, E-value=6e-49, Identity=64%"; Hit description =Chromosome chr6 scaffold_25, whole genome shotgun sequence
  Pfam annotation: Domain name=TPR_2; Domain location=98-131; Score =21.0; E_value=0.0044; Accession=PF07719.8; Description =Tetratricopeptide repeat
MAKLEAKLGMIVDSVGQFFSGKDHLPYCDSDVVAGCEREVLEAEKQSSEEHMQDCLLRLSWALVHSKHPQDVHRGIAMLEGLSLSLILQFNYDPLQQREKLYLLAVGYYRNADYSRSRDLVDRCLALAPDWRQAVTLKKTIEDKITKDGVIGLGIAATAVGLIAGGIAAAVSRKK

SEQ ID NO: 91694 - protein, 969 aa, Glycine max
  Coding DNA Sequence Number=SeqID_9
  Gene Ontology: Mol. function=metal ion binding; Cellular component =intrinsic to membrane; Biological process=innate immune response
  Homolog annotation: Hit_ID=A7PQZ5; Match level="QueryCoverage=99%, HitCoverage=84%, E-value=0.0, Identity=78%"; Hit description =Chromosome chr6 scaffold_25, whole genome shotgun sequence
  Pfam annotation: Domain name=FYVE; Domain location=683-751; Score =59.8; E_value=9.5e-15; Accession=PF01363.12; Description=FYVE zinc finger
  Pfam annotation: Domain name=RCC1; Domain location=294-352; Score =2.4; E_value=0.41; Accession=PF00415.9; Description=Regulator of chromosome condensation (RCC1)
  Pfam annotation: Domain name=RCC1; Domain location=355-404; Score =18.1; E_value=0.008; Accession=PF00415.9; Description=Regulator of chromosome condensation (RCC1)
  Pfam annotation: Domain name=RCC1; Domain location=407-459; Score =27.3; E_value=5.7e-05; Accession=PF00415.9; Description=Regulator of chromosome condensation (RCC1)
  Pfam annotation: Domain name=RCC1; Domain location=462-511; Score =22.9; E_value=0.0012; Accession=PF00415.9; Description=Regulator of chromosome condensation (RCC1)
  Pfam annotation: Domain name=RCC1; Domain location=526-576; Score =39.7; E_value=1e-08; Accession=PF00415.9; Description=Regulator of chromosome condensation (RCC1)
  Pfam annotation: Domain name=RCC1; Domain location=579-628; Score =22.2; E_value=0.002; Accession=PF00415.9; Description=Regulator of chromosome condensation (RCC1)
  Pfam annotation: Domain name=RCC1; Domain location=633-680; Score =27.9; E_value=3.6e-05; Accession=PF00415.9; Description=Regulator of chromosome condensation (RCC1)
  Pfam module annotation: Pfam domain module=FYVE::RCC1::RCC1::RCC1::RCC 1::RCC1::RCC1::RCC1; Domain location=683-751::294-352::355-404::407 -459::462-511::526-576::579-628::633-680
MASDLSRTGPVERDIEQAITALKKGACLLKYGRRGRPKICPFRLSNIVVEIFLLRDCRVGDLEVEWHSDESVLIWFSGKEEKHLKLSQVSRIISGQRTFVSPFSICTCDPIFQRYPRPEKEYQSFSLIYNDRSLDLICKDKDEAEVWFSGLKALISRSHHRKWRTESRSDGIPSEANSPRTYTRRSSPMNSPFGSNESLQKDSGDHLRLHSPYESPPKNGLDKALDVVLYAVPQKGFFPPDSASASVHSVSSGGSDSMHGQMKTMGMDAFRVSLSSAVSTSSQGSGHDDGDALGDVFIWGEGTGDGVLGGGNHRVGSCLGVKMDSLFPKSLESAVVLDVQNIACGGRHAALVTKQGEIFSWGEEAGGRLGHGVDSDVLHPKLIEALSNTNIELVACGEYHTCAVTLSGDLYTWGNGTYNCGLLGHGNQVSHWVPKRVNGPLEGIHVSYISCGPWHTAVVTSAGQLFTFGDGTFGALGHGDRKSVSLPREVESLKGLRTVRAACGVWHTAAVVEVMVGNSSSSNCSSGKLFTWGDGDKGRLGHGDKEAKLVPTRVALVNVKPNFCQVACGHSLTVALTTKGHVYTMGSPVYGQLGIPQADGKLPICVEWKLSESFVEEIACGAYHVAVLTSRTEVYTWGKGANGRLGHGDTDDRNTPTLVEALKDKDVKSIACGTNFTAAICLHKWVSGVDQSMCSGCRMPFNFKRKRHNCYNCGLVFCHSCSSKKSLKASMAPNPNKPYRVCDNCFNKLRKTVETDSSSHSSVSRRGVANQGPLELIDKDDKLDSRSRNQLARFSSMESFKQVESRSSKKNKKLEFNSSRVSPIPNGGSQWGASNISKSFNPVFGSSKKFFSASVPGSRIVSRATSPISRRPSPPRSTTPTPTLGGLTSPNIVVDDAKRTNDSLSQEVIKLRSQVENLTRKAQLQEVELERTTKQLKDAIAIAGEETAKCKAAKEVIKSLTAQVETLIP

SEQ ID NO: 91695 - protein, 292 aa, Glycine max
  Coding DNA Sequence Number=SeqID_10
  Gene Ontology: Mol. function=protein binding; Cellular component =integral to membrane; Biological process=lipid metabolic process
  Homolog annotation: Hit_ID=A7PQY7; Match level="QueryCoverage=99%, HitCoverage=99%, E-value=1e-95, Identity=58%"; Hit description =Chromosome chr6 scaffold_25, whole genome shotgun sequence
  Pfam annotation: Domain name=DUF6; Domain location=19-122; Score=5.0; E_value=0.036; Accession=PF00892.11; Description=Integral membrane protein DUF6
  Pfam annotation: Domain name=DUF803; Domain location=3-246; Score =417.3; E_value=2.3e-122; Accession=PF05653.5; Description=Protein of unknown function (DUF803)
  Pfam module annotation: Pfam domain module=DUF6::DUF803; Domain location=19-122::3-246
MGLSKENLKGLILALVSSGFIGASFIIKKQGLRRAAAVSGVRAGVGGYYYLLEPLWWVGMITREVANFVAYAFAPAVLVTPLGALSIIVSAVLADIILKEKLHNLGILGCIMCIAGSIIIVIHAPKEQPITSVLEIWNMATQPVIVLVFILVFHFAPRCGHTNVLVFTGICSLMGSLSALDTFNTAIVSPIYYVMFTTLTILASVIMFKDWDGQSGGTIVSEICGFIIVLSGTIMLHATKDFERSSSFRGSDPLSPTLSARLFTGNGDSLLKQDEENGSPESNMRSRRQELY

SEQ ID NO: 91696 - protein, 367 aa, Glycine max
  Coding DNA Sequence Number=SeqID_11
  Gene Ontology: Mol. function=ATP-dependent helicase activity; Cellular component=mitochondrion; Biological process=mRNA catabolic process, nonsense-mediated decay
  Homolog annotation: Hit_ID=Q9LUW5; Match level="QueryCoverage=78%, HitCoverage=47%, E-value=1e-112, Identity=69%"; Hit description=DEAD- box ATP-dependent RNA helicase 53
  Pfam annotation: Domain name=DEAD; Domain location=112-282; Score =244.1; E_value=3.1e-70; Accession=PF00270.20; Description=DEADDEAH box helicase
  Pfam annotation: Domain name=ResIII; Domain location=108-277; Score= -22.5; E_value=0.0037; Accession=PF04851.6; Description=Type III restriction enzyme, res subunit
  Pfam module annotation: Pfam domain module=DEAD::ResIII; Domain location=112-282::108-277
  Subcellular localization annotation: CTP_CleavageSite=66; ConfidenceScore=5.57e-01
MLTAVLRRTSSTLSRRGFPAALISASTATATATAGNHFRLLSAAVNSRTFHSNPGPLNFRASSCHRAEYAVDDFPYEEGSKGNADEGLEIAKLGISQDIVSALAKKGITKLFPIQRAVLEPAMQGRDMIGRARTGTGKTLAFGIPIMDKVIQFNAKHGRGRDPLALVLAPTRELARQVESEFCESAPNLDTICVYGGTPISQQMRQLDYGVDIAVGTPGRIIDLLNRGALNLKDVQFVVLDEADQMLQVGFQEDVEKILERLPPKRQTLMFSATMPSWIKQISRNYLNNPLTIDLVGDSDQKLADGISLYSIATDLYVKAGILAPLITRVSLGPMVGLVPYDLEVTGTNSRNSLSACGGKAVRIYAP

SEQ ID NO: 91697 - protein, 278 aa, Glycine max
  Coding DNA Sequence Number=SeqID_12
  Gene Ontology: Mol. function=hydrolase activity, acting on glycosyl bonds; Cellular component=integral to membrane; Biological process =cell wall organization and biogenesis
  Homolog annotation: Hit_ID=A7QN93; Match level="QueryCoverage=84%, HitCoverage=68%, E-value=1e-109, Identity=78%"; Hit description =Chromosome chr2 scaffold_132, whole genome shotgun sequence
  Pfam annotation: Domain name=Glyco_hydro_28; Domain location=2-278; Score=-54.0; E_value=1.8e-06; Accession=PF00295.8; Description =Glycosyl hydrolases family 28
MNSSPGFVKLAFDCTIAILWKRKGTACRKVYEFYPWRWSLGCGENGTIDGQGDEWWNKWKQRTLQFTRPNLVEFVNSRDIIISNVIFKSSPFWNIHPYSNVVVRYVTILAPRDSPNTDGIDPHSSSNVCIEDSYISTGDDLVAEKSGWDEYGIVYGRPSSDITIRRVTGSSPFAGIAIGSETSGGVENVLSEHINLYNMGIGIHIKTNTGRAGYIKNITMSHVYMEEARKGIRISGDVGDHPDDKYDPNALPLVKGVTIKNVWGVKVLQAGLIQGLSS

SEQ ID NO: 91698 - protein, 1432 aa, Glycine max
  Coding DNA Sequence Number=SeqID_13
  Gene Ontology: Mol. function=endonuclease activity; Cellular component=cytoplasm; Biological process=cytoskeleton organization and biogenesis
  Homolog annotation: Hit_ID=A5C1N3; Match level="QueryCoverage=71%, HitCoverage=95%, E-value=1e-112, Identity=30%"; Hit description =Putative uncharacterized protein
  Pfam annotation: Domain name=CRA_rpt; Domain location=132-187; Score =7.5; E_value=0.16; Accession=PF07046.2; Description=Cytoplasmic repetitive antigen (CRA)
  Pfam annotation: Domain name=CRA_rpt; Domain location=209-243; Score =2.9; E_value=0.6; Accession=PF07046.2; Description=Cytoplasmic repetitive antigen (CRA)
  Pfam annotation: Domain name=CRA_rpt; Domain location=300-335; Score =0.9; E_value=1; Accession=PF07046.2; Description=Cytoplasmic repetitive antigen (CRA)
  Pfam annotation: Domain name=M; Domain location=294-314; Score=4.2; E_ value=37; Accession=PF02370.7; Description=M protein repeat
  Pfam annotation: Domain name=M; Domain location=364-384; Score=7.7; E_ value=13; Accession=PF02370.7; Description=M protein repeat
  Pfam annotation: Domain name=M; Domain location=389-409; Score=4.7; E_ value=31; Accession=PF02370.7; Description=M protein repeat
  Pfam module annotation: Pfam domain module=CRA_rpt::CRA_rpt::CRA _rpt::M::M::M; Domain location=132-187::209-243::300-335::294 -314::364-384::389-409
MAFSTNRDQTPKSDSTNPCCELWKKKYSKTQESRNALRQAVKVLEQKINEIQSRYNKVCGAKVEREEKLGEFVAARVHLESETFSLESQIVTPITNQGRGGDGNENRTLQSDWEKEIGRLKELIEVEKGRADSERKNATEACKLLENEKNKVVEKEKEIGGLKRLIEAEKRRADSESKKAAEACKMVGDEKNKVVEKEKEIVGLKRLIEAEKRRADSESKKASEACKLVGDEKNKAAEKEEGIRRLKGIMEVEKRKNDSERKEDTEACKLLGEEKKKVAEKEKEIGRLKGCIEEKKRRVDSERKKATEACKLLEEEKNKAAVKGEIARIEAEKAVKYSFQIGQLEKQVNEAKTKLVSEISTFREATKKFEAENHKLLAEKRNAESGMAKANERLEVEKQKVNEEKRRADAEMVKLEKQKALAKDNWNKFMKEKCLADQMSQQLEEDKKTIEDLKRKIHELSSLTKPVEMAADSKVNADSTEVKLLKNKLKLEKLRAKHTRQKYKLETSRYSILRHDLGRLKMDFIQFLQRLDILDASFSPVAGSMHGQTKFENILDMQNSNVTRQICNLNLSETCRQFENELLEPCCTTIYASDPLRKNIQNTQLLTPGGNYSEKSITGIGSKLEPLVRGSDRTKLQSSAVNSSTESFSDGQLMGSQDAAIFPVTASAKLTQDCKPPDKSVDVHHRKRKRMQDTIEYNANLSPEKLSDLHGLIYRKVGKCLEGGKEVLHNLNNLQEENKRAHKKRKKSRREKVDMIPLVNRDEQKGAEEAETEVYDDANVCRHTSCLAPHTLETSEACGDRICDAANNFDSMVNFDTVPDGNYMKLLELEDATSEECYRKAMDFPISPSLPEIEFCDTFEEGNLTNTSLEKALQDDMLSSRTDLFTSPYLNVINVEINSNEQKCDDCGVSCNLHMRITEKPRTAFSVEDVIGSLNNQLPEFCVVFSNIEDNSIISRILVATKNCIARCNLASQTGWGVANILTALKMEEKLSQKEKVSVLLTLMMFNFAMTATKTFGKLWDGNLFHCLQSYSEHICTETRVLFVENYSLHELLSLIEDFLIEGKVIVNNRVYAETLSCDLRVNDFLDCVNQVSSDVASSEQLAAASIILASVCAATDYVGFICDASYHILQSCKWDSLMVLTILHIFAYLGGEKFFNMDNFGLMVTVLKSLVMFLEDESPSVASACLPSINQLHAELCMNVKCPFLEGVESIDAVACLLLEEIKRINLSDSRLMSDNYDAELWYNQDAIQCTISKNCDVPCLRKFSIFATQPDALRNVNFCRLNDVLSLVELVSNKMSWHWADIKLVPQLLNILDSCVEENFAVRIIVLLGQLGRTGVDFGGYEDKGVGNLRCYLFTYFCRTSSMKAGLSLQVAAATALFGLLPLDFETLFHTKINLSAYSKSVSDNAESLRKWFSGLDKDQQKLLSDVFNM

SEQ ID NO: 91699 - protein, 566 aa, Glycine max
  Coding DNA Sequence Number=SeqID_14
  Gene Ontology: Mol. function=transcription regulator activity; Cellular component=nucleus; Biological process=regulation of transcription, DNA-dependent
  Homolog annotation: Hit_ID=A7PJR3; Match level="QueryCoverage=90%, HitCoverage=98%, E-value=1e-106, Identity=45%"; Hit description =Chromosome chr12 scaffold_18, whole genome shotgun sequence
  Pfam annotation: Domain name=HLH; Domain location=361-415; Score =51.8; E_value=2.3e-12; Accession=PF00010.17; Description=Helix-loop -helix DNA-binding domain
MNNSIPGWDFESDTCLTNQRKLIGPDQELVELLWKNGQVVMHNQTHRKTLGNSSNLRQVQKSDQSVLRSSGPYGNSSNLDQEDAAPWVQFPLEDPLEQDFCSNLLSELPTCEFESYKPIRQLEEEKFAKFFASGTPHHPTTSSSQPLPPNMKPSCIQGLQGNPIPMPAPRFHGPDSSQKIHDFGASRKVLNFPQFSTPRNNVPSAPGITQFREKTTANMSQSEAREYSVITVGSSHCGSNHIPQEQDVSRISSTGVWATTNNNTTLSAEPEAVRDYVQRPICPKSGQGKSEMIELTVTSSSGGSGSTGIGRTCSLSTRDHGQKRKGTEEEALEEQSEDTELKSADGNKASQRTRSSRRNRAAEVHNQSERRRRDRINEKMRTLQQLIPNSNKIRMDVTDKASMLEEAIEYLKSLQFQLQVMWMGGGMTPVMFPGIQHYMSQMGMGMGAPSLPSIHNPMQLPKVPHDQAMSVLQIPNQNLMCQNPVLGAFNYQNQMQNPCLPEQYARYMGYHLMQNASQPMNVFRYGSQAVQHSQTMIAPGNNSSGPMSGTANIDDADSGKAVNDFT

SEQ ID NO: 91700 - protein, 485 aa, Glycine max
  Coding DNA Sequence Number=SeqID_15
  Gene Ontology: Mol. function=transferase activity, transferring glycosyl groups; Biological process=metabolic process
  Homolog annotation: Hit_ID=A7PJQ5; Match level="QueryCoverage=60%, HitCoverage=81%, E-value=1e-110, Identity=71%"; Hit description =Chromosome chr12 scaffold_18, whole genome shotgun sequence
  Pfam annotation: Domain name=BcrAD_BadFG; Domain location=46-335; Score=206.3; E_value=7.2e-59; Accession=PF01869.11; Description =BadFBadGBcrABcrD ATPase family
MTPENGKEKKDFDAEAAGMKRYRNGEIWEFEDDMGVSDGDGTGVLLGLDGGTTSTVCICMPMIPFSHSQLQSLPILARAVAGCSNHNSVGDVSLITSSTEIAARETIEQVMADALSKCGSKRSLVQAVCLAVSGVNHPTDQQRILGWLRDIFPSHVRLYVRNDAVAALASGTMGKLHGCVLIAGTGSIAYGFTEDGKEARAAGAGPVLGDWGSGYGIAAQALTAVVRAHDGRGPSTMLTSSILQTLGLSSAEELIGWTYADPSWARIAALVPVVVTCAEAGDEVANKILLDSVQELASSVKAVVERLGLCGQVIPLHSLLHLANYVKLNGNKHVAVFPFPFGTHVVPLLNLVLKLSQAAPNCSFSFIGTEKSNAVRFLKPHIPTNIKPYCISDGIPEGHPLANHPIEKLSFSLKMGSGNLHKGIQMAEEETKVKVTCVIAVAFVTSSLLMAKNLNVPWIAFCPPMARPRSWCCGSATRIPRSRSS

SEQ ID NO: 91701 - protein, 699 aa, Glycine max
  Coding DNA Sequence Number=SeqID_16
  Gene Ontology: Mol. function=ATP-dependent helicase activity; Cellular component=intracellular; Biological process=dosage compensation complex assembly during dosage compensation by hyperactivation of X chromosome
  Homolog annotation: Hit_ID=A7PJR9; Match level="QueryCoverage=97%, HitCoverage=56%, E-value=0.0, Identity=67%"; Hit description =Chromosome chr12 scaffold_18, whole genome shotgun sequence
  Pfam annotation: Domain name=Ank; Domain location=443-475; Score =15.9; E_value=0.16; Accession=PF00023.21; Description=Ankyrin repeat
  Pfam annotation: Domain name=Ank; Domain location=476-508; Score=0.8; E_value=25; Accession=PF00023.21; Description=Ankyrin repeat
  Pfam annotation: Domain name=DEAD; Domain location=193-346; Score= -9.6; E_value=0.00022; Accession=PF00270.20; Description=DEADDEAH box helicase
  Pfam annotation: Domain name=Helicase_C; Domain location=570-664; Score=46.2; E_value=1.2e-10; Accession=PF00271.22; Description =Helicase conserved C-terminal domain
  Pfam annotation: Domain name=NACHT; Domain location=205-377; Score= -31.9; E_value=0.018; Accession=PF05729.3; Description=NACHT domain
  Pfam annotation: Domain name=R3H; Domain location=33-88; Score=46.9; E_value=7.1e-11; Accession=PF01424.13; Description=R3H domain
  Pfam module annotation: Pfam domain module=Ank::Ank::DEAD::Helicase _C::NACHT::R3H; Domain location=443-475::476-508::193-346::570 -664::205-377::33-88
METTTKNKREKKKGEPLFRQNPNVDEVTRIRISQILEHFRASNDEVYKFDADLSNQERALVHQMALKMGFRSKSYGLGKERRVCVQKMKKKVDTDNGFGSLPQFTFSGEAKWVLGDLFAHYPPGDGNSWEMVGENSDTATDRTKQRPDDIFSRPSMTKAEIARRLEALTSRMNNVSNLKQIIEGRSKLPIVSYKDSITSTVESHQVVLISGETGCGKTTQVPQFILDHMWGKGEVFSERIASERGETIGENVGYKIRLESRGGRQSSIVLCTTGVLLRVLVSKGSHSSKIGRVKDEISGITHIIMDEIHERDRYSDFMLAIIRDMLPLYPHLCLILMSATIDAARFSQYFGGCPIIHVPGFTYPVKTFYLEDVLSIVKSRPDNHLDSTTCSIPKTTCELSEEEKLSIDEAINLAWSNDEWDLLLELVSSEGTPDLFHYQHSLTGLTPLMVFAGKGRVGDMCMLLSCGADCHLRAKDGMTALEIAERENQPEAAEILKKHMDNDFSNSIEEKKLLDKYLATVNPELVDDVLIEQLIRKICIDSTDGGILVFLPGWDDINRTRERLLASPFFKNSSMFMLISLHSMVPSMEQKKVFRHPPHGCRKIVLSTNIAETAITIDDIVYVIDTGRMKEKSYDPYNNVSTLQSSWISKASAKQREGRAGRCQPGICYHLYSRTRAASLPDFQIPEIRRMPIEELCLQ

SEQ ID NO: 91702 - protein, 357 aa, Glycine max
  Coding DNA Sequence Number=SeqID_17
  Homolog annotation: Hit_ID=Q8RX34; Match level="QueryCoverage=82%, HitCoverage=93%, E-value=3e-36, Identity=34%"; Hit description =Putative uncharacterized protein At1g06660
MAKFLKACGTLTGTPVEIRKASEKLKASPAPDKDSEHSRFHCWLPNTSVEKLQLDVQPFDPPTPINLCQKLGNSMDSFEHTPISFISKAQDTEEDSVDYMEKSWSGNLHTADRSERNAALVSALLATNTQRKNKSVRFESETDLATYGSSSDNRHMKENKSPNNQSAYKPSPYPTPLKLFDEMQTPGTVYPASLEELHTGRAQVRSQFVYPTNKPGDNVLRCKILKERDFNPEEDSSELSDLVEKAQNGTPTPEKGSKRFSNENDEIKSNLSSRISPVSTIEEHSPMSFKWWYDNGIPNSTTKYKEDQKVKWHATPFEERLDKALSEENFISQRKLVCGKPVEFDEIEESDTASSQL

SEQ ID NO: 91703 - protein, 94 aa, Glycine max
  Coding DNA Sequence Number=SeqID_18
MSIGGFKPATSPPCLLPSPITGPTLYLLPKVLMTEGRREDIPSSEIALGFGSDGAAEGLDLSDVVFHGQREIGGGLLRPFHALEVVACRFFALW

SEQ ID NO: 91704 - protein, 54 aa, Glycine max
  Coding DNA Sequence Number=SeqID_19
MKSLHCEEGVEKRRWNGTRRSHRGKAEAVTDTRYANENTGFKSLLHPMGLEKLG

SEQ ID NO: 91705 - protein, 519 aa, Glycine max
  Coding DNA Sequence Number=SeqID_20
  Gene Ontology: Mol. function=binding; Cellular component=nucleus; Biological process=regulation of transcription
  Homolog annotation: Hit_ID=A7P390; Match level="QueryCoverage=87%, HitCoverage=89%, E-value=1e-158, Identity=51%"; Hit description =Chromosome chr1 scaffold_5, whole genome shotgun sequence
  Pfam annotation: Domain name=PPR; Domain location=103-137; Score=4.5; E_value=2.3; Accession=PF01535.11; Description=PPR repeat
  Pfam annotation: Domain name=PPR; Domain location=165-199; Score =25.0; E_value=0.00028; Accession=PF01535.11; Description=PPR repeat
  Pfam annotation: Domain name=PPR; Domain location=227-261; Score =23.0; E_value=0.0011; Accession=PF01535.11; Description=PPR repeat
  Pfam annotation: Domain name=PPR; Domain location=273-307; Score=2.0; E_value=4.5; Accession=PF01535.11; Description=PPR repeat
  Pfam annotation: Domain name=PPR; Domain location=308-342; Score =20.8; E_value=0.0052; Accession=PF01535.11; Description=PPR repeat
  Pfam annotation: Domain name=PPR; Domain location=343-377; Score=5.8; E_value=1.6; Accession=PF01535.11; Description=PPR repeat
  Pfam annotation: Domain name=PPR; Domain location=379-412; Score =10.8; E_value=0.41; Accession=PF01535.11; Description=PPR repeat
  Pfam annotation: Domain name=PPR; Domain location=68-102; Score=26.2; E_value=0.00012; Accession=PF01535.11; Description=PPR repeat
  Pfam module annotation: Pfam domain module=PPR::PPR::PPR::PPR::PPR::PP R::PPR::PPR; Domain location=103-137::165-199::227-261::273-307::308 -342::343-377::379-412::68-102
MGQVGSNRTRTQVLHKPLICIHGHKCNHANQNREASGEATALSGGRQVHIPHARAWVEFDKTAQPNGATWNAMFRGYAQAKCHLDVVVLFARMHRAGASLNCFTFPMVVKSCATANAAKEGRQVFAEMRDKNVFAWTAVVAAHVACHDMVSARRLFDLAPQCDVVLWNVIVSGYIELGDMVAARELFDRMPDCDVMSWNTVLSGYANNGEVELFVKVFEEMPARNVYSWNGLIGGYVRNGLFKEALECFKRMLVLVEGEGKEGSDGVVVPNDYTVVAVLSACSRLGDLEIGKWVHVYADSIGYKGNLFVGNALIDMYAKCGVIEKALDVFDGLDRAGERPDGVTFVGILSACTHMGLVRNGFLHFQSMVDDYLIVPQIEHYGCMVDLLGRAGLINQAVDIVRKMPMEPDVNVEMAELALQRLIELEPNNPGNFVMLSNIYKDLGRSQDVARLKVAMRDTGFRKVPGCSVIGCNDSVVEFYSLDERHPETDSIYRALQGLTILLRSHGYVPNLVDVAHAN

SEQ ID NO: 91706 - protein, 381 aa, Glycine max
  Coding DNA Sequence Number=SeqID_21
  Gene Ontology: Mol. function=potassium channel activity; Cellular component=membrane of vacuole with cell cycle-independent morphology; Biological process=potassium ion transport
  Homolog annotation: Hit_ID=A7PJV8; Match level="QueryCoverage=99%, HitCoverage=99%, E-value=1e-101, Identity=53%"; Hit description =Chromosome chr12 scaffold_18, whole genome shotgun sequence
  Pfam annotation: Domain name=Ion_trans_2; Domain location=104-185; Score=57.8; E_value=3.7e-14; Accession=PF07885.7; Description=Ion channel
  Pfam annotation: Domain name=Ion_trans_2; Domain location=227-302; Score=56.4; E_value=1e-13; Accession=PF07885.7; Description=Ion channel
  Pfam module annotation: Pfam domain module=Ion_trans_2::Ion_trans_2; Domain location=104-185::227-302
MQESLLRSCSRKADSPNRSSPGELSIHDLALALAPSLFQSSSHHVTNEAKTSMHLIANLAFKKGKFIHRSRSAPSLLFTDMGLDFQEPSEPHKSSTSIVRLSFLGVFLYVAIGVTVYMTSGSFRGTTTFRPVDAVYFTMVTLCTIGYGDIVPDSTFTKIFTCGFILVGFGFLGFLLNGLVAYICDTQEAFLLSMMDENRYKKILRTYMVDEEKGRMRIRTKVCLALAVVIGCIAIGTVTVHLVEDLNWDDSIYLSITSVTTVGYGDFSLRTVTGRCFAIIWLLVSTLAVARAFIYLTEYSIHKRNRKMAQWVLQKKITLSDLAAADLDNDGSISKSDFVIYKLKQMGKITEIDILQISKQFDSLEHGMYGKITLADLMDTV

SEQ ID NO: 91707 - protein, 225 aa, Glycine max
  Coding DNA Sequence Number=SeqID_22
TGLLHHSPPAPHLLSLIPLHPHAFPCDPNRLQRLQIKHDIDIRHQIRQGVMQIQNLEQLLRRPTAYANCLSEVEELNRGTFHHLHEASLVDGSSDAVEDLLAELLLTRKESSDADLGSFYPASAFVLELLPLKALNVYDAELFNVELVEAHVHGGFSHADIDLDALAEVAEGEHALIDATEVVDGIGGDQINIADATSGTVTVVVNKVDRNNIRIKNIRNLNWFI

SEQ ID NO: 91708 - protein, 79 aa, Glycine max
  Coding DNA Sequence Number=SeqID_23
  Subcellular localization annotation: CTP_CleavageSite=58; ConfidenceScore=5.60e-01
MKFYVSAKDARKGSVKTTVPADTVAARRISSRTVLVLGIVFLLSFVRVAVLVLESSAVCSTFVDSSVRKTVECETSTYE

SEQ ID NO: 91709 - protein, 52 aa, Glycine max
  Coding DNA Sequence Number=SeqID_24
MTPDIYFPSLWRSEIPMRMRGQDSSVKTQSSKFNGNILVSNLNFNTGDRKFH

SEQ ID NO: 91710 - protein, 209 aa, Glycine max
  Coding DNA Sequence Number=SeqID_25
  Gene Ontology: Mol. function=protein-tyrosine kinase activity; Cellular component=cytoplasm; Biological process=protein amino acid phosphorylation
  Homolog annotation: Hit_ID=A7QDC7; Match level="QueryCoverage=88%, HitCoverage=42%, E-value=1e-71, Identity=70%"; Hit description =Chromosome chr10 scaffold_81, whole genome shotgun sequence
  Pfam annotation: Domain name=Ank; Domain location=100-132; Score =12.1; E_value=0.58; Accession=PF00023.21; Description=Ankyrin repeat
  Pfam annotation: Domain name=Ank; Domain location=34-66; Score=11.0; E_value=0.83; Accession=PF00023.21; Description=Ankyrin repeat
  Pfam annotation: Domain name=Ank; Domain location=67-99; Score=45.6; E_value=1.7e-10; Accession=PF00023.21; Description=Ankyrin repeat
  Pfam module annotation: Pfam domain module=Ank::Ank::Ank; Domain location=100-132::34-66::67-99
MEIKKLQPRFSLGRQSSLAPERGGCGGDASEALDPAVRLMYLANEGDSDGIKELLDAGSDVNFTDIDGRTALHVAACQGRTDVVGLLLRRGADVDPQDRWGSTPLVDAMYYKNHDVVKLLEKHGARPPMAPMHVQNAREVPEYEIDPSELDFTNSVCITKGTFRIALWRGTQVAVKTLGEELFTDDDKVWVGLLMQAVVSFMSIGLFNS

SEQ ID NO: 91711 - protein, 438 aa, Glycine max
  Coding DNA Sequence Number=SeqID_26
  Gene Ontology: Mol. function=binding; Cellular component=nucleus; Biological process=activation of protein kinase C
  Homolog annotation: Hit_ID=Q2HS18; Match level="QueryCoverage=89%, HitCoverage=82%, E-value=0.0, Identity=48%"; Hit description =Tetratricopeptide-like helical
  Pfam annotation: Domain name=PPR; Domain location=12-46; Score=1.2; E_ value=5.7; Accession=PF01535.11; Description=PPR repeat
  Pfam annotation: Domain name=PPR; Domain location=179-213; Score =31.6; E_value=2.9e-06; Accession=PF01535.11; Description=PPR repeat
  Pfam annotation: Domain name=PPR; Domain location=216-250; Score =11.3; E_value=0.35; Accession=PF01535.11; Description=PPR repeat
  Pfam annotation: Domain name=PPR; Domain location=252-286; Score =20.9; E_value=0.0047; Accession=PF01535.11; Description=PPR repeat
  Pfam annotation: Domain name=PPR; Domain location=78-112; Score=42.8; E_value=1.2e-09; Accession=PF01535.11; Description=PPR repeat
  Pfam module annotation: Pfam domain module=PPR::PPR::PPR::PPR::PPR; Domain location=12-46::179-213::216-250::252-286::78-112
MGRRDGFEPDEMSLVSLLGACGELGDLELGRWVEGFVVERGMTLNSYIGSALISMYAKCGELESARRIFDGMAARDVITWNAVISGYAQNGMADEAILLFHGMKEDCVTANKITLTAVLSACATIGALDLGKQIDEYASQRGFQHDIFVATALIDMYAKSGSLDNAQRVFKDMPQKNEASWNAMISALAAHGKAKEALSLFQHMSDEGGGARPNDITFVGLLSACVHAGLVDEGYRLFDMMSTLFGLVPKIEHYSCMVDLLARAGHLYEAWDLIRKMPEKPDKVTLGALLGACRSKKNVDIGERVMRMILEVDPSNSGNYIISSKIYANLNMWEDSARMRLLMRQKGITKTPGCSWIEVENHLHEFHAGDGLCLDSIDLSNIIDLLYEELKREGKIGSRGTQLSQLNYFILMLIGLVLSDSVENADKELMRYWEVIQV

SEQ ID NO: 91712 - protein, 114 aa, Glycine max
  Coding DNA Sequence Number=SeqID_27
MKVFSLFGEWNSFWLFKQDENDRESSPKCARYALSVQGSTSAKRGVKHEDAGFVTCAKREARAKHTIQQKHILSLQHALSARSERAKRTYEGPKLISASINRDPSQGKHTSCLK

SEQ ID NO: 91713 - protein, 135 aa, Glycine max
  Coding DNA Sequence Number=SeqID_28
MDRTKQGSKGHIWLETVKGLQKLATEFSGMIINYGEQRLHMLGMANCHNWPENAEKYWLCSQKRKLGFQQSTIDNTNCMLIQFFQNAPAAPLCEHKIATLFGTIDNYAKAMLIYKGKGNGQNYTFALPPFEPVNI

SEQ ID NO: 91714 - protein, 466 aa, Glycine max
  Coding DNA Sequence Number=SeqID_29
  Gene Ontology: Mol. function=calcium ion binding
  Homolog annotation: Hit_ID=A7P296; Match level="QueryCoverage=65%, HitCoverage=78%, E-value=1e-49, Identity=40%"; Hit description =Chromosome chr19 scaffold_4, whole genome shotgun sequence
  Pfam annotation: Domain name=F-box; Domain location=6-53; Score=31.3; E_value=3.6e-06; Accession=PF00646.24; Description=F-box domain
  Pfam annotation: Domain name=FBD; Domain location=381-431; Score =47.3; E_value=5.4e-11; Accession=PF08387.1; Description=FBD
  Pfam module annotation: Pfam domain module=F-box::FBD; Domain location=6-53::381-431
MAVSSDCFCLLPIEVVLTILSLLPFKEVVRTCVLSKDWLDICKSTPNIEFNELFFVKPDQSNETREAQRRAFLEFIKSWIENHKGATIDKFSLSLSMPANVGEIINESVAFATQRGVKELDLDFVDRSKNENGDCSYDSDEALFELPSRVYEHISLESLKLYSCSFIETKVLNFHALKEVSLGWMEVRLTAIKAFLFNCKKLECLSFTRCWNSDKFDLGEEEHMGLTKLFLDKCNFDFDYFRVKAPNLKIFKYCGWINFAVVEIDSLAMEEVDLDFSLESSFEEFGHPIYNLVKDVCTARVLTVCSFVLQVIPTGPEQLRMEVDMDARHLIMKTALDDDEFIGISFFLNSCPLLERLTIEIGPKSELSDYEPAFEFTSLLFWIEYLNVCECLISSLEVVEINGFRGTLNEYRFLEYLIFSGYVLKKIIINMLKDDSGRTVEYYCRHMAELLLTCPCTSRNLEISIF

SEQ ID NO: 91715 - protein, 1041 aa, Glycine max
  Coding DNA Sequence Number=SeqID_30
  Gene Ontology: Mol. function=DNA-directed DNA polymerase activity; Cellular component=intracellular; Biological process=nucleobase, nucleoside, nucleotide and nucleic acid metabolic process
  Homolog annotation: Hit_ID=A7P230; Match level="QueryCoverage=81%, HitCoverage=96%, E-value=0.0, Identity=68%"; Hit description =Chromosome chr19 scaffold_4, whole genome shotgun sequence
  Pfam annotation: Domain name=3_5_exonuc; Domain location=259-483; Score=-8.1; E_value=0.00029; Accession=PF01612.11; Description=3'-5' exonuclease
  Pfam annotation: Domain name=DNA_pol_A; Domain location=637-1040; Score=90.0; E_value=7.8e-24; Accession=PF00476.11; Description=DNA polymerase family A
  Pfam module annotation: Pfam domain module=3_5_exonuc::DNA_pol_A; Domain location=259-483::637-1040
  Subcellular localization annotation: CTP_CleavageSite=59; ConfidenceScore=5.33e-01
MQSFQISYNGLRNSTVLRNFVQSRADFSCCLKGTSVGLNKYNGARYKRNFLCKSPVCISSMKISNASTGTLEEMTEEEELNSLRPCEMQVRTVGMAACNNEFSTTTLGKKLSGGDYRGWTMAKDKLTENKKEMNGSNKFERENGSFSASNGIASIAQNQAVPRNGDSIIVLQDPGTHAPSSVNYSVLNNSKVLTDSEKVIHQYNGSSLGIGKEKVIVVNGDHGLDETAKDSTNATLTKQACGTDQSKLRDRLCSIYDDILVVDNIPLAEEVSKMLTTKYRHLIYACDTEVAKIDVKQETPVDHGEITCFSIYCGPEADFGGGKSCIWVDVLDGGGKEILEKFAEFFSDSSIKKVWHNYSFDCHVIENYGFKVSGFHADTMHMARLWDSSRHLDGGYSLEGLTGDRRVMSRAQLNHEKDLTGKVSMKTIFSKKKLKKDGSEGKTSIIAPVEELQREERIPWICYSALDASSTLKLYESLKSHLSDMPWKFDGLPVYGKTMYDFYNEYWRPFGELLVMMESEGMLVDRAYLESIEKVAKAEQEVAVNRFRKWATRYCPDAQYMNVGSDSQLRQLLFGGIVNRKDSSQTLPTERIFKIPNVDNVIEEGKKAPKKFRDIKLTSLGYNLETEMYTATGWPSVSGDALKALAGSISADYDFFDEDCNLDDLDDEDENPSQSQVASVKIDKSAYGTAYAAFPTEEEGREACHAIAALCQVCSINSLISNFILPLQGHNISGKDLRVHCSLNINTETGRLSARRPNLQNQPALEKDRYKIRQAFIAAPGNSLIVADYGQLELRILAHLADCKSMLEAFEAGGDFHSRTAMNMYPHIREAVEKKEVLLEWHPQPGEDKPPVPLLKDAFASERRKAKMLNFSIAYGKTPVGLSKDWKVSVKEAKKTVDLWYNDRKEVLQWQEERKKEARVLHCVYTLLGRARRFPLMAQANTYQKGHIERAAINTPVQGSAADVAMCAMLQISKNKRLKELGWKLLLQVHDEVILEGPTESAEVAKSIVVECMSKPFNGKNILKVDLSVDAKCAQNWYSGK

SEQ ID NO: 91716 - protein, 1645 aa, Glycine max
  Coding DNA Sequence Number=SeqID_31
  Gene Ontology: Mol. function=binding; Cellular component=nucleus; Biological process=ribosome biogenesis and assembly
  Homolog annotation: Hit_ID=A7Q575; Match level="QueryCoverage=98%, HitCoverage=96%, E-value=1e-124, Identity=43%"; Hit description =Chromosome undetermined scaffold_52, whole genome shotgun sequence
  Pfam annotation: Domain name=BP28CT; Domain location=1403-1575; Score= 113.9; E_value=4.8e-31; Accession=PF08146.3; Description=BP28CT (NUC211) domain
MASSIASQLEAIRSFAKTDSDPLKRPYTRPSILYDPKKAADISTETIFTEALRGLEILIGMDERFRNYKNDLFSHRSIELDRELMGIEQNNQLNVSIASYLRLLSGYFLHTSALQTLEYLIRRHKIHVYNNEDLILCTLPYHDEPEFVRIVQILDTRNTKWGFLDGVKASGARLPRMVIVQQCIRDKGILDALCNYASPSKKSRPSMPAIRFCTAVFVEVLGTVVTVDDDLVKRILPFVSLQPGIKGVSDHKAGSLMIIGLLGNKTALAPKLLNSLIRLVAEVARQEATELTDLHWFRLSLITLISLVQILFVVNTKYPSELRGAAHHFLQDNKARSKKDDSLYKVLCKMLDGNSDSSLDISDSNADVRRATLLDLNNSVILKAKAVGLELEDKDLTVVQAALRVDGLPNVIDSSKLLDALQKVLRRCTDKLLSADNYSLNGEVAVTCLKNAISYFSDHTDYLKNVAAMIFPLLLVLPQAEWETSVTAGDASLDEFKPEVLDWDCSAFFNELLYVKLRHLNVKRDDDKWVNKIRDLFVFFASSKLKHTFLEHLHYLAAQCKISPPRLLSKFFTDEGVTAAVQVESLQCYAFLCSLSQDKWKIELLAEFPSVLVPFASDNQSIRVAAMSCIDSLRTLWCHVERSGKKNVVEIEIQIKLMILSLFKGIGNALMHIPEVGPLLSSFLEQYYDELNKSCPKLSNTETQIVCLLLESCVMSSPSGGNDLQNLLLKALRLGAMTSDDPACVKPCITVLNKLNSQFYMELKNEVKEGLFCELVFLWHNDNGDVQRATKEALMRIDISFSTVGHMLDLILAQKSCISSSAEEKMVKKQKFIGHQEAGYPPNDISRRDNPVYILSSLLDVLLLKKDITNRHLLLGPLFKLLSKVFSGEWVNGAYSPVRRVFPGEVLEHMLDILEVIGQAAVTQDVLFIVVKMKSNTVSKPTAISVVSKFPLCITWSAGIRGVGGGVESPTSPIEIDSHSKHVFEDLISAIVPCWLAKTDDVEKLLMIFMDILPEIVEHRRLSFVLYLLRTLGEGKSLASLLILLLRSLISRKAACFLNVKTRDDLTFYTGEWEYKFAVQICEQYTSMIWLPSLVMLLEQRGNSDVDQALFLELFIVMQFSLQKLQDPEFVFKLESGEDTAVIQALGLLCEVARNHKNVSLKLKGNKGSRSTPSFLLLHMNETSQESLNKLCLEIIRVLDDSSNTSLKVAAVSALEVLAERFPSNNSIFSLCLGSVTRHIVSHNLAVTSSCLRTTAALINVLGPKSLAELPKIMDNVMKSSRRVLASLDKKPETTDVLSASNESHFYVLITLEAVVDKLGGFLNPYLTNIMELLVLYPEYVSGVDAKVESRAHGVRKLLAEKIPVRLALPPLLKLYPAAIEAGDKSLTIVFDMLGTIIGTMDRSSIVAFHGKVFDLCLVALDLRRQSPPSVQNIDVVEKAVLNTMTVLTLKLTESMFKPLLIKSIEWAESEVDETASSGSIDRVISFYGMVNKLTESHRSLFVPYFKHLLGSCVHHLSEGGDVKVSRVNQKKKARILDDGNIKEIGSVSINAWHLRALMLLRPIVSQLVVDPPALLDDSINIPSVKEVDDLLVVCIGQMAVTAGSDLLWKPLNHEAVAVVQQQANWAPSNGSRSKYGVSNISHSN

SEQ ID NO: 91717 - protein, 288 aa, Glycine max
  Coding DNA Sequence Number=SeqID_32
  Gene Ontology: Mol. function=transferase activity, transferring glycosyl groups; Cellular component=integral to membrane; Biological process=carbohydrate metabolic process
  Homolog annotation: Hit_ID=A7PIN1; Match level="QueryCoverage=91%, HitCoverage=98%, E-value=1e-104, Identity=68%"; Hit description =Chromosome chr13 scaffold_17, whole genome shotgun sequence
  Pfam annotation: Domain name=Yip1; Domain location=84-251; Score =173.8; E_value=4.4e-49; Accession=PF04893.8; Description=Yip1 domain
MEESSYTGLPTSHLLGSVPAVITEENNATKHVATGANMQTFPPNNGGDRGPGHQTLGSPTEAFEQQPANNWRGIFSMSSYSEYFNVDTDVVLIRLISSLNPVAADFFSKIDANPDLYGLIWISTTLVFVLASLGNLATFLMQKHADNSTSWSFDVSYVNVAACSIYGYAIVVPLAYYFFLQYMGSNASLIRFWCLWGYSLTIFIMSSFLLIIPVEFLRWVIILLTGVASASFVALNLRSYIEGNELSVAIIAAFFLQMALAIFIKLFCVKPRQFPMLVNQILLFSSPV

SEQ ID NO: 91718 - protein, 493 aa, Glycine max
  Coding DNA Sequence Number=SeqID_33
  Gene Ontology: Mol. function=metal ion binding; Cellular component =intracellular; Biological process=protein modification process
  Homolog annotation: Hit_ID=A7PIN9; Match level="QueryCoverage=97%, HitCoverage=96%, E-value=0.0, Identity=69%"; Hit description =Chromosome chr13 scaffold_17, whole genome shotgun sequence
  Pfam annotation: Domain name=RCC1; Domain location=334-383; Score =7.9; E_value=0.1; Accession=PF00415.9; Description=Regulator of chromosome condensation (RCC1)
  Pfam annotation: Domain name=RCC1; Domain location=386-437; Score =31.2; E_value=3.7e-06; Accession=PF00415.9; Description=Regulator of chromosome condensation (RCC1)
  Pfam annotation: Domain name=RCC1; Domain location=440-488; Score =26.2; E_value=0.00012; Accession=PF00415.9; Description=Regulator of chromosome condensation (RCC1)
  Pfam module annotation: Pfam domain module=RCC1::RCC1::RCC1; Domain location=334-383::386-437::440-488
MAMNNGDGTDGGALQRVLYMWGYLPGALPQRTPLLTPVAVRVPPCDYSWNDVCGGGCGFAIAISESGKLITWGSTDDLGQSYVTSGKHGETPEPFPLPTETSIVKAAAGWAHCVAVTEHGEVYTWGWKECIPSGKVFGESSTGVSLEKDVPGRHTPLFTEQVSPRSQGSRSTGGTASSNSGEESTKRRRVSSAKQTAESSSSSDDSLTAFPCLVTLNPGIRIASVAAGGRHTLALSDTGLVWAWGYGGEGQLGLGSRIRMVSTPHLVPCIDSSYYVKDRSATLARGNMGSEGQTFRIPGSYIKRIACGGRHSAVITVNSYVLILEYLSVELTDAGALLTFGWGLYGQCGQGITDDELSPTCVSSLLGIHIEGIAAGLWHTVCTSADGDVYAFGGNQFGQLGTGADQAETLPRLVDSPSLKNLHAKNISCGARHTALVTEGGKVFCWGWNKYGQLGLGDVIDRNIPSEVTIEGCVPKNVACGWWHTLLLAESHT

SEQ ID NO: 91719 - protein, 139 aa, Glycine max
  Coding DNA Sequence Number=SeqID_34
MTKAPARTRLAHAWGLGSGGSVTSLCGEARDLNGVFLQFYQVPVRLEGDSVAGKVEVVGAEGAVPVREVVADACKDTRGEVWGERVEEKVRFLGILGEEMMNCNCVAFVFVTSQPKLHSDNNSNRNILVLQIEASVCEI

SEQ ID NO: 91720 - protein, 195 aa, Glycine max
  Coding DNA Sequence Number=SeqID_35
  Homolog annotation: Hit_ID=A7P0P7; Match level="QueryCoverage=98%, HitCoverage=100%, E-value=2e-20, Identity=37%"; Hit description =Chromosome chr19 scaffold_4, whole genome shotgun sequence
  Pfam annotation: Domain name=DUF584; Domain location=19-193; Score =156.3; E_value=8e-44; Accession=PF04520.4; Description=Protein of unknown function, DUF584
MEDKYSLGRQHSGIWKSLRDGEFDEEEVWDVFKNRSDYGSSSSGVRKFKDKGKSSSVPARPSSARMIPRSSNSSNNSSASSSNEAKVLQQSAPVNIPDWSKIYRTKTPKNSVSRFDDDYDGDGAANYGGDSDEDGEENDESDSKLPPHEFIARRLARSRISSFSVLEGAGRTLKGRDLSKVRNDVLSKTGFLESL

SEQ ID NO: 91721 - protein, 261 aa, Glycine max
  Coding DNA Sequence Number=SeqID_36
  Gene Ontology: Mol. function=SNAP receptor activity; Cellular component=late endosome membrane; Biological process=abscisic acid mediated signaling
  Homolog annotation: Hit_ID=A7QAV4; Match level="QueryCoverage=98%, HitCoverage=90%, E-value=5e-70, Identity=56%"; Hit description =Chromosome chr5 scaffold_72, whole genome shotgun sequence
  Pfam annotation: Domain name=Syntaxin-6_N; Domain location=6-98; Score=140.1; E_value=6.4e-39; Accession=PF09177.2; Description =Syntaxin 6, N-terminal
MPSAQDPFYVVKQEIQESIDKLKSTFHQWENTADVGERSSLSKEVLASCESIAWQVDELDKAISVAARDPSWYGIDEVEVENRRKWTSDARTQVNKAKRTVEAGKGSNNASLSGMHRELMRLPSSHQTTSNQYAAQDNDDFIESESDRQMLLIKRQDEELDELSLSVQRIGGVGLTIHEELLAQVTGSNPRNSLFPCGVKASYFYPPLTPLGGSLVHWAALEKIIDELGNEMDGTSNRLDFVQRVSLFMISEKSGNGHEEG

SEQ ID NO: 91722 - protein, 724 aa, Glycine max
  Coding DNA Sequence Number=SeqID_37
  Gene Ontology: Mol. function=Rab GTPase activator activity; Cellular component=soluble fraction; Biological process=regulation of GTPase activity
  Homolog annotation: Hit_ID=A7P0N2; Match level="QueryCoverage=82%, HitCoverage=94%, E-value=1e-173, Identity=52%"; Hit description =Chromosome chr19 scaffold_4, whole genome shotgun sequence
MEEQTFVSKARTAFHSAAAKAERVLLDFKSDRALTQFVDRREEDHDKQSSPNTFTGQQPEAESPHTNENDSKLRSELKHIKWRPPHLGIKQDWQDRIKNIRRGRKEVEDTDKVGDASMAVPFYDDNLYLLNMKNDLEAKASEAIPSVESLTAATKDPIPPSSVLKQLAIAVEAGSKAKSMKDLIASSGVSSPARERAGLSFSAVKALVLREKEDKLTSEFTSNEKVVQLINSLFDPEGDFLRRKINSNLEETAMTSLPRDIHGAPPESLVVKLAEILGNYKTLRKMALFWCRVVAELRKLWSEEQYLPGVPQNEIPDLKFRIIATESLDSMMMQANSDIKESTDCCAGAPASPVLYARLNSGELVLRLGADHPAGDMTLLETGEPVYSPITQEGPLLTEDLIRETEEFVLRTGSVGAGCSQLLSDMQAFKAANPGCILEDFVRWYSPPDWTDNEASTEDSDVFDSGEPLSTRGQLSQRMQKEGFAIAEPMLSSNSDFSKLFYDCKEYIIVACQNNKLNEKVDDLVQVYETVEKMLLDPEEALKMIRQTEESTMVTGEPRSPFRTLSLIFGGKDKLLRKSVSKDQTNDEEKSGRQSFSSFFDSKSSLFGKKPPKSGFPSPSAKSSIDTDKFWPSNEKGKEKRLDLIGRKVDKSPDWAGATTIECGSALVVNGSLAKGKCWALLHAREAVKIGAGGTSWGEAWLVQLLFQEDTFGLGYWDKLIFGE

SEQ ID NO: 91723 - protein, 283 aa, Glycine max
  Coding DNA Sequence Number=SeqID_38
  Gene Ontology: Cellular component=endoplasmic reticulum; Biological process=intracellular protein transport
  Homolog annotation: Hit_ID=A7QUI9; Match level="QueryCoverage=40%, HitCoverage=52%, E-value=5e-23, Identity=48%"; Hit description =Chromosome chr10 scaffold_179, whole genome shotgun sequence
  Pfam annotation: Domain name=Bap31; Domain location=4-238; Score= -89.6; E_value=0.1; Accession=PF05529.3; Description=B-cell receptor -associated protein 31-like
MIQLLFILLMIQIAFILILSFANPIRKLVVIGLDLLKQGRGPLVTKTVAATMCVVLSSTVYTITKIQKRSKDASIVNPTDEVLMAHRLLEAAFLGFSLFLGLVIDRQHYYIREINLLRKNLETWKKRNHNHDSLKRRVETEKPNPKGRAQVSGNGCGDFAGGTGGNTGGNNGDGDTDTGGRSDGDTGRDGDTGDTGGGDGTACSKAHDPNTHNLPKGHTLPHLPQLKSSINDVDEEDEASVAFSCPSFGVGFPSILISNSTKTNVTRAEDSAPRLILRKWLEG

SEQ ID NO: 91724 - protein, 130 aa, Glycine max
  Coding DNA Sequence Number=SeqID_39
MVFILATDLLVTNAIFEGRGLQAFSGLLGDVVCVSIPHVPSLRLMAMMALVPIISAHPINIISSTIDSFVTLWNASLQGRGPKRENTALSKWLMLRDKKEEEEWEKKAADDRREGGEKFQKEGRKTDSPK

SEQ ID NO: 91725 - protein, 178 aa, Glycine max
  Coding DNA Sequence Number=SeqID_40
  Homolog annotation: Hit_ID=A7P9Z6; Match level="QueryCoverage=44%, HitCoverage=17%, E-value=2e-12, Identity=48%"; Hit description =Chromosome chr14 scaffold_9, whole genome shotgun sequence
MEVFRVVLSCWRKQRKRLKKEMKELQFDKDEELSEKIARFGTSITNMLPPSQSFSLWPSLTSELGLPSHLFLENDIIPYRTRKLNASEKLRQMRPSLSRKFSSYVLATPVDAKSSTSSGSNNPKPSNMQANLREPTKNLWHSSPLEQKKHDKDMGDEFSGSIIRSAQSLLKESNCLLQ

SEQ ID NO: 91726 - protein, 405 aa, Glycine max
  Coding DNA Sequence Number=SeqID_41
  Gene Ontology: Mol. function=pyruvate dehydrogenase (acetyl -transferring) activity; Cellular component=mitochondrial matrix; Biological process=metabolic process
  Homolog annotation: Hit_ID=P52904; Match level="QueryCoverage=94%, HitCoverage=100%, E-value=1e-176, Identity=84%"; Hit description =Pyruvate dehydrogenase E1 component subunit beta, mitochondrial precursor
  Pfam annotation: Domain name=Transket_pyr; Domain location=48-248; Score=200.0; E_value=5.9e-57; Accession=PF02779.15; Description =Transketolase, pyrimidine binding dom
  Pfam annotation: Domain name=Transketolase_C; Domain location=265 -387; Score=210.4; E_value=4.3e-60; Accession=PF02780.11; Description= Transketolase, C-terminal domain
  Pfam module annotation: Pfam domain module=Transket_pyr::Transketolase _C; Domain location=48-248::265-387
MKDYRGLEGNAEEPNASRKEGRKMLGVIRHKSIRPAFSAIRHLSSAAKEITVREALNSALDEEMSADPKVFLMGEEVGEYQGAYKISKGLLDKYGPERVLDTPITEAGFTGIGVGAAYYGLRPVVEFMTFNFSMQNTWVTRFQHMMIHFTRKNVDFHAIDHIINSAAKSNYMSAGQISVPIVFRGPNGAAAGVGAQHSQCYASWYGSCPGLKVLSPYSSEDARGLLKAAIRDPDPVVFLENELLYGESFPVSAEVLDSSFCLPIGKAKIEREGKDVTITAYSKMVGFALKAAETLAKEGISAEVINLRSIRPLDRSTINTSVRKTNRLVTVEEGFPQHGVGAEICTSVIEESFGYLDAPVERIAGADVPMPYAANLERMAVPQVEDIVRAAKRACYRSVPLAASA

SEQ ID NO: 91727 - protein, 311 aa, Glycine max
  Coding DNA Sequence Number=SeqID_42
  Gene Ontology: Mol. function=pectinesterase activity; Cellular component=cell wall; Biological process=cell wall modification
  Homolog annotation: Hit_ID=A7PRQ3; Match level="QueryCoverage=89%, HitCoverage=92%, E-value=1e-46, Identity=39%"; Hit description =Chromosome chr14 scaffold_27, whole genome shotgun sequence
  Pfam annotation: Domain name=Pectinesterase; Domain location=36-299; Score=57.3; E_value=5.2e-26; Accession=PF01095.10; Description =Pectinesterase
MEMLLRPVLFPLLLFLFCSSWVEGAMDCWGNKIQHTIVVDQHGKGEFRTVQAAFDSIKENNDRWVKVHINAGTYTEKVQISIYKPCIFLEGSGKEVTTITSSGFHSTSTININASSDDNSQSDNTGATCVSFPSNVIVIGITFENSFNLVGSQSIAPAPAAAIYGDKSVFFKCGFACTINATQERSFPGFVTAQFRDSEIDTSGFVFRAGCVMGIGRVNLGRAWGPYSRVIFHGTYLSPIVSPEGWNAWDYTGQEWGSNLTYAEVDCTGPGANTAKRVKWEKNLTGSQLNEFSLSSFINQDGWLSYLPITF

SEQ ID NO: 91728 - protein, 470 aa, Glycine max
  Coding DNA Sequence Number=SeqID_43
  Gene Ontology: Mol. function=lipid binding; Cellular component =integral to membrane; Biological process=defense response to bacterium
  Homolog annotation: Hit_ID=A7PXC2; Match level="QueryCoverage=89%, HitCoverage=80%, E-value=1e-111, Identity=49%"; Hit description =Chromosome chr12 scaffold_36, whole genome shotgun sequence
  Pfam annotation: Domain name=LBP_BPI_CETP; Domain location=36-227; Score=40.3; E_value=7e-09; Accession=PF01273.16; Description=LBP BPI  CETP family, N-terminal domain
  Pfam annotation: Domain name=LBP_BPI_CETP_C; Domain location=259-469; Score=-31.8; E_value=0.00044; Accession=PF02886.8; Description=LBP BPI  CETP family, C-terminal domain
  Pfam module annotation: Pfam domain module=LBP_BPI_CETP::LBP_BPI_CETP_ C; Domain location=36-227::259-469
MAPSICFLLLSLLFLSSSTSGTDEEGFISVIISDKGLDFAKDILIDQAVASIVQSQLPQIEKTVQVPLVGKAKVVLSDITINHIQVNSSSVNTGETGIALVVSGATADLSLNWRYSVSSWLVPIGISDSGTATVKVNDLQVGLTVNLRNQEGTLKLNLLDSGCHTVGPETGRPDKSVSVIFCNKNYSGEYKAIFQFFCRLVDAFAGNIASAVEEAISKKINEGISTLDLLLQSLPKTIPLDETAALNVSFMDNPVLSDSAIELEINGLFTGRNEVLVPQAYYRGSGLSLSASCGGSSPKMITISLHESVFKSGSMLYFTADSMQWIVDELPDQALLNTAEWRFLIPQLYKKYPNDDMNLNISVSSPPDIQVTNKDVSVNIFIDITIDVLEDGEVIPVACISVDFSASFAVEILGNNLAGWLKLRKFSTSLKWSKIGKLHMNLIQLAALYFDMKLDEIEQQGNNMSVFCFN

SEQ ID NO: 91729 - protein, 618 aa, Glycine max
  Coding DNA Sequence Number=SeqID_44
  Gene Ontology: Mol. function=metal ion binding; Biological process =defense response to fungus
  Homolog annotation: Hit_ID=A7P0H2; Match level="QueryCoverage=75%, HitCoverage=38%, E-value=1e-103, Identity=43%"; Hit description =Chromosome chr19 scaffold_4, whole genome shotgun sequence
  Pfam annotation: Domain name=PHD; Domain location=49-106; Score=11.3; E_value=0.00063; Accession=PF00628.20; Description=PHD-finger
MVLEKLNSQKLLDKEVNDLAQPGLTVVGIDSDMIDESNEESEERDDLDVCALCDNGGNVTCCDGVCMRSFHATVEAGRENSCVSLGFTQKEVDEIQSFYCKNCEYYQHQCFACGKLGSSDKVKGAEVIKCVSATCDRFYHPHCVAKLLPQLAKPVAEDLERNIADRALSKVISSQMFAKRVDSQIAFIREIAPSNRGNKNIIQRAWEGLLPNNRILIYCLNHKIDRELGTPVRDHIKFPNMEPTVQKINTTIEQKEPATKERVILKKKNVDLDNSSGKSIAKGSKLTGKLSSHKVGSKKTKKIISGSNISRKPKSKETSRCLTENKRSISKKSEMSDSEQNYNQPTIGEIYALQKEGLKRIKHDNKVNNVITNPLSVKPIESLSVELPPLDADSEKSLLTLFKEARSSITLESVLEKHTFASTHTHPLRNVVEKTITMGKLEYSVNAVQTALRKLESGCSIQDVKAFCDPDDLKQLFKWKDELKIYLAPVLYGNRYTSYGRHFTLVEKLEGLLYPPSSLNHIIDLGLPLSMHHRFLGEADIMDRRNNDDPADAGNEGGFYTVESTVMVAQWFSGSDDVLLGIMHTLHFVFKKIVLIVEARLIVDSDKEKVPAILALIR

SEQ ID NO: 91730 - protein, 78 aa, Glycine max
  Coding DNA Sequence Number=SeqID_45
  Subcellular localization annotation: CTP_CleavageSite=70; ConfidenceScore=5.29e-01
MPVIFVTVAFAKLLVMVQHYSLSCGSMMNQDPNSCWSVRKRMLLLVKTSNMIPNSNFSQVPRQVLQECIVEEQGWICC

SEQ ID NO: 91731 - protein, 322 aa, Glycine max
  Coding DNA Sequence Number=SeqID_46
  Gene Ontology: Mol. function=protein binding; Cellular component =nucleus; Biological process=abscisic acid mediated signaling
  Homolog annotation: Hit_ID=A7P0G6; Match level="QueryCoverage=97%, HitCoverage=98%, E-value=1e-138, Identity=76%"; Hit description =Chromosome chr19 scaffold_4, whole genome shotgun sequence
  Pfam annotation: Domain name=Pirin; Domain location=30-147; Score =171.0; E_value=3.1e-48; Accession=PF02678.7; Description=Pirin
  Pfam annotation: Domain name=Pirin_C; Domain location=200-305; Score =160.6; E_value=4.3e-45; Accession=PF05726.4; Description=Pirin C -terminal region
  Pfam module annotation: Pfam domain module=Pirin::Pirin_C; Domain location=30-147::200-305
MPDQDICSYINEPRLVARKFLARPQHEGVGAVVRRSIGRFELKYFDPFIVLDEFSVTAPAGFPDHPHRGFETVTYMLQLSQCKYQLNMVLICVLVVWQHGAITHEDFEGHKGTIEAGDLQWMTAGRGIVHSEMPAAQGTQKGLQLWINLASKHKMIEPRYQEMLSKDIAETMIDGIKVRVIAGEALGIKSPIYTRTPTMYLDFTLKPGAHLQQIIPKSWNAFVYILEGEGVFGNQKSQPVTSHHILLLGSGDGLEAWNKSSKVLRFILVGGEPLGESVVQFGPFVMNTQEEIDQTIDDFENYTNGFEKARHWRSESAISLDY

SEQ ID NO: 91732 - protein, 146 aa, Glycine max
  Coding DNA Sequence Number=SeqID_47
  Gene Ontology: Mol. function=nucleic acid binding; Cellular component= intracellular; Biological process=regulation of transcription
  Homolog annotation: Hit_ID=A5ATM6; Match level="QueryCoverage=71%, HitCoverage=43%, E-value=9e-20, Identity=44%"; Hit description =Putative uncharacterized protein
MAELSVGDPSRKIVEMIFQKAWFNTSKPMKKVRTVLRYKEYVKKVASEQNPRHPRSTVDGNELLRLYGTTMICFQGKSSKKVHDLCKDPSCYLCQIIQFNFNTRYAEIHLNTSDKELRKRTTATARVHKREKSSNNLQDNCWNCSK

SEQ ID NO: 91733 - protein, 407 aa, Glycine max
  Coding DNA Sequence Number=SeqID_48
  Gene Ontology: Mol. function=magnesium ion binding; Cellular component=integral to membrane; Biological process=transport
  Homolog annotation: Hit_ID=A7P0E1; Match level="QueryCoverage=98%, HitCoverage=62%, E-value=1e-170, Identity=75%"; Hit description =Chromosome chr19 scaffold_4, whole genome shotgun sequence
  Pfam annotation: Domain name=CBS; Domain location=173-272; Score =61.1; E_value=3.8e-15; Accession=PF00571.19; Description=CBS domain
  Pfam annotation: Domain name=CorC_HlyC; Domain location=293-400; Score=45.2; E_value=2.2e-10; Accession=PF03471.8; Description =Transporter associated domain
  Pfam annotation: Domain name=DUF21; Domain location=3-154; Score =88.2; E_value=2.7e-23; Accession=PF01595.11; Description=Domain of unknown function DUF21
  Pfam module annotation: Pfam domain module=CBS::CorC_HlyC::DUF21; Domain location=173-272::293-400::3-154
MCKVRELAEKESENGVFRLLRSDVTRFLTTILIGTTVVNIGATALVTEAATAMFGEAGVSAATGVMTVAILLLTEITPKSIAVHNATEVARFVVRPVAWLSLVLYPVGRIVTYLSMGMLKLLGLKGRSEPYVTEDELKLMLRGAELSGAIEEEEQDMIENVLEIKDTHVREVMTPLVDVVAIDASSSLVDFHHLWVTHQYSRYFEDFQGELLESTTVGDMAHKPAYFVPDSMSVWNLLREFRIRKVHMAVVLNEYGGTVGIVTLEDVVEEIVGEIFDENDSKEEIQKKTGYIVMRAEGVFDVDANTSIDQLSEDLNIKMPEGHQYETVSGFVCEAFGYIPRTGECIKVVLEREDEDDNNESNADQQDQKEKNQSFKLEYYFSSYTKDVNAIFFKKLDQQVCALISGF

SEQ ID NO: 91734 - protein, 60 aa, Glycine max
  Coding DNA Sequence Number=SeqID_49
MKSVCAEKGSAVKKEFLGKMVTCISATNVMPECVQPDVAEVLCLRLAIIKQIARNCMHEA

SEQ ID NO: 91735 - protein, 385 aa, Glycine max
  Coding DNA Sequence Number=SeqID_50
  Homolog annotation: Hit_ID=Q9FJ58; Match level="QueryCoverage=100%, HitCoverage=92%, E-value=1e-107, Identity=52%"; Hit description =Arabidopsis thaliana genomic DNA, chromosome 5, P1 clone:MTE17
  Pfam annotation: Domain name=C2; Domain location=50-137; Score=44.1; E_value=5.1e-10; Accession=PF00168.21; Description=C2 domain
MESPQSVVSPFKRSVLGDAEKYRSDVLSKDIEVNGKEGAVCNVEEFIGVVDVYIHQARDIHNICIYHKQDVYAKICLTSNPENTVSTKTINGGGRNPVFNENLSLSVRTVDSVVKCEIWMLSRVKNYLEDQLLGFALVPLSEVLVKKDGKLEKEFSLSSTDLFHSPAGYVQLSLAYTGASPDVMAISSMPTTEKDSESCESLVRDLDKIEFPDPKIVNEDHLMVSEYFGIPCEESQCSDSLTTTDTENLSSEAGVQLVESFSACSVSSVSTNGVSSPSVAASSDSSPNEETKEKNVDVKDGETDSSFPKPLVTVNIEPEPNVVQQDFVDMYMKSMQQFTESLAKMKLPVDFESGPTSSGNSSSEHKLQTPKSTNSRVFYGSRAFF

SEQ ID NO: 91736 - protein, 184 aa, Glycine max
  Coding DNA Sequence Number=SeqID_51
MLKIPAYEKGVTESPPLVSFDSKESAFKKRFMNAVINMNLRNASPRHNNNVHHDAIARNKEVESEPGSEEEREPSLAGTEEPLLQADANNPPSKPTCIPVEVVNETEEEIESGKSKRRKNGRFEEGVVEETGQAMKENGFEQNGSGKRREVKEGIPWEDGNVVSKSGVVLTEKTKVEIRKRDKR

SEQ ID NO: 91737 - protein, 224 aa, Glycine max
  Coding DNA Sequence Number=SeqID_52
  Gene Ontology: Mol. function=DNA topoisomerase (ATP-hydrolyzing) activity; Cellular component=chromosome; Biological process=DNA topological change
  Homolog annotation: Hit_ID=A7Q967; Match level="QueryCoverage=43%, HitCoverage=27%, E-value=2e-38, Identity=78%"; Hit description =Chromosome chr19 scaffold_66, whole genome shotgun sequence
MAYDTKHLRVPEIQWLGAFPSDSERYFVPNQCLLPLTAEDKRKVEAMLLRCYLEREVPQWRLELQLILQRGVKFEIEALSVHALSFLSESYIPSKIEVSGGMGSFGMAGSKWVFSLGLLLPAFFSVAACILYQVKHTLCKREDSEFKSQFGLNEKCPITQLVKLNNPRVTRETTPEFPFIICLKATVFPKGGHQMKEWEGPTHAPFLLILSSTFSAQVQTCSIL

SEQ ID NO: 91738 - protein, 255 aa, Glycine max
  Coding DNA Sequence Number=SeqID_53
  Gene Ontology: Mol. function=unfolded protein binding; Cellular component=mitochondrial inner membrane; Biological process =intracellular protein transport across a membrane
  Homolog annotation: Hit_ID=A7Q313; Match level="QueryCoverage=89%, HitCoverage=62%, E-value=2e-97, Identity=73%"; Hit description =Chromosome chr12 scaffold_47, whole genome shotgun sequence
  Pfam annotation: Domain name=NIF; Domain location=61-223; Score=79.3; E_value=1.2e-20; Accession=PF03031.9; Description=NLI interacting factor-like phosphatase
MDENVGCKHVSCHQLWRHADSFACDTPVPAKAVELYLDARRVIEEQVKSYTEPYTDKLLPDLLPQEQHVFTLVLDLNETLIHYIWTRDTGWQTFKRPGVDAFLEHLAQFYEIVVYTDEQNMFVDPVIERLDTKHCIRYRLSRPATKYQDGKHFRDLSKLNRNPGKVLYLSGHALESCLQPENCLPIKAWQQQDIDDTALLDFIPFLEFVARSSPPDIRPVLASYQGCDIPSEFIRRSKEHQRRMQEQKNRGRFWK

SEQ ID NO: 91739 - protein, 224 aa, Glycine max
  Coding DNA Sequence Number=SeqID_54
  Gene Ontology: Mol. function=protein serine/threonine kinase activity; Biological process=protein amino acid phosphorylation
  Homolog annotation: Hit_ID=Q9FHG4; Match level="QueryCoverage=37%, HitCoverage=12%, E-value=3e-17, Identity=58%"; Hit description =Serine/threonine-specific kinase like protein
  Pfam annotation: Domain name=Lectin_legB; Domain location=9-138; Score=-120.1; E_value=0.031; Accession=PF00139.10; Description =Legume lectin domain
METIMGGDGSSSSSVNVYCDHPAACFNQKECHNSLTVQTGTYFLVFPGEGSSGDGLAFFLFLSLSFVAVEFDARLDLKSGNTITAWIDYNTEHTLLNVFLSYSRTSSSKSKPLEPPTFTKSKHGLHSEGKVIEAADKRLNGEFEEEEMRLSCVANPDSAERPSMRRVLQILNNVAAPLVVLKVKPTLTFSSDLPLLLTIEDIVSEADEEEFGTSSQSMCEIKIH

SEQ ID NO: 91740 - protein, 726 aa, Glycine max
  Coding DNA Sequence Number=SeqID_55
  Gene Ontology: Mol. function=unfolded protein binding; Cellular component=cytoplasm; Biological process=response to stress
  Homolog annotation: Hit_ID=P55737; Match level="QueryCoverage=99%, HitCoverage=99%, E-value=0.0, Identity=75%"; Hit description=Heat shock protein 81-2
  Pfam annotation: Domain name=HATPase_c; Domain location=77-206; Score= 39.1; E_value=1.6e-08; Accession=PF02518.17; Description=Histidine kinase-, DNA gyrase B-, and HSP90-like ATPase
  Pfam annotation: Domain name=HSP90; Domain location=209-726; Score =1312.0; E_value=0; Accession=PF00183.9; Description=Hsp90 protein
  Pfam module annotation: Pfam domain module=HATPase_c::HSP90; Domain location=77-206::209-726
MASETETFAFQAEINQLLSLIINTFYSNKEIFLRELISNASDPHKFRHDTKYWSIYYSLFLRCPCLALDKIRFESLTDKSKLDAQPELFIHIIPDKTNNTLSIIDSGIGMTKADLVNNLGTIARSGTKEFMEALAAGADVSMIGQFGVGFYSAYLVADKVIVTTKHNDDEQYVWESHAGGSFTVTRDTSGENLGRGTKITLFLKEDQLEYLEERRLKDLIKKHSEFISYPISLWIEKTTEKEISDDEDEEEKKDEEGKVEDVDEDKEKEEKKKKTIKEVSHEWSLVNKQKPIWMRKPEEITKEEYAAFYKSLTNDWEEHLAVKHFSVEGQLEFKAVLFIPKRAPFDLFDTKKKPNNIKLYVRRVFIMDNCEELMPEYLSFVKGIVDSEDLPLNISREMLQQNKILKVIRKNLVKKCIEMFFEIAENKEDYNKFYEAFSKNLKLGIHEDSQNKTKLAELLRYHSTKSGDEMTSLKDYVTRMKEGQNDIYYITGESKKAVENSPFLEKLKKKGFEVLYMVDAIDEYAVGQLKEFEGKKLVSATKEGLKLDESEDEKKKKEELKEKFEGLCHVIKDVLGDKVEKVVVSDRVVDSPCCLVTGEYGWTANMERIMKAQALRDSSMAGYMSSKKTMEINPENPIMDELRKRADADKNDKSVKDLVLLLFETALLTSGFSLDDPNTFGNRIHRMLKLGLSIDEDAGEADADMPPLEDADADADAEGSKMEEVD

SEQ ID NO: 91741 - protein, 649 aa, Glycine max
  Coding DNA Sequence Number=SeqID_56
  Gene Ontology: Mol. function=signal transducer activity; Cellular component=membrane; Biological process=protein modification process
  Homolog annotation: Hit_ID=A7Q9A6; Match level="QueryCoverage=100%, HitCoverage=98%, E-value=1e-143, Identity=48%"; Hit description =Chromosome chr19 scaffold_66, whole genome shotgun sequence
  Pfam annotation: Domain name=DUF827; Domain location=26-549; Score =394.3; E_value=1.8e-115; Accession=PF05701.2; Description=Plant protein of unknown function (DUF827)
MVAKIRQSAANSPNPTKPVVGEIDTSPPFQSVKDAVSLFGEGAFSGETPPNAPIKKAKSYFAESVWAKERQLHLAQKDLKKLKEQLKNAETTKAQVLVELEKAKRVVEDLSQKLKVLSESRESAIQATEASKSQAKQLKEEKCGDPDGTNHAWKEELETAVNNFASVITELDVAKQELSKIRQGYDLSLEARVSALKQTAEAEDAMKANMERACEVSKEILVVQESVEKMNAESVQAHQLQEETLAGQKVLRQSYEAILEESKKKLLDLKKEFNPELIKNLEVQLTETMIEIGVLQKQIENKKTSDLDSLRSVTQDLGDAKESLQRVTGQEDTLRSMVEALGMELENVKREHSELKEKESKTESIVENLQVELWKSEFELEAYLAGESKARGASEEMILTLKQLFSETENARREIEDMKNETAELKMEAAVTKLVLEDAETKLRVAVEEVEAANAAEASALDQIKVLSMRTSPSHSSPSEPGARITISREEFESLVHKVEESDKLADIKVAAATAQVEAAKASENEVLKRLEETQKEIEDMKSETQAALKRAEMAEAAKRAVEGELRKWREREQKKAAEAASQILAETLISPELSPQHYRIQIQNSPPNRVEMKKLEKGKVSVSKKVLLHNISGIFHRKRNHVEGESSS

SEQ ID NO: 91742 - protein, 90 aa, Glycine max
  Coding DNA Sequence Number=SeqID_57
MRAVSRPGYPGQLPRLWPKFISENTTSSGERERERESMDLRTKGFEGSEIPEMEPRLLQHGGLVTGRGGSILDLEDQAVVGVGHDLSLAL

SEQ ID NO: 91743 - protein, 108 aa, Glycine max
  Coding DNA Sequence Number=SeqID_58
MMLTLMQNFETIAFKAEDAELDEGGEGENGAGEVEVFEDEAGDAVVVVVAEVGDAVSGLIVGFLVVSGAFWFEANEVVGTKILVWLWFYGIESMAVLGLANGTVLFVI

SEQ ID NO: 91744 - protein, 638 aa, Glycine max
  Coding DNA Sequence Number=SeqID_59
  Gene Ontology: Mol. function=binding; Cellular component=cytosol
  Homolog annotation: Hit_ID=A7NZQ7; Match level="QueryCoverage=99%, HitCoverage=96%, E-value=0.0, Identity=66%"; Hit description =Chromosome chr6 scaffold_3, whole genome shotgun sequence
  Pfam annotation: Domain name=Arm; Domain location=342-380; Score=4.8; E_value=2.7; Accession=PF00514.14; Description=Armadillobeta-catenin -like repeat
  Pfam annotation: Domain name=Arm; Domain location=383-423; Score =25.9; E_value=0.00015; Accession=PF00514.14; Description =Armadillobeta-catenin-like repeat
  Pfam annotation: Domain name=Arm; Domain location=425-465; Score =31.9; E_value=2.3e-06; Accession=PF00514.14; Description =Armadillobeta-catenin-like repeat
  Pfam annotation: Domain name=Arm; Domain location=468-508; Score=4.0; E_value=3.4; Accession=PF00514.14; Description=Armadillobeta-catenin -like repeat
  Pfam annotation: Domain name=Arm; Domain location=85-125; Score=20.5; E_value=0.0063; Accession=PF00514.14; Description=Armadillobeta -catenin-like repeat
  Pfam annotation: Domain name=HEAT; Domain location=217-254; Score =1.7; E_value=15; Accession=PF02985.13; Description=HEAT repeat
  Pfam annotation: Domain name=HEAT; Domain location=345-382; Score =25.1; E_value=0.00025; Accession=PF02985.13; Description=HEAT repeat
  Pfam annotation: Domain name=HEAT; Domain location=389-425; Score =15.0; E_value=0.16; Accession=PF02985.13; Description=HEAT repeat
  Pfam annotation: Domain name=HEAT; Domain location=436-467; Score =1.3; E_value=17; Accession=PF02985.13; Description=HEAT repeat
  Pfam annotation: Domain name=HEAT; Domain location=474-510; Score =14.7; E_value=0.17; Accession=PF02985.13; Description=HEAT repeat
  Pfam annotation: Domain name=HEAT; Domain location=91-127; Score =11.9; E_value=0.45; Accession=PF02985.13; Description=HEAT repeat
  Pfam module annotation: Pfam domain module=Arm::Arm::Arm::Arm::Arm::HE AT::HEAT::HEAT::HEAT::HEAT::HEAT; Domain location=342-380::383 -423::425-465::468-508::85-125::217-254::345-382::389-425::436 -467::474-510::91-127
MPATPPSSDLILHRLTSSDCEIKLKAIREVKNQIIGNRTKKLSYIKLGAVPALAAALAQADADSASGSTLIVQSAAALGSFACGVDAGVRAVLDAGAFPHLIRLLSAADDKVVDAAARSLRMIYQSNLAPKYDFFKEQDMQFLLSLLKSGNENLTGLGASIVIHSCEKRDEQNMLCCAGALETLISLLDGSLSQRDSSLESLAAILKNNPEVVYKFVDLQNGRVLSSVIELTKDRYSRTRLLACLCLICVKNSSSCYLQDIGIKAKLIHILLELLDESGQVGDSASFAFSSLVAEKEDLQKLAFEANAIDKFNSHLQNCALHPKRLEGIFLALADLCSKLECCRSKFLSLQVLNILVDSLTHDDANVRTAACICLKSVSRSIKNLSAGYFMNERIIAPLVRLLSDLSTSVQVAALGAISNIVIDFTPQKSTFMECGGVKELIQLTKSMDSSLRLNAVLALRNMVFLADKMCKEGIFKELTVSSVASLICDPEPSVQEQALALVCNFVDGCIDCVEYAFAEDGIILDAVARQLKKSSKIEIGIQGMYLLSNIASGNESHREAIMQLLFSKAENVSHSFFYQFLQSNDSCLRTSAVWVIVNLTFPASPGVFGRVVKLRNVGIVSQIKKMVNDPCMDVKVF

SEQ ID NO: 91745 - protein, 325 aa, Glycine max
  Coding DNA Sequence Number=SeqID_60
  Gene Ontology: Mol. function=phosphotransferase activity, alcohol group as acceptor; Cellular component=cytoplasm; Biological process =metabolic process
  Homolog annotation: Hit_ID=A7QQE3; Match level="QueryCoverage=94%, HitCoverage=56%, E-value=1e-103, Identity=64%"; Hit description =Chromosome undetermined scaffold_142, whole genome shotgun sequence
  Pfam annotation: Domain name=PRK; Domain location=49-274; Score =105.4; E_value=1.8e-28; Accession=PF00485.9; Description =Phosphoribulokinase  Uridine kinase family
MGTKSAVDLMESLSEVHFSGFHIDGLEQRKAGTEQPTTSTTDMYKQPFVIGVAGGAASGKTSVCDMIVQQLHDQRVVLVNQNKFITLNEYQLHLSYSQNAQEYQGVNEIPELEILAFSLEMSMVGETTANFTCQSVTQIVLYAYEHSKEAFDTEQLLRVMDKLKRGQAVDIPNYDFKGYKNDVFPARRVNPADVIILEGILVFHDPRVRALMNMKIFVDTDADVRLARRIKRDTADNARDIGAVLDQPAFDDFILPTKKYADIIIPRGRDNHVAIDLIVQHIRTKLGQHDMCKIYRNLYVIQSTFQLNHHDNCFDVDTGYAYPDT

SEQ ID NO: 91746 - protein, 146 aa, Glycine max
  Coding DNA Sequence Number=SeqID_61
  Gene Ontology: Mol. function=transferase activity, transferring glycosyl groups; Cellular component=integral to membrane; Biological process=cell wall organization and biogenesis
  Homolog annotation: Hit_ID=Q9LSG3; Match level="QueryCoverage=89%, HitCoverage=27%, E-value=9e-22, Identity=46%"; Hit description =Glycosyltransferase QUASIMODO1
MKLDSNGGVESIRRSIIALKTDPLKPRLEQIRKQADDHGSLARVCFLCTQAQAGELKACKDFRGAMWQLGGSYEQTSIQASFQQSVLRQVVGDAKESFDNQLKTQKLKDTIFAVNEQLTKAKKQGANSKELALSLHEVDGREDCPS

SEQ ID NO: 91747 - protein, 424 aa, Glycine max
  Coding DNA Sequence Number=SeqID_62
  Gene Ontology: Mol. function=phosphopyruvate hydratase activity; Cellular component=phosphopyruvate hydratase complex; Biological process=glycolysis
  Homolog annotation: Hit_ID=Q9ZW34; Match level="QueryCoverage=99%, HitCoverage=95%, E-value=0.0, Identity=73%"; Hit description=Enolase
  Pfam annotation: Domain name=Enolase_C; Domain location=188-424; Score=334.1; E_value=2.5e-97; Accession=PF00113.13; Description =Enolase, C-terminal TIM barrel domain
  Pfam annotation: Domain name=Enolase_N; Domain location=46-180; Score= 214.2; E_value=3.2e-61; Accession=PF03952.7; Description=Enolase, N -terminal domain
  Pfam module annotation: Pfam domain module=Enolase_C::Enolase_N; Domain location=188-424::46-180
MSVQDYLDKHMLSRKLEDAVNAAVRAKTSDPVLFISNHMRKAVQSVITKIKARQILDSRGIPTVEVDLHTNKGVFRASVPSGNSTSMYEAVELRDGDKGVYLGNGVAKAVKNINDKISEALIGMDPTLQSQIDQAMIDLDKTEKKGELGANAILAVSIAACKAGAAEKEAWLFVPLYKHIADLSGKTSPTLPVPAFTVISGGKHAGSNLAIQEIMILPIGASKFEEALRMGTETYHHLKEAISRAGYDEKIKIALDVAATDFCIGKRYDLDFQSPQKSGQNFKSAEDMIDLYKELCSEYPIVSIEDPFDKEDWEHIKHISSLGICQVVGDDLLMSNAKRIERAITESACNALLLKVNQVGTITEVIEVVKLAKEAHWGVVTSHRCGETIDSFIADLSVGLASGVIKAGAPCRGERLEKYNQVSF

SEQ ID NO: 91748 - protein, 467 aa, Glycine max
  Coding DNA Sequence Number=SeqID_63
  Gene Ontology: Mol. function=transcription factor activity; Cellular component=nucleus; Biological process=regulation of transcription, DNA-dependent
  Homolog annotation: Hit_ID=Q9FKH1; Match level="QueryCoverage=88%, HitCoverage=92%, E-value=2e-82, Identity=42%"; Hit description =Transcriptional regulator STERILE APETALA
  Pfam annotation: Domain name=WD40; Domain location=143-179; Score =15.5; E_value=0.2; Accession=PF00400.23; Description=WD domain, G -beta repeat
  Pfam annotation: Domain name=WD40; Domain location=425-461; Score =2.6; E_value=15; Accession=PF00400.23; Description=WD domain, G-beta repeat
  Pfam module annotation: Pfam domain module=WD40::WD40; Domain location=143-179::425-461
  Subcellular localization annotation: CTP_CleavageSite=43; ConfidenceScore=5.77e-01
MSSTSSSSSSSSSSTSSSTPYDAVAPDIPGPSTRRTGGSGQFEASSSSQRQRAMNEVLPEPLLEALATQLALDAANYNGRLSAASALAILFQVSRSDLLWQRLTRRIWRRTYQLRATWQLEYMYWHRTARNFSTGRHRFFDQAVFDPSDHHHHLLCRCLALSDTHLACGFVDGSVRLFDLETRAHVTTFLSLHGHLFGPFSRSVSGIVIINSSITFARLDGDIYVDNVDGPGPIQARRAVEGDVVNNGVLVGFAGTGRWWVGLYAGIAGRAFQIWDARSEERVFVGGSLTDPETVMGWHMLTELVEAVGRVRVTEREYVVACTASRMVCFSFRNPEVLLRDVGSTMGFVVSSLDASQEAYVVLERNGVGTVRRASTYERLSRFRLNRLWVRGLWACMNLGYVLTYSPAPSPSPSLRVWDIEQAIGRLCVTLGVRAGYVNSLVANDRHVSISSNDNNINLLDFGVQDP

SEQ ID NO: 91749 - protein, 505 aa, Glycine max
  Coding DNA Sequence Number=SeqID_64
  Gene Ontology: Mol. function=heat shock protein binding; Cellular component=cytoplasm; Biological process=protein folding
  Homolog annotation: Hit_ID=A7Q327; Match level="QueryCoverage=96%, HitCoverage=68%, E-value=1e-161, Identity=59%"; Hit description =Chromosome chr12 scaffold_47, whole genome shotgun sequence
  Pfam annotation: Domain name=DnaJ; Domain location=66-127; Score =97.2; E_value=5.3e-26; Accession=PF00226.22; Description=DnaJ domain
MEANKEEALKAIEIAEKRFALRDFAGAKNYAVKAKTLCPGLEGISQMVATFEVYVASEVKHNGDLDYYSILGLKPFADKEAVKKQYKKLAVLLHPDKNKCVGADEAFKLVSEAWTWLSDSAMRSSYDLKRNVQLGGANQTNLSPAHATGTAGYTKCSNLPTPCGRLDTFWTICTSCKVQYEYLRKYVNKRLSCKNCRGTFVAVETGAAPANGSFPYCPWSYVAGNGYGSHSFDGVTYVPTSAPYFNGNGVTGYHSGHGYEYVPNVSFQWGSAGVVNQNGSTTLPADSVHRANGNVKRGRPKVKLGADKRHHVIETMVNTNSDVPFSCSEPQEDKLSRPDKKQKVVVGASFRNGYEEKGSKCASELIVANGNDSMGHGQKPSCTVEVQTKQCSMAPAFDARKLLIEKARKEIRKKLEEMKLSSAAAAAAALNEKEKSQAEVGKVKRETCRKAAPNVSGLQLENGKTGPVSITVPDSDFHDFDKDRSEECFRPKQIWALYDEEDGMP

SEQ ID NO: 91750 - protein, 95 aa, Glycine max
  Coding DNA Sequence Number=SeqID_65
  Gene Ontology: Mol. function=nucleic acid binding; Cellular component= cytoplasm; Biological process=mRNA metabolic process
  Homolog annotation: Hit_ID=A5BR81; Match level="QueryCoverage=97%, HitCoverage=14%, E-value=2e-28, Identity=69%"; Hit description =Putative uncharacterized protein
  Pfam annotation: Domain name=RRM_1; Domain location=30-92; Score =40.5; E_value=6.1e-09; Accession=PF00076.13; Description=RNA recognition motif. (a.k.a. RRM, RB
MAQVQVPPQNAVPDPNGGGAAGNQFVTTSLYVGDLDPNIMDAQLYDLFNQLEQVISVRVCRDLTTRRSLGYGYVNFSNPQDAVVLLSCYIFIRLP

SEQ ID NO: 91751 - protein, 206 aa, Glycine max
  Coding DNA Sequence Number=SeqID_66
  Subcellular localization annotation: CTP_CleavageSite=63; ConfidenceScore=5.56e-01
MQKTLGKAKALFFHPATRLSPGNLADSHSSISLYVRFLISVKKPTNTSTGNHPSLLSSVPPARNSSSKSSVAIDLEEEEEEEEKEERIRRDIARIVKEKDLKSLDDLGGVDSVSAVLCRQHQHSKKGTIDDDNTTIPLPAIGTNLSKFLFNSCKFYRCTILVLLISAGLSFAIEFKQEEPKHGWHVGVAIVFAVLLLVAGNSVANF

SEQ ID NO: 91752 - protein, 508 aa, Glycine max
  Coding DNA Sequence Number=SeqID_67
  Gene Ontology: Mol. function=transferase activity, transferring phosphorus-containing groups; Cellular component=membrane; Biological process=two-component signal transduction system (phosphorelay)
  Homolog annotation: Hit_ID=A5B1L1; Match level="QueryCoverage=97%, HitCoverage=35%, E-value=1e-164, Identity=61%"; Hit description =Putative uncharacterized protein
  Pfam annotation: Domain name=HATPase_c; Domain location=17-150; Score= 75.6; E_value=1.6e-19; Accession=PF02518.17; Description=Histidine kinase-, DNA gyrase B-, and HSP90-like ATPase
  Pfam annotation: Domain name=Response_reg; Domain location=323-458; Score=102.5; E_value=1.3e-27; Accession=PF00072.15; Description =Response regulator receiver domain
  Pfam module annotation: Pfam domain module=HATPase_c::Response_reg; Domain location=17-150::323-458
FTHDKGHVFVSVHLASEVKNPLHIMDAVLREGLNLSQDITNRTYDTLSGFPVCNRWKSWANFTKLSGTNEPEIIQLLVIVEDTGIGIPTDAQSRIFTPFMQADSSTSRTYGGTGIGLSISRCLVDLMGGEIGFVSEPGIGSTFSFTGTFRKGESTSLDAMRQNNHFGSEFQELRTLVVDRRKIRAEVTKYHLQRLGMSVDVTYSLNSACSCLSNVCNMSMLAMILIDKDAWDKEYHILYTIKKRRQNGIKGDPLNLPKIFLLATHLSSNEQDELKSVGVIDDILMKPLWFSSLIQCYRESLGTENKRVNRKKVSKLGNLLIDKQILVVDDNAVNRRVAKGVLQKYGAKVTAVESGRAALKMLELPHNFDACFMDLQMPEMDGFEATRKIRCLESEVNEKIACGQASAEMFGNISYWHIPILAMTADSTQSSNEECIKCGMNDYVSKPFEEEQLYMAMARFFKHPAHKCGLTSNIVMVGHAPADVFLIETACQHQSYQFSIMDLTYGLV

SEQ ID NO: 91753 - protein, 112 aa, Glycine max
  Coding DNA Sequence Number=SeqID_68
MSSKLVGQAEIEMISTPSAIASLNAARASTSGQPILIQHALYIGRRADGTHPPRAVPEANPSRLADLTKFPAIVDAVCDPWPSASLGDIISSLELAPSILKYLAPIILLHNS

SEQ ID NO: 91754 - protein, 659 aa, Glycine max
  Coding DNA Sequence Number=SeqID_69
  Gene Ontology: Mol. function=actin binding; Cellular component =cytoskeleton; Biological process=negative regulation of actin filament depolymerization
  Homolog annotation: Hit_ID=Q9FKI0; Match level="QueryCoverage=97%, HitCoverage=95%, E-value=0.0, Identity=74%"; Hit description=Fimbrin- like protein 2
  Pfam annotation: Domain name=CH; Domain location=123-247; Score=56.0; E_value=1.3e-13; Accession=PF00307.22; Description=Calponin homology (CH) domain
  Pfam annotation: Domain name=CH; Domain location=265-367; Score =104.8; E_value=2.6e-28; Accession=PF00307.22; Description=Calponin homology (CH) domain
  Pfam annotation: Domain name=CH; Domain location=391-495; Score=51.8; E_value=2.3e-12; Accession=PF00307.22; Description=Calponin homology (CH) domain
  Pfam annotation: Domain name=CH; Domain location=499-606; Score=78.9; E_value=1.6e-20; Accession=PF00307.22; Description=Calponin homology (CH) domain
  Pfam module annotation: Pfam domain module=CH::CH::CH::CH; Domain location=123-247::265-367::391-495::499-606
  Subcellular localization annotation: CTP_CleavageSite=27; ConfidenceScore=5.12e-01
MSSFVGVLVSDQWLQSQFTQVELRTLKSKYVSERTQSGRVTVGNLPPIFKKLKAFSELFTEDEIKDALAESYQNMDEEIDFESFLRAHLNLQSRAIAKDGGSKSSSSFLKAATTTVHHAINESEKASYVAHINNYLAEDKFMSQFLPIDPSTNALFDLAKDGVLLCKLINIAVPGTIDERAINTKRVLNPWERNENHTLGLNSAKAIGCTVVNIGTQDLIEGRVAPSGTWFDFASNQADLNLKKTPQLVELVEDDKDVEELISLAPDKLLLKWMNFHLKKAGYEKQVTNFSSDLKDGEAYAYLLNALAPEVAGPSALNTSDPTERANMVLEQAERLDCKRYLTPKDIVEGSPNLNLAFVAQIFQHRNGLTTVDSQKMSFAEMMTDDAETSREERCFRLWINSLGISTYVNNVFEDVRNGWVLLEVLDKVSAGSVNWKLATKPPIKMPFRKVENCNQVIKIGKELNFSLVNVAAFLWQLMRFTMLQLLRNLRSHSQGKEITDADILNWANNKVKRAGRTSQMDSFKDKNLSSGIFFLELLSAVEPRVVNWSLVTKGETGEDKKLNATYIISVARKLGCSIFLLPEDIIEVNQKMILILAASIMYWSLKKPEENITPEASPKASVDGESETDLVDEVSHLAIDEVSNLAIDETTSENASSS

SEQ ID NO: 91755 - protein, 370 aa, Glycine max
  Coding DNA Sequence Number=SeqID_70
  Gene Ontology: Mol. function=binding; Cellular component=cytoplasm; Biological process=positive regulation of multicellular organism growth
  Homolog annotation: Hit_ID=A7R1X7; Match level="QueryCoverage=96%, HitCoverage=99%, E-value=1e-101, Identity=54%"; Hit description =Chromosome undetermined scaffold_383, whole genome shotgun sequence
  Pfam annotation: Domain name=Mo25; Domain location=2-355; Score =239.5; E_value=7.2e-69; Accession=PF08569.2; Description=Mo25 protein family
MKKALFKPKPKTPVELVRHARELIIFLDSNACTRESKREEKLSDLSKMILEIRTVLYGNGESEPNADACSQITREFFKDDTFRLFILYLSNLKLGARQDATHVIANLQRQRVNSQLIASQYLEKNLDLVDMLIGGSSVLDKWLMKVYLISYEKEGDIALTYGAVARECIRHQSVARHVLESEHMKKFFDYIQLPNFEIASDAVATFKELLTRHKSTVAEFLSKNYDWILSAKRFYCGCQFFKEYNSQLLESTSYFTRRYAIKRCILNTALRRTVLIIVIKYVTVIGGYAIGSLECCGNGPLFVANQNKPPEVVSILVTNKHKLLQFLDNFNNDKADEHFQADKQQVISEIITLEHKDRPCTALDNCEVPC

SEQ ID NO: 91756 - protein, 1176 aa, Glycine max
  Coding DNA Sequence Number=SeqID_71
  Homolog annotation: Hit_ID=A7Q2V1; Match level="QueryCoverage=75%, HitCoverage=99%, E-value=0.0, Identity=76%"; Hit description =Chromosome chr12 scaffold_47, whole genome shotgun sequence
  Subcellular localization annotation: CTP_CleavageSite=51; ConfidenceScore=5.47e-01
MDQAGLVRFPSFSFFISFTFQFLPTLQGSKPPLDVADKLTDPFPPSPLFSTANTLNSPLLPPFKFHPALLQPRNLAFATGGYGAGPDDSYESMDDANFSDEELSAPNNLDFSDSPTPHNYDEEQLFPCKGRREILKTGLADQSLTIQVPNTVRRFTDGEMGFNKCLQRNLTPAGTAGVQLQKQFHLRNDTLGLGTPSAPPIIDSEFPLERDSECSIRNEPTDPGSWPSRESLDFNDGTKSETSIEQKPKAKTVAEPTVTELAERLDKTFTDDIERHTPHLQYYNTSSCNSQFAWQTLITYDACIRLCLQAWAKGCTEAPEFLKDECLALRSAFGLHEFLLQPRGVKPTEGRNNRNSEQTLPLKTKKVVGKIRVEVKKLRIIPRQKLKITKSQRGSIYMKAGVEYVRHVSSLVKNGINSMKAASFSLAAEEPLHCLIQLKSTTEENESEPCSAILLRPGSGDYHDFFPLSQGDALIVEVQDSKKVVHGEARIPMSSLSDNPSDRIRWWPVYHDERECVGKIQLSIGSTMTSDENNHIKSAAVVETQAYDLLLEGAMRAQNFHSRNLRLNGPWKWLLDAFADYYGVSNSYARLRYLLHVMNVATPTKDCLGLVRELLEPLIKARSERSLTRQERSILSDCETQIESLLATVFENYKSLDENSPTGLTDHFGSGFDSAAPALDPAVQVYTSLHDILSLDAQTILRNYLQTAARKRCRKHMMETDEFVSSTSEGYLMDTITISTAYLKMKNLCVSIRNEIQADIKIHNQHTIHGQHIFPSSIDLTNITAAVYSTELGKRLRAFLSALPPSSPQAHVNELLVATADFERDLESWNISLVQGGVDSRNLFHNYIMVWIQDMQLSLLDLCKAEKVPWAGVTTNHSTSPFAEEMYEKIKDNLTLYEVVINRWPQYSLYLENAVANIERAIVKSLEKQYSDILTPLKDSIQKRLHLQVQKIARRQSATVHLVPNQLGIFLNTIKRILDVLHCRVEDILNSWASCLPVIGDKKTLFGEQMNGITVLLRTKYKTYLQAIIGNLVNSIQANRNTRLKKILEETTETDGEAEVRERMQLLNSQLTDFISNLHEVFTSQIFIAICRGLWDRMGQIILKFLEGRKENRIWYNGSSYALGILDDTFASQMQRLRGNSLQEKDIEPPRSVIEARSILCKDTANATDTSNYLYI

SEQ ID NO: 91757 - protein, 310 aa, Glycine max
  Coding DNA Sequence Number=SeqID_72
  Homolog annotation: Hit_ID=A5BEV8; Match level="QueryCoverage=40%, HitCoverage=16%, E-value=3e-11, Identity=35%"; Hit description =Putative uncharacterized protein
MKTKLVFVTYDDVLNWARVIVYEIGFMTVIMRLDTNTAVWETSGWRIKMDGEGIMIMLQHIEIKASFETSTHVVEYVFKVILYKKLLGMISKYALNQIVAKYERVSYAGIDSSRYGCVMRTIHGLPCACKLARYVVGNIPLGVIHMFWWRLSFPDQRLSRPKVSIVEEMETTSKWFKELDSNIVHHHLSKQFQEGLCRHWINFIHAFHDSIENIVDVKAELAKWSDEYINLLGGICRFEELKRFLLVDGLSMNLEAMEGACDGQMKQRCHIIEGDSHLSYRKMETTSFLMPPFHKSLYKSLIANVQGTCD

SEQ ID NO: 91758 - protein, 222 aa, Glycine max
  Coding DNA Sequence Number=SeqID_73
  Homolog annotation: Hit_ID=Q2HSY1; Match level="QueryCoverage=55%, HitCoverage=83%, E-value=5e-08, Identity=24%"; Hit description =Putative uncharacterized protein
MLGKYPRLYSISEQQHHEVQQMGSAAEGVWEWSFRRRRNLLKSELEMASNFMQVGNIQPKVHMVCQVGRVRWRKTMIRRLPTRKNLRRRNVDLEDDRCLSCLTQQEDASHIFFQCPKVLPMWWECLSWVQIKSFFPADPAHHFLQHPDCHLPGLIQNRWHTLWASLTWCIWYQRNKLGFSGEAFDGQRVLEQALFFCWLWLKNFERNFNIPFHYWSSNIKTG

SEQ ID NO: 91759 - protein, 624 aa, Glycine max
  Coding DNA Sequence Number=SeqID_74
  Gene Ontology: Mol. function=hedgehog receptor activity; Cellular component=integral to membrane; Biological process=cholesterol transport
  Homolog annotation: Hit_ID=A7P8Q4; Match level="QueryCoverage=41%, HitCoverage=20%, E-value=8e-99, Identity=71%"; Hit description =Chromosome chr3 scaffold_8, whole genome shotgun sequence
  Pfam annotation: Domain name=RRM_1; Domain location=323-393; Score =27.2; E_value=6.1e-05; Accession=PF00076.13; Description=RNA recognition motif. (a.k.a. RRM, RB
MEQPVAFTAQREFGLVYMLCSPLGILPQDTALILEDLQHTHLMLGTRHLKREVCRIGQLRIVGVDNMCIIVDAVKRQPSGLPVEEQISNAMGEVGPSITLASLSEILAFAVGSFVSMPACRVFSMIAALAVLLDFLLQITAFVALVTLDFMRAKDNRIDCFPCVKLNPPSAEQNEGIRLERDGLLTRYMKEVHAPFLGLWGVKILVIAVFAAFTLASIALCTRIEAGLEQQIALPRDSYLQGYFSNISEYLRVGPPLYFVVKDYNYSLESKHTNQLCSISHCDSNSLLNEGLLDERERETVRESGGVQRRKTNWRDAFDIHSFFFTRFPEEMNESDLWYEFKKWGDVREVFIARNRNRWGKRYGFVRFKGVKDVTKLERKLDSLVVGGLKMHVNTPKHGRVRATLEEGIRGGREQKGQEEANRKGKHGYEDNHVDMKMKQFQQKKEATSYAKILMTEGRNTAPGRILRRPSLTGGVSHSSVQLNINVEQKTWLRNTWVGRLKNLALFDRMEDNLMCNGGEDVKPKYIGDDMILLMGLTETRATQMAKEANEQRSSLFYSLEKWTPQLRTGYRLVWLLCWGIPLHAWDLEDTRHIMTAVGEVVEVDDEMDELHRLDRARILVKTP

SEQ ID NO: 91760 - protein, 589 aa, Glycine max
  Coding DNA Sequence Number=SeqID_75
  Gene Ontology: Mol. function=guanyl-nucleotide exchange factor activity; Cellular component=plasma membrane; Biological process =embryonic development ending in seed dormancy
  Homolog annotation: Hit_ID=A7PIJ5; Match level="QueryCoverage=87%, HitCoverage=82%, E-value=0.0, Identity=70%"; Hit description =Chromosome chr13 scaffold_17, whole genome shotgun sequence
  Pfam annotation: Domain name=PRONE; Domain location=2-476; Score =720.8; E_value=9.7e-214; Accession=PF03759.4; Description=PRONE (Plant-specific Rop nucleotide exchang
MDALCNKGENFQKKKDGVPSSSSDSTHECSSPSLGWPIRKATLSKCRKSDEKENEPVSHLEDSKFTTVSSKMSGIDAMKERFAKLLLGEDMSGSGKGVCSALAISNAITNLCATVFGQLWRLEPIPCEKKEMWRREMEWLLSVSDHIVELIPSWQTFPDGSKLEVMTCRPRSDLFMNLPALHKLDNMLLEILDGCKDMEFWYVDQGIVAQDADGSASFCKRIQRQEDKWWLPVPRVPPSGLSENSRKQLNHTRECASQILKASMAINNGALAEMEVPESYLETLPKNGRTCLGDFIYHYITSEKFSPECLLDCLDLSSEHVALEIANCVEASIYVWRRRAHSKPPANPNRSSTKSSWEIVKDFMADGDKRELLAERAENVLLSLKQRFPGLTQTTLDTSKIQCNKVPFHASVTLFSSNLQYFLSKPLTLTHFISNIQDIGKSILESYSRVLESMAFNIVARIEDLLYVDDLTKHSDRFPLVPMTVSVSGTPHKAIGTPRSFSPAPPLISPARGERSPFLGNNHNNNNNIKPQRRGFGVRRVLSNYLGAESKETKILSNSTVVNGSNTSNNKEEQPERQKKSHAMHGKTK

SEQ ID NO: 91761 - protein, 245 aa, Glycine max
  Coding DNA Sequence Number=SeqID_76
  Homolog annotation: Hit_ID=A5AW39; Match level="QueryCoverage=30%, HitCoverage=49%, E-value=2e-19, Identity=58%"; Hit description =Putative uncharacterized protein
MVYKKVNFIGEINDTRDLEVDNKNYKYLIVQKNPSNEHVGEEQTITLTTNQACSLSGSTIEFDSHLHKNTSPRRHWIQFNESRQVQSPSITKKREKEIMSSMGESQQRSLFGSTKASSLPVSTSRSDSEGGLRRRLSSLSLKIQLESPNSSSWSFPRSKSLSSMGDYARTWWDWSWAWILSRKLIFATDLEMNDQETKLLASHNRGTWRHVFYKLRSEIRRFINTSDHTTLPKTYHHKSTPQVFS

SEQ ID NO: 91762 - protein, 274 aa, Glycine max
  Coding DNA Sequence Number=SeqID_77
  Gene Ontology: Mol. function=calcium ion binding
  Homolog annotation: Hit_ID=UPI000034F3BF; Match level="QueryCoverage =58%, HitCoverage=11%, E-value=9e-11, Identity=32%"; Hit description =calcium-binding EF hand family protein
MGIFSLEVIVVPQPFILPETDVGPPSHPPFKVINKAVVVLLLKDDLQILPPLRSWQPGIQEGAADWDEDWDKLEDKEFVFVKELTLDVQNIIAPPKQKLLSAVNTKALNTEALNTEAVNTDSPTFAASPKSDDKSKKPQTTNEQGVGNGSVYNKSEDGSVKSAPNSPFASSAIGSPHGDFDSNIRKTAGEDSSPRDQDTIQETQRNEGNNGGPSGTMEPNESLLNHEVGPREWKVYSRREKRVTKGEGSLDSSELIEWLGSNSWPIGATALCQI

SEQ ID NO: 91763 - protein, 581 aa, Glycine max
  Coding DNA Sequence Number=SeqID_78
  Gene Ontology: Mol. function=extracellular-glutamate-gated ion channel activity; Cellular component=integral to membrane; Biological process=ion transport
  Homolog annotation: Hit_ID=A7P8R9; Match level="QueryCoverage=56%, HitCoverage=49%, E-value=1e-73, Identity=42%"; Hit description =Chromosome chr3 scaffold_8, whole genome shotgun sequence
  Pfam annotation: Domain name=Lig_chan; Domain location=331-538; Score= -0.3; E_value=7.4e-11; Accession=PF00060.17; Description=Ligand-gated ion channel
MAQMIFEGAAVHKNIVKEDDDELSEIRAEQRRLVVGGGGCNGGGKGGDRVFEFGVKGCGAAVWDGGETRDAARGTSPLEYGRDRRLELESGVAGSAPRGEFPHPWGHRKGIGQNGAAKLVRTLATMSVDRCSASTGTRPELYLPCRRRRWSSVPGEELRLRDNGIGRRNRGDRIVVWVNVSEEGIKFLAQGKLLDGEAGEDFFKFQGRFRRGGVGHNNESTRMLGAEIKLASRASTSRSLRKKKRIAQGRTRYNQAVYGEFWADDASQFTLTHSPSISYRDMVSQINGHNAVQGCCIDIFLAAIKLLPCAVQYKFILFGDGHKNPSYYDLVNMITYYVFDAVVGDIAIVTDRTKIVDFTQPYIEFVVASVKKLNSGENTVSSLGRVELIIWLFVVLIINSSYTASLTSILTVQQLCSPITRIDSLIFSSERIGFQVGSFAANYLTEQLNIPKHRLIPLGSSEEYAVAFQSRTLATVVDERPYAFPRDSPLAIDMTTAILTLSENAELQRIQEKWLSEKACGFHSTEEEQLQLNSFRGLKKSPQKVGPSNRCSSRSAHIQTFLHFVDEKEDVSPKKLKRKLV

SEQ ID NO: 91764 - protein, 68 aa, Glycine max
  Coding DNA Sequence Number=SeqID_79
MEVPMSTLGPSGPKELPVPRVTKAAMAFKKGREADLGRQMEFGGKDLLLGQQSQNVNEGGASLSHEAP

SEQ ID NO: 91765 - protein, 729 aa, Glycine max
  Coding DNA Sequence Number=SeqID_80
  Gene Ontology: Mol. function=ARF guanyl-nucleotide exchange factor activity; Cellular component=intracellular; Biological process =regulation of ARF protein signal transduction
  Homolog annotation: Hit_ID=O65490; Match level="QueryCoverage=92%, HitCoverage=35%, E-value=1e-176, Identity=53%"; Hit description =Putative uncharacterized protein F23E12.60
  Pfam annotation: Domain name=Sec7; Domain location=157-342; Score =315.3; E_value=1.2e-91; Accession=PF01369.11; Description=Sec7 domain
MSRKHSWNSPKRTGLCEPQSGEPDLANCVFEYTPENFAYMVYLEHCLLPREAYRIVNGLLKTALGPPTGSTTALSPAQDITFRHESVKCLVSIIKSMGAWMDQQIRIGDLDLAKSPESSSAAENHLILNVEEGNASDHELHSDVNSEFSEAATLEQRRAYKIELQKGISLFNRKPPKGIEFLKSNKKIGSSPEQVALFLKNTAGLDETKIGDYLGEREEFSLKVMHAYVDSFNFKGMDFGEAIRFFLQGFRLPGEAQKIDRIMEKFAERYCKCNPSSFSSADTAYVLAYSVIMLNTDAHNNMVKDKMTKADFVRNNRGIDDGKDLPEEYLGAIYDQIVKNEIKMNADSSAPQNKQANSFNRLLGLEGILNLVNWKQSEEKAVGANGLLIRHIQEQFKSNSRKSDKARPQVEGGDSNVTLTRDASRIVSLMQTDKRVAHWLPNKPNSGHDGVQRNLGSHEGRDDGGRRRKDAVMAAKQQQRVEKGTPECGNSHRKTSAYHVVTDVAILRFMVEVCWGPMLAAFSVTLDQSDDRVATSQCLQGFRHAVHVTAVMGMQTQRDAFVTSVAKFTYLHCAGDMKQKNVDAVKAIISIAIEDGDHLYEAWEHILTCLSRIEHLQLLGEGAPSDATFFTSTNFETEEKALKTLGFSSFKKGTLQNPAMVAVVRGSSYDSTSIGIGNFELNHVFAHSQRLNGEAIVAFVKALCKVSISELQSPTDPRVFGLTKIVEIA

SEQ ID NO: 91766 - protein, 314 aa, Glycine max
  Coding DNA Sequence Number=SeqID_81
  Homolog annotation: Hit_ID=A7PR79; Match level="QueryCoverage=91%, HitCoverage=94%, E-value=2e-54, Identity=80%"; Hit description =Chromosome chr14 scaffold_26, whole genome shotgun sequence
MKRKKWSELEEQTLLSKYSELLRSGTLAKLKTREKKFKPVAEHVNAVHHLRNPASFPFKWSWRDVSIKVQNMRHQYLGVKQKIRLSPHHFNWKDGNNHWENFLKYKEVFGDVQLLESPKPITTAKLGFDVDSDDDENEEEEEEDDDEEDCDEEEDVLKGGGGEARGEAAGEGVSAGEGGGGAGEEAEGVGVSAGEAKGVAGRSGDGAGGAAVERVEEKMEEEEMEWRQRMVAMQVEHEKQMMQMHVEACQNQMQVLGIMARLLCQFFGSGTDGLSNGLGALPPQVLHHGGGLGNAKLWGGKEGETVEHACLTCF

SEQ ID NO: 91767 - protein, 423 aa, Glycine max
  Coding DNA Sequence Number=SeqID_82
  Gene Ontology: Mol. function=protein binding
  Homolog annotation: Hit_ID=A7PIE1; Match level="QueryCoverage=96%, HitCoverage=96%, E-value=1e-151, Identity=65%"; Hit description =Chromosome chr13 scaffold_17, whole genome shotgun sequence
  Pfam annotation: Domain name=DUF620; Domain location=122-373; Score =567.9; E_value=1e-167; Accession=PF04788.3; Description=Protein of unknown function (DUF620)
MKKLCPNLTREDGLETVLEVPIPEEIFTIKSGTSRAWHNMKSWMKPNVESSRSSSLFGGQNTDIQLLLGVVGAPLIPLPVTSHNQPITIKSHNIEASMAKYIVKQYVAAVGGESGLNSVESMYAMGEVRVGSEFSEGEECVSSKKTKKVQMKEEVGGFVVWQKKPELWCLELVVSGYKISAGSDGKVAWRQTPWHHSHASRGPPRPLRRLLQGLDPRSTANLFNNSICVGEKTVNNEECFILKLEADSNSLRTRSSSNVEIIRHTVWGYFSQRTGLLVQLEDSHLIKLKSNASEAIFWETNMESLIQDYRIVDGINIAHAGKTWVTLSRLGECPESHSTTRIKEVWQIEEVDFNIKGLSMDCFLPPSDLKREEEKGVEECGVAASNAKLPYKIQSASFKISVSKVAAINVEDSSASESDDENV

SEQ ID NO: 91768 - protein, 356 aa, Glycine max
  Coding DNA Sequence Number=SeqID_83
  Gene Ontology: Mol. function=DNA binding; Cellular component=nucleus; Biological process=regulation of transcription
  Homolog annotation: Hit_ID=A0FK20; Match level="QueryCoverage=79%, HitCoverage=56%, E-value=2e-46, Identity=43%"; Hit description=Myb transcription factor
  Pfam annotation: Domain name=Myb_DNA-binding; Domain location=52-98; Score=38.2; E_value=2.9e-08; Accession=PF00249.22; Description=Myb -like DNA-binding domain
MVVWSVDTVYLYNDRAFCLELACKLLDVGYIFGLAGHYKYLDCQLSISNSNENSISAEEEDNIIVSAHAIHGNKWAIIAKLLPGRTDNAIKNHWNSTLTRKRMEMGRYVPAHADVIEDGTGNFEKTKASSEETMSIGDINSLNPAEVRNVMMNDETKPPTKDDAKVEEHATLHRPVARVSAFSFYNSPGRPTMGSCSKMFPRQSPLIQSPKPDVGPCKLFDNIDCEPMVSSKDDAKVEEHATLHRPVARVSAFSFYNSPGRPTMGSCSKMFPRQSPLIQSPKPDVGSCKLFDNIDCEPMVPSQCGHGCCSGDSRESHLHGSLLGPEFVDYLESPFSSHAFLSIATDLNCCPKYHRK

SEQ ID NO: 91769 - protein, 116 aa, Glycine max
  Coding DNA Sequence Number=SeqID_84
  Gene Ontology: Mol. function=metal ion binding; Cellular component =cell junction; Biological process=muscle contraction
  Homolog annotation: Hit_ID=P93356; Match level="QueryCoverage=87%, HitCoverage=99%, E-value=2e-43, Identity=65%"; Hit description=LIM -domain SF3 protein
  Pfam annotation: Domain name=LIM; Domain location=10-62; Score=45.5; E_value=1.9e-10; Accession=PF00412.13; Description=LIM domain
MSFIGTQQKCKACGKTVYPVDQLSAYHKACFKCSHCEGTLKLSNYSSMESVLYCKPHNEQLFKETGSFKKNFQSPSKQADKTTPELTRSPSKAASMFSGTKKSVLHVAKLLIRWRR

SEQ ID NO: 91770 - protein, 535 aa, Glycine max
  Coding DNA Sequence Number=SeqID_85
  Gene Ontology: Mol. function=adenylosuccinate lyase activity; Cellular component=extracellular region; Biological process=purine ribonucleotide biosynthetic process
  Homolog annotation: Hit_ID=Q8VZX0; Match level="QueryCoverage=100%, HitCoverage=100%, E-value=0.0, Identity=85%"; Hit description =Adenylosuccinate-AMP lyase
  Pfam annotation: Domain name=ASL_C; Domain location=395-513; Score =281.7; E_value=1.5e-81; Accession=PF08328.2; Description =Adenylosuccinate lyase C-terminal
  Pfam annotation: Domain name=Lyase_1; Domain location=84-383; Score =161.6; E_value=2.1e-45; Accession=PF00206.11; Description=Lyase
  Pfam module annotation: Pfam domain module=ASL_C::Lyase_1; Domain location=395-513::84-383
  Subcellular localization annotation: CTP_CleavageSite=46; ConfidenceScore=5.84e-01
MEFTALSNATQLGSFNPLRTNLQSSTQHFLPFSYASFPSSSRRGCSCKAVLSTHTPTSTHNNMFGPRSIDFELSALTALSPLDGRYWSKVKELAPFLSEYGLIYFRVLVELSVIPEIVEVPSFSDGAKSFLEGLIDNFSVEDALEVKNIERVTNHDVKAVEYFLKHKCQSNAEVAKVVEFFHFACTSEDINNLAHALMLRETMNSIMFPVMDKIIKALCDMAKDNAHVPMLSRTHGQPASPTTLGKEMAIFAARLSRERKDLSQVEIVGKFAGAVGNYNAHIVAYPDVNWPHIAEQFVHSLGLSFNPYVAQIETHDYMAKLFHLLIQFNNILIDFDRDVWGYISLGYFKQTTKAGEIGSSTMPHKVNPIDFENSEGNLGVANGGLSHLSMKLPISRWQARPLEDLTDSTVLRNMGVGIGHSLLAYKSTLQGIGKLQVNEACLSEDLNHCWEVLAEPIQTVMRRYGVPEPYEKLKELTRGRAVTKESIRDFIKGLDIPEEAKSNMLKLTPDTYVGAAVELARTVENVVNTVIGIKI

SEQ ID NO: 91771 - protein, 150 aa, Glycine max
  Coding DNA Sequence Number=SeqID_86
MNSVITVLYFNGRVYEDNDGVIFEGSKKAIQIKRGISFNALKKKIGDKTMLESFKQQQEMSVLELYIEKDVAGGSMFHSANSLTSCGNYVSNDDTQPPTNMSNLNLDEDDDHDDDDYLESNSYVEESLDEDDSVDGISDTDDEVTDIPQP

SEQ ID NO: 91772 - protein, 249 aa, Glycine max
  Coding DNA Sequence Number=SeqID_87
MVWYRRKTKMFVDPNNANTAALGEVVETLQYMVSPQGRNTWTVDDLVPYVDKLAIISEEQERITEPVSHGPASEREFPVPEFHILQSSVETRGIGRRREPVEAEQYSQQMMERGHGMYYTPATFSEYPSQMYQYPFVGHDTDTSETSHSFGGVAETQAHFSWPTMTPSQQHDASMATPNAPFAPQWNVPGAIPDMGDLLGVDLRQDFSAEAEQAEAGRQRGGRRNPDRQARRWDRPCGTSSRHHRHHND

SEQ ID NO: 91773 - protein, 200 aa, Glycine max
  Coding DNA Sequence Number=SeqID_88
  Gene Ontology: Mol. function=protein binding; Cellular component =nucleus; Biological process=jasmonic acid mediated signaling pathway
  Homolog annotation: Hit_ID=Q45FY8; Match level="QueryCoverage=47%, HitCoverage=15%, E-value=5e-40, Identity=85%"; Hit description =Coronatine-insensitive 1
MVLDGAKLYTVVVEKGGLSRVAMECVKFLAHRVPNLPLLLSSNRILDLLNAPFLAVIEDRDARRMTARRLSDVVLDCVMPYIHDSKDRDAVSQVCRRWYELDSLTRKHVTIALCYTTTPDRLRRRFPHLESLKLKGKPRAAMFNLIPEDWGVASLSAHDCEGFGSSSSSSFARSRTSSTQAGKFALDSPLMASTISVVIA

SEQ ID NO: 91774 - protein, 307 aa, Glycine max
  Coding DNA Sequence Number=SeqID_89
  Gene Ontology: Mol. function=protein binding; Biological process =embryonic development ending in birth or egg hatching
  Homolog annotation: Hit_ID=A7PR71; Match level="QueryCoverage=92%, HitCoverage=71%, E-value=1e-116, Identity=73%"; Hit description =Chromosome chr14 scaffold_26, whole genome shotgun sequence
  Pfam annotation: Domain name=AAR2; Domain location=1-306; Score =343.3; E_value=4.1e-100; Accession=PF05282.2; Description=AAR2 protein
MDPGTALELVKHGVTLLFLDVPQYTLVAVGTQMFSVGPTFKGIKMIPPGIHFVYYSSSSRDGKEFSPIIGFFIDAGPSEVIVRKWDQQDERLIKLSEEEEERYSQAVKNLEFDRQLGPYNLSHYEDWKRLSNFITKSVIERLEPIGGEITVECENEIVRNTTKMPMEEALDKQLKVGNSATSVGKSRRKGCYYTSIPHVVKCKGISGQELTSLNLDKTHLLETLLTKDYGDSEDLLLGELQFAFIAFLMGQSLEAFLQWKSLVSLLFGCTEAPFRTRTHLFTKVQNIDINTWNAVNFIPDCSSSSDF

SEQ ID NO: 91775 - protein, 121 aa, Glycine max
  Coding DNA Sequence Number=SeqID_90
  Gene Ontology: Mol. function=sequence-specific DNA binding; Cellular component=nucleus; Biological process=regulation of transcription, DNA-dependent
  Homolog annotation: Hit_ID=A7PIC0; Match level="QueryCoverage=77%, HitCoverage=54%, E-value=8e-34, Identity=74%"; Hit description =Chromosome chr13 scaffold_17, whole genome shotgun sequence
  Pfam annotation: Domain name=Homeobox; Domain location=24-85; Score =56.9; E_value=7.2e-14; Accession=PF00046.20; Description=Homeobox domain
MDEGLSGFCIRSSSGSVRGKSGTKCGRWNPTTEQVKLLTELFRSGLRTPSTDQIQKISTQLSFYGKIESKNVFYWFQNHKARERQKNRKLSFDDHKDLICRQNAPSTQSLAEMYQVSKPDR

SEQ ID NO: 91776 - protein, 75 aa, Glycine max
  Coding DNA Sequence Number=SeqID_91
  Subcellular localization annotation: CTP_CleavageSite=58; ConfidenceScore=5.03e-01
MELCFYCLFPSSSPIGLIFHTDPKYDSFGSSFLHSAAPLPPQRRRPPPFFFLSFNNIVVNYCAELDNRTDDWSKE

SEQ ID NO: 91777 - protein, 760 aa, Glycine max
  Coding DNA Sequence Number=SeqID_92
  Gene Ontology: Mol. function=metalloendopeptidase activity; Cellular component=chloroplast thylakoid membrane; Biological process =proteolysis
  Homolog annotation: Hit_ID=A7Q3E4; Match level="QueryCoverage=61%, HitCoverage=90%, E-value=0.0, Identity=68%"; Hit description =Chromosome chr13 scaffold_48, whole genome shotgun sequence
  Pfam annotation: Domain name=Peptidase_M50; Domain location=518-699; Score=79.3; E_value=1.2e-20; Accession=PF02163.13; Description =Peptidase family M50
NKMQDITRMDAAVDAMRPLGFRTQLILRTVNELLDVYGGNQGWCFIEEAYYKLLMEALLSKQQGSAEDKDGARRDDVVNGTSSVGISEVGSSGMVTQDTPIYTSDCLGSSSQANASLGNLETDVGNLAVQADSGGNEQDMMNKPENEIKTADNVKGSKDSTIANNIESTSVKTPMIQSSEAFDHRPCRCPPEGCHGWIDDDDDDDDDDDLIHFPVPPLFRQIEKMIVQLLRHFAGISSFLCRAAPLASNLISVFSIPTVFAIRVVVGRNMFRFTFVTDLASNADAVLNWNRSSRRRGIACSVTEPDNGSDEKEKEADKNGETLRVEDSSEQSIPPPVDAEQLNEFSDENKGQSDVQQNMDDSNEVASGSPLPGVKPQKLDEAIKIPKETIEILKNQVFGFDTFFVTSQDPYEGGVLFKGNLRGQAAKSYDKISKRLKDKFGDEYKLFLLVNPEDDKPVAVVVPRTTLQPETTAVPEWFAAGSFGLITVFTLLLRNVPALQSDLLSTFDNLNLLKDGLPGALVTALILGVHELGHFLAAKDTGVKLGVPYFVPSWQIGSFGAITRIRNIVPNREDLLKVAAAGPIAGYALGLLLLLLGFVLPPSDGIGVVVDASVFHESFLAGGIAKLLLGNVLKEGTAISINPLVIWAWAGLLINAINSIPAGELDGGRISFALWGRKASLRFTGVSIALLGVSSLLNDVAFYWVVLIFFLQRGPIAPLSEEITDPGEKYVAIGVTVLLLGLLVCLPYPFPFTEETITSF

SEQ ID NO: 91778 - protein, 212 aa, Glycine max
  Coding DNA Sequence Number=SeqID_93
MVTLSILFFSFAVLKSNPVREWLKWKSTETASTYFAEATKKTMLWAFSNGHMLINIMKLRKILSNTTTRMIFFLFRRDPWCFFARPLRACRELQLRWLKDKFVTEVRFSSSQWIVLEKLLLERYGISMELKEPKNRANDCMMRVLYFRLNGMLPSNLLVCSAAMKHQHGHGTQYGHRHVNTCNVQNIERNTGVVSVSDIDTDACRTPDTTRD

SEQ ID NO: 91779 - protein, 385 aa, Glycine max
  Coding DNA Sequence Number=SeqID_94
  Gene Ontology: Mol. function=oxidoreductase activity; Cellular component=integral to membrane; Biological process=electron transport
  Homolog annotation: Hit_ID=A4PBE6; Match level="QueryCoverage=84%, HitCoverage=63%, E-value=1e-134, Identity=76%"; Hit description =Cytochrome P450 enzyme
  Pfam annotation: Domain name=p450; Domain location=34-383; Score= -144.7; E_value=1.7e-05; Accession=PF00067.13; Description=Cytochrome P450
  Subcellular localization annotation: CTP_CleavageSite=50; ConfidenceScore=5.11e-01
MASFIFTPVLFLLIISAVLLFLHRRSRCRRFRLPPGTLGLPFVGETLQLISAYKSDNPEPFMDQRVKRYGPIFTTHVFGEPTVFSTDPETNRFILLNEGKLFECSYPGSISNLLGKHSLLLMKGSLHKRMHSLTMSFANSSIIKDHLLVDIDRLIRLNLDSWSDRVLLMEEAKKHVSVIYVMEMELELVTQIPWFSILCPISITFELTVKQLMSFDPGEWTETLRKEYVLVIEGFFSVPLPLFSSTYRRAIKARTKVAEALTLVVRDRRKESVTEEKKNDMLGALLASGYHFSDEEIVDFMLALLVAGYETTSTIMTLAIKFLTETPLALAQLKLARVVGHIDVAPSLELPHQRVHVHVHDHRSCGVVSFEISFSLSLYSPLPPF

SEQ ID NO: 91780 - protein, 89 aa, Glycine max
  Coding DNA Sequence Number=SeqID_95
  Gene Ontology: Mol. function=oxidoreductase activity, acting on single donors with incorporation of molecular oxygen, incorporation of two atoms of oxygen
  Homolog annotation: Hit_ID=A5AZG3; Match level="QueryCoverage=94%, HitCoverage=23%, E-value=1e-30, Identity=80%"; Hit description =Putative uncharacterized protein
MAWYDINVLSNANYKSVEHRVLVNSNKERVSLAFFYNPKSDIPIEPAKELVKPDQPALYTPMTFDEYRLFIRLRGPCGKSHVESLKSPR

SEQ ID NO: 91781 - protein, 473 aa, Glycine max
  Coding DNA Sequence Number=SeqID_96
  Homolog annotation: Hit_ID=A7Q3J3; Match level="QueryCoverage=48%, HitCoverage=60%, E-value=9e-60, Identity=51%"; Hit description =Chromosome chr13 scaffold_48, whole genome shotgun sequence
  Subcellular localization annotation: CTP_CleavageSite=89; ConfidenceScore=5.42e-01
MASSDLFGGATSAPPPTPAAHHDNIMSSSDAADALSRLLQRLPPTLSLPTRLPSPSSAAATCPPCLSLNDVLSCVSKLGYAQLTDHSVPSELANSAESEALALFDLSQDQKQSLFPKNWPLGYGNDEDEDEDGVADSFRFDSACSTESSELALFSLRKFARELEKLGLMIVDELTKDLGCENPLGDDPTRVCSVMWVSESLPGNKSGGFYPFVIGLQYQIRNQKYSLLSDSGWVSVLPHVDSILVTFGDIAQVWSNGKLKKVRGRPMATVGDENGSRCITMSLLITLPTDSRVAPLLPKVTCNKDQKEEEIEGEEEENNDGGDEELEKRVFNSFDFEDYAWRVYHERILFKDPLDRGGSGGLPGATTNGGLPGATSSGGVPGATTSGSLSGASTSGKRDVPGPPLVDVPDRLPLVVAPRAPPLLVAPDRPPLVVASGRPPLPPLSHRPVKSRHVSRSAGTRLSGPNLVILSTK

SEQ ID NO: 91782 - protein, 112 aa, Glycine max
  Coding DNA Sequence Number=SeqID_97
MEIKFTMRERERETERDSERDSGWERVRSRRERRENERTRGMEGPCLFIAREGKGGQQRRLRVNWRDHRNISSFYFTRFPEDTTEDELWKIFRRAGDVREVFIPNKRNRTGR

SEQ ID NO: 91783 - protein, 108 aa, Glycine max
  Coding DNA Sequence Number=SeqID_98
MEWIPWHGSRTRPRENRIEPAPTLTDKNRVDRVRGRVRVFPDNPKRGRGRVWDYSYCSSQPLSQGEVVENVRPLKRGINEEEVLLENVELILDAFDYLQLPFALKQGI

SEQ ID NO: 91784 - protein, 164 aa, Glycine max
  Coding DNA Sequence Number=SeqID_99
MKAFNVNLGAVLRLFRTETKLTREPWYMKPISQYPVAASLSPLSRNRHWRYHLLQHPLSPIPPAPRAGHPLSLLSPPIPPAAMAAPLPLSPNQLLSRHWHWRFKLPASVNGDTHKPLTQVTESSYNPSKGTDIHVVIIILEERASNPLEVYITPILGAGVRVTK

SEQ ID NO: 91785 - protein, 117 aa, Glycine max
  Coding DNA Sequence Number=SeqID_100
MNHYEEETLKNECHKQEEHKMVKKTSSPYELNSNDDPETERGKGGTMRTNVVHSGETSVDTRISEGDNSSLTGLTTEQWQTLDCISRTLIGAAYKTDGLHSMDLWHKQLGHPSLKIT

SEQ ID NO: 91786 - protein, 155 aa, Glycine max
  Coding DNA Sequence Number=SeqID_101
MNTKPFFSLCLLCALLLICVVATEPSKDATQGSVYCITSCIFLSQITPRTIVLPLILHAFFLATPIPHSISMHVNQKNQRHGQMPGEVVEVEDMVEVGDMVEAGDTVEAGDMVEAGDMAVDMAEDANAAVERAANVAEVKKHKHELKTHIRVYSM

SEQ ID NO: 91787 - protein, 28 aa, Glycine max
  Coding DNA Sequence Number=SeqID_102
MDNATWVGLGNINRPILGVQTAYAVNRI

SEQ ID NO: 91788 - protein, 288 aa, Glycine max
  Coding DNA Sequence Number=SeqID_103
  Gene Ontology: Mol. function=protein disulfide oxidoreductase activity; Biological process=intracellular signaling cascade
  Homolog annotation: Hit_ID=A7PIU2; Match level="QueryCoverage=67%, HitCoverage=37%, E-value=3e-71, Identity=69%"; Hit description =Chromosome chr13 scaffold_17, whole genome shotgun sequence
  Pfam annotation: Domain name=DUF547; Domain location=81-217; Score =151.1; E_value=3e-42; Accession=PF04784.5; Description=Protein of unknown function, DUF547
  Subcellular localization annotation: CTP_CleavageSite=25; ConfidenceScore=5.03e-01
MITEQRSSSLNYEVISKGRKTSNRRASLGSALDFHSLFSTPRRSTEYEVPRRSSGKIAREYPMHIEDAIEKPNELLEELLKCLIDLSFLTYKQKFAFWINIYNACIMNAFLHLGLPSTQEKLLSLMNKLRIDTGCNERRRDSTECTGYRTLYSSAPISQKGPMDEKEVLLRHAYGLGYPEPNVTFALCRGTWSSPALRVYTSDDVVNQLGRAKVEYLEASVGITSKRKILVPKLLEWHKHDFADEMESLLEWIYCQLPRSGSLKRATMECLIKETKISSVQNGGNPAI

SEQ ID NO: 91789 - protein, 301 aa, Glycine max
  Coding DNA Sequence Number=SeqID_104
  Gene Ontology: Mol. function=binding; Cellular component=endoplasmic reticulum; Biological process=intracellular protein transport
  Homolog annotation: Hit_ID=A9PB12; Match level="QueryCoverage=99%, HitCoverage=99%, E-value=1e-122, Identity=70%"; Hit description =Putative uncharacterized protein
  Pfam annotation: Domain name=NSF; Domain location=111-122; Score=6.2; E_value=34; Accession=PF02071.11; Description=Aromatic-di-Alanine (AdAR) repeat
  Pfam annotation: Domain name=NSF; Domain location=131-142; Score=4.9; E_value=52; Accession=PF02071.11; Description=Aromatic-di-Alanine (AdAR) repeat
  Pfam annotation: Domain name=NSF; Domain location=32-43; Score=7.7; E_ value=20; Accession=PF02071.11; Description=Aromatic-di-Alanine (AdAR) repeat
  Pfam annotation: Domain name=NSF; Domain location=72-83; Score=14.5; E_value=0.41; Accession=PF02071.11; Description=Aromatic-di-Alanine (AdAR) repeat
  Pfam annotation: Domain name=NSF; Domain location=91-102; Score=4.5; E_value=60; Accession=PF02071.11; Description=Aromatic-di-Alanine (AdAR) repeat
  Pfam annotation: Domain name=TPR_1; Domain location=112-145; Score =15.0; E_value=0.083; Accession=PF00515.19; Description =Tetratricopeptide repeat
  Pfam annotation: Domain name=TPR_1; Domain location=53-86; Score=2.2; E_value=2.9; Accession=PF00515.19; Description=Tetratricopeptide repeat
  Pfam annotation: Domain name=TPR_2; Domain location=112-145; Score =16.1; E_value=0.13; Accession=PF07719.8; Description=Tetratricopeptid e repeat
  Pfam annotation: Domain name=TPR_2; Domain location=53-86; Score=8.7; E_value=2.5; Accession=PF07719.8; Description=Tetratricopeptide repeat
  Pfam module annotation: Pfam domain module=NSF::NSF::NSF::NSF::NSF::TP R_1::TPR_1::TPR_2::TPR_2; Domain location=111-122::131-142::32-43::72- 83::91-102::112-145::53-86::112-145::53-86
MGDHLARAEDFENKAEKKLSSWGLFGSKFEDAADLFDKSANSYKLAKSWDKAGSTYIKLASCHLKLESKHEAAQAYVDAARCYKKTNINESVSCLDNAVNIFCEIGRLSMAARYLKEIAELYESEQNISQAVAYYEKSADFFENEEVNTSANQCKQKVAQFSAQLEQYQRSIEIYEDIARQSLSNTLLKYGVKGHLLNAGICELCKGDVIAITNALERYQVQYFSRIYILRPDLDPTFSGTREYRLLADIAAAIDEEDVGKFTEVIKEFDSLTPLDSWKTTLLLRVKDKLKAKEIEEDDLT

SEQ ID NO: 91790 - protein, 130 aa, Glycine max
  Coding DNA Sequence Number=SeqID_105
  Gene Ontology: Biological process=polar nucleus fusion
  Homolog annotation: Hit_ID=A7QAH5; Match level="QueryCoverage=68%, HitCoverage=27%, E-value=2e-35, Identity=79%"; Hit description =Chromosome undetermined scaffold_71, whole genome shotgun sequence
MGGGKIDEKRNFRPRLLVLAGIRINYSSNLRNHRYRNMKEEEVNHCQIQEWYPMFKSVSIKTLIHQLPESFIQHLLDDSGPFLLPVSVLNEDALPNRIHNPDEEEDFQVSEGSGDEAEAWNFDPPFLLLS

SEQ ID NO: 91791 - protein, 313 aa, Glycine max
  Coding DNA Sequence Number=SeqID_106
  Gene Ontology: Biological process=intracellular signaling cascade
  Homolog annotation: Hit_ID=Q9SIZ1; Match level="QueryCoverage=100%, HitCoverage=74%, E-value=1e-136, Identity=73%"; Hit description =Putative uncharacterized protein At2g40320
  Pfam annotation: Domain name=DUF231; Domain location=251-313; Score= -64.1; E_value=0.024; Accession=PF03005.6; Description=Arabidopsis proteins of unknown function
MKPPFSPSSSLLRGKARLSPYLFTLIVFILFVAILYGEDFMCIFGQQFQNYSNYPHKLSSTTERVKRQKLPFAVGKAEEGCDVFSGSWVRDELTRPLYEESECPYIQPQLTCQEHGRPDKDYQHWRWQPHGCDLPKFNASLVLETLRGKRMMFVGDSLNRGQYVSFVCLLHKLIPEDGKSMETFDSLTVFSIKEYNATIEFYWAPFLLESNSDNAVIHRISDRIVRKGSINKHGRNWKGVDILVFNTYLWWMTGLKMKILLGSFDDEVKEIVELSTEDAYGMAMKSMLRWVRLNMDPKKTRVFFTSMSPSHGK

SEQ ID NO: 91792 - protein, 399 aa, Glycine max
  Coding DNA Sequence Number=SeqID_107
  Gene Ontology: Mol. function=mannosyl-glycoprotein endo-beta-N -acetylglucosaminidase activity; Cellular component=cell surface; Biological process=cell adhesion
  Homolog annotation: Hit_ID=A7Q3P1; Match level="QueryCoverage=98%, HitCoverage=54%, E-value=1e-126, Identity=57%"; Hit description =Chromosome chr13 scaffold_48, whole genome shotgun sequence
MCQTNAALDVIRKDDVSAAIFAPGWVYETKQAPDFETAQNRWWSLVGKSWGITRKYLGTLPFYTNFDQGSGYHISVDGDQVSDAPWCNISSQGVQPLLEFADSTANSIQLIVNLKEASYNGGGNITFKGSLEKDTYFKRRIFQGEFILSKLPIHFFYSVKSDSNSSLGLVLEFTSTINKTMSVLLTSHGMDHLSSEFSKVVLTSEHKGNALGWVIHEGTIEMNGYILTGIHALCYKPNAPSKELKSRPFGPGHTAPSSTDYSAVLGHITVKTSNYKPDFPISTSWLVDGEYIHWKSGPQDSRILSVKISWNLKGKNFAFPHYNVFVEKPPKLADGNSGTTLEPVQEYLGVAHVNCFYVSELKVPASTSSLKFIIQVCDFDGTNRNLEDCPYYQLEIKGL

SEQ ID NO: 91793 - protein, 186 aa, Glycine max
  Coding DNA Sequence Number=SeqID_108
  Gene Ontology: Mol. function=transition metal ion binding; Cellular component=chloroplast; Biological process=cellular iron ion homeostasis
  Homolog annotation: Hit_ID=Q41709; Match level="QueryCoverage=89%, HitCoverage=63%, E-value=1e-59, Identity=73%"; Hit description =Ferritin-2, chloroplast precursor
  Pfam annotation: Domain name=Ferritin; Domain location=83-185; Score =35.2; E_value=2.4e-07; Accession=PF00210.15; Description=Ferritin -like domain
  Subcellular localization annotation: CTP_CleavageSite=36; ConfidenceScore=5.67e-01
MLLRTAASAASASSLSLFSPTSEPLRSVPARGLVVRAAKGSTNHRALTGVIFEPFEEVKKELDLVPTVPQASLARQKYVDESEAAVNEQIKLLLSLSLSLAHRVEYNVSYVYHAMFAYFDRDNVALRGLAKFFKESSEEEREHAEKLMEYQNKRGGRVKLQSIVMPLSEFDHADKGDALHVHEGML

SEQ ID NO: 91794 - protein, 245 aa, Glycine max
  Coding DNA Sequence Number=SeqID_109
MNSLTLFLSFCLILITNSPSLTNANEAILQLSLYKAIEGQKFLRTLMKSENVPAIAQCANSDYESVITAYKSALSKLKDDPKTAKHYARDAEAILQLSLYKAIEGQKFLRTLMKSENVPAIAQCANSDYESVITAYKSALSKLKDDPKTAKHYARDAGNGPVSWWGWNRVRATRPKPHLGNRVGNALDETNPKTMQDLGNHHEGWCAFSECHWPTMRDRDRGSGNRAEALPEAWWHNQNKKKGKS

SEQ ID NO: 91795 - protein, 131 aa, Glycine max
  Coding DNA Sequence Number=SeqID_110
  Homolog annotation: Hit_ID=A5BGF1; Match level="QueryCoverage=57%, HitCoverage=85%, E-value=4e-13, Identity=54%"; Hit description =Putative uncharacterized protein
  Pfam annotation: Domain name=DVL; Domain location=59-77; Score=19.0; E_value=0.018; Accession=PF08137.3; Description=DVL family
  Subcellular localization annotation: CTP_CleavageSite=54; ConfidenceScore=5.79e-01
MASSVSTTPPMYFDEKWKLSKKEGSTRSRSSSTSTPFIKNSSSSQRRCAFASKCAKLVKEQRARFYIMRRRVVSTIQLVLAPEIKYNVSKETTLKVLWEKLKNIYALVPNQSPLFEDEVVSTQNGDGRRSP

SEQ ID NO: 91796 - protein, 225 aa, Glycine max
  Coding DNA Sequence Number=SeqID_111
  Gene Ontology: Mol. function=aspartic-type endopeptidase activity; Cellular component=endoplasmic reticulum; Biological process =proteolysis
  Homolog annotation: Hit_ID=A7PNQ0; Match level="QueryCoverage=99%, HitCoverage=52%, E-value=8e-86, Identity=70%"; Hit description =Chromosome chr8 scaffold_23, whole genome shotgun sequence
MSLPKFSYCISGEDALGVLLLGDGTDAPSPLQYTPLVTATTSSPYFNRVAYTVQLEGIKVSEKLLQLPKSVFVPDHTGAGQTMVDSGTQFTFLLGSVYSSLKDEFLEQTKGVLTRIEDPNFVFEGAMDLCYHAPASFAAVPAVTLVFSGAEMRVSGERLLYRVSKGSDWVYCFTFGNSDLLGIEAYVIGHHHQQNVWMEFDLLKSRVGFTQTTCDLATQRLGLSP

SEQ ID NO: 91797 - protein, 171 aa, Glycine max
  Coding DNA Sequence Number=SeqID_112
AILQLSLYKAIEGQKFLRTLMKSENVPAIAQCANSDYESVITAYKSALSKLKDDPKTAKHYARDAGNGPVSCETALAATTSPWLKLPHHKMNSLTLFLVAPSLLDPHYSAIAECANSDYEYVVMAFRSALSDLKYDPLTAIYANLMPNMLLMDLNTAAHIFNPAIPALIVA

SEQ ID NO: 91798 - protein, 1024 aa, Glycine max
  Coding DNA Sequence Number=SeqID_113
  Gene Ontology: Mol. function=ubiquitin-protein ligase activity; Cellular component=ubiquitin ligase complex; Biological process =protein ubiquitination
  Homolog annotation: Hit_ID=A7Q3L5; Match level="QueryCoverage=65%, HitCoverage=98%, E-value=0.0, Identity=73%"; Hit description =Chromosome chr13 scaffold_48, whole genome shotgun sequence
  Pfam annotation: Domain name=Arm; Domain location=422-462; Score =39.2; E_value=1.4e-08; Accession=PF00514.14; Description =Armadillobeta-catenin-like repeat
  Pfam annotation: Domain name=Arm; Domain location=463-504; Score =13.2; E_value=0.23; Accession=PF00514.14; Description=Armadillobeta -catenin-like repeat
  Pfam annotation: Domain name=Arm; Domain location=505-546; Score =23.8; E_value=0.00065; Accession=PF00514.14; Description =Armadillobeta-catenin-like repeat
  Pfam annotation: Domain name=Arm; Domain location=547-587; Score =22.4; E_value=0.0017; Accession=PF00514.14; Description =Armadillobeta-catenin-like repeat
  Pfam annotation: Domain name=Arm; Domain location=588-629; Score=6.7; E_value=1.6; Accession=PF00514.14; Description=Armadillobeta-catenin -like repeat
  Pfam annotation: Domain name=CbiC; Domain location=399-568; Score= -82.7; E_value=0.053; Accession=PF02570.6; Description=Precorrin-8X methylmutase
  Pfam annotation: Domain name=HEAT_PBS; Domain location=491-528; Score= 13.4; E_value=0.86; Accession=PF03130.7; Description=PBS lyase HEAT -like repeat
  Pfam annotation: Domain name=HEAT_PBS; Domain location=533-569; Score= 5.7; E_value=15; Accession=PF03130.7; Description=PBS lyase HEAT-like repeat
  Pfam annotation: Domain name=HEAT_PBS; Domain location=584-611; Score= 1.5; E_value=62; Accession=PF03130.7; Description=PBS lyase HEAT-like repeat
  Pfam annotation: Domain name=Lipase_GDSL; Domain location=695-1014; Score=186.9; E_value=5.2e-53; Accession=PF00657.13; Description=GDSL- like LipaseAcylhydrolase
  Pfam annotation: Domain name=U-box; Domain location=281-355; Score =91.4; E_value=2.9e-24; Accession=PF04564.6; Description=U-box domain
  Pfam module annotation: Pfam domain module=Arm::Arm::Arm::Arm::Arm::Cb iC::HEAT_PBS::HEAT_PBS::HEAT_PBS::Lipase_GDSL::U-box; Domain location= 422-462::463-504::505-546::547-587::588-629::399-568::491-528::533 -569::584-611::695-1014::281-355
MNNVLSAMMVSPGLLPSGTLLDSLIHVCNEVGSMEKFPLVHTRNVSTMIRRIKLLSSLFEEIQETDTPLPPSSILCLTELFSVIRRVKVLIQDCKDGSSLWSLIQLEFISNQFYVLVKEMGRALDILSLSLLNVTSDIKEQVELLHKQAKRAELLIDPRELHRREQLIQVMANNSLQNKKKKGLVDFGKVEEILSSIGLRTPSDYEEEISKLEAEAQNQAGTGGLIVVSNINNLISLMCYSKSMIFKEGESDTKEDCKPLSSFLYNKVYDSSSSSQSMTPNVPDEFRCPISLDLMRDPVIVSSGHSYDRISIAQWINSGHHTCPKSGQRLIHTALIPNYALKSLVQQWCHDNNVPVDEPTTEGNKNSSKKLKEDAVDHISANKAAADAVKMTAEFLVGKLATGSADIQRQAAYELRLLTKTGMVNRSVIAEVGAIPFLVTLLGSQDSRIQEHAVTALFNLSIFDNNKILIMAAGAVDSIVEVLESGKTMEARENAAASIYSLSMVDECKVQIGGRPRAIPALVELLKEGTPIGKRDAASALFNLAVYNPNKVSVVKAEAVPVLVELLMDDKAGITDDALAVLALLLGCSEGLEEIRNSRALVPLLIDLLRFGSVKGKENSITLLLGLCKQEGEVVARRLLANPRSIPSLQSLAADGSLRARRKADAVLRFLNSFSILLLLCMLKSTTASSNFSAIFAFGDSTVDPGNNNHLFTLFRGDHFPYGRDFPTHLATGRFSNGKIATDYLAQFLGLKDLLPAYFDPLVTVSDMVTGVSFASGGSGLDPNTVALARVLDLSSQLASFEQALQRITRVVGNQKANDILENALFVISIGTNDMLYNAYLMPATSRMIRYGSISGYQDYLLQNLNDFVQTLYGAGARRILVAGLPPIGCLPVQVTLSSIKDLHWLQRVCDAQQNMDSQAYNNKLQSHIHLLQSTLNDAKIAYFDIYTPILDMVQNPTKYGFAQTLQGCCGTGLLEMGPVCNALDLTCPDPSKYLFWDAVHLTEAGNYVLAENGQQNVIPYLSN

SEQ ID NO: 91799 - protein, 461 aa, Glycine max
  Coding DNA Sequence Number=SeqID_114
  Gene Ontology: Mol. function=aspartic-type endopeptidase activity; Cellular component=extracellular region; Biological process =proteolysis
  Homolog annotation: Hit_ID=A7P689; Match level="QueryCoverage=93%, HitCoverage=89%, E-value=1e-85, Identity=41%"; Hit description =Chromosome chr4 scaffold_6, whole genome shotgun sequence
  Pfam annotation: Domain name=Asp; Domain location=112-458; Score= -100.0; E_value=1.1e-07; Accession=PF00026.14; Description=Eukaryotic aspartyl protease
  Subcellular localization annotation: CTP_CleavageSite=25; ConfidenceScore=5.09e-01
MATSLTFTCITVFFSFFLSFNNYVKGDLIPPSTCNRTSIKGLNRKISLELVHMDGPCSHLKRNNVVNDNDFLRDHERVKYIQSRIFKNNNLTELDSSVSIPTIPGLPLSTLNYIIVIRLGTPENSYQMVFDTGSSLTWTQCYQCKTCYEQSDARFNPLNSSTYKGSVCSDKTCKGLMNTRQGLKCSKDIRLCHYSIRYGDGSYSTGFFGKDRLALYSNISPNSGITDDFYFGCGIINKGLFHRTAGVFGLGRGELSFVSQTSSQYMETFSYCIPNIDKVGYITFGPDPDADHDERIEYTPLVIPQGGLSHYGLNITGIAIDGDILMGLDFNEIDHGGFIIDSGCIVTRLPPTIYAKLRSVYQQRMSNYPSAPTYTPFDTCYDLSGFHYPIPEMSFVFPGVTVDLPRAGTFYQLNPKQYCLAFIPNKDDSQISIFGNIQQKTLEIVHDNLGNKIGFRPNGCG

SEQ ID NO: 91800 - protein, 481 aa, Glycine max
  Coding DNA Sequence Number=SeqID_115
  Gene Ontology: Mol. function=aspartic-type endopeptidase activity; Cellular component=extracellular region; Biological process =proteolysis
  Homolog annotation: Hit_ID=A7P689; Match level="QueryCoverage=90%, HitCoverage=89%, E-value=3e-87, Identity=42%"; Hit description =Chromosome chr4 scaffold_6, whole genome shotgun sequence
  Pfam annotation: Domain name=Asp; Domain location=132-478; Score= -92.7; E_value=4e-08; Accession=PF00026.14; Description=Eukaryotic aspartyl protease
  Subcellular localization annotation: CTP_CleavageSite=39; ConfidenceScore=5.06e-01
MSHAFHSHMQHMRYQRRDLQMSTSFTFTCITVFFFFLLSFDNYAKGDLIPSPTCKRTSIQGLNRKVSLDLVHIDGPCSHLKRDNVSIDNDLFRDHERVKYIQSRISKNNSSYQLDSSVSIPTIPGIPLGTLNYYIVIRLGTPENNYQLQFDTGSDLTWTQCEQCTTCYEQSGPRFYPAKSTTYVASNCFDETCKVLIKNEHGLDCSKDVHLCHYRIYYGDGSLTRGYFGKDRLALYNDLAPNPGITDNFYFGCGIINDGTFGRTSGIFGLGRGELSFLSQTSKQYMETFSYCIPSVDDVGYITFGYDPDTDFDKRIKYTPLVIPQGGLNHYGLSITGIAIDGDILPGLNFSQINHAGFIIDSGTVFTRLPPTIYATLRSVFQQRLSNYPTAPSHNVFDTCYDLTGYHYPIPEMSFVFPGVTVDLHPPGVLYEFDDKQSCLAFIPNKDDSQITIFGNVQQKTLEIVYDNPGNRIGFRSDGCS

SEQ ID NO: 91801 - protein, 339 aa, Glycine max
  Coding DNA Sequence Number=SeqID_116
  Gene Ontology: Mol. function=structural molecule activity; Cellular component=synapse; Biological process=regulation of apoptosis
  Homolog annotation: Hit_ID=A5AEF9; Match level="QueryCoverage=94%, HitCoverage=45%, E-value=3e-65, Identity=47%"; Hit description =Putative uncharacterized protein
  Pfam annotation: Domain name=Ank; Domain location=238-269; Score =11.0; E_value=0.85; Accession=PF00023.21; Description=Ankyrin repeat
  Pfam annotation: Domain name=Ank; Domain location=272-304; Score =35.0; E_value=2.6e-07; Accession=PF00023.21; Description=Ankyrin repeat
  Pfam annotation: Domain name=Ank; Domain location=305-337; Score =16.1; E_value=0.13; Accession=PF00023.21; Description=Ankyrin repeat
  Pfam annotation: Domain name=Motile_Sperm; Domain location=4-117; Score=48.8; E_value=2e-11; Accession=PF00635.17; Description=MSP (Major sperm protein) domain
  Pfam module annotation: Pfam domain module=Ank::Ank::Ank::Motile _Sperm; Domain location=238-269::272-304::305-337::4-117
MEALVEVCEPAEVRIEFALNCKCRATVRIRSLTQTTPVAFKIQTSSPNKFLVNPPSGLIQPLSSATFQVILKPQSHLPHSYPRSPSDRFLVKTAEFCANSSCSTHPESINSWFASRPYGFKTLDIKLKVAFVGPILLNDAVTRGDLDAVRNLIKRQRSMLAELSPTQAETLLGAATKLLNPDDMVHLLLEAGLRIIPNPNNAPDQGEEIFEASRNGHVAEVESLLRRCGGSVKYRDQYGLTAVHAAAFKGHKDVLMVLSELSDLDLECEDREGHVPLHMAVESGDVGTVKVLVEKGVNLNAVNKRGATPLYMAKIWGYDDICQLLVSRGALYSLTSTSG

SEQ ID NO: 91802 - protein, 290 aa, Glycine max
  Coding DNA Sequence Number=SeqID_117
MAASPTTPDNIISKEPPTKIIVCCQYIHDSNMLSGVAREHEEACRATNQAVGIARRTASKSVFLCEDFVASVALIAHYESEASARIAGVVLVGAREAFDEPVELAALVELADVVSSANVDATDEYARQGEVAAAAEDGVELVAEAVVDGDVALVDGDAEAAQDGSDGAAVVECAANNTEGGKARSTAVEIRTRRKRDGDLGAAGSDSGLSWKRLWISLKEEQEKLKERVRECDGDDDGEGEGGGVLRNPLGELSHGGHMRSGKRKRVLRVVKSGEGDGHAKKTKRRGWGL

SEQ ID NO: 91803 - protein, 74 aa, Glycine max
  Coding DNA Sequence Number=SeqID_118
MKGKAERNVNLLVVGGGATATVGPRAVMAQCARRSGRENDARWWRNWEGMSLAEERERERGRWRHATVTGVVGG

SEQ ID NO: 91804 - protein, 85 aa, Glycine max
  Coding DNA Sequence Number=SeqID_119
  Subcellular localization annotation: CTP_CleavageSite=41; ConfidenceScore=5.27e-01
MEPRNSATCTPPSRCDPSCAQLTPESCTPRSCPLERFCGKTASARVRKRRRVLFSFRDEGQVEEEAYEEAEEEAPKDETEIQVVR

SEQ ID NO: 91805 - protein, 176 aa, Glycine max
  Coding DNA Sequence Number=SeqID_120
MRYLHRRSICGTRCLNSPPGRLSIQGIFKAEIHHRHLTRQSRKAYSTLRIETSQAIYLLSQRGSLLGSTHSMVAHSSLRIETSQVIYLLSQRGLLKLEDRDFPSYLSSLSERLSTWIDSFYGDSLKLEDRDFPSNLSSLSERLSTWIESSYGGSLKLEDRDFSSYLSSLSERLTQV

SEQ ID NO: 91806 - protein, 264 aa, Glycine max
  Coding DNA Sequence Number=SeqID_121
MEILPLYKKIVGLQGCVYKIDSLYGGSLKLKDRDFPSYLFSLSERLSTWIDSFYGSSLKLEDRDFPSNLSSLSERLSTWIESPYGGSLKLEDRDFSSYLPSLSDRLTQRDSILGLTHSTVAHSSLRIETSQAIYLLSQRGSLLGLSHSMVAHSSLRIETSQAIYLLSQRGSLLGLSHPMVAHSSLRIETSQAIYLLSQRDLLKLEDRNFSSYLSSLSERLSTWIDSLYGGSLKLEDKDFPNYLSSLSERLFLTLRSGFTLVLDG

SEQ ID NO: 91807 - protein, 68 aa, Glycine max
  Coding DNA Sequence Number=SeqID_122
MQSKLKDLELEANALIFVGGKVSVDILPLMKLLSFAVGVLPDHVPKHFKEGTNEKSKELSTVLTSSPI

SEQ ID NO: 91808 - protein, 286 aa, Glycine max
  Coding DNA Sequence Number=SeqID_123
  Gene Ontology: Mol. function=calmodulin binding; Cellular component =nucleus; Biological process=glucosinolate biosynthetic process
  Homolog annotation: Hit_ID=A5BAD4; Match level="QueryCoverage=91%, HitCoverage=84%, E-value=1e-61, Identity=43%"; Hit description =Putative uncharacterized protein
VRRNSAENRRWLSVRSYLCGDEFNSVLAENDSASVKSSEVTVSQSVNEDLLNDKGDTSCEETVENVTQNRTDSNSKKSLNEEEAAILIQSAFRGFLEDWDDSTVSSYVSKMRMQNRMEASTRRERALAYAFSQQLRICSKRRSPKFDRMESNMSWSWLERWMATRLPETSSVESHAMKQYDPSNGSHKFTIMTRFLDAAGEEKESCGSNEVPLHFDNYSINSREEKFSFKPHTPKTNFKARRTVSRRKTVPSYQFHEEQPKVRTQNLFISSHAIQAKHNIFMIMSQ

SEQ ID NO: 91809 - protein, 115 aa, Glycine max
  Coding DNA Sequence Number=SeqID_124
MAEYTKGMLVFGLGVLIVSMWCMKGTEASGDDDDGPTIHAVRREEPPEGCGSHHSEGGVEECTEEDDSLGLYGDIDDTFKAAVRKVASSFHHHDDDGHGDDSPDVAHNNVNVLGH

SEQ ID NO: 91810 - protein, 1102 aa, Glycine max
  Coding DNA Sequence Number=SeqID_125
  Gene Ontology: Mol. function=hydrolase activity, acting on ester bonds; Cellular component=chromosome, pericentric region; Biological process=cell division
  Homolog annotation: Hit_ID=A7PXB1; Match level="QueryCoverage=63%, HitCoverage=92%, E-value=0.0, Identity=65%"; Hit description =Chromosome chr12 scaffold_36, whole genome shotgun sequence
  Pfam annotation: Domain name=Dor1; Domain location=405-737; Score= -115.0; E_value=0.01; Accession=PF04124.3; Description=Dor1-like family
  Pfam annotation: Domain name=Lipase_GDSL; Domain location=36-348; Score=174.8; E_value=2.2e-49; Accession=PF00657.13; Description=GDSL- like LipaseAcylhydrolase
  Pfam annotation: Domain name=Zw10; Domain location=393-983; Score =606.2; E_value=3e-179; Accession=PF06248.4; Description =Centromerekinetochore Zw10
  Pfam module annotation: Pfam domain module=Dor1::Lipase_GDSL::Zw10; Domain location=405-737::36-348::393-983
MEKGQRKTTPLLLCSHIVVLHLLSLVAETSAKVSAVIVFGDSSVDAGNNNFIPTIARSNFQPYGRDFEGGKATGRFCNGRIPTDFISESFGLKPYVPAYLDPKYNISDFASGVTFASAATGYDNATSDVLSVIPLWKQLEYYKGYQKNLSAYLGESKAKDTIAEALHLMSLGTNDFLENYYTMPGRASQFTPQQYQNFLAGIAENFIRSLYGLGARKVSLGGLPPMGCLPLERTTSIAGGNDCVARYNNIALEFNNRLKNLTIKLNQELPGLKLVFSNPYYIMLSIIKRPQLYGFESTSVACCATGMFEMGYACSRGQMFSCTDASKYVFWDSFHPTEMTNSIVAKPGWVILSQAHQKQKSKRSHLATVNTPTQTHSKRTLAVSAVFATVPSPSMESLFGSINVRDLLSAQDLSDPNSPLSAPDLRLLIQRLESQSFQIRSQVQSYLVSHHEDFARLFSLCNDTVSQTREVSDDVSAILGLLSDHPIDAEVREIVSETKSKKEELKMKKELLGLVGTVVALNQRLESVREALKSGRFEFAAQGLKELKVALRIGDEDDREPLVYGLLRKEWSQCFEEIQEVLVNFMEKAVRFDGDLNQVEIKYHLEVENVNGIQLQTVLEAMDVVGILEYGLAKVADLMIKYVITPFVNHGRPLSFLEELHQELALLKIVPSPDSKFEYLDGEFLYSGILLFIKFIYRSICFQKSSWMRCFGRLTWPRISELIISSFLSKVVPTDASKLPDFQKIIACTSKFEMALKELMYISESDDKDNRLSNFAENVEVHFAFKKKTEILANARNLLLECDFSIPQEYTRDGSVWKSDETSAQSSSHVVDLLFLSQRCLVSKAAKQLMELVHQTLQDVCLSSTRVAFEFYHTARDAVLLYEVVVPVKLERQLNGINQVAILLHNDCLYLSQEILGFAFEYRTDFPSSMKEHAVFVDLAPRFQLLAEEILQRQVHLVIYNLKEAIDGADGFQNTHQMKQFESAKFSIDQVVFILEKVHIIWEPLLLPSTYRRSMCTVLESVFSRIARDILLLDDIAAEETLQLQRLIYLMLENLSSLFESLAPGEQNLHEFPAESLEDLIPSLRKIRKLSGMQRHLLNYFF

SEQ ID NO: 91811 - protein, 87 aa, Glycine max
  Coding DNA Sequence Number=SeqID_126
MMVQELDTPGHGGPEVLQPVIPPLLRAGGDRCSVKPASRCALQLHASVTQLGKLTHMSETYKEWFVLKPSRCGACLSHEVGVLYGGT

SEQ ID NO: 91812 - protein, 84 aa, Glycine max
  Coding DNA Sequence Number=SeqID_127
MENNDVGKSRRATSTIVMENSDNDEPEKKRPHLTFVSSRTPRNSINTPATNKTADPGVLQFQNQQLVQQIDIQKHALHDLEEKT

SEQ ID NO: 91813 - protein, 274 aa, Glycine max
  Coding DNA Sequence Number=SeqID_128
  Gene Ontology: Mol. function=oxidoreductase activity; Cellular component=cytoplasm; Biological process=ethylene biosynthetic process
  Homolog annotation: Hit_ID=O04076; Match level="QueryCoverage=99%, HitCoverage=99%, E-value=1e-111, Identity=67%"; Hit description=ACC -oxidase
  Pfam annotation: Domain name=2OG-FeII_Oxy; Domain location=117-217; Score=154.4; E_value=3.2e-43; Accession=PF03171.11; Description=2OG -Fe(II) oxygenase superfamily
MENFPVINLKNINGEERKTILEQIQDACQNWGFFELVNHGIPLELLDAVERTWIGRAHSSCANISEIPDLSQEYQDAMKEFAKKLEKLAEELLDLLCENLGLEKGYLKNAFYGSKGPNFGTKVANYPACPKPELVKGLRAHTDAGGIILLLQDDKVSGLQLLKDGQWVDVPPMRHSIVVNLGDQIEVITNGRYKSVEHRVIAQTNGTRMSVASFYNPASDAVIYPAPALLEKEAQETEQVYPKFVFEDYMKLYATLKFHPKEPRFQAMKAVNSF

SEQ ID NO: 91814 - protein, 1246 aa, Glycine max
  Coding DNA Sequence Number=SeqID_129
  Gene Ontology: Mol. function=transmembrane receptor activity; Cellular component=intrinsic to membrane; Biological process=innate immune response
  Homolog annotation: Hit_ID=A1Y1U0; Match level="QueryCoverage=86%, HitCoverage=99%, E-value=0.0, Identity=39%"; Hit description=CMR1
  Pfam annotation: Domain name=DUF423; Domain location=6-97; Score =24.2; E_value=1.1e-07; Accession=PF04241.6; Description=Protein of unknown function (DUF423)
  Pfam annotation: Domain name=LRR_1; Domain location=777-796; Score =2.0; E_value=1.3e+02; Accession=PF00560.24; Description=Leucine Rich Repeat
  Pfam annotation: Domain name=LRR_1; Domain location=800-821; Score =12.7; E_value=1.4; Accession=PF00560.24; Description=Leucine Rich Repeat
  Pfam annotation: Domain name=LRR_1; Domain location=824-846; Score =3.8; E_value=61; Accession=PF00560.24; Description=Leucine Rich Repeat
  Pfam annotation: Domain name=LRR_1; Domain location=848-870; Score =15.4; E_value=0.22; Accession=PF00560.24; Description=Leucine Rich Repeat
  Pfam annotation: Domain name=LRR_1; Domain location=872-896; Score =8.5; E_value=8; Accession=PF00560.24; Description=Leucine Rich Repeat
  Pfam annotation: Domain name=LRR_1; Domain location=940-963; Score =9.2; E_value=6.1; Accession=PF00560.24; Description=Leucine Rich Repeat
  Pfam annotation: Domain name=LRR_1; Domain location=965-987; Score =9.0; E_value=6.7; Accession=PF00560.24; Description=Leucine Rich Repeat
  Pfam annotation: Domain name=LRR_1; Domain location=989-1014; Score =10.0; E_value=4.2; Accession=PF00560.24; Description=Leucine Rich Repeat
  Pfam annotation: Domain name=NACHT; Domain location=336-489; Score= -7.1; E_value=0.00021; Accession=PF05729.3; Description=NACHT domain
  Pfam annotation: Domain name=NB-ARC; Domain location=298-593; Score =140.2; E_value=5.9e-39; Accession=PF00931.13; Description=NB-ARC domain
  Pfam annotation: Domain name=TIR; Domain location=139-273; Score =141.3; E_value=2.7e-39; Accession=PF01582.11; Description=TIR domain
  Pfam module annotation: Pfam domain module=DUF423::LRR_1::LRR_1::LRR _1::LRR_1::LRR_1::LRR_1::LRR_1::LRR_1::NACHT::NB-ARC::TIR; Domain location=6-97::777-796::800-821::824-846::848-870::872-896::940 -963::965-987::...
  Pfam module annotation: Domain location=989-1014::336-489::298 -593::139-273
MDPQLWHKVAAISGVAALGLGTYGAHVFKPQNPAYNDVWHTASLYHLVHTAALVAAPITKHPNVFGGLLTAGILAFSGTVSHCHIDVEDEEFISLSWLHVYKLGWVSQILSEVLGCERESFNMLRGESSSNSWRWTYHVFLSFRGEDTRLDFTDHLYAALVRKGIIAFRDDKQLEKGDAIAEELPKAIEESLGAIVILSENYASSSWCLDELNKILESNRVLGREVFPVFYGVSPGEVQHQKTQSFYEAFKKHERRSGKDTEKVQKWRDSLKELGQIPGWESKHYQHQTELIENIVESVWTKLRPKMPSFNDGLIGIGSRVKKMDSLLSIESEDVRFIGIWGMGGIGKTTVARVVFQKIKDQFDVSCFLDNVREISRETNGMLRLQTKLLSHLAIKGLEIIDLDEGKNTIINLLSEKKVLLVLDDVDDTSQLGNLAKRVEWFGRGSRVIITTRDTQVLISHGVVENYNIEFLNSDESLQLLSQKAFKRDEPLEHYLELSKVVAKHAGGLPLALELLGSFLCGRSEFQWREVVDMIKEVSASHIVMKSLRISYNGLPRCHKALFLDIACFFKGRVKELATQTLEICDRYPAVGIELLVEKSLATYDGFTIGMHDLLQETAREIVIEESHVDAGKRSRLWSLEDTNQVLKYSRENESIEGIALNSPEKDEANWDPEAFSRMYNLRLLIISFPIKLARGLKCLCSSLKFLQWNDFSLETLPLGVQLDELAFAKLKFIDLSYSEDLIQTPIVSGAPCLERMLLIGCINLVEVHPSVGQHKRLVVLCMKNCKNLQIMPRKLEMDSLEELILSGCSKVKKLPEFGKNMKSLSLLSVENCINLLCLPNSICNLKSLRKLNISGCSRLSTLPNGLNENESLEELDVSGTAIREITLSKVRLEKLKELSFGGRKELAPNSQNLLLWISKFMRQPNLKESTMPPLSSLLALVSLDLSYCDLNDESFPSHLGSLSLLQDLDLSGNNFVNPPAQCIINLSMLQNLSFNDCPRLESLPVLPPNLQGLYANNCPKLKPFNLDEEMLWKIYETQSRPEVWFIIPGNEIPCWFDNQNCLAIDSSHHPYDKLGCDSVTSITVDVPKDCQLSKWWGIAVCLVLEPSNMEEEDSSRSYVRPTSTGNEEMCIYYWVCKAPDRDPDPKFPIASKFGHLVYKLNDPYIHIIFLSADHATIKKCGCRVVCKEKIEEWRKHSDGLNISRLTEVNDDEEFRRELVVEEPTSPNTFSSTDKTAVNTALGKMI

SEQ ID NO: 91815 - protein, 44 aa, Glycine max
  Coding DNA Sequence Number=SeqID_130
MTRPDPERNTSVSGVRISFPPITFPVIVLRSRTRYGNPFSLFGS

SEQ ID NO: 91816 - protein, 214 aa, Glycine max
  Coding DNA Sequence Number=SeqID_131
MMQVEISLRFNQGTGESVLVSGEVGGAGGAYSYEALKRLDRLWSSICSSQEGSCHSMVLISFRKSNYSICLLCKNLCKLSGSSDLIDKEKGSYDVLAPNNEDLASHFRERLYTLEANMDGRTREMDKGRGDNGSLKFTRPHVEGARTSRLDEDMTKNKDKDSLEGLGGPMTRARARKAKETLQQVLSILFEYKPKFQGEKSKVVSCIMTQMEED

SEQ ID NO: 91817 - protein, 434 aa, Glycine max
  Coding DNA Sequence Number=SeqID_132
  Gene Ontology: Mol. function=lipid binding; Cellular component=Golgi apparatus; Biological process=Golgi organization and biogenesis
  Homolog annotation: Hit_ID=Q9AXJ6; Match level="QueryCoverage=100%, HitCoverage=100%, E-value=1e-139, Identity=65%"; Hit description =Phosphatase-like protein Psc923
  Pfam annotation: Domain name=SEP; Domain location=222-322; Score =107.6; E_value=3.7e-29; Accession=PF08059.4; Description=SEP domain
  Pfam annotation: Domain name=UBX; Domain location=355-434; Score =90.8; E_value=4.2e-24; Accession=PF00789.11; Description=UBX domain
  Pfam module annotation: Pfam domain module=SEP::UBX; Domain location =222-322::355-434
MEGEKENPDGNAALVNSFCEITSSSKEEALFFLESHNFDLDAAVSTFLDNANNPLIPLNDDLAIPNPNAVSPPSDSHSPDFNPSRSPSPSPSPTRTPYELRSRRSLGKKPSTSRQGKIRTLGDLKRPSRDDDDSGSDPDFEPDEYYTGGEKSGMLVRDPTRGNNNNNLDDIFDQARQVAVDAPPENPRSSSRSRSFSGTARLLSGETVPSAPQRVEEVTHTVIFWRNGFSVNDGPLRRLDDPQNAPFLEVVCHDFCFQKLLLKEKEKLEFKLCLYSIKKSECPKELEPADRRTAVHVNLTRRDEDYPEPVKPRQRAFQGVGRTLGSTSSSNDEPIQTTGASPNTAPMPTMGLVVDESQPVTSIQLRLADGTRMVSRFNHHHTIRDVRAFIDASRPGGVRSYQLQTMGFPPKQLTDLDQSIEQAGIANSVVIQKL

SEQ ID NO: 91818 - protein, 832 aa, Glycine max
  Coding DNA Sequence Number=SeqID_133
  Gene Ontology: Cellular component=integral to membrane; Biological process=morphogenesis of an epithelium
  Homolog annotation: Hit_ID=A7NUT8; Match level="QueryCoverage=100%, HitCoverage=82%, E-value=0.0, Identity=58%"; Hit description =Chromosome chr18 scaffold_1, whole genome shotgun sequence
MWKLNKSIAKELLPTQPVDFPIEPWWEVCLVNLTLEEFKKLSKEEMATIDKVCMEEANSFVMFDPDIVRGLCKRGLVYFDVPIYPQDRFKVFVVSNENVTVRDLATTLQADLSQLQAAAAFVCRLGWATKVVDPESIIGDSTILASPVASSTSDEDAFVAIQNYENTLFDNDSIQQGDASASGNHGPRSSYTRVAFIVDANITSYLMMGSVSPGLKSHAVTLYEAGKLGYGSIADLCKDLSTLEGATYEGELQEFANHLFSLRCVLECLQSGGIVTNIKEEGSSDKLSMITSSNDGPSSEIAESSWVDKSGDCSILEAVINNEDLINYDSEKLVEASIYTERVSSGIDDETRSITLEDGSDHIHEADKSNTKFDSNEKLEVFESADVKTEMLKRTKKYRVDLLRSESLASLAPATLDRLFLRDYGIVVSIVPLSHSSILPRPTGPVHFGPPTYSSMSPWMKLVLYSTAGSGPISVVLMKGQCLRLLPAPLAGCEKALIWSWDASTTGGLGRKLEGKLVKGSILLHYLNSLLKHSAVLVLPLSRCDLNEYGKLITLDIPLPLKNADGSIPSVGKELGLNEEEDSKLNSLLANLANKMKLWTVGYIRLLKLFNGGTKSDQFSSEEKYEWVPLSVEFGMPLFSPTLCNSICRRIVSSELLQCGSFGEHYDAMQNLRKKLHDICDGYQSTGPITKHLYQKDQAFGQPMDPASGRWNSLMDLSPFSDVLSVRQRLKLANRQHCQNEVLRCDGSFLRSYTLTPAHEAATEPIKESHEANTIKTEPEENDSKEAILPGVNLIFDGSRLLPFDIGTCLQARQPISLIIDAAAASTYAPFK

SEQ ID NO: 91819 - protein, 385 aa, Glycine max
  Coding DNA Sequence Number=SeqID_134
  Gene Ontology: Mol. function=protein serine/threonine kinase activity; Cellular component=integral to membrane; Biological process=protein amino acid phosphorylation
  Homolog annotation: Hit_ID=A5YJW6; Match level="QueryCoverage=94%, HitCoverage=58%, E-value=0.0, Identity=95%"; Hit description=NFR1a
  Pfam annotation: Domain name=LysM; Domain location=97-142; Score=7.8; E_value=0.098; Accession=PF01476.11; Description=LysM domain
MELKKGLLVFFLLLECVCYNVESKCVKGCDVAFASYYVSPDLSLENIARLMESSIEVIISFNEDNISNGYPLSFYRLNIPFPCDCIGGEFLGHVFEYSASAGDTYDSIAKVTYANLTTVELLRRFNGYDQNGIPANARVNVTVNCSCGNSQVSKDYGMFITYPLRPGNNLHDIANEARLDAQLLQRYNPGVNFSKESGTVFIPGRDQHGDYVPLYPRKTGLARGAAVGISIAGICSLLLLVICLYGKYFQKKEGEKTKLPTENSMAFSTQDGTVSGSAEYETSGSSGTASATGLTGIMVAKSMEFSYQELAKATNNFSLENKIGQGGFGAVYYAELRGEKTAIKKMDVQASTEFLCELKVLTHVHHFNLVQHPSNNPKHVYIWEG

SEQ ID NO: 91820 - protein, 218 aa, Glycine max
  Coding DNA Sequence Number=SeqID_135
  Homolog annotation: Hit_ID=A7QTC1; Match level="QueryCoverage=50%, HitCoverage=27%, E-value=5e-22, Identity=46%"; Hit description =Chromosome chr1 scaffold_166, whole genome shotgun sequence
SGFLRERKRLQCEGFFSQFRHDIEIPNGENARNCVANMILKFHDDPTVNGPMEEHKHRALIHFLKRCKKPIELIFHCMDQVVEELRDSYSPLDPIWMQETPSLYDSVPDDCAHHNDPVYGKPGKLYFMPYIKSDMLMLENQLPMRVVLHTLIEVETDTAQRLHVGASNEITSYVFFIGTVIDDGMDMAILHRKRDPDQRSPKISPWIVMENLKRYRGT

SEQ ID NO: 91821 - protein, 943 aa, Glycine max
  Coding DNA Sequence Number=SeqID_136
  Gene Ontology: Mol. function=ATPase activity; Cellular component =chromosome; Biological process=chromosome organization and biogenesis
  Homolog annotation: Hit_ID=A7QJS0; Match level="QueryCoverage=98%, HitCoverage=78%, E-value=0.0, Identity=58%"; Hit description =Chromosome undetermined scaffold_107, whole genome shotgun sequence
  Pfam annotation: Domain name=SMC_N; Domain location=6-943; Score= -63.8; E_value=5.6e-07; Accession=PF02463.10; Description=RecFRecNSMC N terminal domain
MKVEIKIEMKPLKVRIEDARAKVSDTSARKYNDVLDAHEKSKDLENTLKDVTKELQNFNKEKEVIEKRRTVALKKHTELELDVKDLQEKISGNTRAKEDAARQLEILEKEIQDSTAELGKIVPLHEDQVQKEKDIVKRKASRDKWLQKEIDDLERVHSSNKGQATQFGLAVDFWKLLVEAKEKPVTTQSQTQLNGTFYAAYFKMNWEQKLLDEIDRLKEELQDCDENINRRKSEITTLESLIAQSREGLNRYKEERDKLHGERNEECIHPKYRMRSLWGKENELTAEIDKLRAEVEKAEKSLDHAIPGDVRRGLNSVRKICREYNISGVHGPIIELLNCDEKFFTAVEVTAGNRVKGPRITYPQSSDVIPLLKKLNFKHDYTPAFSQTSFALHFRVVVGVVVIALLILKPKDDSFSHGWHELTKNMVSDGLGLKVICKNLDVASRVARSDGLDCITLDGDQVSKKGSMTGGFYDHRRSRLRFMNIIKQNADTIHIREEELEKIDQKINEIVAEQQKIDAKCAHDKSVIEQLKQDIANANKQKLLISKALTKKEKSVGDVQNQIEQLNASIAMKKAEMGTELIDHLTPEEKKLLSDLNPEIKDLKEKLVACKTDRIETEARRAELDTNLTTNLRRRKQELEAVISSADADSLVADAESKWQELSDAKILVDDAIGQLRSVTESINDRTRQIKKIKDELNKLKDEYERKLQEDAKELEQLQSKKNTYAAKEEEYAKKIRELGPLTSDAFEACNEQLQQFSHVNKKALDQYINFTEQREELQKRQAELDAGDEKIKELITVLDQRKDESIERTFKGVARHFREVFSELVLGGHGHLVMMKKKDGDHDDDEDEDGPREANPEGRVEKYIGVKVKARFVNLTRWDESIVVCIRMLEGETQSMKQLSGGQKTVVALTLIFAIQRCDPAPFYLFDEIDAALDPQYRTAVG

SEQ ID NO: 91822 - protein, 316 aa, Glycine max
  Coding DNA Sequence Number=SeqID_137
  Gene Ontology: Mol. function=ATPase activity; Cellular component =chromosome; Biological process=chromosome organization and biogenesis
  Homolog annotation: Hit_ID=A9U123; Match level="QueryCoverage=73%, HitCoverage=20%, E-value=1e-101, Identity=80%"; Hit description =Condensin complex component SMC3
  Pfam annotation: Domain name=SMC_N; Domain location=2-291; Score =101.6; E_value=2.4e-27; Accession=PF02463.10; Description =RecFRecNSMC N terminal domain
MYIKQVVIEGFKSYREQIATEPFSSKVNCVVGANGSGKTNFFHAIRFVLSDLFQNLRGEDRQALLHEGAGHQVLSAFVEIVFDNSDNRIPVDKEEVRLRRTIGFKKDEYFLDGKHITKTEVMNLLESAGFSRSNPYYVVQQGKIASLTLMKDSERLDLLKEIGGTRVYEERRRESNKRKQIIQVVQYLDERLKELDEEKEELRKYQQLDKQRKSLEYAIYSKEVQDAQQKLTEPSPKIKYCIFEQLVGIESFIREQYAVPMLKPSLIYFNLALSLSNVGFGFFPTPPLMPNTFELGVWIIWWVILLMDLGYALIPS

SEQ ID NO: 91823 - protein, 594 aa, Glycine max
  Coding DNA Sequence Number=SeqID_138
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q7XAS3; Match level="QueryCoverage=96%, HitCoverage=96%, E-value=0.0, Identity=71%"; Hit description=Beta-D -glucosidase
  Pfam annotation: Domain name=Glyco_hydro_3; Domain location=103-344; Score=301.8; E_value=1.3e-87; Accession=PF00933.12; Description =Glycosyl hydrolase family 3 N terminal domain
  Pfam annotation: Domain name=Glyco_hydro_3_C; Domain location=379 -591; Score=211.0; E_value=2.8e-60; Accession=PF01915.13; Description= Glycosyl hydrolase family 3 C terminal domain
  Pfam module annotation: Pfam domain module=Glyco_hydro_3::Glyco_hydro_ 3_C; Domain location=103-344::379-591
MGTTTTPLVLVLLFCCLVSVLQAEYLKYKDPKQPLNVRIKNLLKRMTLEEKIGQMVQIERSVATPQVMKKYFIGSVLSGGESVPATNASAETWIQMVNGIQNGSLSTRLGIPMIYGIDAVHGNNNVYKATIFPHNVGLGVTRQVNMDPVLIKKIGDATALEVRATGIQYVFAPCIAVCRDPRWGRCFESYSEDPKIAQAMTEIIPGLQGDISSNSRKGVPYVSGKNKVAACAKHYVGDGGTTKGINENNTVISYSELLRIHMPPYYDSIVKGVSTVMVSYSSWNGQKMHANHFLVTNYLKNKLKFRGFVISDWLGIDKITSPPHSNYSYSIQVGVGAGIDMIMVPFNFTEFIDVLTYQVKNNIIPEHRQIAREAVRKSLVLLKNGKSAEKPLLPLPKKAAKILVAGSHADNLGYQCGGWTITWQGLGGNNLTVGTTILEAVKQTIDPATKVVFNENPDSNFVKSNNFSCAIVVVGEHPYATTFGDSLNLTIPEPGPSTITNVCGSIQCVVVLITGRPVVIQPYLSKVDALVAAWLPGTEGQGVADLLFGDYGFTGKLARTWFKTVDQLPMNVGDKYYDPLFPFGFGLSTNPTKY

SEQ ID NO: 91824 - protein, 652 aa, Glycine max
  Coding DNA Sequence Number=SeqID_139
  Gene Ontology: Mol. function=magnesium ion binding; Cellular component=postsynaptic membrane; Biological process=Mo-molybdopterin cofactor biosynthetic process
  Homolog annotation: Hit_ID=A7PG87; Match level="QueryCoverage=99%, HitCoverage=98%, E-value=0.0, Identity=71%"; Hit description =Chromosome chr6 scaffold_15, whole genome shotgun sequence
  Pfam annotation: Domain name=MoCF_biosynth; Domain location=179-324; Score=127.1; E_value=5.1e-35; Accession=PF00994.15; Description =Probable molybdopterin binding domain
  Pfam annotation: Domain name=MoCF_biosynth; Domain location=456-604; Score=144.0; E_value=4.1e-40; Accession=PF00994.15; Description =Probable molybdopterin binding domain
  Pfam annotation: Domain name=MoeA_C; Domain location=337-415; Score =62.6; E_value=1.4e-15; Accession=PF03454.6; Description=MoeA C -terminal region (domain IV)
  Pfam annotation: Domain name=MoeA_N; Domain location=1-166; Score =232.8; E_value=7.8e-67; Accession=PF03453.8; Description=MoeA N -terminal region (domain I and II)
  Pfam module annotation: Pfam domain module=MoCF_biosynth::MoCF _biosynth::MoeA_C::MoeA_N; Domain location=179-324::456-604::337 -415::1-166
MISVIDALQTVLNASKRLPPLTVPLHDALGKVLAQDVRAPDPLPPYPASVKDGYAVVSADGPGEYPVVAESRAGDDALGLTLSPGTVAYVTTGGPIPDGADAVVQVENTEIVNNASDGTKRVRILLQTTKGNDIRPVGVDIKKDAVVLTSGERLGASEIGLLATVGVTMVKVYPTPTVAVLSTGDELVEPTTGHLNRGQIRDSNRAMLLAAAVQHQCKVLDFGIAKDDKEYQGRILDKAFASGIHILLTSGGVSMGDKDFIKPLLEKRGKVHFDKVCIKPGKPFTFAEIDFQSTESKILAFGLPGNPVSSLVCFHLFVVPAIRYLAGWTNPHHFRVQARLRQPIKTDPIRPEYHRASVIWTDNDGSGNPGFVAVSTGHQVSSRLLSMKSANALLEFPATGSVVSAGTAVSAIIISDLRPMACDENHKSSDSAFALPGIKSNKITTDSSGDAEVKVAILTVSDTVAMGAGPDRSGPRAVSVINSSSERLGGARVVATAVVPDDVAKIQDILRRWSDIEQMDLIITLGGTGFTSRDLTPEATKPLIEKETPGLLHVMMQESLKVTKSAMLSRSAAGIRGSTLIINMPGNPNAVAECMEALLPALKHGLKQLRGDKKEKHPRHVPHAEAVPADVWEQSYMLATGAGSDVSCSCCT

SEQ ID NO: 91825 - protein, 54 aa, Glycine max
  Coding DNA Sequence Number=SeqID_140
MKGLCQTREKNIINESSGKYCSSCTMCGKVLSNLGSNSRRIKEKRKSNVKNVKK

SEQ ID NO: 91826 - protein, 149 aa, Glycine max
  Coding DNA Sequence Number=SeqID_141
  Gene Ontology: Mol. function=protein binding; Cellular component =clathrin coat of trans-Golgi network vesicle; Biological process =intracellular protein transport
  Homolog annotation: Hit_ID=O23685; Match level="QueryCoverage=99%, HitCoverage=98%, E-value=8e-63, Identity=73%"; Hit description =Clathrin assembly protein AP19 homolog
  Pfam annotation: Domain name=Clat_adaptor_s; Domain location=1-129; Score=189.8; E_value=6.8e-54; Accession=PF01217.11; Description =Clathrin adaptor complex small chain
MIHFVLLISRQGKVRLAKWYSPYSQKERSKVIRELTGLIISRAPKLCNFVEWRGFKVVYKRYASLYFCICNDHEDNELETLAIIHHYVETLDRYFGSAYFILDEILLAGAMQETSKRTTLRLIGAQEDLVEAAKEEASSLSNIIAQATK

SEQ ID NO: 91827 - protein, 161 aa, Glycine max
  Coding DNA Sequence Number=SeqID_142
  Gene Ontology: Mol. function=exonuclease activity; Cellular component= intracellular
  Homolog annotation: Hit_ID=Q9ZVE0; Match level="QueryCoverage=59%, HitCoverage=36%, E-value=9e-15, Identity=46%"; Hit description =Oligoribonuclease
MEKLANSFSVLELDADDSHVPTTAGSSDKRVNADIDIVPGKSEKQNLENPVTSSCEYKLPLVWIDLEMTGLNIEVDRILEIACIITDGNLTKTVENLECEFEPNSTPKASSRGEGYPSLIYFNLALFIDDMGLEFFPIHPLKSRALLGLGAWITMVGDPLD

SEQ ID NO: 91828 - protein, 109 aa, Glycine max
  Coding DNA Sequence Number=SeqID_143
  Homolog annotation: Hit_ID=A7PXF9; Match level="QueryCoverage=88%, HitCoverage=17%, E-value=3e-19, Identity=53%"; Hit description =Chromosome chr12 scaffold_36, whole genome shotgun sequence
MWRVLAAVTRNLQSTRKSSKVADESMFESGNGVELFGHERGRRSQHGWGLVCSILQAPISILSCVSHPQVNNNGSDGIWVTTGEFSSQVSEMNHLMGILVNANCVALGF

SEQ ID NO: 91829 - protein, 357 aa, Glycine max
  Coding DNA Sequence Number=SeqID_144
  Gene Ontology: Mol. function=nickel ion binding; Cellular component =cytoplasm; Biological process=nitrogen compound metabolic process
  Homolog annotation: Hit_ID=Q8H1P4; Match level="QueryCoverage=61%, HitCoverage=91%, E-value=1e-113, Identity=94%"; Hit description =Urease accessory protein UreF
  Pfam annotation: Domain name=DnaJ_CXXCXGXG; Domain location=49-123; Score=-31.1; E_value=0.012; Accession=PF00684.10; Description=DnaJ central domain (4 repeats)
  Pfam annotation: Domain name=UreF; Domain location=166-304; Score= -58.6; E_value=0.09; Accession=PF01730.7; Description=UreF
  Pfam module annotation: Pfam domain module=DnaJ_CXXCXGXG::UreF; Domain location=49-123::166-304
  Subcellular localization annotation: CTP_CleavageSite=63; ConfidenceScore=5.47e-01
MGFGTLSLSVVVRFEATNFNGLPPSRSSNSLPHLSFTKPSWVVRTESNVRKKRRKKPDPHCVVCEGSGRVDCHQCHGKGRTNQVHLEMLPKGEWPKWCRTCGGSGLSYCSRCLGTGEYRDDGIWFKVLENVLVQQLYFQWQLLDSLLPTGGFAHSFGLEAAVQCHLVSDSNDLKTFVIHILENTGSLLLPFVYSASMLPNLETWHKLDKILDATLTNEVGRKASISQGSALMRVASAVFSEVPSLKTMRDTSLGLGTVSFHHAPVFGLICGALGFDKTSSQRAYMFITMRDVISAATRLNLIGPLGAALLQHQVAPNAEVILEKWMNRAVDEACQTMPLLDTVQGCHGYLFSRLFSS

SEQ ID NO: 91830 - protein, 86 aa, Glycine max
  Coding DNA Sequence Number=SeqID_145
  Gene Ontology: Mol. function=pantetheine-phosphate adenylyltransferase activity; Biological process=coenzyme A biosynthetic process
  Homolog annotation: Hit_ID=A7PQ67; Match level="QueryCoverage=61%, HitCoverage=30%, E-value=1e-16, Identity=79%"; Hit description =Chromosome chr18 scaffold_24, whole genome shotgun sequence
MAVHGDDDPVVMVVPNLSPPNTYEAVVNGGTFDRLHNGHRLFLTASAELARRRIVIGVCDGPMLAKKQNSIFMYAPTIIIVLQLQF

SEQ ID NO: 91831 - protein, 630 aa, Glycine max
  Coding DNA Sequence Number=SeqID_146
  Homolog annotation: Hit_ID=Q9FKM4; Match level="QueryCoverage=100%, HitCoverage=100%, E-value=0.0, Identity=67%"; Hit description =Arabidopsis thaliana genomic DNA, chromosome 5, P1 clone:MUA2
MSCLALSLQPANGSDILLQTREWFPPSRALGALSAFRHTRRAFASNKHSAPDDAYAAESIGDDPLAASSGQVIVGVESRYRVVYRLVNGIYVLGITVADHDNSVNVFECIHIVNQAVSVVVTACRGVDVTPEKLSRKYAEIYMALDIVLRGVSNIRLAAMLATMHGESIAKMVHSAIDTENKIRGAETWPSAEVHSLEHQAGIDAFTTATFELPPETLKAGDEVAASLAPAAPEPQEEPQQKQDESQVEKDPFAASDAINKPQELVEGFKKTKDPSSTDLTSALEGLDVTTLPPPEATQSTQINVEGFEGNYGGVEFGHEQASIGEAFEGFNDAWGGGLDPSEFVGPTKPNKPQGLGGVELLQTGPDAAPKAAAESGAGTPLENLLVKKTEMRGPEMYISEEISAEFRESLLTRVGLMGVVYLRTLPPKTAGDKETEFSFRIEGTEAVKRFVIQSSRVSSLGNGMFHVRTAASEEPIPIMKYSLVPSLTPLPLRVRLTKRHTGSLLSVMIQYASNPDLLVPLHDITFTLKLPVDPTLLKVSPKAVLNRTEREIKWVVPEIPLKGSPGRLRVRMPVDSNEDDEEIEVVGYVKFSERVTQSLSGVSIRPASDGKTDFYEVSHRLESGVYMCD

SEQ ID NO: 91832 - protein, 342 aa, Glycine max
  Coding DNA Sequence Number=SeqID_147
  Gene Ontology: Mol. function=[ribulose-bisphosphate carboxylase] -lysine N-methyltransferase activity; Cellular component=nucleus
  Homolog annotation: Hit_ID=A7Q6E8; Match level="QueryCoverage=92%, HitCoverage=61%, E-value=1e-101, Identity=51%"; Hit description =Chromosome chr11 scaffold_56, whole genome shotgun sequence
  Pfam annotation: Domain name=SET; Domain location=12-217; Score= -14.8; E_value=0.043; Accession=PF00856.19; Description=SET domain
MSYVHQTIMFFITDKCFYPIQYGVLKEIDGISSETILLLWSMKEKYNCDSKFKIYFDTLPEKFNTAAYLFNLFKTPSESSSTGLSFSIQAITMLDGTLLLEEIMQARQHLHAQYDELFPALCNNFPDIFPPELYTWEKFLWACELWYSNSMKIMYSDGKLRTCLIPLAGFLNHSLCPHVMHYGKVDPATNSLKFCLSRPCRSGEECCLSYGNFSSSHLITFYGFLPQGDNSYDVIPLDIDGSDVDSNEDIPVSNWTTHMLQGSLENELEVLENLKDIFDDMMENMGKIDLDDRENCSWDEKLAMDFKDLQRRIACSVSTSCHTGMDMLKNELCKCMAEDILG

SEQ ID NO: 91833 - protein, 260 aa, Glycine max
  Coding DNA Sequence Number=SeqID_148
  Homolog annotation: Hit_ID=Q9SUM1; Match level="QueryCoverage=88%, HitCoverage=88%, E-value=1e-18, Identity=33%"; Hit description =Putative uncharacterized protein F9N11.80
MEEEQAHIMKESDDVESQEEEEEREEALSLCDLPLNRNSRTPSLDDTSFKKILRPSSLPDHACEIFNGFSSSSSSDMCPADDIIFCGKLVPFKAEEPLKNFIVEEEKSPSRRRRSESLSSVTRSNSVSTCTGSRQLMMRNSKSLDHSRLRESSAPEVDRNSSTRSFVPAEAAAKKATKPRWYSLMFGTMKIPPEMELSDMKNRQVRRNPSATMFVATESGGKVAVNRSPGKVSWRILKALSCKDHSSVAVTTSFSLPQAS

SEQ ID NO: 91834 - protein, 1040 aa, Glycine max
  Coding DNA Sequence Number=SeqID_149
  Gene Ontology: Mol. function=transporter activity; Cellular component= membrane; Biological process=oligopeptide transport
  Homolog annotation: Hit_ID=Q9FRU2; Match level="QueryCoverage=98%, HitCoverage=99%, E-value=0.0, Identity=65%"; Hit description=Nitrate transporter NRT1-5
  Pfam annotation: Domain name=PTR2; Domain location=561-947; Score =215.9; E_value=9.8e-62; Accession=PF00854.12; Description=POT family
KATGPAPLTSLAQAVVVAIKKRRLNLSEYPLDSSLFAYVSPQSINSKLLHTSQFRFLDKAAIITPQDGINPDGSASDPWSLCSMQQVEELKCLLRVIPIWFAGIFFYIAIVQQNTMLVFQALQSDRRILSTNFKILAASYTIFQMLSLTIWLPIYDRILVPSLQRVTKKEGGITVLQRIGFGMFLSILCTMVSGVVEERRRTLALTNPIGLEPRKGAISSMSGLWLVPQLTLAGLSDAFAIVGQVEFFYKQFPENMKSLAASLFFCGLAGSSYLSSLLISIIHRATAKSSTGNWLPQDLNKGRLDYFYYIITALEVVNFGYFILCAKWYKYKGTGSSSSGDLQLDQHLERIIMNTVGERMTKRETSENDEEESLLKNENSGTDNESKINYRGWKVMPFIIGNEIFEKLGAIGTLSNLLVYLTTVFNLENITATNIINIFNGSTNFATLLGAFLSDAFFGRYKILAFCTVASFVNRTIPQSLNELKREQNRNRSGLGRVSADSGELRVHASCCLQLLNRVSSSSRRIRCQSATVKSDGEGILRETTTVKFECHCAVCASSRLAAIEKLHPPHCEESAICQGPTEGQMTFLKTGLGLLMVGAAGIRPCNLAFGADQFNPNTDSGKKGITSFFNWYFFTFTVAQMISLTIIVYIQSNVSWAVGLGIPSALMFVSSIIFFMGSKLYVKVKPSGSPITSIVQVIVVATKKRRLKLPEYQYPSLFNYVAPNVHQMVYLNRFLDKAAIVTPQDQINPNGSVTDPWNLCSMQQVEEVKCLLRVLPIWVSGILYFVVIVQQHTILVFQALLSDRRIGQSEFLIPGASYYVFLMISVAIWLPMYDRKVMPLLQRLTGKEGGITLLQRMGIGIFFSILSMLVSAKVEKHRRTLALINPLGVETRKGAISSMSGLWLIPQLSLAGLAEAFMSVAQVEFYYKQFPENMRSIAGSLYYCGHAGSSYLSSVLISVIHQITAKSETGNWLPEDLNKGRLDNFYSLIAALEIINLGYFVLCARWFRYKGTGSSSIELEKATKQSERSATNCVNDSNL

SEQ ID NO: 91835 - protein, 317 aa, Glycine max
  Coding DNA Sequence Number=SeqID_150
  Homolog annotation: Hit_ID=A7QI57; Match level="QueryCoverage=99%, HitCoverage=84%, E-value=4e-85, Identity=51%"; Hit description =Chromosome chr17 scaffold_101, whole genome shotgun sequence
MTLLEVIKDASVNSKPLDSPIDYPIVLNPDGILPNLKPEVEDESSSSLIKPLIGWQLSQTDAEIIDISKKFFIQLKAKLKNNNDLNKGEFIGSLNSYLENIRDKLGVVIEFDPSCSGYNRALIDKLGVFMGKDVAGLVLDGSVSLEIWEVVKALIVNGITEHSCYSNLITKLVEKKRSDLLCLCITHGFDLGSSEILTILRYFLSPSKDAYNSMVTVKKDWECQVLLAIEKANDSNLKKYLLTAKEASILLMMAYDGFSASEICLHYLFASSNINDVVLSPSFTKWLKKYERFPQAGPCPKASSVSEACEWVPKLED

SEQ ID NO: 91836 - protein, 600 aa, Glycine max
  Coding DNA Sequence Number=SeqID_151
  Gene Ontology: Mol. function=sequence-specific DNA binding; Cellular component=nucleus; Biological process=regulation of transcription, DNA-dependent
  Homolog annotation: Hit_ID=A7Q2T1; Match level="QueryCoverage=84%, HitCoverage=90%, E-value=2e-86, Identity=40%"; Hit description =Chromosome chr1 scaffold_46, whole genome shotgun sequence
  Pfam annotation: Domain name=WRKY; Domain location=246-306; Score =136.6; E_value=6.9e-38; Accession=PF03106.6; Description=WRKY DNA -binding domain
MEIASERSGDGSSGLKEENSVGDDDGRHKQEIIVEEPLVANTERSILEAGPSTSPNKKEDEVDDQLETAKAEMGVVREENQRLKMCLNKIMNEYRTLEMQFQDILKQQGTKKNVDKGKADSHEEILEESDLVSLCLGRVPTINARSDEKIKVSNKPLKDDEGFNNEELTLGLECKFETSKSGSTTEALPNNIPSPENSCEVPKEEGGESKEALKTMRDSTEDEVAQQNPTKKPRVCVRARCDTPTMNDGCQWRKYGQKISKGNPCPRAYYRCTIAPSCPVRKQVQRCADDKSILITTYEGTHNHSLPPTATAMASTTSAAASMLLSGSSTSNSNSASIPSATPTNLHGLNFYLSEGSKPRQLYLSNPALSSSPSHPTITLDLTTSHPAASSSSSSPFFRFNSNYNNNNQPRYPSSSSSLSFSSNNSSQIANAISWSNGFLNHNNRDILSSVNFGRQQQMENVYQSYMQKNNSNNNNNNTSLVPQADTISAATKVITADPTFQSALAAALSSFIGGGGVGNTRGSQGCNFGESLSLGQKMKWGEVFPVSEKGCASSFVNKTPVANTQTESLMFLPPSSLPFSSTTKSASASPADNSNTTIN

SEQ ID NO: 91837 - protein, 573 aa, Glycine max
  Coding DNA Sequence Number=SeqID_152
  Homolog annotation: Hit_ID=Q9M3Z1; Match level="QueryCoverage=55%, HitCoverage=99%, E-value=1e-127, Identity=74%"; Hit description =Putative uncharacterized protein
  Pfam annotation: Domain name=IQ; Domain location=15-35; Score=21.4; E_ value=0.0033; Accession=PF00612.18; Description=IQ calmodulin-binding motif
  Pfam annotation: Domain name=IQ; Domain location=41-61; Score=3.2; E _value=19; Accession=PF00612.18; Description=IQ calmodulin-binding motif
  Pfam module annotation: Pfam domain module=IQ::IQ; Domain location=15- 35::41-61
MGVSFMKARRAFRALKGIIRLQALIRGHLVRRQAVATLCSMYGIVKFQALVRGGIVRHSNVGSEIQEKCNILNPLDGKLVKPIAISMKITKLSANAFIRKLLTSSTRIMVLRLQYLPGDLNSLKFMGGYSHHPPNYCVNNLGHLLTSSTRIMVLQLQYVPGDPNSVLSWLERWSASHFWKPVPQPKKIRDTKSHRKHGNISVGDTHMSKSKRTNRKLPTASFDSVPVQAHPEFEKPKRNMRKIPSQSSDPPVQENPQSELEKIKRNLRKVHNPVVENAVPSEVESETPKDHLEKATVTSCLAVSEQEVISSNEKIKKEATLIVSSVPDIETTPRLSVSKEVLDSPSSYQVTVESKPLTEITTKDKNIHVSDEVKNEPIDLPEPICKDENSHLTNGDLSHKEDQIGSENQKPNGKASIVAKQERAENGIQNSPALPSYMAATESAKAKLKAQGSPRFGQDGSEKNNHTRRHSLPSSTNCKISSHSPRTLRQVQSGGKGGHRSDRTVSSSRDGNGKVIQAEWRRTYLGRQIDLRGFLLETNPQPGSDLKHFAMSVLLRGMAKDIFRQEEQRNRGV

SEQ ID NO: 91838 - protein, 640 aa, Glycine max
  Coding DNA Sequence Number=SeqID_153
  Gene Ontology: Mol. function=binding; Cellular component=nucleus; Biological process=thiamin biosynthetic process
  Homolog annotation: Hit_ID=A7PDM7; Match level="QueryCoverage=99%, HitCoverage=98%, E-value=0.0, Identity=65%"; Hit description =Chromosome chr17 scaffold_12, whole genome shotgun sequence
  Pfam annotation: Domain name=PPR; Domain location=170-204; Score =18.6; E_value=0.024; Accession=PF01535.11; Description=PPR repeat
  Pfam annotation: Domain name=PPR; Domain location=232-266; Score =38.3; E_value=2.7e-08; Accession=PF01535.11; Description=PPR repeat
  Pfam annotation: Domain name=PPR; Domain location=334-368; Score =49.4; E_value=1.2e-11; Accession=PF01535.11; Description=PPR repeat
  Pfam annotation: Domain name=PPR; Domain location=369-403; Score =13.4; E_value=0.2; Accession=PF01535.11; Description=PPR repeat
  Pfam annotation: Domain name=PPR; Domain location=405-439; Score =11.0; E_value=0.38; Accession=PF01535.11; Description=PPR repeat
  Pfam module annotation: Pfam domain module=PPR::PPR::PPR::PPR::PPR; Domain location=170-204::232-266::334-368::369-403::405-439
MEEAWVSLLSKCSSLKPTKQIHAQICKTGLHTDPLVFGKLLLHCAITISDALHYALRLFHHFPNPDTFMHNTLIRSLSLSQTPLSSLHPFIQLRRQPTLSPDSFTFAFALKAVANSRHLRPGIQLHSQAFRHGFDAHIFVGTTLISMYAECGDSGSARRVFDEMSEPNVVTWNAVLTAAFRCGDVEGAQDVFGCMPVRNLTSWNGMLAGYAKAGELGLARRVFYEMPLRDEVSWSTMIVGFAHNGCFDEAFGFFRELLREEIRTNEVSLTGVLSACAQAGAFEFGKILHGFVEKAGFLYVGSVNNALIDTYSKCGNVAMARLVFQNMPVARSIVSWTSIIAGLAMHGCGEEAIQLFHEMEESGVRPDGITFISLLYACSHSGLVEEGCGLFSKMKNLYGIEPAIEHYGCMVDLYGRAARLQKAYEFICEMPVSPNAIIWRTLLGACSIHGNIEMAELVKARLAEMDPDNSGDHVLLSNVYAVAGKWKDVSSIRRTMTEHSMKKTPGWSMIEIDKVIYGFVAGEKPNEVTEEAHEKLREIMLRLRTEAGYAPQLRSVLHDIEEEEKEDSVSKHSEKLAAAFGIAKLPKGRILRIVKNLRVCGDCHTVMKLISKVYQVEIIVRDRSRFHSFKDGFCSCRDYW

SEQ ID NO: 91839 - protein, 194 aa, Glycine max
  Coding DNA Sequence Number=SeqID_154
MVKTRSLGQALDRIIERALGRKVKGDVDEQRKIAHVAGNVEHVDHSYDEIHEQPEEAATDDVVADVEERTELKLSSHERKVEKFDRKCDYNPRRCDIVATSADYKGLPKLRGFSCDEIVLLLVELLEVSSEENLPPPLMAKPTTTTTITCRRTTENNAPPPKRTQERTTKFHGTPLTRTKVKKNNTRSRAEGKH

SEQ ID NO: 91840 - protein, 208 aa, Glycine max
  Coding DNA Sequence Number=SeqID_155
  Homolog annotation: Hit_ID=A7PDM0; Match level="QueryCoverage=79%, HitCoverage=75%, E-value=2e-45, Identity=53%"; Hit description =Chromosome chr17 scaffold_12, whole genome shotgun sequence
MAEATASEPEIVEPTTMAAADTAFDGVDSNQKRTRVDSDDEEDGVSKKRKVDEEEKEPSGPVKLGFKSFASSLEMFDYFYNLLHAWPPFQNLNQYEHMMLLELLKNGHTEPDTKIGGGICVFQVRKHPMWKSRCFFLVREGESVDDFSFHKCVDHILPLPEEMQVKPDANMALGGGKKHYRGKSGGGGTSGHGHGKKGGSKHFMCFMI

SEQ ID NO: 91841 - protein, 171 aa, Glycine max
  Coding DNA Sequence Number=SeqID_156
  Gene Ontology: Mol. function=endonuclease activity
  Homolog annotation: Hit_ID=A7PDL1; Match level="QueryCoverage=33%, HitCoverage=29%, E-value=3e-27, Identity=86%"; Hit description =Chromosome chr17 scaffold_12, whole genome shotgun sequence
  Subcellular localization annotation: CTP_CleavageSite=43; ConfidenceScore=5.83e-01
MNQMRGISGSGSSSREARRRKARSTSPVKDRSKTSSSKLTSSSSSSKRSTSPSATLLDVDDDVTSLFHDYPSPNPNPNPNPRSFPHSVKQKCWEKADKVKGRDPDRWRRDALGNTLFRKLVGCPGCLCHDYDHIIPYSKEKNILCTFICSAYFIYYISPDWCRNNSDSCPC

SEQ ID NO: 91842 - protein, 50 aa, Glycine max
  Coding DNA Sequence Number=SeqID_157
  Homolog annotation: Hit_ID=A7PDH7; Match level="QueryCoverage=60%, HitCoverage=17%, E-value=3e-08, Identity=83%"; Hit description =Chromosome chr17 scaffold_12, whole genome shotgun sequence
MAVYGDVKRPGNQCRCRTIAEKLGKFKPKDDTDALDEFELATPLLSSLYH

SEQ ID NO: 91843 - protein, 213 aa, Glycine max
  Coding DNA Sequence Number=SeqID_158
  Gene Ontology: Mol. function=molecular_function; Cellular component =nucleus; Biological process=biological_process
  Homolog annotation: Hit_ID=A7Q911; Match level="QueryCoverage=95%, HitCoverage=96%, E-value=2e-61, Identity=53%"; Hit description =Chromosome chr9 scaffold_65, whole genome shotgun sequence
  Pfam annotation: Domain name=DUF298; Domain location=104-207; Score =81.1; E_value=3.6e-21; Accession=PF03556.6; Description=Domain of unknown function (DUF298)
MPRPKRKAAPPITSSDVDSSLRTEPKKSTTKQFDRIDNLFESYANKSLGLIDPDGIEALCKDVHVDHTDVRMLILAWKLKAEKQGYFSKDEWRKGLKCLGADTLPKLRKAINGLKKEGIILSEEKQRSIDIETICELLNVVLRSEFPTQVNLLTEYLKIQNDYRALNIDHWRNFYRFFKEVSLIDLRSYDSSQAWPVILDNFVDWLKEKEEKI

SEQ ID NO: 91844 - protein, 339 aa, Glycine max
  Coding DNA Sequence Number=SeqID_159
MHFAYKVNIRNAEEFITVFYSAEKSTIRGVTDGIRADISSGTDYIVKDDLKELIDTTYTIKMHLLFRSSSLKNSTVKLPKQIVKVSERATYGGGPTWGRTRRCFELVAHVDSVAGEKINVPLAKDASHVVCVNFTCQGHAKGRCGGVLSWLRMWMTRAVSKGTKLEKEIYMYEDPIALSLSNSKSLYKIPFENIMLFLICHTDHWKNSGDVHPGRGFPPKRATTTPEAWPNQSSDAPKTELVWLRKELACRQGVGFLMEARWVVLDRSTMGVPNRGFASQKGGQMAAADSCDRRSCQKFKNISSKKERSFVRALECRNKVARRRAKQRDPPGIVDLCQE

SEQ ID NO: 91845 - protein, 737 aa, Glycine max
  Coding DNA Sequence Number=SeqID_160
  Gene Ontology: Mol. function=protein binding; Cellular component =integral to membrane; Biological process=phagocytosis, engulfment
  Homolog annotation: Hit_ID=A7QS13; Match level="QueryCoverage=89%, HitCoverage=100%, E-value=0.0, Identity=84%"; Hit description =Chromosome undetermined scaffold_155, whole genome shotgun sequence
  Pfam annotation: Domain name=EMP70; Domain location=134-695; Score =840.6; E_value=8.6e-250; Accession=PF02990.7; Description =Endomembrane protein 70
MKTVRGKEAYKFAVPGFNALVPPFRVYFPFFLTIINSRFPLLEEIVSCPQTHFPHRSSSLCPRHFPYLGLSDLMQNRPKMESFHRFRLWVFVFLCLMFQSGNGFYLPGSYPHKYGIGDELSVKVNSLTSIETEMPFSYYSLPFCKPEGGVKDSAENLGELLMGDRIENSPYKFKMYTNESEIFLCQVEKLSDDEFKILKKRIDEMYQVNLILDNLPAIRFTKKVEYFLRWTGYPVGIKIQDVYYMFNHLRFNVLVHKYEETNVARVMGTGDATEMIPTIGKEGSDKPGYMVVGFEVIPCSIMHNADSVKGLKMYNKYPSPIRCDPSTVAMPIKEGQPLTFTYEITFEESDIKWPSRWDAYLKMEGAKVHWFSILNSLMVITFLAGIVLVIFLRTVRRDLTRYEELDKEAQAQMNEELSGWKLVVGDVFRAPSNPALLCIMVGDGVQILGMAVVTILFAALGFMSPASRGTLITGMLFFYMILGVAAGYVAVRLWRTIGCGDQKGWSSVAWKAACFFPGIAFLILTTLNFLLWGSHSTGAIPFSLFVILILLWFCISVPLTLIGGLFGARAPHVEYPVRTNQIPREIPQQRYPSWLLVLGAGTLPFGTLFIELFFIMSSIWMGRVYYVFGFLLVVMILLVVVCAEVSLVLTYMHLCVEDWRWWWKSFFASGSVAIYIFLYSINYLVFDLKNLSGPVSATLYLGYSLFMVLAIMLATGTVGFLSSFWFVYYLFSSVKLD

SEQ ID NO: 91846 - protein, 41 aa, Glycine max
  Coding DNA Sequence Number=SeqID_161
MEKEEMTRKDTEVAVGGHRKERFIGKGSAFSEGCWIKLVIQ

SEQ ID NO: 91847 - protein, 474 aa, Glycine max
  Coding DNA Sequence Number=SeqID_162
  Gene Ontology: Mol. function=phosphoprotein phosphatase activity; Biological process=intracellular signaling cascade
  Homolog annotation: Hit_ID=A7R8Y3; Match level="QueryCoverage=33%, HitCoverage=59%, E-value=6e-16, Identity=28%"; Hit description =Chromosome undetermined scaffold_3090, whole genome shotgun sequence
  Subcellular localization annotation: CTP_CleavageSite=45; ConfidenceScore=5.32e-01
MGCASSVGDFVHGRHVSNGDMSLLSALSASSAVKSRQPVQVQRLRAAASTTDYKVKSIGGMCILIQMWAWERCTTLAPKRTPPIIDNKPLGHRWLRRGNQHIGNDDLRVFRRKLDLMKQHEFVWEPYTATVMAALPPICVVGSVAWFAVVPLICFHVLSGTNPIEFYDNLDCNNLFPAEFRVDVYPRQEGLLGFNSDYMVWYRRKTKMFVDPKNANTAALGEVVETLQYMVSPQGRNTWTVDNLVPYVDKLAIISEEQERIIEPVSHGPASEREFPAQEFHILQSSVETRGIGRRREPMYQYPFASHHTDTFETSHSFGGVAETQPHFSWSTMTPSQSFLQRLSKQKRGDNAATEEILIVKREDGIDHVAHPHDITDTIMTDFHVFVLRLGLGVRFYGIGLGFMEYGVRLYVLGLGLGVRLYGLGLGLGVRLYGLGLGFMEYGKVLGLGWMGLGVEIMGLGFGLGLEIRGLGIR

SEQ ID NO: 91848 - protein, 53 aa, Glycine max
  Coding DNA Sequence Number=SeqID_163
MEVEAACNTALVSIEGARIAKERFLEVFLKEFFDGCSIWVNSCKSTSSHRKEL

SEQ ID NO: 91849 - protein, 176 aa, Glycine max
  Coding DNA Sequence Number=SeqID_164
  Homolog annotation: Hit_ID=A7QS36; Match level="QueryCoverage=44%, HitCoverage=36%, E-value=1e-11, Identity=43%"; Hit description =Chromosome undetermined scaffold_155, whole genome shotgun sequence
  Subcellular localization annotation: CTP_CleavageSite=21; ConfidenceScore=5.42e-01
MKSQPSRTCMCSPTNHPGSFRCSMHKKPPLAAAVPSKWESSPMAAKANSLKATLLQMIKPSSHDHHKRKTFQPKPTRFSLMNNGNAAVVAAENAIATGGKAQPAIASGGKAGERGACRQKGWRDWQCSGSRPGCWRDSHVSAGLAQGAGETAMSRELFRLAGLVSALHCIGMQHRV

SEQ ID NO: 91850 - protein, 309 aa, Glycine max
  Coding DNA Sequence Number=SeqID_165
  Gene Ontology: Mol. function=adenylate cyclase activity; Biological process=cAMP biosynthetic process
  Homolog annotation: Hit_ID=A7QTL3; Match level="QueryCoverage=64%, HitCoverage=88%, E-value=5e-76, Identity=71%"; Hit description =Chromosome chr11 scaffold_170, whole genome shotgun sequence
  Pfam annotation: Domain name=CYTH; Domain location=94-290; Score =54.2; E_value=4.5e-13; Accession=PF01928.12; Description=CYTH domain
MTKEKENKDVWLETKDEGSNLHGWIGKSGVNSLRIIRLAAATPPPLPPPPPPPLAPLLSSVSWIAAAKIPLPRPIASASPRKTLTALSLLSSPMEVEVKLRLADANAHRHVTTLLSPFHVITHRQQNLFFDGAASELSARRAVLRLRFYGDDERCVASLKARAVLVDGVSRVEEDEEDLDPSIGRECVAEPAKLGSVESRVLKRVQEEFGTEKGLVGLGGFGNLRSVYDWKGLKLEVDETSFDFGTLYEIECESSDPERAKRLLEEFLKENEINYSYSTASKFAIFRSGKLPYHCRQVPTVFASLHYEL

SEQ ID NO: 91851 - protein, 38 aa, Glycine max
  Coding DNA Sequence Number=SeqID_166
MEEEPFDGVLLSSMEFLKIQWCNVATARAKVMREINLI

SEQ ID NO: 91852 - protein, 390 aa, Glycine max
  Coding DNA Sequence Number=SeqID_167
  Gene Ontology: Mol. function=binding
  Homolog annotation: Hit_ID=Q402G4; Match level="QueryCoverage=89%, HitCoverage=95%, E-value=1e-177, Identity=94%"; Hit description =Putative uncharacterized protein GmTDF-5
MEEEESEKSPQLVRVLEALKEATHDIQRHHSSDSPAIKALLELHSILSSSDPYLSALSDHLIRLKTLVHSLNHSNGLLSFLTRPLSTLSLSRLASQIESEIQSWIDRETLHTLSSSLRNPNNNHEFVSLLTQSIYRVSQGFNRELQDLVLKLKLFSSLESVLFDDKCSIPVREQAGLAVSALIRFNKDVFVGQVLMGPTVRALVSMGSVLSLEVLCSLIRSIRSPLVDEIESNGEIPNIIAMLNSEDLELRVVALGCALEIGYFGRKEAVEAMMKEGLVEKLVELQRSEKGGDLIEIGREKVSGVLERKPFASCVARFAVQLEVGEGLRQREKRAFKPEILIRVRDASVSEAEAATIAAEILLDRGNRDYEENYMDAEYAEEKSAEESRF

SEQ ID NO: 91853 - protein, 257 aa, Glycine max
  Coding DNA Sequence Number=SeqID_168
  Gene Ontology: Mol. function=transferase activity; Cellular component= membrane; Biological process=metabolic process
  Homolog annotation: Hit_ID=A4Q7M8; Match level="QueryCoverage=96%, HitCoverage=40%, E-value=1e-114, Identity=75%"; Hit description =Exostosin-like
  Pfam annotation: Domain name=Exostosin; Domain location=7-256; Score =57.2; E_value=5.8e-14; Accession=PF03016.6; Description=Exostosin family
MVKRFKVWVYQEGEQPLVHDGPVNNIYAIEGQFMDEIDNNDKWSQFRARHPEEAHVFFLPFSIANVVHYVYKPILKQSDYEPVRLQLLVEDYISVIEDKYPYWNRSKGADHFLLSCHDWAPKVSNGNPELFQSFIRALCNANTSEGFHPNRDVSIPEVYLPVGKLGPPSLGQHPNSRTILAFFAGGVHGEIRKILLKHWKDKDNEVRVHEYLPKSQNYTKLMGQSKFCLCPSGHEVASPRVVEAIHAGNYLTRTEIP

SEQ ID NO: 91854 - protein, 154 aa, Glycine max
  Coding DNA Sequence Number=SeqID_169
  Gene Ontology: Mol. function=protein binding; Cellular component =integral to membrane; Biological process=vesicle-mediated transport
  Homolog annotation: Hit_ID=A4Q7K9; Match level="QueryCoverage=91%, HitCoverage=62%, E-value=2e-62, Identity=83%"; Hit description =Longin-like
MGILYGMVARGQVILAEFSATQSNASVVAKQILSKINQGSDDTNNDSNVSFSHDRYVFHVKRTDGLTVLCMADDAFGRMIPFAFLEDIHKKFVKTYGRAILSAPAYAMNDEFSRVLNQQMEYYSNDPNADRLNRLKGEMTQASSKYTHLDLSTL

SEQ ID NO: 91855 - protein, 308 aa, Glycine max
  Coding DNA Sequence Number=SeqID_170
MSDAQRNNDPIMFDTQPSSEIVMPETQPSNETLVHEAQNINDVVMSEALPENELVNSTADPNNHLSHPESFSHDHQYTNLHMIPELESLPNSDPLPSSEPMQDIHLTDIKPLPHNHLAQYDTLPNNHHMDHSEAVSNHQLTHFETLSNEQLANSHLLPDYDGLQNSETLHDHPIVNSQPLYEIVNASNIPNYGIGQVRIRHALHWGKVCALNHELSKEQLGKLESTPFSLMLTRMDNKNIRVSNLLLFELLEARKSVVSNSRHVDHFLLKKSHLYLACQVQARDNEIPPGVAMVGKDLLYGQGLEVKI

SEQ ID NO: 91856 - protein, 1249 aa, Glycine max
  Coding DNA Sequence Number=SeqID_171
  Gene Ontology: Mol. function=protein binding; Cellular component =intracellular; Biological process=primary shoot apical meristem specification
  Homolog annotation: Hit_ID=A7PF76; Match level="QueryCoverage=90%, HitCoverage=100%, E-value=0.0, Identity=80%"; Hit description =Chromosome chr11 scaffold_13, whole genome shotgun sequence
  Pfam annotation: Domain name=LisH; Domain location=121-147; Score =19.0; E_value=0.009; Accession=PF08513.2; Description=LisH
  Pfam annotation: Domain name=WD40; Domain location=1033-1071; Score =34.0; E_value=5.3e-07; Accession=PF00400.23; Description=WD domain, G-beta repeat
  Pfam annotation: Domain name=WD40; Domain location=463-501; Score =6.9; E_value=4.5; Accession=PF00400.23; Description=WD domain, G -beta repeat
  Pfam annotation: Domain name=WD40; Domain location=524-562; Score =6.7; E_value=4.8; Accession=PF00400.23; Description=WD domain, G -beta repeat
  Pfam annotation: Domain name=WD40; Domain location=569-609; Score =29.4; E_value=1.4e-05; Accession=PF00400.23; Description=WD domain, G-beta repeat
  Pfam annotation: Domain name=WD40; Domain location=613-653; Score =26.6; E_value=9.5e-05; Accession=PF00400.23; Description=WD domain, G-beta repeat
  Pfam annotation: Domain name=WD40; Domain location=703-742; Score =8.5; E_value=2.8; Accession=PF00400.23; Description=WD domain, G -beta repeat
  Pfam annotation: Domain name=WD40; Domain location=949-986; Score =11.5; E_value=1.2; Accession=PF00400.23; Description=WD domain, G -beta repeat
  Pfam annotation: Domain name=WD40; Domain location=990-1029; Score =9.2; E_value=2.3; Accession=PF00400.23; Description=WD domain, G -beta repeat
  Pfam module annotation: Pfam domain module=LisH::WD40::WD40::WD40::WD4 0::WD40::WD40::WD40::WD40; Domain location=121-147::1033-1071::463 -501::524-562::569-609::613-653::703-742::949-986::990-1029
MIPSHLVLFKLSDDTIISSLTTILLFSLYLRFLFLLLVLLLQIPSPLLLYKYSARRALTQEKARERKWSEKNTETLPRHSCSAPSLSICVRDSLAGIVDLFGSRSFRAAFVDGTVMSSLSRELVFLILQFLDEEKFKETVHKLEQESGFFFNMRYFEDMVTNGEWDEVEKYLSGFTKVDDNRYSMKIFFEIRKQKYLEALDKQDRAKAVDILVKDLKVFAAFNEELFKEITQLLTLDNFRHNEQLSKYGDTKSARGIMLAELKKLIEANPLFRDKLQFPTLKNSRLRTLINQSLNWQHQLCKNPRPNPDIKTLFVDHSCGQVQPNGARAPSPVTNPLMGAVPKAGGFPPLGAHGPFQPTPAALPTSLAGWMANPSPVPHPSASAGPIGLAAANNAAILKRPRTPPSNNPAMDYQTADSDHVLKRTRPFGLSDEVSNLPVNLLPVAYSGQSHGQSSYSSDDLPKTVVMTLNQGSIVKSMDFHPLQQILLLVGTNMGDVMVWDIGSRERIAQRNFKVWELGACSVALQASLSNDYSASINRVVWSPDGTLCSVAYSKHIVHIYSYHGGDDLRNHLEIEAHAGSVNDLAFSYPNKQLCVVTCGEDRVIKVWDAVTGAKQYTFEGHEAPVYSVCPHHKESIQFIFSTATDGKIKAWLYDNMGSRVDYDAPGHSSTTMAYSADGTRLFSCGTNKEGESFLVEWNESEGAVKRTYHGLGKRSVGVVQFDTTKNRFLAAGDEFTIKFWDMDNTNMLTSVEAEGGLLASPCIRFNKDGILLAVSTNDNGVKILANAEGIRLLRTVENRTFDASRVASAAVVKAPTIGAFPSTNVTVGTSLADRAPPVAAMVGINNDTRNLADVKPRIVDESVEKSRIWKLTEINEPSQCRSLKLPDSLSSMRVSRLIYTNQGVAILALAANAVHKLWKWQRNERNTTGKATASIQPQLWQPSSGILMTNDISDTNPEDAVSCFALSKNDSYVMSASGGKISLFNMMTFKTMTTFMPPPPAATFLAFHPQDNNIIAIGMEDSSIQIYNVRVDEVKTKLKGHQKRITGLAFSHVLNVLVSSGADSQLCVWSTDGWEKQASKFLQMPSGRPPAPLADTRVQFHLDQTHLLAVHETQIALYEAPKLECIKQFSPREANPITHATYSCDSQSIYVSFEDGSIGILTVPALRLRCRINQSAYLHPNPSLRVHPLVIAAHPSEPNQFALGLTDGGVHVLEPLEAEGKWGTPPPNENGAGPSTASGAAVSEQPQR

SEQ ID NO: 91857 - protein, 393 aa, Glycine max
  Coding DNA Sequence Number=SeqID_172
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q4ZGK1; Match level="QueryCoverage=92%, HitCoverage=96%, E-value=1e-146, Identity=71%"; Hit description=Beta- 1,3-glucanase 1
  Pfam annotation: Domain name=Glyco_hydro_17; Domain location=58-377; Score=380.9; E_value=2e-111; Accession=PF00332.9; Description =Glycosyl hydrolases family 17
  Subcellular localization annotation: CTP_CleavageSite=52; ConfidenceScore=5.00e-01
MACLRRKKHCVQGQQRVSFSNFDHPRQSNMYLILRFFCPFSILFFTPIASVQAFTGTYGINYGRIANNIPSPDEVVTLLRAEKIRNVRIYDADHSVLKAFSGTGLEIVVGLPNGQLQDMSSNPDHALNWVKENVQSFLPDTRIRGIAVGNEVLGGGDYSLWGVLLGAVKNIYNATVKLHLDQLVQISTANSFAVFSQSYPPSSGKFDDNVNQFMKPLLEFFQQIGSPFCVNAYPFLVYASDPEHIDINYALFEPTKGIYDPTYRLHYDNMLDAQIDAAYAALEDAGFDKMEVIITETGWASNGDQTEAGANATNARTYNYNLRRRLAKRKGTPHRPKNVVKAYIFALFNENEKPGHSSEKNYGLFKADGSISYDIGFHGLNAGHSSLLSLKVP

SEQ ID NO: 91858 - protein, 180 aa, Glycine max
  Coding DNA Sequence Number=SeqID_173
  Homolog annotation: Hit_ID=A9PGA0; Match level="QueryCoverage=82%, HitCoverage=81%, E-value=2e-35, Identity=54%"; Hit description =Putative uncharacterized protein
MNSGCFGCCVKPTPIIAVDEPAKGLRIQGQTVRKPHISDGFWSSSTCDLDNSNIQSQRSISSVSTSNQILYHSGGTSTPGANPEFVNPGKFYIGLLLWNESRLQWVGSGKSRKHGQQKREPRLNWNATYESLLGTRQPFPKPIPLSKLLLFKAVTMHLYESGPCLDCHFLGSLHDVAGGS

SEQ ID NO: 91859 - protein, 133 aa, Glycine max
  Coding DNA Sequence Number=SeqID_174
  Homolog annotation: Hit_ID=A7PF34; Match level="QueryCoverage=78%, HitCoverage=50%, E-value=3e-48, Identity=84%"; Hit description =Chromosome chr11 scaffold_13, whole genome shotgun sequence
MASSLLSVHHFLPSQTWKEGEIYKFPNGSKLYYQTTRVTFVFDDEALEVKIGEQLQESGENAFVGGKKCWKYSTFVNWEFWWPNFPILVYFKETQTKPEGQIHCFPIIFNGKQLYDVMVERAGPSKTSGPKES

SEQ ID NO: 91860 - protein, 151 aa, Glycine max
  Coding DNA Sequence Number=SeqID_175
  Gene Ontology: Mol. function=protein serine/threonine kinase activity; Biological process=protein amino acid phosphorylation
  Homolog annotation: Hit_ID=A7QBA4; Match level="QueryCoverage=94%, HitCoverage=19%, E-value=7e-30, Identity=48%"; Hit description =Chromosome chr4 scaffold_73, whole genome shotgun sequence
  Pfam annotation: Domain name=B_lectin; Domain location=55-151; Score =19.7; E_value=3.7e-05; Accession=PF01453.15; Description=D-mannose binding lectin
MDIIDITITFLLLMSAGTRVETQPPKQQQIQAGASLLPNITPAWWPSHSGQIALGSYTHGARQWRDDPPVTSNAKLQPTMDDKLVLIDGQGEKKVIARNASAKASFASMHDSGNFVLYNNNSSIIWQSFDYPTDTLLGSQSLPNGNQLASS

SEQ ID NO: 91861 - protein, 193 aa, Glycine max
  Coding DNA Sequence Number=SeqID_176
  Gene Ontology: Mol. function=zinc ion binding; Cellular component =intracellular
  Homolog annotation: Hit_ID=A7P7R9; Match level="QueryCoverage=57%, HitCoverage=84%, E-value=7e-23, Identity=40%"; Hit description =Chromosome chr9 scaffold_7, whole genome shotgun sequence
  Pfam annotation: Domain name=zf-RanBP; Domain location=104-132; Score= 28.8; E_value=2e-05; Accession=PF00641.9; Description=Zn-finger in Ran binding protein and others
  Pfam annotation: Domain name=zf-RanBP; Domain location=60-89; Score =20.6; E_value=0.0029; Accession=PF00641.9; Description=Zn-finger in Ran binding protein and others
  Pfam module annotation: Pfam domain module=zf-RanBP::zf-RanBP; Domain location=104-132::60-89
MVLSAAPVKKIAKVYKKSSVHVSATCTYSPYLVAPRIDGTKNSYNSKIQVWILIRKMSWSGGDWMCGVCEHINFKKREACQSCGYPKYGGPDPSTYRYNRTEALAGDWFCNCGAHNFASRSNCFRCGSMKDDYSSGYGNNSGGYGSDTFPPGWKTGDWLCPRSFSHYHHIFSTHNSVSILSYIIITFSAASVQ

SEQ ID NO: 91862 - protein, 278 aa, Glycine max
  Coding DNA Sequence Number=SeqID_177
  Gene Ontology: Mol. function=binding; Cellular component=nucleus; Biological process=activation of protein kinase C
  Homolog annotation: Hit_ID=A7P2H4; Match level="QueryCoverage=100%, HitCoverage=59%, E-value=1e-115, Identity=59%"; Hit description =Chromosome chr1 scaffold_5, whole genome shotgun sequence
MISELAMNGHAERALGLFKEMINEGFQPDDITFVGVLSACTQAGLVDLGHRYFSSMNKDYGISPKLQHYGCMIDLLARSGKFDEAKVLMGNMEMEPDGAIWGSLLNARRVHGQVEFGEYVAERLFELEPENSGAFVLLSNIYAGAGRWDDIDGIVHEFLVGDKFHPQSENIFRLLDEVDRLLEETGFVPDTSEVLYDMDEEWKEGALNQHSEKLAIAFGLISTKPGTTIRIVKNLRVCPNCHSATKLISKIFNREIIARDRNRFHHFKDGFCSCNDCW

SEQ ID NO: 91863 - protein, 404 aa, Glycine max
  Coding DNA Sequence Number=SeqID_178
  Gene Ontology: Mol. function=RNA binding
  Homolog annotation: Hit_ID=A7P5N7; Match level="QueryCoverage=98%, HitCoverage=98%, E-value=4e-79, Identity=44%"; Hit description =Chromosome chr4 scaffold_6, whole genome shotgun sequence
  Pfam annotation: Domain name=Agenet; Domain location=3-67; Score =62.3; E_value=1.7e-15; Accession=PF05641.3; Description=Agenet domain
  Pfam annotation: Domain name=Agenet; Domain location=72-132; Score =1.4; E_value=0.17; Accession=PF05641.3; Description=Agenet domain
  Pfam annotation: Domain name=ENT; Domain location=340-400; Score =24.4; E_value=0.00042; Accession=PF03735.5; Description=ENT domain
  Pfam module annotation: Pfam domain module=Agenet::Agenet::ENT; Domain location=3-67::72-132::340-400
MKFKKGNKVEVLSKVEVPCGSWLCAEIICSNGHHYTVKYDGYESDAGEAIVERVSRKDLRPCPPALELTDNWSPGDVVEIFQNFSWKMATVLKILGKNHILVRLLGSSLEFQVSKFDIRVRQSWQDDKWIIVGKGSSSCENRKRSSTQLQKTSTKTKLSGSAYYRPEKKKLSILESELIYFKTLKRGSNSQVEAYAEPPPKFRALENEGRCHRARVRNPPTPLKQVQGVSFPRDVIAEECIPASVNNRKTGISNMIDMERRKETGTVGCSFGENRESNHADSITCSVGSCSITSRNSCKLQFPVSAGPFDDVDSSFSDAESVCQRSDEEGDCSPPTQEELAAEIHRLELHAYRCTIEALHASGPLSWEQEALMTNLRLSLHISNDEHLMELRNLISSENSIPLR

SEQ ID NO: 91864 - protein, 109 aa, Glycine max
  Coding DNA Sequence Number=SeqID_179
RSPSESPESNRAPPPATAGPIPIAGEPPPPAAGTGYGGDGVESAETALRRLLHGGEGEAAPDDDQQVFSRHHVSLRDRFSTGLRLQGSLRSVTLEQFTNSSLVYFADCL

SEQ ID NO: 91865 - protein, 22 aa, Glycine max
  Coding DNA Sequence Number=SeqID_180
MEERLWDRTSLGWNEVEAIRKQ

SEQ ID NO: 91866 - protein, 472 aa, Glycine max
  Coding DNA Sequence Number=SeqID_181
  Gene Ontology: Mol. function=kinase activity; Cellular component =mitochondrion; Biological process=carbohydrate metabolic process
  Homolog annotation: Hit_ID=Q67Y17; Match level="QueryCoverage=94%, HitCoverage=79%, E-value=0.0, Identity=70%"; Hit description=MRNA, complete cds, clone: RAFL25-18-P16
  Pfam annotation: Domain name=FGGY_N; Domain location=15-275; Score =11.6; E_value=9.1e-11; Accession=PF00370.12; Description=FGGY family of carbohydrate kinases,
MAASSSSPDEPSRSVFLGVDVGTGSARAGLFDEEGKLLGSSSSSIQIWKDGACVEQSSTDIWLAVCAAVKAACSKAEVAPTEVKGMGFAATCSLVAVDSDSSPVSVSWSGDSRRNVIVWMDHRAVEQAERINSSKSPVLEYCGGAVSPEMEPPKLLWVKENLQESWSMVFRWMDLSDWLSYRATGDDTRSLCTTVCKWTYLGHAHMQHVNDKESRDMEACGWDDDFWEEIGLGDLIEGHHAKIGIHLINIGLELGLVPGIPVGTSLIDAHAGGVGVIESVPPSEAEEHDMEAICNRMVLVCGTSTCHMAVSRSKLFIPGVWGPFWSAMVPEYWLTEGGQSATGALLDHIIENHAASARLANQAATQKISLFELLNKMLETMIVELNLSFIAALTEDVHVLPDFHGNRSPIADPKAKGVIYGLTLDTSDKQLALLYLATVQGIAYGTRHIVEHCNAHGHKVRICQKYVAHWLY

SEQ ID NO: 91867 - protein, 53 aa, Glycine max
  Coding DNA Sequence Number=SeqID_182
MRGFNLSLSWETLHLLGLIGREEEQYRWRWRKEMSPKGEISLKFTHVTIDSLT

SEQ ID NO: 91868 - protein, 68 aa, Glycine max
  Coding DNA Sequence Number=SeqID_183
MLVRGAELWKNASNAAFLRFLAFCWPFAHMFFPALSPDSVDNRITAFDWHDRFPDWKAGSERNAINVS

SEQ ID NO: 91869 - protein, 96 aa, Glycine max
  Coding DNA Sequence Number=SeqID_184
  Gene Ontology: Mol. function=catalytic activity
  Homolog annotation: Hit_ID=A7R313; Match level="QueryCoverage=94%, HitCoverage=28%, E-value=2e-38, Identity=78%"; Hit description =Chromosome undetermined scaffold_470, whole genome shotgun sequence
MWWSGFMKRSYDKGITWTEREQLPPGILGPIKNKPLLLENGDILCGSSVESWKSWGAWAEVTTDFSGTWRKYGPIYIENRPLGVIQPVPYHTACFA

SEQ ID NO: 91870 - protein, 352 aa, Glycine max
  Coding DNA Sequence Number=SeqID_185
  Gene Ontology: Mol. function=catalytic activity
  Homolog annotation: Hit_ID=A7R313; Match level="QueryCoverage=88%, HitCoverage=98%, E-value=1e-148, Identity=80%"; Hit description =Chromosome undetermined scaffold_470, whole genome shotgun sequence
  Pfam annotation: Domain name=BNR; Domain location=112-123; Score =10.1; E_value=6; Accession=PF02012.11; Description=BNRAsp-box repeat
  Pfam annotation: Domain name=BNR; Domain location=164-175; Score =11.5; E_value=3.1; Accession=PF02012.11; Description=BNRAsp-box repeat
  Pfam annotation: Domain name=BNR; Domain location=217-228; Score=9.7; E_value=6.9; Accession=PF02012.11; Description=BNRAsp-box repeat
  Pfam annotation: Domain name=BNR; Domain location=266-277; Score=5.5; E_value=25; Accession=PF02012.11; Description=BNRAsp-box repeat
  Pfam module annotation: Pfam domain module=BNR::BNR::BNR::BNR; Domain location=112-123::164-175::217-228::266-277
MASNCSIEGPLVEEFTYQAGSAPFKSCHASTIVEVDKDHFLVAYFGGTFEGAPDVKIWVQTYKNGRWQAPVIADEEPNVPMWNPALFKLPSDELLLFYKIGQEVQKWSGFMKRSYDKGKTWTGREQLPPGILGPIKNKPILLENGNLLCGSSVESWNSWGAWVEVTTDFGRSWSKYGPIYIENKPLSVIQPVPYQTADGKLRVLLRSFDGIGRVCMSESSDGGKTWGYAKPTQLPNPNSGIDGVKLRDGRLLLAYNTVSRSVLKVALSKDDGDSWCEVLTLEDTSGMEFSYPAVIQDSDGRIHITYTYNRTQIKSLHCNTAYSDFQLIMSRCRLYLSYIPNSLFGKSVQIVY

SEQ ID NO: 91871 - protein, 258 aa, Glycine max
  Coding DNA Sequence Number=SeqID_186
  Gene Ontology: Mol. function=hydrolase activity
  Homolog annotation: Hit_ID=A7Q6N8; Match level="QueryCoverage=90%, HitCoverage=56%, E-value=5e-99, Identity=73%"; Hit description =Chromosome chr11 scaffold_56, whole genome shotgun sequence
  Pfam annotation: Domain name=UPF0066; Domain location=79-210; Score =125.3; E_value=1.8e-34; Accession=PF01980.7; Description =Uncharacterised protein family UPF0066
MVDTYVLKRKWNHLNSKIEELEASLKSFSDNCASERQGRIRAQQALRKEVTQSQPNSQKLNLTSYPMMPIGVVHSCFSTRNGTPRQPLLVPLARACLVFNTTRVPPASLEGLEEYSHCWILYVFHLNTDLDKLWKHPSKSGFKAKVRVPRLKGGRKGVFATRSPHRPCPIGLTVAKVEAVQGNMILLSGVDLVDGTPVLDIKPYLPYCDNIQEATVPNWLMEDNLLSVASVSFSEHFTSALKNIWIMVNGCTPSVLTV

SEQ ID NO: 91872 - protein, 51 aa, Glycine max
  Coding DNA Sequence Number=SeqID_187
MEERGVAFLSARKLNYDTGVDKNPTQPITVVECSTGKVDRNHGYHGQVVEG

SEQ ID NO: 91873 - protein, 514 aa, Glycine max
  Coding DNA Sequence Number=SeqID_188
  Gene Ontology: Mol. function=metal ion binding; Cellular component =integral to membrane; Biological process=ubiquitin cycle
  Homolog annotation: Hit_ID=A7PFF9; Match level="QueryCoverage=99%, HitCoverage=87%, E-value=1e-127, Identity=55%"; Hit description =Chromosome chr11 scaffold_14, whole genome shotgun sequence
  Pfam annotation: Domain name=PHD; Domain location=128-170; Score= -5.4; E_value=0.056; Accession=PF00628.20; Description=PHD-finger
  Pfam annotation: Domain name=zf-C3HC4; Domain location=126-167; Score= 35.0; E_value=2.8e-07; Accession=PF00097.16; Description=Zinc finger, C3HC4 type (RING finger)
  Pfam module annotation: Pfam domain module=PHD::zf-C3HC4; Domain location=128-170::126-167
MGHRPPEQPPYFLSEPNPPFPPTTTVRSDSFSLNDRALKVSPSILLIIIILAIVFFISGLLHLLVRFLWRPQTREPDELDNVTALQGQLQQLFHLHDAGVDQSFIDTLPVFLYKAIIGLKKYPFDCAVCLCEFEPEDKLRLLPKCSHAFHMECIDTWLLSHSTCPLCRASLLPDQFSATNACSPIVLVLESGSSESSREIVPERVGASAAVGRTSSVMTTDSRLGCRGDSEFGSTRVDLMKSGELLSEIPDPTVPNGVEKVVTVKLGKFRSVDGGGEGGEGSSSSTSTNNVDARRCFSMGSFAYVMDESSSLQVPIRTPIKKQSSKKKSGLPLTPGHRPAMSECDCESRRDFKFAGFDATTIIVEDDAATSTGATTSSTTCNGNSAAAIGRSRKESFSISKIWLRGKKDKPNSVADSSRRAVSFRFPAKSSVVTAASGSAHDDDDDDLKGKNCKFDTRSTISEMDIGKWENGGGSEFDYDDENQSCYSLDSSQARAPSFARRTLLWLTGGRQNK

SEQ ID NO: 91874 - protein, 258 aa, Glycine max
  Coding DNA Sequence Number=SeqID_189
  Homolog annotation: Hit_ID=A7QLC4; Match level="QueryCoverage=85%, HitCoverage=76%, E-value=8e-57, Identity=47%"; Hit description =Chromosome chr11 scaffold_118, whole genome shotgun sequence
MAELNTLVVRKPCFGLPTDQIPYFEVGDSVAYNNEKEGIIECLKKDVGVVDLDSGVSSLPEWISTKAILTTWLADALAYELWLGCEGSSAYSIYYSDLPWPLGKILSWKKAIWVKLKHGITNDNAEVKKEEIYERAKSAYEALSSCLGEQNYLFENRPSSLDAIFLAHGLVVLHALPESSMLRIKFSEHANLVRYVQQCKTELIDAAPSPSSAPQFHTDATSSASKSHSIVVFLTLMTSFDDAEVELDDDDGSYDYDE

SEQ ID NO: 91875 - protein, 312 aa, Glycine max
  Coding DNA Sequence Number=SeqID_190
  Gene Ontology: Mol. function=methyltransferase activity; Cellular component=cellular_component; Biological process=metabolic process
  Homolog annotation: Hit_ID=Q9LVD0; Match level="QueryCoverage=100%, HitCoverage=100%, E-value=1e-108, Identity=66%"; Hit description =Protein carboxyl methylase-like
  Pfam annotation: Domain name=Methyltransf_11; Domain location=56-159; Score=43.2; E_value=9.5e-10; Accession=PF08241.3; Description =Methyltransferase domain
  Pfam annotation: Domain name=Methyltransf_12; Domain location=56-157; Score=29.3; E_value=1.4e-05; Accession=PF08242.3; Description =Methyltransferase domain
  Pfam module annotation: Pfam domain module=Methyltransf _11::Methyltransf_12; Domain location=56-159::56-157
MASRPEVIAPPEIFYDDAEARKYTSSSRIVQIQATLSERALELLALPDDGVPKLLLDIGCGSGLSGETISENGHHWIGLDISASMLNVAVEREVEGDLLLGDMGQGIGIRPGVMDGAISISAVQWLCNADKSSHNPRLRLKAFFTSLYKCLSNGARAVFQVYPENIDQRELILNAAMHAGFAGGIVVDFPHSIILPSLLEHGVSLTGEQLSYDSSKKRKEFLVLTCGQCSVNASISKGKNEDGESCSDDDSEDEENQTVCISDRHRPRKKQKNNKVGKGKEWLLRKKEQMRRRGNVVPPNTKYTGRKRKDRF

SEQ ID NO: 91876 - protein, 90 aa, Glycine max
  Coding DNA Sequence Number=SeqID_191
  Subcellular localization annotation: CTP_CleavageSite=52; ConfidenceScore=5.05e-01
MANIRKWERTNYSSGDSMHSDIIITARDTDGTTHSQFISVSQSRPFFFSFNRCSRLRKTKHMNMAALSNAGPKPLLLSSINRPTVAASLH

SEQ ID NO: 91877 - protein, 45 aa, Glycine max
  Coding DNA Sequence Number=SeqID_192
MEKPLLVIVMGKDGWSGSPFVRKGGHQRCGSERESMMWEREKGKE

SEQ ID NO: 91878 - protein, 436 aa, Glycine max
  Coding DNA Sequence Number=SeqID_193
  Gene Ontology: Mol. function=hydrolase activity; Cellular component =cytoplasm; Biological process=metabolic process
  Homolog annotation: Hit_ID=A7PFI6; Match level="QueryCoverage=88%, HitCoverage=68%, E-value=1e-169, Identity=73%"; Hit description =Chromosome chr11 scaffold_14, whole genome shotgun sequence
  Pfam annotation: Domain name=5_nucleotid; Domain location=184-436; Score=282.2; E_value=1e-81; Accession=PF05761.5; Description=5' nucleotidase family
  Subcellular localization annotation: CTP_CleavageSite=29; ConfidenceScore=5.34e-01
MASLRIRNLLRFSIHGTLLSSSPLRPGFSGSSRSYSVVESSKHFLLKSDDEEIFALRRKFEAAKQSFLSIPDALREMPKMNPKGIYVNKNVRLDQLQVYGFDYDYTLAHYSSDLQTLIYDLAKEYLVNEVSSDNTVLLYDYGSFPYSSCCSFQLRYPEVCTSFKYDPTFPIRGLYYDKSKGCLMKLDFFGSIEPDGCFFGRRRLSHTEIRDIYGTRHIGRDHARSLVGLMDFFCFSEACLLADIVQYFVDAKLEFDASYIYEDVIRAIDHVHRSGLVHRGILSDPHRYLVKNGKILRYLKMLRERGKKLFLLTNSPYYFVDGGMRFMLEDSLDCRDSWTELFDVVIAKANKPQFYTSEHPFRCYDTKNDTLTFTKVDEFLPDKIYYHGCLKSFLQITKWNGPEVIYFGDHLFSDLRGPSKAGWRTAAIIHELEARL

SEQ ID NO: 91879 - protein, 49 aa, Glycine max
  Coding DNA Sequence Number=SeqID_194
MAPLMGGCFWLWWQLKQQCQQQQQHQRHQNMATDYGIQQWPGKAKQVRK

SEQ ID NO: 91880 - protein, 1156 aa, Glycine max
  Coding DNA Sequence Number=SeqID_195
  Gene Ontology: Biological process=protein modification process
  Homolog annotation: Hit_ID=A7PFL5; Match level="QueryCoverage=100%, HitCoverage=100%, E-value=0.0, Identity=63%"; Hit description =Chromosome chr11 scaffold_14, whole genome shotgun sequence
  Pfam annotation: Domain name=DUF593; Domain location=592-674; Score= -29.2; E_value=0.049; Accession=PF04576.6; Description=Protein of unknown function, DUF593
MSSSVTGSIVHQGQLLVHIAENGHSFELDCNENTLVESVMRSIQSVTGINFGDQLVLCLDMKLESQRPLSAYKLPSDEREVFIFNKARLQNNSPVPPPEQVDIPSHLEPPPPASSHDPHPLDDASDPALKALPSYERQFRYHYHRGHVIYTGTMMKYEHCERLLREQMVQERAVEVARGNLDQYYRMINQNYGDFMKRYMQQCRMHSDLLVNFGKDIEKLRSIKLHPALQTANRKCLLDLVKEENLRKSVENCTSSHKQFENKVSQFKQTFGEVKRRAEELLSSRDFLPIKNLEQAIKEHQRYINEQKSIMQSLSKDVNTVKKLVDDCLSSQLSSSLRPHDAVSALGPMYDVHDKNHLPKMQACDRAISKLLEFCKENKNEMNLFVHNYMQNITYVSYLIKDQKLQFPVFKEAMARQDGLFMDLKLFHGIGPAYRACLAEIVRRKASMKLYMGMAGQMAERLAIKREAELRRREEFLRLHSSCIPKEVLASMGLFDTPNQCDVNIAPFDGGLLNIDISDVERYAPEYLTGVTSKLDKQGSSKSSSALSSDSSHLAEAVDITGDSIERDDSEDLLDGSELLEIAGTCKMEVENAKLKAELAGRIALICSLCPELEYESLDDERVNNILRNAAEKTQEALHLKDEYIKHVQSMLKMKQMLCVSYEKRIQELEQKLSDQYVQGQKMSSVNDAADLPLVAGKTDNYKSESISGEANMPCISTSEPMDEVSCISSSLDAKLGLFMFTEHTGKALDGVDENMLDSSGVQNPQLDSSMMEPHREEAQSGDKDKKGKIIVQLGMSLTNSSTGENMPVSHDLVPCDSAVCQDLESKVNDEKVLELQSALADKSNQLNETETKLKTVMEKVAVLRRELEASQKLLDESQMNCAHLENCLHEAREEAQTQKSSADRRASEYSLLRASVIKTRSFFERLKTCVYSPGGVAGFADSLRNLAQSLANSANDRDDDDIAEFRKCIRVLADRVGFLSKHREELHEKNTRTEAANEQLRKELEEKIDQVKTYYNKHQLEKQANKEKICFGCLEVHEIAAFVLTSAGHYEAITRNCSNYYLSDESVALFADHLPTRPNYIVGQIVHIERQIVKTLPPRPEHGRADKFTPDKGADWLTLNSGSTPNPYGLPVGCEYFLVTVAMLPDTPIHSSSPS

SEQ ID NO: 91881 - protein, 542 aa, Glycine max
  Coding DNA Sequence Number=SeqID_196
  Gene Ontology: Mol. function=nucleic acid binding; Cellular component= intracellular
  Homolog annotation: Hit_ID=A7PFK7; Match level="QueryCoverage=99%, HitCoverage=93%, E-value=1e-141, Identity=53%"; Hit description =Chromosome chr11 scaffold_14, whole genome shotgun sequence
MEEPLQEEHAPPNKRFKSSSASQDEQWNASNGASSSSSPSQYNILDEPSPLGLRLRKSPSLLDLIQMKLSQGNVIIANTQDENFISSGLKKESRGAAASGSVEKLKASNFPASLLRIGSWEYKSKHEGDLVAKCYFAKQKLVWEVIEGELKSKMEIQWPDIMALKANCPDTGPSSLTVVLARQPLFFKETNPQPRKHTLWQATSDFTDGAACKHRQHFLEFPQGLLAKHFEKLIQCDARLNFLSQQPEIILDSPHFDTQPAAFENLDNPEDRDLHLVNGKGSTTSCLQVIESPHSSQSPSFKVEHNGRLGINFDFPPDIGTFHSFVNLPNIHPLSIIVSLSHIYWDQGRDCSRSSETDFKGPRNLDQIKLPGLQPSMSVSDFIGHIEHCLSEQITSGNPSFCGGRSELQEMLEEIAQHLLNDNQVITTSDEISLMTRVNSLCCLLQKDPAGLQSSHDKESAVAEGPDDEKRIQLSHDLESMQNNKIKMDVKPAEEDFRDASGSKQTLGMSRKDSFAELLHQLPRIASLSKFLFDISEEDSDS

SEQ ID NO: 91882 - protein, 853 aa, Glycine max
  Coding DNA Sequence Number=SeqID_197
  Gene Ontology: Mol. function=transferase activity, transferring glycosyl groups; Cellular component=integral to membrane; Biological process=cell wall organization and biogenesis
  Homolog annotation: Hit_ID=A8R7F0; Match level="QueryCoverage=99%, HitCoverage=82%, E-value=0.0, Identity=86%"; Hit description =Cellulose synthase catalytic subunit
  Pfam annotation: Domain name=Cellulose_synt; Domain location=50-849; Score=2073.9; E_value=0; Accession=PF03552.5; Description=Cellulose synthase
MWNAVIKAGNGKWDEAKEDRMDDWKLQQGNLGPEPDEDPDAAMLDEARQPLSRKVPIASSKVNPYRMVIVARLVILAFFLRYRLMNPVHDALGLWLTSIICEIWFAFSWILDQFPKWYPIDRETYLDRLSIRYEREGEPNMLAPVDVFVSTVDPMKEPPLVTANTVLSILAMDYPVAKISCYISDDGASMCTFEALSETAEFARKWVPFCKKFSIEPRAPEMYFSEKIDYLKDKVQPTFVKERRAMKREYEEFKVRINALVAKAQKVPQGGWIMQDGTPWPGNNTKDHPGMIQVFLGHSGGHDTEGNELPRLVYVSREKRPGFQHHKKAGAMNALIRVSAVLTNAPFMLNLDCDHYVNNSKAAREAMCFLMDPQTGKKVCYVQFPQRFDGIDRHDRYANRNTVFFDINMKGLDGIQGPAYVGTGCVFRRQALYGYNPPKGPKRPKMVSCDCCPCFGKRKKVKYEGNDANGEAASLRGVDDDKEVLMSQMNFEKKFGQSSIFVTSTLMEEGGVPPSASSASQLKEAIHVISCGYEDKTEWGIELGWIYGSITEDILTGFKMHCRGWRSIYCMPKRAAFKGTAPINLSDRLNQVLRWALGSIEIFFSRHCPLWYGYKEGKLKWLERFAYANTTVYPFTSIPLVAYCVLPAVCLLTDKFIMPPISTFAGLYFVALFSSIIATGLLELKWSGVSIEEWWRNEQFWVIGGVSAHLFAVIQGLLKVLAGIDTNFTVTSKAADDEEFGELYTFKWTTLLIPPTTILIINIVGVVAGISDAINNGYQSWGPLFGKLFFSFWVIVHLYPFLKGLMGRQNRTPTIVVIWSVLLASIFSLLWVRIDPFVLKTKGPDTKLCGINC

SEQ ID NO: 91883 - protein, 256 aa, Glycine max
  Coding DNA Sequence Number=SeqID_198
  Homolog annotation: Hit_ID=A7PFQ1; Match level="QueryCoverage=64%, HitCoverage=34%, E-value=2e-16, Identity=38%"; Hit description =Chromosome chr11 scaffold_14, whole genome shotgun sequence
MEFQYRDGQNQRTPLAMPFSGVAYFSGNPLEGYEFMPGGFPDNVPTPNVFPTTMLINAEEAFRQELVKKQIRREREEEEIRKKIISRETTLAHRRELEEEVKREMMSERMGGIPMQRTEGFLFPDRVYVNLESSYQRMMNHVNHINIFGRPQPQLPGQVDTRQPYTLTNTEKDKVIILAKPNVDDYGAKRKAMAPLAVDESENLGKKSKPEWSCTLCGITVTSEKQLNAHHQGKKHKAKETFLRTQKIGFDSRPNH

SEQ ID NO: 91884 - protein, 335 aa, Glycine max
  Coding DNA Sequence Number=SeqID_199
  Gene Ontology: Mol. function=nucleic acid binding; Cellular component= intracellular
  Homolog annotation: Hit_ID=A7PFQ1; Match level="QueryCoverage=69%, HitCoverage=64%, E-value=5e-23, Identity=29%"; Hit description =Chromosome chr11 scaffold_14, whole genome shotgun sequence
  Pfam annotation: Domain name=zf-U1; Domain location=288-325; Score =3.5; E_value=0.048; Accession=PF06220.3; Description=U1 zinc finger
  Subcellular localization annotation: CTP_CleavageSite=59; ConfidenceScore=5.36e-01
MEFKYRDGQIRRTPSPLRSPLPSNSYVSNRPLHGCDFASGGFPSNVSAPRVFPMVMSINVNEVFQRELEKEKIWRELEKEKIRREIIASEMAFAQRRELEDEVRKEMELERTFRIPMQRSEGIAFREPISESINQSRLNNITMFGGLPFHLLSQASKQIHTDNIQFDNKEASNSKDKVIILNKPDDHCGEKRKAVTLPIDDNESLQKKAKKEWTCELCQISTTSEKGLNDHIQGKKHKANKESTRTQKIGLDSRPERETLHPCLTPADDQNETTTIKQAQETSAPSKGKKFEFWCELCQVQTHSEIVMQSHKNGKKHLRNMKKLNHNNDGVANLG

SEQ ID NO: 91885 - protein, 109 aa, Glycine max
  Coding DNA Sequence Number=SeqID_200
MNVMGKVFIVLQETLVPQPGPLILIYLIRRVQGDNPFHLLHEIKEKQENPKGKNKRRLKGKGEKERKKKTSDEDGIFWGLAEGQFGEHSFDERERNVRERKKGSSIEDR

SEQ ID NO: 91886 - protein, 108 aa, Glycine max
  Coding DNA Sequence Number=SeqID_201
  Gene Ontology: Mol. function=serine carboxypeptidase activity; Cellular component=extracellular region; Biological process =proteolysis
  Homolog annotation: Hit_ID=A5AE13; Match level="QueryCoverage=70%, HitCoverage=17%, E-value=2e-22, Identity=70%"; Hit description =Putative uncharacterized protein
MTFQSKAGIFFLCLLIIAFSSINLAVAVPKEQEQDRILALPGQPRVAFSQFSGYVTVNEQHGRALFYWLTESPTSPQNKPLVLWLNGARESLNSSSSTFYTSFIPLPL

SEQ ID NO: 91887 - protein, 817 aa, Glycine max
  Coding DNA Sequence Number=SeqID_202
  Gene Ontology: Mol. function=voltage-gated potassium channel activity; Cellular component=integral to membrane; Biological process=potassium ion transport
  Homolog annotation: Hit_ID=O82226; Match level="QueryCoverage=99%, HitCoverage=99%, E-value=1e-162, Identity=70%"; Hit description =Probable cyclic nucleotide-gated ion channel 6
  Pfam annotation: Domain name=Ion_trans; Domain location=152-509; Score=63.3; E_value=8.5e-16; Accession=PF00520.22; Description=Ion transport protein
  Pfam annotation: Domain name=cNMP_binding; Domain location=610-710; Score=37.6; E_value=4.4e-08; Accession=PF00027.20; Description =Cyclic nucleotide-binding domain
  Pfam module annotation: Pfam domain module=Ion_trans::cNMP_binding; Domain location=152-509::610-710
MFDCGPKSEYMGGQRENFLRLEALDSTLSSSSDAGVIKSGFSIDKLSHGHGNSTTSRSFKRGMRRGSEGLKSIGRSLGLGVSRAVFPEDLKVSEKKIFDPQDKFLLLWNKLFVISCILAVSIDPLFFYLPVINDSFHCLGIDRKLATIVTTLRTLVDAFYLLHMALQFRTAYIAPSSRVFGRGELVIDSAQIAKRYLQRYFIIDFLSVLPIPQIVVWRFLQRSKGSDVLATKQALLFIILLQYVPRFLRMVPLTSELKRTAGVFAETAWAGAAYYLLLYMLASHIVGAFWYLLAIERNDSCWQKACSDIRCNKNFLYCGNQHMEGYSAWNKTSEDIQSRCSADGDPAHFDYGIFGQVLSSGIISSKKFISKYCYCLWWGLQNLRLTAIRKTETSIFYVKPDLNTDIPSISPELSSNIFSDFSLSKLDGKTVDYCCISNGVGIRKSRKGTKGIVLTAEAEECEKSRGLYQSAHTARDLGLQTSTYPGEVIFSIALAISGLILFALLIGNMQTYLQSLTIRLEEMRVKRRDSEQWMHHRLLPQDLRERVRRYDQYKWLATRGVDEENLVQSLPKDLRRDIKRHLCLALVRRVPLFESMDERLLDAICERLKPCLFTENTYIVREGDPVDEMLFIIRGRLESVTTDGGRSGFFNRGFLKEADFCGEELLTWALDPKSGSNLPSSTRTVKALMEVEAFALTADELKFVASQFRRLHSRQVQHTFRFYSQQWRTWAACFIQAAWRRYSKKKIMKLRQKEDESDGAHENVGGSSYSFGAALLASKFAAHTLRGVHRNRLAKTARELVKLQKPPEPDFSADDAN

SEQ ID NO: 91888 - protein, 44 aa, Glycine max
  Coding DNA Sequence Number=SeqID_203
MRLKESPNVEIAFCIVEKEKNSKKRNFPGKGVRFGSENNRNVED

SEQ ID NO: 91889 - protein, 93 aa, Glycine max
  Coding DNA Sequence Number=SeqID_204
MGHECLTDKRLSAEEMAVGGDLHWDLLVKQGHRERENQGIVCGFCFVRKGKSEDKTRHRENTMYGGGNVVLTNFSASLEWMTWVPLIRREKDC

SEQ ID NO: 91890 - protein, 197 aa, Glycine max
  Coding DNA Sequence Number=SeqID_205
MTHKLFFYLKLSNGIELTILRKVIPKLNSGSKPYSENSEASCFLATEPEGRGSEEEEGFRVSTWKWLEKPLKGFLTGRNTIFLDSKGGAAVVVVDEEGSGGFGGSVWITMVSAIGGVREASKREEKKKTRKKQRVSASGKRRPGPGPGIECIYMCGLENPGSVIEQLGHSNLNRVDRGGQTSNQDRFLLILTFNYGI

SEQ ID NO: 91891 - protein, 681 aa, Glycine max
  Coding DNA Sequence Number=SeqID_206
  Gene Ontology: Mol. function=two-component response regulator activity; Cellular component=nucleus; Biological process=two -component signal transduction system (phosphorelay)
  Homolog annotation: Hit_ID=A5AD81; Match level="QueryCoverage=96%, HitCoverage=97%, E-value=1e-153, Identity=46%"; Hit description =Putative uncharacterized protein
  Pfam annotation: Domain name=Myb_DNA-binding; Domain location=211 -261; Score=44.4; E_value=4.1e-10; Accession=PF00249.22; Description =Myb-like DNA-binding domain
  Pfam annotation: Domain name=Response_reg; Domain location=11-124; Score=107.5; E_value=4.1e-29; Accession=PF00072.15; Description =Response regulator receiver domain
  Pfam module annotation: Pfam domain module=Myb_DNA-binding::Response _reg; Domain location=211-261::11-124
MGVEDRFPVGMRVLAVDDDETCLSVLENLLRKCQYNVTTTNQAIKALDMLRKNRNKFDLVISDVNMPDMDGFKLLELVELEMDLPVIMLSGYGDKERVMRGVIHGACDYLTKPVRIEELQNIWQHVVRRRIDSKDKNKTASEGKACSMAGKLANEEKACYMAGECSQAMASKSNADQNIKLGQKRKEQSEDEEEEEYDQENEEPSNQKKPRLVWDAELHRKFLAAINHLGIDKAFPKRILDLMNVEGLTRENIASHLQKYRLGLKKSTQQPSMVATLGNSDPYQQMDSIEGFRTLSGSGGMISTTLPSYASGGLFCRLNSPSGLRGINSSLLVQPVHSQNIDSRSIKTLGNMQLSMFSANQTSSLLQGIPTSIDGNQFQQNNCSIGIRKLSPLDDLSSGFKVSSGFSNSRATVRNPNNSLHGLSNNHLLLQGNSPPTHNSGAFGNHSSLGAASVKTQSFDPGICELGYNRCNKSWQGTTQISKFPANTSAVSNNDQLAQNNLNFSSSTFCSGNSPVDFSSTSVVAPPLEDARGKLRCQEGLLENILLTSCYTQHQSWEADNRGCNKEMSQTFNTIKSVSPNGDTSSLGHSLDQNNTVSSKRIDVSLVNPSVTQSSEDEKFYSMESIDGCILQSMESQEDLMQNTFESLDDIMSEITKQEQNAIMLMDGEMEFDAYHVGSCI

SEQ ID NO: 91892 - protein, 556 aa, Glycine max
  Coding DNA Sequence Number=SeqID_207
  Gene Ontology: Mol. function=hydrolase activity; Cellular component =extracellular region; Biological process=metabolic process
  Homolog annotation: Hit_ID=Q9FF10; Match level="QueryCoverage=98%, HitCoverage=98%, E-value=0.0, Identity=59%"; Hit description =Heparanase-like protein 1 precursor
  Pfam annotation: Domain name=Glyco_hydro_79n; Domain location=22-341; Score=583.8; E_value=1.7e-172; Accession=PF03662.5; Description =Glycosyl hydrolase family 79, N-terminal domain
MGIHLGLFLFLASLRMTLSQDVEHGSVLVDGIQAIAETDDNFICATIDWWPHDKCDYNYCPWGDSSAVNLDLSHPFFAKAIQALKPLRIRVGGSLQDQVLYEVGSLKSPCHPFQKMKGGLFGFSKGCLQMKRWDELNHFFDETGALVTFGLNALRGRHQISHTVWGGDWDPSNAKDFISYTISKGYKIDSWEFGNELSGKGIGASVGAAQYGKDLIKLKEILHTLYKNSTFKPSLVAPGGFYNKEWFDKLLQVTGPGIVNVLTHHVYNLGPGSDEHLDRKILDPENLSKIESIFSNLSETIQKYGPWSSAWVGEAGGAFNSGGRSISNTFVNSFWYLDQLGIASRYNTKVYCRQTLIGGNYGLLNTTTFIPNPDYYRQVLVLFLSSALLWRQLMGKTVLAASSDVFSPSLRTYAHCSKGRDGITLLLINLSNQTHFTLTVHDRVPVSNGGNENAKSIHTENSFFSHLKRAFSWIGTKGSDVTFREEYQLTPKDDYLRSQTMLLNGIPLELTNDGEIPTLDPLLNNVHSPIHLAPLSIAFIVFPNFDAPACAEHRKL

SEQ ID NO: 91893 - protein, 381 aa, Glycine max
  Coding DNA Sequence Number=SeqID_208
  Gene Ontology: Mol. function=protein transporter activity; Cellular component=Golgi membrane; Biological process=vesicle fusion with Golgi apparatus
  Homolog annotation: Hit_ID=A7PDG0; Match level="QueryCoverage=87%, HitCoverage=79%, E-value=2e-72, Identity=50%"; Hit description =Chromosome chr17 scaffold_12, whole genome shotgun sequence
MSNSCRSDNHTPLNAEQLSTRRRREHRKEKGVLQSSQSQSIQSVQMQILEQHKMSFLEAHAEDKKHIQGLEKELLNCSQEIDYLQDQLSASNTEVNYLEEHIRSLELKLEGMEDLQEEVFRLREELKRSNSKHFFLIQELDTKEIELEKSALSIEKLEESFSSITLESQFEVESMKLDMMALEQSLFEAKKIQDETLDENNRMSRSIEELQVALQDAQKIIISLNEENRKLKEKLDIANKNSRISSQKDEYWLENNDRLQLETQSSLNGRGNNSTILEDIRTYGVHGPHVGRLAMILYLAADLKGKMEMSQQIQEYECLIKKLKEELREEKLRAKEEAEDLVQEMAELRYQFTSSLEEECKRRACIEHASLQRIAELEAQV

SEQ ID NO: 91894 - protein, 379 aa, Glycine max
  Coding DNA Sequence Number=SeqID_209
  Gene Ontology: Mol. function=hydrolase activity, hydrolyzing O -glycosyl compounds; Cellular component=extracellular region; Biological process=carbohydrate metabolic process
  Homolog annotation: Hit_ID=A7R1P5; Match level="QueryCoverage=91%, HitCoverage=93%, E-value=1e-118, Identity=60%"; Hit description =Chromosome undetermined scaffold_366, whole genome shotgun sequence
  Pfam annotation: Domain name=Glyco_hydro_18; Domain location=28-358; Score=321.2; E_value=1.9e-93; Accession=PF00704.19; Description =Glycosyl hydrolases family 18
MAYSKSFSFLISILLFIFHNFHVSTAQKIKGGYWFPGSSFAVSDINSTLYTHLFCAFADLNASTYQVTISSSNAPQFSTFTQTVQKKNPSVKTLLSIGGGASNPSTFSAMASQAGRRKTFIDSSIQLARSNNFHGLDMDWEYPSTSTDMTNYGFLIREWRTALVNEARNSGKQILLLVGAVFYSSNYYSLNYTIQDVINAFDFVNVMAYDFYGPNWYPNFTAPPAALYALNHPAANRVSGDMGIRDWIGSGMPASKLVLGVPFYGYAWRLLNSNNRGLFDRANGSAFGGDGSMGYSQIREFVSQNRAACTFNSTVVSDYCSSGTTWIGYDDVQSVSAKVAYAKTNNLGGHFVWHVGADYNWVLSQAGAVYPDMYCCYRV

SEQ ID NO: 91895 - protein, 353 aa, Glycine max
  Coding DNA Sequence Number=SeqID_210
  Gene Ontology: Mol. function=prenyltransferase activity; Cellular component=integral to membrane
  Homolog annotation: Hit_ID=Q58FG4; Match level="QueryCoverage=88%, HitCoverage=88%, E-value=1e-159, Identity=82%"; Hit description =Homogentisate phytylprenyltransferase
  Pfam annotation: Domain name=UbiA; Domain location=81-352; Score =34.7; E_value=3.3e-07; Accession=PF01040.9; Description=UbiA prenyltransferase family
  Subcellular localization annotation: CTP_CleavageSite=49; ConfidenceScore=5.33e-01
MDSLLLRSFPNINNASSLTTTGANFSRTKSFANIYHATTSEKSLESEPQAFDPKSILDSVKNSLDAFYRFSRPHTVIGTALSIISVSLLAVEKISDISPLFFTGVLEAVVAALFMNIYIVGLNQLSDVEIDKINKPYLPLASGEYSFETGVTIVASFSILSFWLGWVVGSWPLFWALFVSFVLGTAYSINVPLLRWKRFAVLAAMCILAVRAVIVQLAFFLHMQTHVYKRPPVFSRPLIFATAFMSFFSVVIALFKDIPDIEGDKVFGIQSFSVRLGQKPVFWTCVTLLEIAYGVALLVGAASPCLWSKIFTVQILKLASPLAGKGEATFIYPPPEPTRVLCHLAIVFFTVVF

SEQ ID NO: 91896 - protein, 241 aa, Glycine max
  Coding DNA Sequence Number=SeqID_211
  Gene Ontology: Mol. function=nucleic acid binding; Cellular component= intracellular; Biological process=regulation of transcription
  Homolog annotation: Hit_ID=A7PDG3; Match level="QueryCoverage=100%, HitCoverage=40%, E-value=9e-54, Identity=50%"; Hit description =Chromosome chr17 scaffold_12, whole genome shotgun sequence
  Pfam annotation: Domain name=zf-C2H2; Domain location=100-122; Score =10.9; E_value=0.75; Accession=PF00096.17; Description=Zinc finger, C2H2 type
  Pfam annotation: Domain name=zf-C2H2; Domain location=13-35; Score =13.0; E_value=0.45; Accession=PF00096.17; Description=Zinc finger, C2H2 type
  Pfam module annotation: Pfam domain module=zf-C2H2::zf-C2H2; Domain location=100-122::13-35
MEGDHHRIQELKHACKFCGKCFPCGRSLGGHMRSHITNLSSEMMNEKKEKLSSSLNNGGDKDSEAAAATNAAASYGLRENPKKTWRISDYSSEDPLVFDKFCKECGKGFHSWKALFGHMKCHSEKERVSNSLEDQDSWTNSAKMVMDSQSDNEATAPNKRRRSKRRTRYTVVASSAAAATTSSVVSFANPSSSSLSEVEQEQEEVAMSLMMLSRDVSPWSGRHSVAESSDNNSAYFEARSS

SEQ ID NO: 91897 - protein, 151 aa, Glycine max
  Coding DNA Sequence Number=SeqID_212
MENLEKEEAVTPTRRLNIEYNGSDLYDSFEFKQMTLQLNEAIQTSKESSPAYREMTHRHKLKKAIQGSNGSSPSLVFHLNSPFYRRHLKRLYKESTKAPRRISSPQVPDKPTCVRGTREKGFVTRLWLKVKGLLGKKHEGEEGRNQPSKAF

SEQ ID NO: 91898 - protein, 93 aa, Glycine max
  Coding DNA Sequence Number=SeqID_213
MHLKKRPCEVEKRNEPEKGIIGNDNIGASTTDAVEILLGVHPGDRAWSSILSDMVSGAKDRKFVTIGHCLVGGKVRVFFPSTRSWNSVDDDDG

SEQ ID NO: 91899 - protein, 172 aa, Glycine max
  Coding DNA Sequence Number=SeqID_214
  Homolog annotation: Hit_ID=UPI0000502575; Match level="QueryCoverage =48%, HitCoverage=84%, E-value=1e-08, Identity=33%"; Hit description =UPI0000502575 related cluster
MKSEISKTATFKVRHLYIICEGDQGEAQPVAIGDMFMDTVKKGKPDLRKVLPVAIGEMKGSTITGPIGNECAELWTRIKKKKGQNCQRREEVAARNGHSASMNYEPSQEGGTDSTEVKELPEYIELMEKQGFHRKTHQQPMMENANNGTCLVWGEQEQYTYRDLANATELPS

SEQ ID NO: 91900 - protein, 593 aa, Glycine max
  Coding DNA Sequence Number=SeqID_215
  Gene Ontology: Mol. function=heat shock protein binding; Cellular component=intracellular; Biological process=response to stress
  Homolog annotation: Hit_ID=A7PWK5; Match level="QueryCoverage=92%, HitCoverage=93%, E-value=1e-131, Identity=48%"; Hit description =Chromosome chr8 scaffold_34, whole genome shotgun sequence
  Pfam annotation: Domain name=DnaJ; Domain location=10-76; Score =111.8; E_value=2.1e-30; Accession=PF00226.22; Description=DnaJ domain
MASSSAAKRCHYEVLGLPRDCAPDEIRSAYRRLALQRHPDKLVKSGLSQEEATAQFQELQHAYEVLSDPKERAWYDSHRSQILFSDPNTVSNSFVPDLFSFFSNTVYSGYTNTAKGFYKVYSDVFDKIHANEINFARKLGLDSDAVRQAPVMGNLDSPYAQVTAFYSYWLGFCTVMDFCWVDEYDVMAGPNRKSRRIMEEENNKVRRKARREYNDTVRRLGDFVKKRDKRVIDMKVKRSVEEERKKEEERERKRRLEKEKKERAMAYEEPEWAKVDEDVEEVVEEEVEERENEELYCVLCKKKFKSDKQWKNHEQSKKHKERVAEFRGSIGDDEEDLEEEEEGEEGLESAEVGVNDETDNGIGDLEARIKNGLNVEEGETRNGIELNDDDEFIDASRVKEGEEAGVSVSFDEDGNEEEEEEEEEGDIENGVLEAMVAGHKNRKPRASTHKPKTSVAPLPIENENDDELGPMEYNNQKGARKKRRAKKEKGRKNWEESQEAAASGDYEDIISNANDNSHAEESSSQHFMENEDNGIENEQVGRDEKISNQPADKKGRDKNISQQAADKKGAGKDTKTKAKVSSKGRKGKVRTSE

SEQ ID NO: 91901 - protein, 502 aa, Glycine max
  Coding DNA Sequence Number=SeqID_216
  Gene Ontology: Mol. function=protein binding; Cellular component =endosome membrane; Biological process=phosphorylation
  Homolog annotation: Hit_ID=Q9C6A4; Match level="QueryCoverage=79%, HitCoverage=90%, E-value=1e-107, Identity=44%"; Hit description =Putative uncharacterized protein F9E11.8
  Pfam annotation: Domain name=Kelch_1; Domain location=126-170; Score =10.4; E_value=0.17; Accession=PF01344.16; Description=Kelch motif
  Pfam annotation: Domain name=Kelch_1; Domain location=171-210; Score =12.3; E_value=0.1; Accession=PF01344.16; Description=Kelch motif
  Pfam annotation: Domain name=Kelch_1; Domain location=211-257; Score =38.9; E_value=1.8e-08; Accession=PF01344.16; Description=Kelch motif
  Pfam annotation: Domain name=Kelch_1; Domain location=25-71; Score =20.0; E_value=0.0087; Accession=PF01344.16; Description=Kelch motif
  Pfam annotation: Domain name=Kelch_1; Domain location=76-121; Score =28.3; E_value=2.8e-05; Accession=PF01344.16; Description=Kelch motif
  Pfam annotation: Domain name=Kelch_2; Domain location=126-169; Score =12.4; E_value=1.4; Accession=PF07646.6; Description=Kelch motif
  Pfam annotation: Domain name=Kelch_2; Domain location=171-209; Score =9.2; E_value=3.4; Accession=PF07646.6; Description=Kelch motif
  Pfam annotation: Domain name=Kelch_2; Domain location=211-257; Score =21.0; E_value=0.0046; Accession=PF07646.6; Description=Kelch motif
  Pfam annotation: Domain name=Kelch_2; Domain location=25-71; Score =21.5; E_value=0.0031; Accession=PF07646.6; Description=Kelch motif
  Pfam annotation: Domain name=Kelch_2; Domain location=76-121; Score =19.0; E_value=0.018; Accession=PF07646.6; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch_2; Domain location=126-170::171-210::211-257::25-71::76-121::126 -169::171-209::211-257::25-71::76-121
WEKVEVKAIGTTTEGGGGGGPGKRWGHTCNAVKGGRLVYVFGGYGKDNCQTNQVHVFDTVKQTWSQPALKGSPPTPRDSHTSTAVGDNLFVFGGTDGMNPLKDLHILDTSLQTWVSPTIRGEGPPAREGHSAAVVGKRLFIFGGCGKSADNNNELYYNDLYILNAGTPPSPRDSHSCSSWRNKIIVIGGEDGHDYYLSDVHILDTGQLLPPRAGHSTVSFGKNLFVFGGFTDAQNLYNDLYMLDIDTGVWTNVTTATNGPSARFSVAGDCLDPFRSGVLIFIGGCRLNIPVNQSLPPGKKMFEAKVTENISEGYTIETVIDGKPLRGILFLNKPISLYTDAHTCSRKRTVGEIDSVVSNGIHPNQFKTPKVVKQNQMENREASRGDSSESHEHRTESIAVLMSSNPMTANPSDTHKVSANPEAEAAALNQNDEKHETPKSLIGNLTNDGANDVTSSKVPRRDKTSDAPNYNTEFLKPAAAESALHLSNQGEDIFSEVGFQTG

SEQ ID NO: 91902 - protein, 590 aa, Glycine max
  Coding DNA Sequence Number=SeqID_217
  Gene Ontology: Mol. function=ATPase activity, coupled to transmembrane movement of substances; Cellular component=integral to membrane; Biological process=transport
  Homolog annotation: Hit_ID=A7QHZ1; Match level="QueryCoverage=94%, HitCoverage=95%, E-value=0.0, Identity=71%"; Hit description =Chromosome chr17 scaffold_101, whole genome shotgun sequence
  Pfam annotation: Domain name=ABC_membrane; Domain location=43-315; Score=183.4; E_value=5.6e-52; Accession=PF00664.14; Description=ABC transporter transmembrane region
  Pfam annotation: Domain name=ABC_tran; Domain location=389-538; Score= 141.7; E_value=2e-39; Accession=PF00005.18; Description=ABC transporter
  Pfam module annotation: Pfam domain module=ABC_membrane::ABC_tran; Domain location=43-315::389-538
GRGKRDGASEGQASDLEHGDAVPAANVGFCRVLSLAKPEAGKLVIGTVALLIAATSSILVQKFGGKIIDIVSREMKTPEEKDEALNAVKNTILEIFLVVVFGSICTALRAWLFYTASERVVARLRKNLFSHLVNQEIAFFDVTRTGELLSRLSEDTQIIKNAATTNLSEALRNFSTALIGLSFMFATSWKLTLLALAVVPVLSVAVRKFGRYLRELSHKTQAAAAVASSIAEESFGAIRTVRSFAQEDYEVTRYSEKVNETLNLGLKQAVSLNAASTLSVIIVVIYGANLTIKGSMSSGDLTSFILYSLSVGSSISGLSGLYTVVMKAAGASRRVFQLLDRTSSMPKSGDKCPLGDHDGEVELDDVWFAYPSRPSHPVLKGITLKLHPGTKVALVGPSGGGKISIVSQEPTLFNCSIEENIAYGFDGKVNDVDIENAAKMANAHEFISKFPEKYQTFVGERGVRLSGGQKQRIAIARALLMDPKILLLDEATSALDAESEYLVQDAMESLMKGRTVLVIAHRLSTVKTADTVAVISDGQVVERGNHEELLSKNGVYTALGQMILRHKFLGRPSLPQLQVTALPSVSEERK

SEQ ID NO: 91903 - protein, 459 aa, Glycine max
  Coding DNA Sequence Number=SeqID_218
  Homolog annotation: Hit_ID=A7Q370; Match level="QueryCoverage=94%, HitCoverage=95%, E-value=7e-99, Identity=49%"; Hit description =Chromosome chr12 scaffold_47, whole genome shotgun sequence
MDHGNHLLVFTLLSFLLRGESWGWFSSSKETPSSGKTHAANEGNFSAEFSIESFNDHKGVKLIENAKKKMISSNSCWQNAYQHLFAGCSEILAVDEKRSRLAWHLSDCFQRDSGRSPFPHCDPKSSIVVCSRSLDDLAHKVYLEFYLETNTICYQLQAHAFKYETERLVTELKTSAQYVEHKLDSIEEKSEYLLQGSRQIHDSLDSIGSHTKQVVQTANYLEGHIDSVLTHSRSAYEQTTKIALSQTQLNEGKENMKRNLEDGLAMLKDSYNYLGKEIEKMDNLKSKAEDIGNMAGISIDKQQQLLEGQSTALEELNSLTEFQSKALEESRKTRQYFAEYGHRQHEELIQRQQQIQGFHDRLMENSREILSSQVCNFWNYETLNHQMLLTLINKVNSMQKEKELPWDLYTDYEGWSEWIDADLPDDVNCLDDPDHIQEVAENPITVTKNYNLRNRNLFH

SEQ ID NO: 91904 - protein, 181 aa, Glycine max
  Coding DNA Sequence Number=SeqID_219
  Gene Ontology: Mol. function=sequence-specific DNA binding; Cellular component=nucleus; Biological process=regulation of transcription, DNA-dependent
  Homolog annotation: Hit_ID=Q4F8B3; Match level="QueryCoverage=100%, HitCoverage=75%, E-value=3e-41, Identity=52%"; Hit description=MADS box protein
  Pfam annotation: Domain name=K-box; Domain location=13-110; Score =124.5; E_value=3.1e-34; Accession=PF01486.8; Description=K-box region
MMKTLEKYQKYSYSALETTRPINDSQNYQEYLRLKARVEVLQCSQRNLLGEDLAQMNTNELEQLENQLETALKNIRSTKTQFMLDQLSDLHHRETLLIETNNVLRSKLEETNNSQVQVSLALEAGGPSIQYTNFPPQSEGFFQPMGVNPTLQIGYNQTNPHDANVGASSLSMHGFASEWML

SEQ ID NO: 91905 - protein, 455 aa, Glycine max
  Coding DNA Sequence Number=SeqID_220
  Gene Ontology: Mol. function=binding; Cellular component=cytosol; Biological process=embryonic development ending in birth or egg hatching
  Homolog annotation: Hit_ID=A7PYY1; Match level="QueryCoverage=91%, HitCoverage=85%, E-value=0.0, Identity=75%"; Hit description =Chromosome chr4 scaffold_39, whole genome shotgun sequence
  Pfam annotation: Domain name=NMD3; Domain location=19-232; Score =298.3; E_value=1.5e-86; Accession=PF04981.4; Description=NMD3 family
MAQESGMFMVNQTIGSVLCCKCGIPMQPNAAKMCVKCLRSEVDITEGLLKCLVLVHCPECESYLQPPRSWVKLQLESKELLTFCLKKLQKNLNSNKVRLVHAEFIWTEPHSRRVKVKVKVQKEVLNGAILEQSYPVEYVQQEHMCESCSRVQANPDQWVAAVQLRQHVSHRRTFFYLEQLILKHGAAATAIRIKQMEQGKVAPLRSHHDKQLVSHDPKSNNYNYKYTFSVEISPICREDLICVPPRVAAGLGNIGPLVICTKVTNSIALLDPFTLRHCFIDADQYWRASFKSLLTSRQLVEYIVLDVETVSSEVTIGDTKYRLADAQVARISDFGKNDTIFNIKTHLGHLLNPGDYALGYDLCGANSNDMELDKYKGHIPEAILIKKSYEEKHQKKRGKPRSWKLKSLEMEVDDKGRVDQEYKPSDGDESSVPLEELLADLDLSEHEDEEDNMTE

SEQ ID NO: 91906 - protein, 188 aa, Glycine max
  Coding DNA Sequence Number=SeqID_221
  Homolog annotation: Hit_ID=A7PGG5; Match level="QueryCoverage=47%, HitCoverage=18%, E-value=3e-37, Identity=82%"; Hit description =Chromosome chr17 scaffold_16, whole genome shotgun sequence
MKRTKGEIILTMNCVVVWCGFDLDNKRRLRFSGGRSGVGIGEWWFREIVLSSIWGEARISAEWEGLMGLKKWESKVQKVGMGVLGSGGSGSGSGSGSSRSRMKMWMIRATTSVLLWTCIVQLTALGDMWGPRVLKGWPSCFTHESAVRAMDVELPSQRPPLLPPKRVYKNNGYLMVSCNGGLNQMRAA

SEQ ID NO: 91907 - protein, 703 aa, Glycine max
  Coding DNA Sequence Number=SeqID_222
  Gene Ontology: Mol. function=metal ion binding; Cellular component =nucleus; Biological process=regulation of transcription, DNA -dependent
  Homolog annotation: Hit_ID=A7Q6D8; Match level="QueryCoverage=98%, HitCoverage=100%, E-value=0.0, Identity=59%"; Hit description =Chromosome chr11 scaffold_56, whole genome shotgun sequence
  Pfam annotation: Domain name=PHD; Domain location=152-220; Score= -5.2; E_value=0.054; Accession=PF00628.20; Description=PHD-finger
  Pfam annotation: Domain name=fn3; Domain location=310-393; Score =24.5; E_value=0.0004; Accession=PF00041.12; Description=Fibronectin type III domain
  Pfam module annotation: Pfam domain module=PHD::fn3; Domain location =152-220::310-393
LALDPSKCSKLSMEEKRELVYEVSKWSHGASEMLQSWSRQEILQILCAEMGKERKYTGLTKLKIIENLLKIVSEKKSGGNETATDPEPQSSPAPGQKPAKRQRKSENPSHVPVPATSITVNNGGDSVNTAYCKNSACKATLNQSYAFCKRCSCCICHQYDDNKDPSLWLICSSENPFPGVSCGLSCHLECALKHDGSGIAKDGEHPKLDGGFYCVSCGKVNDLLGQRLLQGTEVYEELYKIVDEAVKKLEPEVGPLIGSPVKIGRGIVNRLSSGPEVQKLCGFALESLDSLLSKRILPSSPKPTTQDAHLLAPNMVRFEDVTATTLTIILGSEEPSGEIIAGYTLWHRKVDDVDYPTDPTCTSLLPNRRFRVSGLIPGTEYSFKVVSNDLRESGMCEVQVSTEHGEEEVPNCSATERSQSPVTNCSSLSNPSSVEDETNNCNPYSDLTDNRADHYPSYHKDSNQLASGNLSNDVINCSNLGSVGLPPDADSLSDKQHAGGTTASIPSSDVLKLENKHSPEEQVTEDMSTDDGLNSPALTGRECVPLVGSSKGGLPNTPCKLETLKDGPGKNKRSKSSGKDQENVSGKREGPQDGSTSKKRSGERQEEGRVANGFSDRDFEYYVKVIRWLECEGHIEKNFRQKFLTWYSLRATSQEVRIVKIYIDTFLEDPASLAEQLVDTFSECISSKRTSVVPAGFCMKLWH

SEQ ID NO: 91908 - protein, 367 aa, Glycine max
  Coding DNA Sequence Number=SeqID_223
  Gene Ontology: Mol. function=nucleotide binding; Cellular component =Golgi apparatus
  Homolog annotation: Hit_ID=A7PGG5; Match level="QueryCoverage=99%, HitCoverage=69%, E-value=1e-177, Identity=84%"; Hit description =Chromosome chr17 scaffold_16, whole genome shotgun sequence
  Pfam annotation: Domain name=DUF246; Domain location=1-314; Score =531.0; E_value=1.3e-156; Accession=PF03138.5; Description=Plant protein family
DFQDIFDVDHFIASLRDEVRILKELPPRLKMKVERGFLYTMPPISWSDISYYKDQILPLIQKYKVVHLNRTDARLANNGQPIEIQKLRCRVNFSGLRFTSQIEELGRKVIRLLRQKGQFLVLHLRYEMDMLAFSGCTQGCNSDEVDELTRMRYAYPWWKEKIINSDLKRKDGLCPLTPEETALTLKALDIDQNIQIYIAAGEIYGGERRMAGLAKEYPKLVNINTQGSMVRKETLLEPSDLRFFQNHSSQMAALDYLVSLESDIFVPTYDGNMAKVVEGHRRYLGFKRTILLNRKLLVELIDQYNNGVLNWDEFSSAVKEAHADRMGSQTKRFVIPERPKEEDYFYANPQECLEQSADEPLALSSST

SEQ ID NO: 91909 - protein, 507 aa, Glycine max
  Coding DNA Sequence Number=SeqID_224
  Gene Ontology: Mol. function=metal ion binding
  Homolog annotation: Hit_ID=A7PGG8; Match level="QueryCoverage=84%, HitCoverage=81%, E-value=3e-40, Identity=31%"; Hit description =Chromosome chr17 scaffold_16, whole genome shotgun sequence
  Pfam annotation: Domain name=C1_3; Domain location=12-41; Score=7.0; E_value=0.081; Accession=PF07649.3; Description=C1-like domain
  Pfam annotation: Domain name=PHD; Domain location=13-60; Score=45.7; E_value=1.6e-10; Accession=PF00628.20; Description=PHD-finger
  Pfam module annotation: Pfam domain module=C1_3::PHD; Domain location= 12-41::13-60
MATGPADSYTETKCGVCHAGTDEHLLLLCDLCDTASHTYCVGLGYTVPEGDWFCHDCAISRKINIKEDSDQQNVVPTAEPRVTVDIFDIVRETGSQVVQRPRASPLQQNLSSPSVIPLPDRLSYLSRLKGKRPVTGFCHMQRNVKAFRENWNALRSGSLQFRCNSSQPGSTVSQKQDSSSLSHHKLDDLHSMASTSLQQSTVQGGPSNKMLNERVFKDADKAWKMMDRAKKIQLPHHRTGRVDKPSCSGGARKISLAHCNFSEVKDQHSKALDLRNTKKEKQCDYSRLNQNLENRSTLKLEEKRQSRDTCEKMIHVRDHTTHSKGYCERPLSRKVHTSIQGGPCREDGLRNVAEEQSLYACLVTSADLASSRDKFGSMFSNRGVNLVNEEKRLAKSSEDGNTRNIVDSKTEIQSLVKLNLKLLTRDKKLGFDTFKVVARQATHTILAACSSDQQKSSTSSSSSVCSHADNTPQFQKSTLMPNCCRQCFYNFVNNVVHSTILEKVGCA

SEQ ID NO: 91910 - protein, 492 aa, Glycine max
  Coding DNA Sequence Number=SeqID_225
  Gene Ontology: Mol. function=signal peptidase activity; Cellular component=integral to membrane; Biological process=signal peptide processing
  Homolog annotation: Hit_ID=A9PH26; Match level="QueryCoverage=98%, HitCoverage=69%, E-value=1e-161, Identity=64%"; Hit description =Putative uncharacterized protein
  Pfam annotation: Domain name=ECH; Domain location=181-333; Score= -65.3; E_value=0.046; Accession=PF00378.11; Description=Enoyl-CoA hydrataseisomerase family
  Pfam annotation: Domain name=Peptidase_S49; Domain location=246-400; Score=153.9; E_value=4.3e-43; Accession=PF01343.9; Description =Peptidase family S49
  Pfam module annotation: Pfam domain module=ECH::Peptidase_S49; Domain location=181-333::246-400
MSVQRCVLENLGIEPEVERIGKYKSVGDQLTRKTMSEDHHEMLTALLDNIYTNWLDKVSSARGKKREDIENFINKGVYQVERLKEEGFLTDIIYDDEVITRLKERLQVKTDKNLPMVDNRIQLQVMGLSPTLEVWDSSVGLVLSIGIRAFHHVSVANERHRKYSGVRKSTLGLSGGKELIAIIRASGSIRRIESSLSTRSSGIIGEKLIEKIRKVRESNKYKAAIIRIDSPGGDALASDLMWREIRLLAASKPVIASMSDVAASGGYYMAMGAGVIVAESLTLTGSIGVVTGKFNLGKLYEKIGFNKEIISRGRYAELRAAEQRSLRPDEAELFSKSAQHAYKQFRDKAALSRSMTVDKMEEVAQGRVWTGKDAASHGLVDAIGGLSRAVAIAKLKANIPLDRQTIILVIVLELCQVTVLELSRPSPSLPEILRGLGNSLVGVDRTFNELLQDLTFSHEVQARMDGIMFEKLEGYPYANPILALIKDYLSSL

SEQ ID NO: 91911 - protein, 428 aa, Glycine max
  Coding DNA Sequence Number=SeqID_226
  Gene Ontology: Cellular component=chromosome, pericentric region; Biological process=cell cycle
  Homolog annotation: Hit_ID=A7PGJ6; Match level="QueryCoverage=66%, HitCoverage=98%, E-value=2e-57, Identity=43%"; Hit description =Chromosome chr17 scaffold_16, whole genome shotgun sequence
  Pfam annotation: Domain name=F-box; Domain location=24-74; Score =18.9; E_value=0.019; Accession=PF00646.24; Description=F-box domain
  Pfam annotation: Domain name=Mis12; Domain location=147-341; Score =64.8; E_value=3e-16; Accession=PF05859.3; Description=Mis12 protein
  Pfam module annotation: Pfam domain module=F-box::Mis12; Domain location=24-74::147-341
MAIVRLMKTSNKKRHTYNNGSSTSPIKSLPKDLLVEVVARVASDSIVDLRNMKQCCKDFLDASEDNYVWQQVSLDKFPLMRWLPNDKASCFLKCCRESGNIESLYREGLLKFFNYPNGNINGLGDLKTAALKGHIEAKYVYEGDSEAIFGALNLNPQLFCNEVLNIVDDVLDEAFNFFYQDASTKLNIEGTQRSQDLKKGVDCVRLNVQSVLDKQLAAWESYILRHCFALPQGFRMPNTANVSNYYVMLVVEFKAMTSIASTPMLVVDVDLYSICVRDIAIDDDEIPDESNENALDPGAPFDPDIDAQLDSLREKLIEVGKESEMLNQEMQALERKSAVNVAGHINEAVQLYEQNSMHEVFQEIVTTASELGAKMAKLNSSMIEETDQTKTKRIYSTEMDLSAINPAKGLSNMKLDDVEEFVSVMKSM

SEQ ID NO: 91912 - protein, 84 aa, Glycine max
  Coding DNA Sequence Number=SeqID_227
  Subcellular localization annotation: CTP_CleavageSite=48; ConfidenceScore=5.17e-01
MAWGGLSGAGTPQFHFSLLLVARQGCRPRWPETTTTTTIESLRDVDVNNSRGVANTTQVDEGHNILVIVAGEEHPTHLAKPLSL

SEQ ID NO: 91913 - protein, 598 aa, Glycine max
  Coding DNA Sequence Number=SeqID_228
  Gene Ontology: Mol. function=phenylalanine-tRNA ligase activity; Cellular component=cytoplasm; Biological process=phenylalanyl-tRNA aminoacylation
  Homolog annotation: Hit_ID=A7PGI6; Match level="QueryCoverage=98%, HitCoverage=98%, E-value=0.0, Identity=76%"; Hit description =Chromosome chr17 scaffold_16, whole genome shotgun sequence
  Pfam annotation: Domain name=B3_4; Domain location=119-281; Score =48.6; E_value=2.2e-11; Accession=PF03483.8; Description=B34 domain
  Pfam annotation: Domain name=B5; Domain location=306-379; Score=93.2; E_value=8.2e-25; Accession=PF03484.6; Description=tRNA synthetase B5 domain
  Pfam module annotation: Pfam domain module=B3_4::B5; Domain location =119-281::306-379
MPTVSVGRDRLYAALGKTYTQEEFEDLCFSFGIELDDVTTEKAIVRKEKHLDEEEADEDEEVIYKIEVPANRYDLLCLEGLAQALRVFCEFQEIPTYRLSNISKDAIQKMHVKPETSLIRPYVVCAVLRGITFDKVRYSSFIDLQDKLHQNICRRRTLVAIGTHDLDKLEGPFTYEALPPSSITFTPLKQERNFRADELMEFYKSDLKLKKFLHIIEDSPVFPVIYDSKRTVLSLPPIINGAHSAITLETKNVFIECTATDLTKAKIVLNTMVTAFSEYCENKFVIEPVEVISSDGKSNIYPDLSVYNMEVSLSYINGLIGVSLEAEEVTKYLNRMQLHAKQSASHNKQCNIVVSVPPSRSDVLHPCDVMEDVAIAYGFNAIKDKAVVDNKGSKRLAASLTLLPLNELSDLIRKEVALIGFTEVLTFILCSKKENFAMLNRKDDKSKAVIIGNPRSSDFEAVRTSLMPGILKTVAHNKDHPKPIKIFEVGDIAVLDEQRDVGAKNLRQLAALYCGANAGFEIIHGLVDRVMEKNGVPFVSPGDKSGYYIERSDEPEFLAGRQARIIYKGKHIGTFGIVHPEVLLIPEIMSACFNMAIC

SEQ ID NO: 91914 - protein, 128 aa, Glycine max
  Coding DNA Sequence Number=SeqID_229
  Gene Ontology: Mol. function=zinc ion binding; Cellular component =cytoplasm
  Homolog annotation: Hit_ID=A5ADS2; Match level="QueryCoverage=66%, HitCoverage=17%, E-value=5e-17, Identity=50%"; Hit description =Putative uncharacterized protein
  Pfam annotation: Domain name=PB1; Domain location=31-117; Score=36.1; E_value=1.3e-07; Accession=PF00564.15; Description=PB1 domain
MSLPGSQFKAANRYAKSLATLSKFCSEEEASSRIRVKYGDTLRRFSARVDENNRLELDMVDLRAKICSIFSFSADANLILRYVDEDGDLVTLVDDDELRDVMRQQFESSLKFDVHMTMTVGVNSNAGV

SEQ ID NO: 91915 - protein, 89 aa, Glycine max
  Coding DNA Sequence Number=SeqID_230
MASKLEKRTEHLELFYTEGCQLIRILSCVLKWKKEGIKKMFNAEEDQEEEEAPETKISRKENYKSTTIRKQGKPELQIEVRFWLIATGS

SEQ ID NO: 91916 - protein, 29 aa, Glycine max
  Coding DNA Sequence Number=SeqID_231
MEGNGPRESNRDDCVVGGANHILYNNPNE

SEQ ID NO: 91917 - protein, 287 aa, Glycine max
  Coding DNA Sequence Number=SeqID_232
  Gene Ontology: Mol. function=ATP-dependent helicase activity; Cellular component=nucleus; Biological process=mRNA catabolic process, nonsense-mediated decay
  Homolog annotation: Hit_ID=A7PCT3; Match level="QueryCoverage=71%, HitCoverage=48%, E-value=3e-93, Identity=83%"; Hit description =Chromosome chr17 scaffold_12, whole genome shotgun sequence
  Pfam annotation: Domain name=Helicase_C; Domain location=127-203; Score=126.2; E_value=9.6e-35; Accession=PF00271.22; Description =Helicase conserved C-terminal domain
MPLTLILPGVSHEGIEIYSRHILKMRTILTRYVLCVWIRPDRQTLLWSATWPRDVETLARQFLHNPYKVIIGSPYLKANQSINQIVEVVTDMEKYNRLIRLLKEVMDGSRILIFMETKKGCDQVTRQMRVDGWPALSIHGDKNQAERDWVLAEFKSGRSPIMTATDVAARGLDVKDIKCVINYDFPTSLEDYVHRIGRTGRAGAKGTAYTFFTHANAKFARDLIKILQDAGQTVSPALTALVRSAGSGQFGSGGGFRSRGRGGYGNRGLTSGSNAIPLGSKRPWHCL

SEQ ID NO: 91918 - protein, 44 aa, Glycine max
  Coding DNA Sequence Number=SeqID_233
MYPITSDHNIQSTAQDMTQVLHVDEHLCRVMDSDGYSLTSRLSV

SEQ ID NO: 91919 - protein, 627 aa, Glycine max
  Coding DNA Sequence Number=SeqID_234
  Gene Ontology: Mol. function=amine oxidase activity; Cellular component=cytoplasm; Biological process=amine metabolic process
  Homolog annotation: Hit_ID=A7QXZ7; Match level="QueryCoverage=96%, HitCoverage=88%, E-value=0.0, Identity=74%"; Hit description =Chromosome undetermined scaffold_235, whole genome shotgun sequence
  Pfam annotation: Domain name=Cu_amine_oxid; Domain location=257-600; Score=489.5; E_value=4.2e-144; Accession=PF01179.11; Description =Copper amine oxidase, enzyme domain
  Pfam annotation: Domain name=Cu_amine_oxidN2; Domain location=8-118; Score=31.6; E_value=2.8e-06; Accession=PF02727.7; Description=Copper amine oxidase, N2 domain
  Pfam annotation: Domain name=Cu_amine_oxidN3; Domain location=133 -237; Score=174.5; E_value=2.7e-49; Accession=PF02728.7; Description =Copper amine oxidase, N3 domain
  Pfam module annotation: Pfam domain module=Cu_amine_oxid::Cu_amine _oxidN2::Cu_amine_oxidN3; Domain location=257-600::8-118::133-237
MSRTQSSHPLDPLSAAEISVAVATVRAAGATPELRDSIRFIEVVLLEPDKHVVALADAYFFSPFQPSLLPRTKGGAVIPSNLPPRCARIVVYNKKTNETSIWIVELSQVHAVTRRGHHRGKVISSQVVPDAQPPMDAMEYAECEAVVKDFPPFREAMKKRGIEDMDLVMVDAWCVGYYNEADDPNRRLTKPLIFCRGESDSPMENGYARPVEGIYVLVDMQNMLVIEFEDRKFVPLPPVDPLRRYTHGETRGGFDRSDIKPLQIIQLEGPSFRVDGSYVAWQKWNFRIGFTPREGLVIYSVAYIDGSQGRRPVAHRLSFVEMVVPYGDPNEPHYRKNAFHAGENGLGKNAHSLKKGCDCLGYIKYFDAHFTNFTGGVETIENCVCLHEEDHGILWKHHDWRTGLAEDGKIESEVKLTGILSLGSLLPGEFRKYGTTIAPGLYAPVHQHFFVARMNMTVDSKPGDALNQVVEINVKVEEPGDNNVHNNAFYAEETLLKSELEAMRDCNPLAARHWIVRNTRIGNRTGQLTGYKLVPGSNCLPLAGSEAKFLRRAAFLRHNLWVPRLEDWPVMPVERIGFMLMPHGFFNCSPAVDVPLPSPCELDSKENDMNETEASKEIEGCVLVAKL

SEQ ID NO: 91920 - protein, 439 aa, Glycine max
  Coding DNA Sequence Number=SeqID_235
  Gene Ontology: Mol. function=carbon-sulfur lyase activity; Cellular component=vacuole
  Homolog annotation: Hit_ID=A7PCU3; Match level="QueryCoverage=67%, HitCoverage=64%, E-value=1e-109, Identity=64%"; Hit description =Chromosome chr17 scaffold_12, whole genome shotgun sequence
  Pfam annotation: Domain name=Alliinase_C; Domain location=4-345; Score=534.2; E_value=1.4e-157; Accession=PF04864.4; Description =Allinase, C-terminal domain
  Pfam annotation: Domain name=Aminotran_1_2; Domain location=19-371; Score=-85.1; E_value=0.0051; Accession=PF00155.12; Description =Aminotransferase class I and II
  Pfam module annotation: Pfam domain module=Alliinase_C::Aminotran_1 _2; Domain location=4-345::19-371
MLMVCSGDPTIYERFWRQVGDKTTIIIPGWQSLSYFSDGSNICWFLETEFAREVVRLHKVVGNAVTEGRHIVVGTGSSQLILAALYALSSPDAAEPISVVSAAPYYSSYPSMADYQKSGLYKWAGDAENFDKEGPYIELVTSPNNPDGHRREAMVNRSQGLLIHDLAYYWPQYTPISSPSDHDLTLFTVSKSTGHAGMRIGWALVKDKGVAKKMTKFIEISTIGVSKDSQLRAAKVLKAVSDSCEHENSQYEESFFMYSYNIMSQRWKQLRAVVEAGDLFTLPQFSPAFCTFFGQETEPQPGRCGCSGECERRRLVANQAKEEMEVMPKTPDVRKPATARAMNRAAGSKTGLKMTKSGVTTVRLMTVAERLSCCCGSAMGGIEASYVCVRGIVGYGKRERGGDENLRKRKVVTRGEGDEHLGGGLHGKRYMSFDSEERC

SEQ ID NO: 91921 - protein, 321 aa, Glycine max
  Coding DNA Sequence Number=SeqID_236
  Gene Ontology: Mol. function=oxidoreductase activity; Cellular component=endoplasmic reticulum; Biological process=metabolic process
  Homolog annotation: Hit_ID=Q8RWK2; Match level="QueryCoverage=96%, HitCoverage=96%, E-value=1e-114, Identity=65%"; Hit description =Ribitol dehydrogenase-like
  Pfam annotation: Domain name=adh_short; Domain location=38-174; Score= -15.3; E_value=0.00013; Accession=PF00106.16; Description=short chain dehydrogenase
  Subcellular localization annotation: CTP_CleavageSite=57; ConfidenceScore=5.16e-01
MKATLRYLAGLAGPSGFGSNSTAEQVTQDCSSLLPSNLTALITGGTSGIGAETARVLAKRGVRIVIGARDLRKAKEVREKIQKESPHAEKYIHEGLKVRVIVFHRNNAGMYSQNLEFSEEKIEMTFATNYLGHFLVTKMLLEKMIDTAKKTGIQGRIINVSSVIHSWVKRSCFSFNDMLCGKNYNGTRAYAKSKLATILHVKEVARQLKERNANVTINAVHPGIVKTGIIRAHKGLITDSLFFIASKLLKSISQGASTTCYVALSEQTDGVSGKYFTDCNESNCSSLANDESEARKLWNDTHALLHKRLRQATNSKCFFPT

SEQ ID NO: 91922 - protein, 207 aa, Glycine max
  Coding DNA Sequence Number=SeqID_237
  Gene Ontology: Mol. function=transporter activity; Cellular component= intracellular; Biological process=transport
  Homolog annotation: Hit_ID=A7PCV8; Match level="QueryCoverage=68%, HitCoverage=54%, E-value=1e-55, Identity=73%"; Hit description =Chromosome chr17 scaffold_12, whole genome shotgun sequence
  Pfam annotation: Domain name=CRAL_TRIO_N; Domain location=38-107; Score=14.2; E_value=0.0027; Accession=PF03765.6; Description =CRALTRIO, N-terminus
  Subcellular localization annotation: CTP_CleavageSite=31; ConfidenceScore=5.04e-01
MVLMRTVYPTIAVPLPLPLSNLPVRTNFAVRCANVHSQTQLDSRKLVLAVKEKLEKEHHNLPVGRNGRDDEDMILWFLKDRKFSIDDAIYKLTKAIKWRRDFEVSKLTEEVVKDALQTGKGYVHDLLDINGRPVVVVVGSKHIPQALDPADDERLCVFLIEKALSKLPTGKEQILTIVDLRGFSTENADLKFLTFLVVFFIICQISF

SEQ ID NO: 91923 - protein, 128 aa, Glycine max
  Coding DNA Sequence Number=SeqID_238
MHFLEVTLDKSYGHILGVPKLRARLQKPQTALVVVSEDHSQISDLQKAPKDTFPIGNSCFHISGKDGRKPVVSFCNRPFSRDIEVISSSNSKRTRISISSFMVPYVLVASFLYPQFILPEIIPKISGN

SEQ ID NO: 91924 - protein, 337 aa, Glycine max
  Coding DNA Sequence Number=SeqID_239
  Gene Ontology: Mol. function=inositol-1,3,4-trisphosphate 5/6-kinase activity; Cellular component=intracellular; Biological process =inositol trisphosphate metabolic process
  Homolog annotation: Hit_ID=A7X665; Match level="QueryCoverage=93%, HitCoverage=100%, E-value=1e-170, Identity=95%"; Hit description =Inositol phosphate kinase
  Pfam annotation: Domain name=Ins134_P3_kin; Domain location=4-308; Score=501.1; E_value=1.3e-147; Accession=PF05770.2; Description =Inositol 1, 3, 4-trisphosphate 56-kinase
MSESEVAGQRYRVGYALQGKKVESFIQPSLLDHAKQHSIDLVQIDPTAPLQQQGPFHCIIHKLHTQHWKNLLQQFSSKHPNTVIIDPPELVDRLHNRVSMLDAVTHLQFSLENATIGVPKQVVVNEPKSFDLHKFEEEQGLRFPVIAKPLAADGGAGSHELCLVFDEEGLHALSVPMVLQEFVNHGGVVFKIYVAGQRVNCVKRKSLGDITEEKLKVLRGSLPFSRVSSLGVEDEGGGAVEDAEMPPQSLVGELARGLREALGLNLFNVDVIRDGKEPTRYLVIDINYFPGYAKLPSYEPFITDFLLDIVRSKTAYFTSLNCSVQCPCIKLGLERGC

SEQ ID NO: 91925 - protein, 112 aa, Glycine max
  Coding DNA Sequence Number=SeqID_240
MIRNRCSQFRAFSEFLPARGRKIDKENKLYIHERCGGEDLWHGGEGLEDFPGRQRRWRGRRRRGRGEGEEGEEGARAEGRDGGVTGLVSDGDACDDLEVEDAGSEGEDEVEG

SEQ ID NO: 91926 - protein, 545 aa, Glycine max
  Coding DNA Sequence Number=SeqID_241
  Gene Ontology: Mol. function=RNA splicing factor activity, transesterification mechanism; Cellular component=ribonucleoprotein complex; Biological process=rRNA processing
  Homolog annotation: Hit_ID=Q9FJY5; Match level="QueryCoverage=93%, HitCoverage=98%, E-value=2e-98, Identity=64%"; Hit description =Genomic DNA, chromosome 5, TAC clone:K1F13
  Pfam annotation: Domain name=Mpp10; Domain location=12-525; Score =508.0; E_value=1.1e-149; Accession=PF04006.3; Description=Mpp10 protein
MENTSNDAGVEALRLLKATEPPSFLTPNPALSEAARTASQYLFSSLKPFSPKSPLDQLLVDGFDAEQIWQQIDLQTQPLLSTIRRRVKQLVENPEEISQLKVPSEGGNKKEEKSQDEWEEESDGFDEELDEEEEEDEDDEVKEGEGEEEEEETEDEEEEGEDNEEGGVIEDKFFKIDELTKYLEKEEDDFENGEADREGEEEDDEEESDEEGDFGIGDDDDEDEDEEAEGIESARYEDFFGGKKERGSKRKAQVLQESEYSDDEDDMEFDKQTKGTASAHEKQLEKIQSKIELMEKANIDPKTWTMQGEVTAAKRPKNSALEVDLDFEHNVRPAPVITEEVTASIEDIIKKRIIEGHFNDVQRVPKLPSKAPREVKELDDNKSKQGLAELYEQEYVQKTDPTSAPLSFKDEQKNEASMLFKRLCLKLDALSHFNFAPKPVIEDMSIQANVPALAMEEIAPVAVSDAAMLAPEEVFDGKGDIKEETELTKAERKTRRANKKRKFKAEAVKRTNKKAQEGVIRSKVNGFYKVMVEVTSLMSGACFLS

SEQ ID NO: 91927 - protein, 56 aa, Glycine max
  Coding DNA Sequence Number=SeqID_242
MQVDDGEENKVFVIAEDVHGGRRWSDAKEEMGGVEEWKQNHKGKDKEAIVWHVKVF

SEQ ID NO: 91928 - protein, 626 aa, Glycine max
  Coding DNA Sequence Number=SeqID_243
  Gene Ontology: Mol. function=serine-type endopeptidase activity; Cellular component=small subunit processome; Biological process=rRNA processing
  Homolog annotation: Hit_ID=A7PB86; Match level="QueryCoverage=96%, HitCoverage=71%, E-value=0.0, Identity=62%"; Hit description =Chromosome chr16 scaffold_10, whole genome shotgun sequence
  Pfam annotation: Domain name=WD40; Domain location=134-174; Score =16.7; E_value=0.088; Accession=PF00400.23; Description=WD domain, G -beta repeat
  Pfam annotation: Domain name=WD40; Domain location=185-266; Score =6.9; E_value=4.4; Accession=PF00400.23; Description=WD domain, G -beta repeat
  Pfam annotation: Domain name=WD40; Domain location=329-368; Score =0.9; E_value=25; Accession=PF00400.23; Description=WD domain, G-beta repeat
  Pfam annotation: Domain name=WD40; Domain location=372-413; Score =39.0; E_value=1.7e-08; Accession=PF00400.23; Description=WD domain, G-beta repeat
  Pfam annotation: Domain name=WD40; Domain location=417-456; Score =38.7; E_value=2.1e-08; Accession=PF00400.23; Description=WD domain, G-beta repeat
  Pfam annotation: Domain name=WD40; Domain location=470-508; Score =34.9; E_value=2.9e-07; Accession=PF00400.23; Description=WD domain, G-beta repeat
  Pfam annotation: Domain name=WD40; Domain location=50-88; Score=23.2; E_value=0.00095; Accession=PF00400.23; Description=WD domain, G-beta repeat
  Pfam annotation: Domain name=WD40; Domain location=512-550; Score =41.4; E_value=3.3e-09; Accession=PF00400.23; Description=WD domain, G-beta repeat
  Pfam annotation: Domain name=WD40; Domain location=554-592; Score =37.9; E_value=3.8e-08; Accession=PF00400.23; Description=WD domain, G-beta repeat
  Pfam annotation: Domain name=WD40; Domain location=92-130; Score =51.1; E_value=3.9e-12; Accession=PF00400.23; Description=WD domain, G-beta repeat
  Pfam module annotation: Pfam domain module=WD40::WD40::WD40::WD40::WD4 0::WD40::WD40::WD40::WD40::WD40; Domain location=134-174::185 -266::329-368::372-413::417-456::470-508::50-88::512-550::554-592::92- 130
MEPLRLKTNYRCVPALQQFYTGGPFVVSSDSSFIACACGESIKIVDSATAAIRSTLDADSESFTALALSPDDRLLFSSGHSRQIRVWDLSTLKCVRSWKGHEGPVMCMTCHPSGGLLATGGADRKVLVWDVDGGYCTHYFKGHGGVVSCVMFHSDPEKQLLFSGSDDGGDHATVRVWDISKTKKKNCIATLDNHSSAVVTLWDLHGYSGKKTVITNEAVEAVCVIGAGSPFASSLDLYQQNAKIHDGSEIFYFITVGERGIVRIWNSKGAGCIFEQKTSDVTAGMDEDGSRRGFTSAVMLASDQGLLCVTADQQFLFYSLDFTEQLLQLNLTKRLVGYNEEIVDMKFIGDDEKFLALATNLEQIRVYDLSSMSCSYVLSGHTEIVLCLDSCVSSSGKPLIVTGSKDNSVRLWEPESANCIGVGIGHMGAVGAIAFSKRKRDFFVSGSSDHTLKVWSMDGLLDNMTVPINLKAKAVVAAHDKDINSVAVAPNDSLVCSGSQDRTACVWRLPDLVSVVVFKGHKRGIWSVEFSPVDQCVVTASGDKTIRIWAISDGSCLKTFEGHTSSVLRALFVTRGTQIVSCGADGLVKLWTVKTNECVATYDHHEDKVPVDPLIYLFSDDFSFNS

SEQ ID NO: 91929 - protein, 799 aa, Glycine max
  Coding DNA Sequence Number=SeqID_244
  Gene Ontology: Mol. function=pantothenate kinase activity; Cellular component=cytoplasm; Biological process=coenzyme A biosynthetic process
  Homolog annotation: Hit_ID=Q8L5Y9; Match level="QueryCoverage=95%, HitCoverage=92%, E-value=0.0, Identity=73%"; Hit description =Pantothenate kinase 2
  Pfam annotation: Domain name=Fumble; Domain location=47-394; Score =672.9; E_value=2.6e-199; Accession=PF03630.5; Description=Fumble
MAHTGSNSSMHRSSSRPQLDLSKAEIQGNFEEKYPTILLPNQSHDISHLALDIGGSLIKLVYFSRHQDQSTYDKRVKNVKNRLGFPPNGNRRSYPILGGRLHFVKFETSKINECLDFISSKQLHSAGGESRYSDARTDSNAIIKATGGGAHKFADLFKERLGLSLDKEDEMSCLVAGANFLLKAIRHEAFTHMEGQKEFVQIDTNDLFPYLLVNIGSGVSMIKVDGDGKYERVSGTNVGGGTYWGLGRLLTKCESFDELLELSQKGDNSNTDMLVGDIYGGMDYSKIGLSASTIASSFGKATSEKKGLEDYRPEDISLSLLRMISYNIAQIAYLNALRFGLKRIFFGGFFIRGHAYTMDAISFAIHFWSNGAAQAMFLRHEGFLGALGAFMSYEKHGLDDLMVHQLVERFPMGAPYTGGKIHGPPLRDLNEKASERNWKTLMFAVQISWMEKFLQKVTEITAPVPMAPPGTTGLGGFEVPLSKGSTLRSDASALNVGVLHLVPTLEATIVSSAWLLWLMQNLYLMKVLVQDFVRALARSCGQGGTDDAKRRGDAFARAFSAHLARENEASLAVLPDLLMELDSMDEETRLLTLIEGVLAANIFDWGSRACVDLYHKGTIIEIYRMSRNKMQRPWRVDDFDAFKQRMLGTGDKKPPPHRRALLFVDNAGADIVLGMLPLARELLRRGTEVVLVANSLPALNDVTAMELPDIVAEAAKHCDILRRAAESGGLLVDAMTNTLDSPRENSSSVPLMVVENGCGSPCIDLRQVSSELAAAAKDADLGWVELFIPTSMPDFSVML

SEQ ID NO: 91930 - protein, 267 aa, Glycine max
  Coding DNA Sequence Number=SeqID_245
  Homolog annotation: Hit_ID=A7PD37; Match level="QueryCoverage=100%, HitCoverage=100%, E-value=8e-81, Identity=56%"; Hit description =Chromosome chr17 scaffold_12, whole genome shotgun sequence
MPGPGPHLMYAMGSGLCLTSISNGRFGPHHTLFYTINAFFGPDVGSFTEWLGSLFGGSAHALGSSLEDLIHHPFFYILLLGLPLSFLYSRISSYLLHTQLLDSVSRVGLSLFFVSSVVENSGFTAGSFTHFFLDHLFEENGKTTTYTWILSTGWWQSRAPVNPDAVVVVVFLCACLIGGFFYLNRANASNSMMKKSYQSMLLVMSIACLYCLWCAIQIYWISPPRPAVGEEADLGVLVFLAIYFFLPYGLCIMSMSPKDHDPNQIPL

SEQ ID NO: 91931 - protein, 210 aa, Glycine max
  Coding DNA Sequence Number=SeqID_246
  Gene Ontology: Mol. function=ribonuclease III activity; Cellular component=intracellular; Biological process=RNA processing
  Homolog annotation: Hit_ID=A2XP78; Match level="QueryCoverage=71%, HitCoverage=70%, E-value=2e-28, Identity=43%"; Hit description =Putative uncharacterized protein
  Pfam annotation: Domain name=Ribonuclease_3; Domain location=99-186; Score=13.2; E_value=0.00039; Accession=PF00636.17; Description =RNase3 domain
MASFRRSTALAQQKVARSSDLGVLGLDLDVKIRSKISWKHGLGEGHATTPTSKLRLKPLSSPFSTALETLQKQLGYTFKSIDLLRRAMTHASFSEENNKAFAILGASVIETSVSFHLLSRDVDLSSKELNRRLSQITNVDSSCAVDGTRLGLHKVVRVSPKTNSSAPAVVCGAFRAIFGAVAIDTGKSDDAGNVFWNLHGGGDLGVAVAL

SEQ ID NO: 91932 - protein, 88 aa, Glycine max
  Coding DNA Sequence Number=SeqID_247
MGEEEVVAARTVAGGGGAGGGGGGNGDSNKPTMVVIVISSGSNHGKRDTGGDKGGSCNGSRGSKNKENKWAMWGEVILIQRVGLGTVN

SEQ ID NO: 91933 - protein, 286 aa, Glycine max
  Coding DNA Sequence Number=SeqID_248
  Gene Ontology: Mol. function=molecular_function; Cellular component =membrane; Biological process=auxin mediated signaling pathway
  Homolog annotation: Hit_ID=A7PD50; Match level="QueryCoverage=97%, HitCoverage=96%, E-value=1e-62, Identity=43%"; Hit description =Chromosome chr17 scaffold_12, whole genome shotgun sequence
  Pfam annotation: Domain name=DUF6; Domain location=143-250; Score =6.4; E_value=0.03; Accession=PF00892.11; Description=Integral membrane protein DUF6
  Pfam annotation: Domain name=DUF6; Domain location=21-140; Score =14.4; E_value=0.01; Accession=PF00892.11; Description=Integral membrane protein DUF6
  Pfam module annotation: Pfam domain module=DUF6::DUF6; Domain location=143-250::21-140
MGVRSNLVEWSPFIAMVTVECLNVGLSTLSKAAMSRGVNHFVLVVYSNNKAIPFFLASLQVLPPRHSRICSITVMQNCVFIGINYSSPTLGSTMSNLSPAITFVLAVTLRMEKLNIRSSISQIKVMGAVLSISGALVVTFYKGSSISTFRIQPSLLAETNNWVIGGLVFAMASVSFAAWNITQAIAGSVVTFSVTAWCIKRKGPVFVSMFKPAGIAIAAFSSVAFLGETLHVGSIIGAVIIAIGLYTVLWAQSKEENLKGLEVDRKPSPSTQTSPLLESHQRNILA

SEQ ID NO: 91934 - protein, 201 aa, Glycine max
  Coding DNA Sequence Number=SeqID_249
  Gene Ontology: Mol. function=metal ion binding; Cellular component =cytoskeleton; Biological process=regulation of the force of heart contraction
  Homolog annotation: Hit_ID=A7PD59; Match level="QueryCoverage=86%, HitCoverage=98%, E-value=2e-82, Identity=77%"; Hit description =Chromosome chr17 scaffold_12, whole genome shotgun sequence
  Pfam annotation: Domain name=LIM; Domain location=102-158; Score =74.1; E_value=4.5e-19; Accession=PF00412.13; Description=LIM domain
  Pfam annotation: Domain name=LIM; Domain location=11-59; Score=34.1; E_value=4.9e-07; Accession=PF00412.13; Description=LIM domain
  Pfam module annotation: Pfam domain module=LIM::LIM; Domain location =102-158::11-59
MASFAGTTQKCTACEKKVYWVEQLTADNKVYHKSCFRCHHCKGTLKGVLYCKPHFDQLFKMTGSLDKSFEGIPRSARVERSADQVQSNNKVSRLFSGTQEKCVGCKKTVYPIEKVAVDGKSYHKSCFRCTHGGCVISPSNYVAHEHRLYCRHHHTQLFKQKGNFSQLDKHDSVQVVITENTTQHPDPSNGNTDTTPAEESS

SEQ ID NO: 91935 - protein, 206 aa, Glycine max
  Coding DNA Sequence Number=SeqID_250
  Gene Ontology: Mol. function=nucleotide binding; Cellular component =intracellular; Biological process=small GTPase mediated signal transduction
  Homolog annotation: Hit_ID=O82481; Match level="QueryCoverage=80%, HitCoverage=77%, E-value=5e-87, Identity=92%"; Hit description=Rac -like GTP-binding protein ARAC10
  Pfam annotation: Domain name=Miro; Domain location=10-123; Score =53.9; E_value=5.5e-13; Accession=PF08477.4; Description=Miro-like protein
  Pfam annotation: Domain name=Ras; Domain location=10-192; Score =209.0; E_value=1.2e-59; Accession=PF00071.13; Description=Ras family
  Pfam module annotation: Pfam domain module=Miro::Ras; Domain location= 10-123::10-192
MAATASRFIKCVTVGDGAVGKTCMLICYTSNKFPTDYIPTVFDNFSANVVVENTTVNLGLWDTAGQEDYNRLRPLSYRGADVFVLAFSLVSHASYENVLKKWVPELQHFAPGVPVVLVGTKLDLREDKHYLADHPGLAPVTSEQGEELRKLVGATYYIECSSKTQQPSSPGETSLVVVNMVGIWQLGKKLNQYVKGPYYYGPDHKW

SEQ ID NO: 91936 - protein, 539 aa, Glycine max
  Coding DNA Sequence Number=SeqID_251
  Gene Ontology: Mol. function=actin filament binding; Cellular component=intercellular junction; Biological process=actin cytoskeleton organization and biogenesis
  Homolog annotation: Hit_ID=A7PD83; Match level="QueryCoverage=70%, HitCoverage=44%, E-value=2e-68, Identity=39%"; Hit description =Chromosome chr17 scaffold_12, whole genome shotgun sequence
  Pfam annotation: Domain name=FH2; Domain location=116-491; Score =64.2; E_value=4.5e-16; Accession=PF02181.14; Description=Formin Homology 2 Domain
  Subcellular localization annotation: CTP_CleavageSite=11; ConfidenceScore=5.06e-01
MSAPSQTIVITATATAATMLLFAVTFFYFQKFVLARYHHRYIVATSFLREAGLNNEDIKKVGGNMKGLLVEENGIDILYMMETEGGQFKTRFPNGRYNPSYEDDEEKGTDIMVQRSKRIKPQDVTVPLPCEILGSANVGHSTVWDQISDRSFWKSVMHSMLAKNILSAETLEKLAKIAPTQEEAKIMQFSDNPDKLVDAESFLYHILRAVPTAFIHLKALLIRSSYGCEVIQLKEHLKTLESSSNSILRAVPTAFIHLKALLIRSSYGCEVIQLKEHLKTLEMGCNEMKTSSLLLKFLKAILKAGNPMNVGTSRGNAHGFNLSALEKLSHPVAQFEARQQASNQKHNLNSSTGETSNTNEPHSDNRVQKEEVKEYLVLGGLRDELCEVKKAASIEHQNFSSMYSIPNAYVTKIRQIITCFGNSERGGFIKVMKGFPEECEVEPKVVREEQEMVMELLKKTNEYYLTGGSKDNISNPFQLFITVKEFLDMVDEVCKELRRQLEKTNAGGEAVSTPPLSPSKRAPLRLTNFNYIFGQARQE

SEQ ID NO: 91937 - protein, 445 aa, Glycine max
  Coding DNA Sequence Number=SeqID_252
  Gene Ontology: Mol. function=transcription factor activity; Cellular component=transcription factor complex; Biological process =regulation of transcription, DNA-dependent
  Homolog annotation: Hit_ID=A7PD78; Match level="QueryCoverage=98%, HitCoverage=96%, E-value=1e-103, Identity=50%"; Hit description =Chromosome chr17 scaffold_12, whole genome shotgun sequence
  Pfam annotation: Domain name=E2F_TDP; Domain location=16-81; Score =112.0; E_value=1.9e-30; Accession=PF02319.11; Description =Transcription factor E2Fdimerisation partner (TDP)
  Pfam annotation: Domain name=E2F_TDP; Domain location=216-296; Score =128.8; E_value=1.5e-35; Accession=PF02319.11; Description =Transcription factor E2Fdimerisation partner (TDP)
  Pfam module annotation: Pfam domain module=E2F_TDP::E2F_TDP; Domain location=16-81::216-296
MASSDPISSRHYTYNRKQKSLGLLCTNFLSLYNRDTVHLIGLDDAATRLGVERRRIYDIVNVLESIGVLSRKAKNQYTWRGFAAIPLTLQDLKEEGLKENSNSLRGPGNHDKVSDDEDDEETQSNPAATGSQSDKLNPNSTLPKPLKNENECKKKKRYGWDAFKEKNIDLGWRVVRELGHHHLTKSSVPFVKRLLAATVVYLCCWQRHQLLRFENRREKSLALLTQNFVKLFVCSNVELISLDEAAKLLLGDAHNTSVMRTKVRRLYDIANVLSSMNLIEKTHTMDTRKPAFRWLGSEGKTWDETLHKSNLNDSRKRAFGSDITNISFERNKVELFTSGDLNPNPKKPRMENGSGLGEADENNLKQGIKQASKSYEFGPFAPACVPKVGASQNNNMKQVHDWGSLATAHSPQYQNEALRELFSHYMEAWKLWYSEIARKRPLQIL

SEQ ID NO: 91938 - protein, 328 aa, Glycine max
  Coding DNA Sequence Number=SeqID_253
  Homolog annotation: Hit_ID=A7PD81; Match level="QueryCoverage=99%, HitCoverage=99%, E-value=2e-47, Identity=59%"; Hit description =Chromosome chr17 scaffold_12, whole genome shotgun sequence
  Pfam annotation: Domain name=DUF1777; Domain location=82-207; Score= -63.4; E_value=0.0051; Accession=PF08648.3; Description=Protein of unknown function (DUF1777)
MEEEKAAAYYDELSRKGEGAARFKQGLGFSSSAPNDDVPKPSSFLSKFVKASSTAPSNSEKQAQLQSIHHKLKKKPSSESRVSSSDSDRSRRRSRDRYRESRRRSRSRERHRHRERGRRRSRSVSPRKQRRSEKDANDRGKVSETKKRKNAEIDYYKLIPGYDRMSSAERVKAKMKLQLSETGKAKYLQAAQDSEKGEGWERFEFNKDAPLDDEEVEVYTFASLNGGLSFQLYLLVIGIAEDDASLVKHIGQSFRFSAVKARREEQIQAAHEEAMFGATALLPPTSTDSEPERDNEKETDKKELVTSLLSETVLAKQNGSWRDRVRQT

SEQ ID NO: 91939 - protein, 96 aa, Glycine max
  Coding DNA Sequence Number=SeqID_254
  Gene Ontology: Mol. function=binding; Cellular component=plastid chromosome; Biological process=positive regulation of transcription, DNA-dependent
  Homolog annotation: Hit_ID=Q9S7Q2; Match level="QueryCoverage=85%, HitCoverage=9%, E-value=6e-36, Identity=85%"; Hit description =Putative uncharacterized protein F9E10.30
MRVSDIHQGIGQMIKGDFDDESNWQIVEYVFDKLNSEGCGLGMRFYNALLEALWWMFQRERAARVLNEASKRGLFPELFRKRKHILTSLGVEAIDK

SEQ ID NO: 91940 - protein, 214 aa, Glycine max
  Coding DNA Sequence Number=SeqID_255
  Gene Ontology: Mol. function=transcription regulator activity; Cellular component=nucleus; Biological process=regulation of transcription
  Homolog annotation: Hit_ID=A7QI14; Match level="QueryCoverage=92%, HitCoverage=89%, E-value=9e-49, Identity=50%"; Hit description =Chromosome chr17 scaffold_101, whole genome shotgun sequence
  Pfam annotation: Domain name=HLH; Domain location=107-157; Score =38.2; E_value=2.9e-08; Accession=PF00010.17; Description=Helix-loop -helix DNA-binding domain
MEPPLINDSTFSSANPSLSEIWPSHFPTDHTPSNKRHLSPSTDCGSNKHIKSSGSGSQDQNGALKAGEVDATSVAGNKLPEQTAKPSSSEQPPKQDYIHVRARRGQATDSHSLAERARREKISERMKILQDIVPGCNKVIGKALVLDEIINYIQSLQHQVEFLSMKLEAVNSRLSMSPTIECFPSKENTQEMPSAGLVYIDASYDVYRTWIRKE

SEQ ID NO: 91941 - protein, 209 aa, Glycine max
  Coding DNA Sequence Number=SeqID_256
  Homolog annotation: Hit_ID=Q6R9J8; Match level="QueryCoverage=16%, HitCoverage=34%, E-value=8e-07, Identity=76%"; Hit description =Putative uncharacterized protein orf99-a2
MVTNMCLVEKKQTKVGSLAVLFSVANWDRSPARPCYEKSRSLHFLAVLGVFSLVVRVVMQQMVVHALAQRMKLKPSSLVSKATSEVDETLVSANSVSGPACCKAEGVDKSSTIQQIGSASSPASKPDSVTYACDIDGVQEHVDHLSPLNADHLMIKENFTSVHPRPSVSTDSKSIRNTYTTMVGILGRTRRFDVISKLQEQIVSHTVHC

SEQ ID NO: 91942 - protein, 559 aa, Glycine max
  Coding DNA Sequence Number=SeqID_257
  Gene Ontology: Mol. function=binding; Cellular component=nuclear pore; Biological process=protein import into nucleus, docking
  Homolog annotation: Hit_ID=A7PD87; Match level="QueryCoverage=95%, HitCoverage=50%, E-value=0.0, Identity=74%"; Hit description =Chromosome chr17 scaffold_12, whole genome shotgun sequence
  Pfam annotation: Domain name=IBN_N; Domain location=26-93; Score =22.8; E_value=0.00041; Accession=PF03810.10; Description=Importin -beta N-terminal domain
  Pfam annotation: Domain name=Xpo1; Domain location=98-255; Score =86.9; E_value=6.3e-23; Accession=PF08389.3; Description=Exportin 1 -like protein
  Pfam module annotation: Pfam domain module=IBN_N::Xpo1; Domain location=26-93::98-255
MDLQNTVKEALNALYHHPDDAVRMQADRYLQDFQRTLDAWQVADNLLHDPSSNLETLIFCSQTLRSKVQRDFEELPSTAFRPLRDSLNTLLKKFHKGPPKVRTQISIAVAALAVHVPAEDWGDGGIVKWLRDEMDSHPEYIPGFLELLTVLPEEVLNYKIAARPERRRQFEKELTSQMEIALNILTACLSISELKEQWSYGDVFMLNGQVLEAFASWLRLKHGIPGSVLSSHPLVLTALSSLNSELLSEASVNVISELIHYTTAGNIDGVSANMPLIQVIVPQVMNLKVQLGDSTKDEEDVKAIARLFADMGDSYVELIATGSDESMLIVHALLEVASHPEYDIASMTFNFWHSLQLNLTKRESYISYGNEACIEAERNRRLQVFRPAYESLVSLVSLPGWKLEVGTNVSSETVKHPCSAWFPALMCATLKSVIFRVQYPEDYQDLSYEDLKEFKQTKYAVADVLTDASSVLGGDATLKILYMKLLEAVSGHGNNEHKEWCPAEAALFCIRAISNYVSVVEAEVMPQECKIVSKFLNCCNPAKFDMILDRSHNVFKDRP

SEQ ID NO: 91943 - protein, 80 aa, Glycine max
  Coding DNA Sequence Number=SeqID_258
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A5C8A3; Match level="QueryCoverage=98%, HitCoverage=22%, E-value=5e-18, Identity=59%"; Hit description =Putative uncharacterized protein
MAYKAFFLLGLFLSTLASVTFAEAVAAILDVSSLNRSSFPQGFIFGTASAAYQYEGAAKEDGKGASIWDTFTHKYPDSVN

SEQ ID NO: 91944 - protein, 82 aa, Glycine max
  Coding DNA Sequence Number=SeqID_259
  Gene Ontology: Mol. function=oxidoreductase activity; Biological process=metabolic process
  Homolog annotation: Hit_ID=A7NZW2; Match level="QueryCoverage=95%, HitCoverage=28%, E-value=1e-22, Identity=60%"; Hit description =Chromosome chr6 scaffold_3, whole genome shotgun sequence
MTLWRVVGLNGTLQVERGFQGQHGYLVSFYGTDGQNKSSFFPFSGVTEELKAFINDVSENTLKGARDVAVLEAMLESGAKRQ

SEQ ID NO: 91945 - protein, 135 aa, Glycine max
  Coding DNA Sequence Number=SeqID_260
MPLFDAEEGEGCDAARDLAGYSPPVGDCDAGETRQLADRRRDVAGHVAGAVGALEDRLLRLAAEVDVGDAAGLLVAAHAVPLMAAVGAGPGVEDSEIGLVERRPGVFAWDFGILTMLKKIGGTTEHGVEGKWCDR

SEQ ID NO: 91946 - protein, 484 aa, Glycine max
  Coding DNA Sequence Number=SeqID_261
  Gene Ontology: Mol. function=transferase activity, transferring glycosyl groups; Cellular component=integral to membrane; Biological process=metabolic process
  Homolog annotation: Hit_ID=A7NZV0; Match level="QueryCoverage=98%, HitCoverage=96%, E-value=1e-177, Identity=62%"; Hit description =Chromosome chr6 scaffold_3, whole genome shotgun sequence
  Pfam annotation: Domain name=Glyco_tran_28_C; Domain location=283 -463; Score=-40.0; E_value=0.1; Accession=PF04101.7; Description =Glycosyltransferase family 28 C-terminal domain
  Pfam annotation: Domain name=UDPGT; Domain location=9-467; Score= -108.8; E_value=4e-05; Accession=PF00201.9; Description=UDP -glucoronosyl and UDP-glucosyl transferase
  Pfam module annotation: Pfam domain module=Glyco_tran_28_C::UDPGT; Domain location=283-463::9-467
MAETEGKQEAVLFPFMAQGHIIPFLALALELEQRKKYSITILNTSLNIKKLRSSIPPDSTISLVEIPFTPSDHGLPPNTENTDSIPYHLVIRLIQASTTLQPAFKTLIQNILFQNQKHQLLIISDIFFGWTATVAKELGVFHVVFSGTSGFGLACYYSLWHNLPHRRVNSDEFSLPDFPEARVIHRTQLPNNISEADGTDPWSVFQKSNLSQWVNSDGILFNTVEEFDSVGLGYFKRKLGRPVWPIGPVLFSSGSGSGSRGKGGGINPNLCTEWLNTKPSKSVLFVCFGSMNTISALQMMELGKALERCGKNFVWVVRPPIGFDINSEFREGEWLPEGFVERVKESGKGLVVHDWAPQVEILSHFAVSAFLSHCGWNSVLESLSQGVPILGWPMAAEQFYNCKLLEEEVGVCVEVARGKSSEVKYEDIVAKIELVMDETEKGVAMGKKAGDVRDMIRDAVKDEDGFKGSSVRAMDEFLSAAFES

SEQ ID NO: 91947 - protein, 115 aa, Glycine max
  Coding DNA Sequence Number=SeqID_262
MAWSPYVAIAFFVNCYIIFVSVEYQTLSLGWKSELTNDDVNSSKQAIRILSGVAGLSSGNHSLRPISALAAMIASLMANNTADARKNGGSPTALDEWMALTFGWPYQLVHTTINR

SEQ ID NO: 91948 - protein, 381 aa, Glycine max
  Coding DNA Sequence Number=SeqID_263
  Gene Ontology: Mol. function=acyltransferase activity; Cellular component=integral to membrane; Biological process=metabolic process
  Homolog annotation: Hit_ID=A7PWB6; Match level="QueryCoverage=97%, HitCoverage=95%, E-value=1e-126, Identity=59%"; Hit description =Chromosome chr8 scaffold_34, whole genome shotgun sequence
  Pfam annotation: Domain name=Acyltransferase; Domain location=66-223; Score=60.3; E_value=6.7e-15; Accession=PF01553.12; Description =Acyltransferase
MAFPATIVILPLGILFILSGLIVNIIQAVFFVLLRPLSKNCYSRINKLLTESLWLELIWLIDWWAGIKIELYTDSETLQLMGKENALVICNHRSDIDWLIGWVLAQRSGCLGSTVAIMKKEVKFLPVLGWSMWFAEYIFLERDWAKDETSLKSGFRHLEHMPFPFWLALFVEGTRFTQTKLLQAQEFAASKGLPIPRNVLIPRTKGFVTAVQSLRPFVPAIYDCTYAVPKSEASPTLVRIFKGISCPVKVQIKRHKMEELPETDDGIGQWCKDAFVAKDALLEKYSTTEIFSEQDLQQIRRHKTSILVVVCWLCLLGFLVYEFFQWTSLLSSWEGILFTVLFLLLVTVIMEIFIHSSQSERSKPPMVLPTQDPMKQKLLQT

SEQ ID NO: 91949 - protein, 265 aa, Glycine max
  Coding DNA Sequence Number=SeqID_264
  Gene Ontology: Mol. function=amino acid binding; Cellular component =chloroplast thylakoid membrane; Biological process=response to cold
  Homolog annotation: Hit_ID=A7PVK1; Match level="QueryCoverage=86%, HitCoverage=87%, E-value=2e-89, Identity=70%"; Hit description =Chromosome chr9 scaffold_33, whole genome shotgun sequence
MAVAMAACSLGLHLSADNTLRPFEKTTILKALSISDATKPCYISHKTRLSSSSSGITMIPRATTVIGTVEDGNQGEADTIPTPVVIIDQDSDPDATVVEITFGDRLGALLDTMNALKNLGLNVVKANVFLDSSGKHNKFSITKADSGRKVEDPELLEAIRLTILNNMIQYHPESSAQLALGAAFGLVPPKEQTADRPGLLVDLVKTITDINIAVESGEFDTEGLLAKAKFHVNYKDKALIKPLQLVLVNSLRYFLRRPETEESSF

SEQ ID NO: 91950 - protein, 338 aa, Glycine max
  Coding DNA Sequence Number=SeqID_265
  Gene Ontology: Mol. function=nucleic acid binding; Cellular component= cytosol; Biological process=regulation of mRNA stability
  Homolog annotation: Hit_ID=A7NZS1; Match level="QueryCoverage=71%, HitCoverage=53%, E-value=4e-55, Identity=52%"; Hit description =Chromosome chr6 scaffold_3, whole genome shotgun sequence
  Pfam annotation: Domain name=RRM_1; Domain location=64-129; Score =75.1; E_value=2.4e-19; Accession=PF00076.13; Description=RNA recognition motif. (a.k.a. RRM, RB
MTEMNGVYCSTRPMRISAATPKKTTSAYAAPAAPVPKPVYPVPAYTAPVVQVQPPEYDVNNTAIFVGNLDLNVSEEELKQNFLQFGEIVSVKVQSGKGCGFVQFGTRASAEEAIQKMQEKMIGQQVVRISWGRTLTARQDLPGGWGPQMDPNQWSAYYGYGQGYEAYAYGAAHDPSFYAYGAYAGYAQYPQQVEGAQDLSGMSVPTMEQREELYDPLAMPDVDKLNAAYLSVHGSAILGRIQHLGCFDGFKGMKRKPFAFVEALVCEIKLQIEDFLTQGPPMLDLVVSSGFILGFLFFGTKVLKEGLNNHHEFMEGEKFGENVIEGVVAIEKQQGKKY

SEQ ID NO: 91951 - protein, 184 aa, Glycine max
  Coding DNA Sequence Number=SeqID_266
  Gene Ontology: Mol. function=drug transporter activity; Cellular component=membrane; Biological process=multidrug transport
  Homolog annotation: Hit_ID=A7NZR1; Match level="QueryCoverage=83%, HitCoverage=29%, E-value=5e-46, Identity=64%"; Hit description =Chromosome chr6 scaffold_3, whole genome shotgun sequence
  Pfam annotation: Domain name=MatE; Domain location=1-126; Score=1.2; E_value=0.0017; Accession=PF01554.9; Description=MatE
MVWLAVSLLADGLAVAGQAILAGAFANKDFDRATATASRVLQMGLVLGLALAFILGIGLHFGAKIFTQDANVLHLIQIGIPFVAVTQPLNSIAFVFDGVNFGASDFAYSAFSMVVVAILSIICLLILSSAGGFIGIWVALTIYMGLRAFAGFLRTLGVPKELMTAHGRHRSYSFILGLGFSGVC

SEQ ID NO: 91952 - protein, 106 aa, Glycine max
  Coding DNA Sequence Number=SeqID_267
  Homolog annotation: Hit_ID=Q2HS30; Match level="QueryCoverage=72%, HitCoverage=59%, E-value=1e-09, Identity=50%"; Hit description =Putative uncharacterized protein
MVDKANIMIIKRRRNRGGGCPTRLQKHAPASLDIDKVLIDRPSNPFGEASRAIPLLSPLVLSPQPIYADITIQVRTSEKNENNGMNEGGRTSGSVDTGSELALIPS

SEQ ID NO: 91953 - protein, 1074 aa, Glycine max
  Coding DNA Sequence Number=SeqID_268
  Gene Ontology: Mol. function=RNA binding; Cellular component=voltage -gated potassium channel complex; Biological process=potassium ion transport
  Homolog annotation: Hit_ID=Q2HS37; Match level="QueryCoverage=99%, HitCoverage=99%, E-value=0.0, Identity=75%"; Hit description=Nucleic acid binding NABP
  Pfam annotation: Domain name=NABP; Domain location=309-718; Score =163.8; E_value=4.5e-46; Accession=PF07990.3; Description=Nucleic acid binding protein NABP
  Pfam annotation: Domain name=PUF; Domain location=719-753; Score =36.0; E_value=1.3e-07; Accession=PF00806.10; Description=Pumilio -family RNA binding repeat
  Pfam annotation: Domain name=PUF; Domain location=755-789; Score =30.3; E_value=7e-06; Accession=PF00806.10; Description=Pumilio -family RNA binding repeat
  Pfam annotation: Domain name=PUF; Domain location=791-825; Score =35.1; E_value=2.5e-07; Accession=PF00806.10; Description=Pumilio -family RNA binding repeat
  Pfam annotation: Domain name=PUF; Domain location=827-861; Score =32.8; E_value=1.3e-06; Accession=PF00806.10; Description=Pumilio -family RNA binding repeat
  Pfam annotation: Domain name=PUF; Domain location=863-898; Score =40.0; E_value=8.5e-09; Accession=PF00806.10; Description=Pumilio -family RNA binding repeat
  Pfam annotation: Domain name=PUF; Domain location=900-934; Score =35.6; E_value=1.8e-07; Accession=PF00806.10; Description=Pumilio -family RNA binding repeat
  Pfam annotation: Domain name=PUF; Domain location=936-970; Score =33.6; E_value=7.3e-07; Accession=PF00806.10; Description=Pumilio -family RNA binding repeat
  Pfam annotation: Domain name=PUF; Domain location=998-1032; Score =28.1; E_value=3.1e-05; Accession=PF00806.10; Description=Pumilio -family RNA binding repeat
  Pfam module annotation: Pfam domain module=NABP::PUF::PUF::PUF::PUF::P UF::PUF::PUF::PUF; Domain location=309-718::719-753::755-789::791 -825::827-861::863-898::900-934::936-970::998-1032
MLSELGTRPMLGGNEGSFGDELEKEIGMLLREQRRQEVDDRERELNLYRSGSAPPTVEGSLSAVGGLFGGGGGGAGTAAGAVFSEFSGAKSGNGFSSEEELRSDPAYLSYYYSNVNLNPRLPPPLLSKEDWRFTQRLKGGASVLGGIGDRRKVNRADDNGGRSLFATPPGFNMRKQESEVESENPRGSAEWGGDGLIGLPGLGLGSKQKSLAEIFQDDLGLNASVTGFPSRPASRNAFDENGDIISSVESELAHLRRDSLATDTLRSVSNVPVSSAAQNTGPQASYSYAAALGSSLSRSTTPDPQLVARAPSPCPTPIGGGRVVAAEKRGINSPDAFNGVSSGVNEPADIVAALSGMNLSADDVLDGDSHFPSQVESDVDNHQRYLFGMQGGQDPGKQHAYLKKSESGHLHKSAYSDSGKNGGSMSDINNPSLDRHAELQKCAVPPNNSYFKGSPTSAFSGGGGVPAQYSPLDGTNSAFTYYGLSGYAGNPALASLVASQLGTSNLPPLFENVAAASVMAAPGMDSRILGGGLSSGVAAPSDVHGHGRMGNQIAGGALQAPFVDPMYLQYIRSSELAAAQLAALNDPSVDRNYLGNSYMNLLELQKAYLGTLLSPQKSQYNVPLSAKSGGSNHGYYGNPAYGLSYPGSPMANSLSTSPVGSGSPIRHNDLNMRFASGMRNLAGVMGPWHLDAGNMDENFASSLLEEFKSNKTKCFELSEISGHVVEFSADQYGSRFIQQKLETATTEEKNMVYQEIMPQALALMTDVFGNYVVQKFFEHGLASQRRELANKLFEHVLTLSLQMYGCRVIQKAIEVVDLDQKIKMVQELDGNIMRCVRDQNGNHVIQKCIECVPEDAINFIVSTFFDQVVTLSTHPYGCRVIQRVLEHCKDPNTQQKVMDEILGAVSMLAQDQYGNYVVQHVLEHGKPHERSAIIKELAGKIVQMSQQKFASNVVEKCLTFGGPSERQLLVNEMLGSTDENEPLQLAQSRLEMPIFVQIGHDDHMAMMKDQFANYVVQKVLETCDDQQRELILSRIKVHLNALKKYTYGKHIVARVEKLVAAGERRIAAQSPHPA

SEQ ID NO: 91954 - protein, 261 aa, Glycine max
  Coding DNA Sequence Number=SeqID_269
  Homolog annotation: Hit_ID=Q2HS22; Match level="QueryCoverage=91%, HitCoverage=80%, E-value=5e-27, Identity=36%"; Hit description=IMP dehydrogenase/GMP reductase, putative
MAVELHTSLPSHLFPDDNHDVVSSQHNHKDDIHHASALNPLPELPMKDNDDDFISELTHRMARFLLPDDDTFDFSSIDLDSSRDSKQGSPEGSSQEASAPATPEECCWKSSYDMFGTVEEMKLNETGNSNNKLLRSSNIELYSYQSLIQEQIRAIEMSGVKPEHVVVSPKRKPSTRRAQTYEAKKGNGRRARPSRPGPQQGGAGMRVLFLKGPGSRAGTGVFLPRGDVATTPSDSTNKQVDPHGPLNLPFRNFMSLASSLN

SEQ ID NO: 91955 - protein, 345 aa, Glycine max
  Coding DNA Sequence Number=SeqID_270
  Gene Ontology: Mol. function=metal ion transmembrane transporter activity; Cellular component=membrane; Biological process=metal ion transport
  Homolog annotation: Hit_ID=Q9AWG7; Match level="QueryCoverage=97%, HitCoverage=98%, E-value=1e-138, Identity=72%"; Hit description=Zinc transporter
  Pfam annotation: Domain name=Zip; Domain location=52-342; Score =210.6; E_value=3.7e-60; Accession=PF02535.13; Description=ZIP Zinc transporter
MASSNKMKIIKSTFLVLCLLASSFLCPIKAHGGSGDSHDDESDSEGLHSRGLIVVKIWCLIIFLVSTFAGGVSPYFYRWNESFLLLGTQFAGGVFLGTSLMHFLSDSDETFRDLTTKSYPFAYMLASSGYLLTMLGDCVITYVTSNSKREAKVVELEGGTTPPQEHEHDQARDHCAVAETTNPVLLKTSSVGDTILLILALCFHSVFEGIAVGVAGTKADAWRNLWTISLHKIFAAIAMGIALLRMLPKRPFVTTAAYSLAFAVSSPIGVGIGIAINATTQGSTADWMFAITMGIACGVFIYVAINHLISKGFKPHKTTRYDTPWFRFVAVLSGVAVIAVVMIWD

SEQ ID NO: 91956 - protein, 98 aa, Glycine max
  Coding DNA Sequence Number=SeqID_271
  Homolog annotation: Hit_ID=Q8L7D0; Match level="QueryCoverage=44%, HitCoverage=38%, E-value=3e-12, Identity=77%"; Hit description =Putative uncharacterized protein
  Pfam annotation: Domain name=DVL; Domain location=73-91; Score=42.5; E_value=1.5e-09; Accession=PF08137.3; Description=DVL family
  Subcellular localization annotation: CTP_CleavageSite=55; ConfidenceScore=5.92e-01
MDEKRKASKKDTGSFSSPGSLFSRSTSTSNSPLLRSLSQKSSSSSSKCNNNNLPRSFSQKNPSIGRKCTKLAKEQKARFYIMRRCVAMLVCWHKHGDS

SEQ ID NO: 91957 - protein, 620 aa, Glycine max
  Coding DNA Sequence Number=SeqID_272
  Gene Ontology: Mol. function=protein binding; Cellular component =nucleus; Biological process=regulation of transcription
  Homolog annotation: Hit_ID=A7NYY1; Match level="QueryCoverage=90%, HitCoverage=93%, E-value=1e-119, Identity=44%"; Hit description =Chromosome chr6 scaffold_3, whole genome shotgun sequence
  Pfam annotation: Domain name=GRAS; Domain location=249-527; Score =234.2; E_value=3e-67; Accession=PF03514.5; Description=GRAS family transcription factor
MSCNFLVEFNMNSLVQNFSGPITEFSNQNQVEKGFDFEFDDSSSSLSSGASSGGESTEVTKYSNQILRYISDILMDEEDDLERKPCMLQECLRLQAAEKSFHDALLHQPSSRFRDESVSITDSDENYGRNASFESNGSCTTDNSCESVLVNGVGEFDSSFLQLQTPLVDSPHDPSGESPGVGFFHDPFVKSQAAGYFHDGTWNLFQSQSQTKKPLMVEEGFSASAPREKRSHGMDDYAFHEQEGRRGSKVSAVFSDESESPEILDEVLLCQSGRSQSLLCAAAEPSQSVNLGGPWQALTNGMQMTYSARLGNTLQLLGMDSSVWLITLPMALRQEVDKLFGNPDIVSLVENEGSVHIIDFGICYGFQWPCLIKKLSERHGGPPRLRITGIELPQPGFRPAERVEETGRRLANYCKKFNVPFEYNCLAQKWETIKLADLKIDRNEVTVVSCFYRLKNLPDETVEVKSPRDAVLKLIRMINPNMFIHGVVNGTYSAPFFLTRFREALYHFSSLFDMFEANVPREDPERVMLEKGLFGRDAINVIACEGAERVERPETYKQWQVRNQRAGFKQVRFDPQLVNHEKEMVKKEYHKDFVVAEDGKWVLLGWKGRILNAISAWTPA

SEQ ID NO: 91958 - protein, 328 aa, Glycine max
  Coding DNA Sequence Number=SeqID_273
  Gene Ontology: Mol. function=serine-type endopeptidase activity; Cellular component=integral to membrane; Biological process=beta -lactam antibiotic catabolic process
  Homolog annotation: Hit_ID=A7NYY8; Match level="QueryCoverage=94%, HitCoverage=80%, E-value=2e-98, Identity=59%"; Hit description =Chromosome chr6 scaffold_3, whole genome shotgun sequence
  Pfam annotation: Domain name=Rhomboid; Domain location=120-264; Score= 200.8; E_value=3.3e-57; Accession=PF01694.13; Description=Rhomboid family
MGRDPSSATVEVQVHPRRDTIAGCGRRLSPSPPSPPAVRDRDFSLFKRWFPWLVPTFVVANIVVFIVTMYINDCPKHSFYGSCVASFLGRFSFQPLKENPLFGPSSSTLEKMGALEVGKVIHRHQVWRLFSCIWLHGGVVHLLANMLSLVFIGIRLEQEFGFVRIGFLYVISGFGGSLLSALFIQEGISVGASGALFGLLGGMLSELLINWTIYANKFAALLTLIVIVVINLAVGILPHVDNFAHIGGFVSGFLLGFIFLIRPQFKWVSSRHRNSHSSAAAPSVKYKHKPYQYALWVISFILLIAGDLIALFSTIGYLHKIGTLMLVS

SEQ ID NO: 91959 - protein, 622 aa, Glycine max
  Coding DNA Sequence Number=SeqID_274
  Gene Ontology: Mol. function=DNA binding; Cellular component=nucleus; Biological process=protein modification process
  Homolog annotation: Hit_ID=A7NYY2; Match level="QueryCoverage=100%, HitCoverage=100%, E-value=1e-100, Identity=48%"; Hit description =Chromosome chr6 scaffold_3, whole genome shotgun sequence
  Pfam annotation: Domain name=Myb_DNA-binding; Domain location=522 -572; Score=23.6; E_value=0.00076; Accession=PF00249.22; Description =Myb-like DNA-binding domain
MVLQKRLDYSFYGYHVPTKRRATRSAKRRATFQRRLEDNQMCAFDLLATIADNLLQEKQNPTISSDRSSEKDRDGFSKVECQDANKPFKTELSDEASCDRKCQHEFVREGCPDANKPFKAELSDEGSSDRKCFSNISSQLYNQNCCLKELLQHEIDGHSCIASIVTSSSCSEKIVAERLVDGKGHNGVENLASKVELGSSGCLESSGCKLDGDVSKVKDGKVGKVPIDTGTGMCCFEDPLDEKPPALISSCGNAKMSGYDDSKPQSSLSKGCDNVLVDSRDDDENFSGNQLLNKFKIFDADHGTSSLGHSALRSRDSHVKLRIKSFRVPELFIEIPETATVGSLKLLQQFALQRTVMEAVTAVLGGGLRVGVILHGKKVRDDSKTLLQTGISHDNHLDALGFALEPNCSQNRSSACATTDSLCVPGADMHQPLIGYPSSRAAIHQRIQGFSNMLAEHQATGLGNLVESDHDSAPSPINTSGEKNLTDSKELITVPEMGMEALAVLPVHQKSKRTEIAPRRIRRPFSVAEVEALVQAVEKLGTGRWRDVKLHAFDNAKHRTYVDLKDKWKTLVHTARISPQQRRGEPVPQELLDRVLTAHAYWSQQQTKQQLKHHSTKPCLLL

SEQ ID NO: 91960 - protein, 86 aa, Glycine max
  Coding DNA Sequence Number=SeqID_275
MKRASEKSGQAVAAEDNVKNTEFLGHAGCPSEDVGYDAKLLLMDDGWSHGRRCYLWSEEVKGISKKTTEESGLMPRKELSVMWPCA

SEQ ID NO: 91961 - protein, 89 aa, Glycine max
  Coding DNA Sequence Number=SeqID_276
  Homolog annotation: Hit_ID=A5BPS9; Match level="QueryCoverage=84%, HitCoverage=12%, E-value=1e-14, Identity=48%"; Hit description =Putative uncharacterized protein
MNHVHLFPAYRGLMDVDKAQADSLCRYGVKTCHIMGYIVGQKGRYDALGFTREDLYNYFDSLIHAQIKDGDIVASLSYLDEMSDTDPML

SEQ ID NO: 91962 - protein, 292 aa, Glycine max
  Coding DNA Sequence Number=SeqID_277
  Homolog annotation: Hit_ID=A7NZ33; Match level="QueryCoverage=88%, HitCoverage=86%, E-value=2e-64, Identity=52%"; Hit description =Chromosome chr6 scaffold_3, whole genome shotgun sequence
MDIEMDAKGAFYWGCWKTPCAMHVANNTGRGGVNRDIERTTTSREPEMELDLLHKPFGEEGTVESELMRLHNLAGPPRFLFPIKEETKEDLESEDRSRKGSRTRSLSDLMLTIDTPFLTPVASSPLKCCSLPLDPLHSYKHQGFNPLFESSVELEYNRFRSSPPPKFKFMRDAEEKLHRKLMEEARRKAVDNNNVQECGVKDCSNETLATDFRDGSFLKFIQTTEHKQPQQYLPQFPSGSSQILPLASSPTTLRPLEKASISMLNANAVSKSGVQIMNLESLAEVIEHCRKA

SEQ ID NO: 91963 - protein, 249 aa, Glycine max
  Coding DNA Sequence Number=SeqID_278
  Gene Ontology: Mol. function=small conjugating protein ligase activity; Cellular component=cytoplasm; Biological process=ubiquitin- dependent protein catabolic process
  Homolog annotation: Hit_ID=A9NPX2; Match level="QueryCoverage=68%, HitCoverage=59%, E-value=6e-25, Identity=41%"; Hit description =Putative uncharacterized protein
  Pfam annotation: Domain name=UQ_con; Domain location=1-136; Score =62.9; E_value=1.1e-15; Accession=PF00179.17; Description=Ubiquitin -conjugating enzyme
MSFPPNYPNSPPSVKFTSELWHPNVYPDGRVCISILHPPGDDPNGYELASERWTPVHTHCINDSSHSHSRIELSIPCTVNEKGNISLLVESIVLSIISMLSSPNDESPANVEAASYLMATYLHPREEKATRPALALTCCSILSCAALPYPVLGEQKEWRDRRDEFKKKLGFSSSFCELKDIQLNVWIGSPVTVDPSRLPFVLEKQIVLLLYLYMAVLPSAALLWLLKRDDNKATTSNSHSVLISSDKYP

SEQ ID NO: 91964 - protein, 116 aa, Glycine max
  Coding DNA Sequence Number=SeqID_279
  Subcellular localization annotation: CTP_CleavageSite=37; ConfidenceScore=5.11e-01
MNQGSRDKNLMGKNLSNTKQPKTPYTDPNTVPWALTFAALNVAWVLLGAPSILLVHPALKENFKNVLKRLNNLDWRKRVMVFALDSGTVSEPPRNMLLEAVKNMFKVLVEKIAHWE

SEQ ID NO: 91965 - protein, 325 aa, Glycine max
  Coding DNA Sequence Number=SeqID_280
  Gene Ontology: Mol. function=amino acid binding; Biological process =metabolic process
  Homolog annotation: Hit_ID=A5B4J2; Match level="QueryCoverage=77%, HitCoverage=50%, E-value=1e-108, Identity=75%"; Hit description =Putative uncharacterized protein
MDQLRNNVNARSLPGSNALYGSSTVSKDRSMKLICLAKTFINCQLYFECILLLISNHHLLQFSFRELLHTRNRQDETCERLNAVLRDSCISCELQLAGPEYEYNQGISSLSPALAEELFRCELSDNEVRAQALSPDMTKLKKTNVTMDNSLSPAHTLVQIRCADHKGLLYDIMRTLKDLNMKISYGRFSPNSMGYRDLDIFIQQKDGKKILDPEKQSALCSRLKQEMLHPLRVIIANRGPDTELLVANPVELSGMGRPRVFYDVTFALKTVGICVFSAEVGRHSTSEREWEVYRFLLDENCEFQLTGVAARNKIVNRVRRTLMGW

SEQ ID NO: 91966 - protein, 83 aa, Glycine max
  Coding DNA Sequence Number=SeqID_281
  Gene Ontology: Mol. function=catalytic activity; Biological process =metabolic process
  Homolog annotation: Hit_ID=Q0QLH2; Match level="QueryCoverage=74%, HitCoverage=22%, E-value=3e-20, Identity=77%"; Hit description =Cinnamoyl CoA reductase
MICVNTKNAQVVSSFEVIFFWCSDEKNPRAKPYTFSNQKLKDLGLEFTPVSQCLYETVKSLQEKGHLPVPAKQQEEDSTTVKS

SEQ ID NO: 91967 - protein, 97 aa, Glycine max
  Coding DNA Sequence Number=SeqID_282
MKRWEIRLKTKIQFQEERKKEDRRLEKKEEVDVTRETKGKFGDESSGDGESNQEGPIPLPFSLEENRPWIEQSHFFCTSLSLSMCSSAFPSQLNSEI

SEQ ID NO: 91968 - protein, 387 aa, Glycine max
  Coding DNA Sequence Number=SeqID_283
  Gene Ontology: Mol. function=3'-phosphoadenosine 5'-phosphosulfate transmembrane transporter activity; Cellular component=integral to membrane; Biological process=positive regulation of I-kappaB kinase/NF-kappaB cascade
  Homolog annotation: Hit_ID=A7NZ73; Match level="QueryCoverage=95%, HitCoverage=85%, E-value=3e-97, Identity=86%"; Hit description =Chromosome chr6 scaffold_3, whole genome shotgun sequence
  Pfam annotation: Domain name=DUF6; Domain location=229-360; Score =7.4; E_value=0.026; Accession=PF00892.11; Description=Integral membrane protein DUF6
  Pfam annotation: Domain name=TPT; Domain location=220-358; Score= -3.5; E_value=0.00092; Accession=PF03151.7; Description=Triose -phosphate Transporter family
  Pfam annotation: Domain name=UAA; Domain location=1-366; Score=262.0; E_value=1.3e-75; Accession=PF08449.2; Description=UAA transporter family
  Pfam module annotation: Pfam domain module=DUF6::TPT::UAA; Domain location=229-360::220-358::1-366
EKIMRVPYGAEKEYFKHSLFLVFCNRITTSAVSACSLLASKKAMDPVAPIYKYCLISVSNILTTTCQYEALKYVSFPVQTLAKCAKTIPVMSNNLYLKCKSLPHDSLSLKQNTLHRRNTCGPTVWPQPSERLSIQEISMSMDPSLSFTRLSRSPNQIISSDTNCWEIRGVWGALIMQKRYQGPDYLLAFLITLGCSVFILYPAGADMSPYSRGRENTVWGVLLMVGYLGFDGFTSTFQDKLFRGYDMEIHNQIFYTTLCSCILSLTGLILQGHLIPAVEFVYNHHDCFFDIALLSTVATVSQFFISYTIRTFGALTFATIMTTRQLVSIMLSCVWFAHPLSWEQWIGAVIVFGSLYGKSFSRKMPQKTTSSITLVQKGDPNNLKDNP

SEQ ID NO: 91969 - protein, 188 aa, Glycine max
  Coding DNA Sequence Number=SeqID_284
MSNSTSSSSQLTTLKEELEMFLATLPKLTNEEHEQWCEMAKITLKVVVPPDTILNTVSAKDQIYGEVSLSFVVRWKDVLDRLRRFINEDGNFHTVVYNQDLDKLVIVAGWTTLRDFYHVTAYHQVSLTHYGKNVYLTPQKVSCSSLDVPNTMYYFLKDKGWTHSYLDDVAECWLVFNHWRKTLKIGAG

SEQ ID NO: 91970 - protein, 61 aa, Glycine max
  Coding DNA Sequence Number=SeqID_285
MVFNLPNAKTASATLKYHSSSKEMVWLVMAVKSMRELDEDVGVKDEREAMEGSYRKPERIL

SEQ ID NO: 91971 - protein, 213 aa, Glycine max
  Coding DNA Sequence Number=SeqID_286
  Gene Ontology: Mol. function=transcription factor activity; Cellular component=nucleus; Biological process=regulation of transcription, DNA-dependent
  Homolog annotation: Hit_ID=B0LL84; Match level="QueryCoverage=77%, HitCoverage=92%, E-value=2e-21, Identity=38%"; Hit description =Ethylene response factor
  Pfam annotation: Domain name=AP2; Domain location=47-92; Score=22.8; E_value=0.0013; Accession=PF00847.11; Description=AP2 domain
MELIRVPHSYIGNESEVKYSSYYPTSPQDSREQRMGLKNSSNMGSVSGHLALWYMGSVENAVMKTRIWLGTFETAEDAARAYDEAARLMCGPKARTNFPYNPNEPQSSSSKLLSATLTAKLHKCHMASLSLQMSKQKQSQTEPHQGSSNDSGNSIAGTSSDNTQFRWPEEEGQVELLEQQQQFQPVLQDDHIEQMIQELLDYGSMEISFVHSA

SEQ ID NO: 91972 - protein, 255 aa, Glycine max
  Coding DNA Sequence Number=SeqID_287
  Homolog annotation: Hit_ID=A2YE73; Match level="QueryCoverage=32%, HitCoverage=41%, E-value=6e-14, Identity=47%"; Hit description =Putative uncharacterized protein
MTLSSWICVNNSKTMLLQIVHPGGHVELHDRPVTAAEIMCRYPRCHVAYPYVFQQPWAVVEPETMLMLGQKYYVVPNSTIRKLQRLSPRSSPSPSPSPAPACEIEISSSVDEIRNTQSSKEEDDVMLSTCCVFRNKSSAKQSNIYKQYSKNKSKKSEIRADVRNLSLNINNDKNGGLSHDSCFVSMFIGGRTKANASDMAKETRTSSSSAHLCDGNNTLTRKRTKDLAGNGLRSSPKNVWSSEHWQPSLESITEE

SEQ ID NO: 91973 - protein, 115 aa, Glycine max
  Coding DNA Sequence Number=SeqID_288
MTKTKINVIEKLNNSPSKDPCRKEIDDEEERGDSADCKTPLNRRNQIMLRQDFDNLAHDVFALYCTGDQIHLDTQTIQEIKSFNFQHLNQMAWMELSSTAQEPDEIDSVLFFKTY

SEQ ID NO: 91974 - protein, 303 aa, Glycine max
  Coding DNA Sequence Number=SeqID_289
  Gene Ontology: Mol. function=transcription regulator activity; Cellular component=nucleus; Biological process=regulation of transcription
  Homolog annotation: Hit_ID=A7R4Y3; Match level="QueryCoverage=60%, HitCoverage=76%, E-value=5e-40, Identity=48%"; Hit description =Chromosome undetermined scaffold_813, whole genome shotgun sequence
  Pfam annotation: Domain name=HLH; Domain location=116-165; Score =46.5; E_value=9.1e-11; Accession=PF00010.17; Description=Helix-loop -helix DNA-binding domain
MEENPWGSWSADMEVDDEVVNESLCHTNLFDEEFLRDILQRPQEGAPNLNNSSIMSSLCAQDIKPTTLFPTTYILSFDNSAALLPTETDRDFSSSKLPSSNSRANHGIKKPGSASESLNHIMSERNRRQELTSKFIALAATIPGLKKMDKAHVLREAINYVKQLQERVEELEEDIQKNGVESEITITRSHLCIDDGTNTDECYGPNEALPEVEARVLGKEVLIKIHCGKHYGILLEVMSELERLHLYISASNVLPFGNTLDITIIAQMGDKYNLVAKDLVKELRQVAMMKSFNKKIETMFARR

SEQ ID NO: 91975 - protein, 885 aa, Glycine max
  Coding DNA Sequence Number=SeqID_290
  Gene Ontology: Mol. function=oxidoreductase activity, acting on the CH-OH group of donors, NAD or NADP as acceptor; Cellular component =chloroplast; Biological process=branched chain family amino acid biosynthetic process
  Homolog annotation: Hit_ID=P93832; Match level="QueryCoverage=41%, HitCoverage=99%, E-value=1e-147, Identity=66%"; Hit description=3 -isopropylmalate dehydrogenase 2, chloroplast precursor
  Pfam annotation: Domain name=BRAP2; Domain location=488-598; Score =136.6; E_value=7.3e-38; Accession=PF07576.3; Description=BRCA1 -associated protein 2
  Pfam annotation: Domain name=Iso_dh; Domain location=45-360; Score =549.9; E_value=2.7e-162; Accession=PF00180.11; Description =Isocitrateisopropylmalate dehydrogen
  Pfam module annotation: Pfam domain module=BRAP2::Iso_dh; Domain location=488-598::45-360
  Subcellular localization annotation: CTP_CleavageSite=30; ConfidenceScore=5.09e-01
MAACLQLWQCKLARPFDSLPVRRSIPLSLRCSAAPSSSKPTRSYSITLIPGDGIGPEIISVAKDVLVLAGYLEGIKYDFREMLMGGAALDATGLPLPHETLSAAKQSHAVLLGAVGGYKWDRNDKHLKPETGLLQIRKELGVFANLRPATVYSPLVDASTLKREVAEGVDIMLIRELTGEPRGFGTNDNGEEIGFNTEIYATHEASMLWRKRFLAIAQEYPDVELSHMYVDNASMQLIRDPKQFDTMVTNNIFGDILSDEASMVTGSIGMLPSASLGASGPGLFEPIHGSAPDIAGQDKANPFATVLSAAMLLRYGLGEEKAAERIENAVMDTLNRGFRTGDIYSAGTKLVGCKQLGEEILKSVESNVPAGAAAGCPMRNLANPPSPPLSSGNDTPSTLPPLVCVVGVPNHMTYADFCQFCGSFIQHMLEMRIVWEGMWSSTSSTAAIPSDEEPSESSSSSSFSTSLFNFSSGNPRIEETRGLMHLFPDDTPSTLPVGRKPLVCVVGVPNHMTYADFCQFCGSFIQHMLEMRIVRMDGMEDQYSVLVRFDDQDSTDSFYKHYNGRRFSSLEVEVCRVLFTLDVQYTGSIEHAQPSNATSTELPTCPIRTPVEFLQLYATILSIVPVFLNGQILLVLYAAIASSKLKNLYVLFVKPLRTYGYVLYVGMLAVEDNYVHRLIQSKTDGKLIELNTQCAHADNGCGSCSCEDNAMNEAILNSKVEAIVNEYNELLATQLENQKLVSVLHLSLAVNLQNIASLKEESERKISKAVQKAISLKQQKIQSKIDRCKKEKKFLDDLNENLVKNEDIWKTKILAIEEREKKTTRLMGDRVADLEMQLGDLMVCLEGGRTVEQLAASDEIKEGIILDKSIESSTTSGSDLVGRDA

SEQ ID NO: 91976 - protein, 629 aa, Glycine max
  Coding DNA Sequence Number=SeqID_291
  Homolog annotation: Hit_ID=A7Q4C7; Match level="QueryCoverage=87%, HitCoverage=85%, E-value=1e-144, Identity=51%"; Hit description =Chromosome chr9 scaffold_49, whole genome shotgun sequence
  Pfam annotation: Domain name=GST_N; Domain location=104-166; Score =10.3; E_value=0.075; Accession=PF02798.11; Description=Glutathione S- transferase, N-terminal domain
  Pfam annotation: Domain name=mTERF; Domain location=223-609; Score =98.3; E_value=2.4e-26; Accession=PF02536.5; Description=mTERF
  Pfam module annotation: Pfam domain module=GST_N::mTERF; Domain location=104-166::223-609
MEGDGCNVKMLVKIHTNWFAPFAFPVRLAHKIEGCFELSKYVLFTRPPISSSFEVDNDKARKRRSSWRCGCGSEEARRAVSSYLGELGVSEEDSVWISSKSPEYVKMLVEGVRDLEQWQIALAGLSFKDKIIHIAAQKGDKGKVAYLESLGFTLSSSMNIARYLPSDTHTLPSLMHKVTRIKQLLFFSPTPDHHLLIKSIRLMMRHLSISIDEDLQHTLSFFEKLQAKPGGLGILAYKNAAFRSLIESFPRLLQLSVDNHFTPILHFLHNFGIPTFRISNIILAFPPLLFWDLQLLQTRLLVFKEIDLPDKDYAKLLLKYPWLLSTSIQENYTELLAFSYSIKVPKTQIDRAIESHPHLLSCSTSKLKSMVDQFAELGVRNKKLNQVIAKSPQLLLRKPKDFLQTPQGKACVLLLWVKPQFEHFKHETFVEILHKVGGLCTICPSSPKGSCVREQIKEAYDGRVFGLGNLGYINITLAAMWLCINKTLQRKIEFLGRVGVSKTFLPGVIRKYPELLVSDIDKTLLQRIMYLMKLGLSEKDIAYMGVLRPKIEFLVNSMERPVRDVVDYPRYFSYSLEKKIKPRYWVLKGRDIKCSLKDMLGKNDEEFAAEFMGIGRMLVYPPVSSNDSQ

SEQ ID NO: 91977 - protein, 107 aa, Glycine max
  Coding DNA Sequence Number=SeqID_292
  Homolog annotation: Hit_ID=A7Q4C3; Match level="QueryCoverage=44%, HitCoverage=18%, E-value=2e-09, Identity=65%"; Hit description =Chromosome chr9 scaffold_49, whole genome shotgun sequence
MGGVPVALIVLRWCSDDQIWSGAAVELFGEECSESEPILNHHHLHLPPPGESSFSCEIIPISAAASGDDDLQNVRVDETCHLVNADQPQCRICLDIGGLFTYSYPFP

SEQ ID NO: 91978 - protein, 132 aa, Glycine max
  Coding DNA Sequence Number=SeqID_293
  Gene Ontology: Mol. function=histone acetyltransferase activity; Cellular component=nucleus; Biological process=regulation of transcription, DNA-dependent
  Homolog annotation: Hit_ID=A7Q4K1; Match level="QueryCoverage=84%, HitCoverage=8%, E-value=1e-48, Identity=81%"; Hit description =Chromosome chr9 scaffold_49, whole genome shotgun sequence
  Pfam annotation: Domain name=zf-TAZ; Domain location=22-94; Score =35.5; E_value=2e-07; Accession=PF02135.7; Description=TAZ zinc finger
MLSGDIALLSIRSDVNGFYNLQLRKMLDLLVHASQCRSAHCQYPNCRKVKGLFRHGMHCKIRASGGCVLCKKMWYLLQLHARACKESECHVPRCRDLKEHLRRLQQQSDSRRRAAVMEMMRQRAAEVANSSG

SEQ ID NO: 91979 - protein, 185 aa, Glycine max
  Coding DNA Sequence Number=SeqID_294
KTSAGGAGKNGERRLTARLPEEVFRKLSGRTLLPEIPNVSGRNLLPESFRKQGSSGKRLVSSGRTLLPESFPNGSSGSLAVSPLSPFFPAPPALVFYPMPNATTTQCIIKPNGRLTKLTSNGNGVQAKEAAAGLAVACGGRECSRKRKEKKQKHWVKVKRMLPEEERKETKALGESESGRKEGVF

SEQ ID NO: 91980 - protein, 568 aa, Glycine max
  Coding DNA Sequence Number=SeqID_295
  Gene Ontology: Mol. function=heat shock protein binding; Cellular component=chloroplast thylakoid membrane; Biological process =response to heat
  Homolog annotation: Hit_ID=P92424; Match level="QueryCoverage=78%, HitCoverage=97%, E-value=1e-122, Identity=50%"; Hit description=DnaJ homologue precursor
  Pfam annotation: Domain name=DnaJ; Domain location=67-128; Score =136.7; E_value=6.7e-38; Accession=PF00226.22; Description=DnaJ domain
  Pfam annotation: Domain name=DnaJ_C; Domain location=298-440; Score =26.8; E_value=1.2e-08; Accession=PF01556.9; Description=DnaJ C terminal region
  Pfam annotation: Domain name=DnaJ_CXXCXGXG; Domain location=151-235; Score=99.7; E_value=9.1e-27; Accession=PF00684.10; Description=DnaJ central domain (4 repeats)
  Pfam module annotation: Pfam domain module=DnaJ::DnaJ_C::DnaJ _CXXCXGXG; Domain location=67-128::298-440::151-235
  Subcellular localization annotation: CTP_CleavageSite=76; ConfidenceScore=5.80e-01
MAVTTLSLLPPSTRPCFCGTVHLRSHNSFLSIHSTSSSSFLSFSSISIPNHSPTRRPFHTVLASSSDYYSTLGVPKSATGKEIKAAYRRLARQYHPDVNKEPGATEKFKEISAAYEVLSDDKKRALYDQYGEAGVKSAVGGGSSAYTAIFGKEKEFELSHLETCEVCTGTGAKIGSKMRVCSTCGGRGQVMRTEQTPFGLFSQVSVCPNCGGDGEVISEYCRKCNGEGRIRVKKNIKVKVPPGVSSGSILRVTGEGDAGPRGTNVPSKLEYSSIVNGTEGLDIKNSTIQPTPNVFYSQKVNSREENCPSLTRGPPGDLYVYLDVQEIPGIQRDDINLVSMLSISYLDAIRGAVVKVKTVEGISELQIPAGTQPGDVLVLARKELATLGDASRRSKSRPRTHSSGGGTESPTAQKDESPTATVEEKTEKSEDENDVWNKLKDFAGSPSVASSICLLLLVGTITLLLVSAVTLILTGAVTLVWFYNGFYVLDNNLQIWINLRRPPPTTVHTATIKALVSRWSMSMTTEVVVGETCGVASLSVVVGGRGVDAVAEVEEEGDDGVEEKKRRW

SEQ ID NO: 91981 - protein, 338 aa, Glycine max
  Coding DNA Sequence Number=SeqID_296
  Gene Ontology: Mol. function=monooxygenase activity; Biological process=electron transport
  Homolog annotation: Hit_ID=A7PF87; Match level="QueryCoverage=100%, HitCoverage=100%, E-value=4e-31, Identity=47%"; Hit description =Chromosome chr11 scaffold_13, whole genome shotgun sequence
MSAAVCGSKRSLFEELPPSPPVSKRLRCSSSPIRLSLPSLIDHLRSLFPHMDDQVLERALQECGNDLDAAIKSLHGLCLGSADDNSQIAPQPDLPNVVHTGTLEENDDASASGDQPASGNFPADGAEWIDLFVREMTCATSVDDARSRAARLLEVLEKSITAHASSGATTALQRFSASPFIKIHEHRSIVHPPGHYCLQLPNLCSAATNVAFEEDYGSGNLETGFFDSVCMSSMCPCGVKGWGIWAEWVDLNENLMLKEQIEALTKEKNCFKSAFRIQLERLSDYENKNQELQQLKQLVSQYQEQIRTLEVNNYALRMHLNQAQQYNPFPGRFPPDAF

SEQ ID NO: 91982 - protein, 438 aa, Glycine max
  Coding DNA Sequence Number=SeqID_297
  Gene Ontology: Mol. function=phosphoinositide binding; Biological process=cell communication
  Homolog annotation: Hit_ID=A7QIK2; Match level="QueryCoverage=77%, HitCoverage=50%, E-value=1e-54, Identity=39%"; Hit description =Chromosome chr9 scaffold_104, whole genome shotgun sequence
MEKLLPDVDVSRSAPVAMFLELEAAARSSFHDVNEHVSDEASANATTPSHMIQDNSPGSVKAHGSSAAIVPGNNEVSELGTPQHGKDNCSDQIMDNSTLEHGLINPTETNVHCATSSENFVYKDNITDKVTGYTADAIAIHLDGTEFTPAVQDYNLNAHVKRLSTENITSDLSSLRNTETSNLTTTTLVQDALHSLAGSHEASRNSDLFFTFPLDEQHKLKKILNTQKQRLVTTKADVEDLIARLNQEMAARQYLVTKVSVVYTNAVGYGGTSEEMPETEMKLKLEEDERLLAESTKESVIQEKQMLQQELDVAREQLKHLQKHHDEFEMKSKTDMKVLIKEVKSLRSSELELKQQLSELMKEKLDLEGIVKSLLHRSCHLHESFINLGTETIFHAIFNFTLIPLVKVNLGEDGKNYITEKSREANEGMTSESLLERK

SEQ ID NO: 91983 - protein, 616 aa, Glycine max
  Coding DNA Sequence Number=SeqID_298
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A5BDY0; Match level="QueryCoverage=53%, HitCoverage=76%, E-value=1e-143, Identity=77%"; Hit description =Putative uncharacterized protein
  Pfam annotation: Domain name=Glyco_hydro_17; Domain location=275-588; Score=383.0; E_value=4.6e-112; Accession=PF00332.9; Description =Glycosyl hydrolases family 17
  Pfam annotation: Domain name=MBD; Domain location=11-84; Score=65.4; E_value=1.9e-16; Accession=PF01429.10; Description=Methyl-CpG binding domain
  Pfam module annotation: Pfam domain module=Glyco_hydro_17::MBD; Domain location=275-588::11-84
MENAEEMMQQNDEVLSVELPAPSGWNKLFFPKKLGTPRKSEIVFIAPTGEEISTKKQLEQYLKAHPGNPVISEFDWGTGETPRRSARISEKVKSTPPADSDTPKKRARKSSGSKKDNKETESASEEGKAKSDTEDPKAAEEEKNEGNDNSNSGGKQLENGDKTEQIDEQAKKPDVDMEENDLNDTNNKLENDSDEIKNSHVNGENVIAERPEGEEAQKQEVEPAEKVAEEAANTAETEKSLLTELEKEKNEEKTDTATLEANGGGEKENPNAAQMIADNLPPPESVVTLLKAAKIKNIRIYDADHQVLRAFKGSGIEIVVGLGNEFLKDMSVGEDRAMSWVKENVQQFLPETKICGIAVGNEILGGTDMELWEVLLPAAKNVYNALSKLGLAKDVQVSSPHSEAVFANSFPPSSCTFKEDVLPYMKPLLQFFSQIGTPFFINAYPFLAYKNDPQHIDLNYALFLKNPGIYDAKTKLHYSNMFEAQVDAAYAALEKVGFDKMDVIVSETGWASHGDDNEAGATIKNARTYNGNLRKRLLKKKGTPYRPKKVVKAYVFALFNENLKPGSTSERNFGLFKADGSIAYDIGFTGLVPSSATSSFLSFKVYGLWILLYFHY

SEQ ID NO: 91984 - protein, 132 aa, Glycine max
  Coding DNA Sequence Number=SeqID_299
MLDTDTDPHNHTPPKPEKKTSMSRSNVLKNHRSIKMKESDQVEEAKQKIYKKKLTPPSVRKLFSSSGLDMHEGSRLQTLVMGGGMGSGGGRICGGGRGSHGRDGTDAYYQNMIQANPNNALLLGNYAKFLKE

SEQ ID NO: 91985 - protein, 485 aa, Glycine max
  Coding DNA Sequence Number=SeqID_300
  Gene Ontology: Mol. function=tetracycline:hydrogen antiporter activity; Cellular component=cytoplasm; Biological process=response to antibiotic
  Homolog annotation: Hit_ID=A7QAQ9; Match level="QueryCoverage=100%, HitCoverage=99%, E-value=1e-180, Identity=67%"; Hit description =Chromosome chr5 scaffold_72, whole genome shotgun sequence
  Pfam annotation: Domain name=Diphthamide_syn; Domain location=28-372; Score=119.1; E_value=1.3e-32; Accession=PF01866.8; Description =Putative diphthamide synthesis protein
  Subcellular localization annotation: CTP_CleavageSite=57; ConfidenceScore=5.04e-01
MDFESNYDIAASANFIHTHNFIKVALQFPDNLLKHSTRVVTALRNTLQSTEVGLFVMADTAYGSCCIDEVGASHINADCVIHYGHTCFSPTTTLPAFCVFGKASICIADCVESMSKYALTNSKPIMVLFGLEYAHSMQRIKEALLESSMSCRFDPKSEVHFADVPSSVMFPSKDIKKINVLQEPVSDCNGASGTMYSIGGLTWKLPEGQSMDDYLVFWIGHDDSAFANVVLTFNACEIVRYDANENRMVTDLFQHRRILKRRYYLVERAKDANIVGILVGTLGVAGYLHIINQMMELITGAGKKAYTLVMGRPNPAKLANFPECDVFLYVSCAQTALLDSKEYLAPVITPFEAMIAFNRGSQWTGAYVMEFRDLINLPQMGVGNQEEEEARFSFLKGGYVEDFENQENVEEERETLALVNATEKALQLRNNSNVLMKGSARSGAEFLANRSYQGLNMSSENTSPEPYLIGRRGRASGYEDEKNKQ

SEQ ID NO: 91986 - protein, 77 aa, Glycine max
  Coding DNA Sequence Number=SeqID_301
MHVNILRYQKNNRQHIGGVVQKGGHKEKKELRGSGHQGRDNRTYAQAAIPLKKMETQQWIGGSKGGTKRRRYYRELF

SEQ ID NO: 91987 - protein, 223 aa, Glycine max
  Coding DNA Sequence Number=SeqID_302
  Gene Ontology: Mol. function=zinc ion binding; Cellular component =intracellular
  Homolog annotation: Hit_ID=Q2HVX5; Match level="QueryCoverage=53%, HitCoverage=45%, E-value=6e-39, Identity=67%"; Hit description =Biotin/lipoyl attachment
  Pfam annotation: Domain name=Biotin_lipoyl; Domain location=146-212; Score=16.8; E_value=0.00012; Accession=PF00364.13; Description =Biotin-requiring enzyme
  Pfam annotation: Domain name=zf-RanBP; Domain location=6-37; Score =10.0; E_value=0.066; Accession=PF00641.9; Description=Zn-finger in Ran binding protein and others
  Pfam module annotation: Pfam domain module=Biotin_lipoyl::zf-RanBP; Domain location=146-212::6-37
  Subcellular localization annotation: CTP_CleavageSite=30; ConfidenceScore=5.07e-01
MAAPQLSGDWYCGAANCGAHNFASRSSFFECAAVNNDSAADTSRSRAFGGAGTAWKSGDNLFAAVFEDCENTVAKGNIGIRDVQYYDLCWVPLSFTAFRRSEGSEEVKSSGLTSELIPNLIEPVDPIPSSGSIQRFLNKAADEGLVIIQSPKGRRAPPSCKEKQNVEEGQVICYIEQLGGELPIESDVSGEVIKILQKDGDPVGYGDALVAILPSFPGIKKLQ

SEQ ID NO: 91988 - protein, 534 aa, Glycine max
  Coding DNA Sequence Number=SeqID_303
  Gene Ontology: Mol. function=cytochrome-c oxidase activity; Cellular component=cellulose and pectin-containing cell wall; Biological process=electron transport
  Homolog annotation: Hit_ID=A7P5N4; Match level="QueryCoverage=64%, HitCoverage=91%, E-value=1e-143, Identity=70%"; Hit description =Chromosome chr4 scaffold_6, whole genome shotgun sequence
  Pfam annotation: Domain name=COX5B; Domain location=426-525; Score =77.0; E_value=6.2e-20; Accession=PF01215.10; Description=Cytochrome c oxidase subunit Vb
  Pfam annotation: Domain name=DUF642; Domain location=42-355; Score =679.6; E_value=2.5e-201; Accession=PF04862.3; Description=Protein of unknown function, DUF642
  Pfam module annotation: Pfam domain module=COX5B::DUF642; Domain location=426-525::42-355
MQSLKLQLVLFLSISTSHAVFSFTDGLLPNGNFEQGPKPSQLKGSVVTGHDAIPNWTISGFVEYIKSGQKQGDMLLVVPEGDYAVRLGNEASIKQKLKLIKGSFYSITFSAARTCAQEEKLNVSVVPTTEKRDWGIIPIQTMYGSNGWESFTCGFRADFPEAQIVIHNPGKEEDPACGPLIDSVALKVLYPPKRTRANLLKNGNFEEGPYIFPNSSWGALIPPHIEDSHGPLPGWIVESLKAVKYIDSDHFAVPEGKRAIELVAGKESALAQVVITTIGKTYDLTFAVGDANNACESSMMVEAFAGTNTVQVPYQSKGKGGFVRGKLRFKAVSTRTRLRFLSTFYTMKSDNSGARAMGWHTWQGYWVWPWPLEETPQIEIETMWRRLFSSSNLKSLHTALSPSRPRLAAPLLTRHVTAHSGASSVKRRVEDVVPIATGHEREEIQADLEGRDILEINHPVGPFGTKEAPAVVKSYFDRRIVGCPGDEGEDEHDVVWFWLEKGKPKECPVCSQYFKLEVVGPGGDPYGHGDHDHH

SEQ ID NO: 91989 - protein, 69 aa, Glycine max
  Coding DNA Sequence Number=SeqID_304
MLAHNNNLIIKDVTTNGAVEKCPSLRESSGKGNRKKIIDGPPEVIVERRYLGWRVKANPLSYIEGVDLN

SEQ ID NO: 91990 - protein, 90 aa, Glycine max
  Coding DNA Sequence Number=SeqID_305
  Subcellular localization annotation: CTP_CleavageSite=54; ConfidenceScore=5.36e-01
MVKFAPNYDSSKYLKTTSWPNPVQVLSARHALSVQGSTSAKRGVKHKDVGFITRAKREAHAKRAIQQKHMLSLQHVLSARSERVKRKVSR

SEQ ID NO: 91991 - protein, 221 aa, Glycine max
  Coding DNA Sequence Number=SeqID_306
  Gene Ontology: Mol. function=transferase activity, transferring nitrogenous groups; Cellular component=cytoplasm; Biological process= biosynthetic process
  Homolog annotation: Hit_ID=A9PFW6; Match level="QueryCoverage=93%, HitCoverage=52%, E-value=7e-95, Identity=79%"; Hit description =Putative uncharacterized protein
  Pfam annotation: Domain name=Aminotran_1_2; Domain location=1-207; Score=-78.5; E_value=0.0024; Accession=PF00155.12; Description =Aminotransferase class I and II
IIFPKNMLIDHNCKRISDLCKNAGSWLVVDNTYEYFMYDGLKHSCVEGNHIVNVFSFSKAYGMMGWRVGYIAYPSEVKDFAEQLLKVQDNIPICASILSQYLALYSLEVGPQWVLDQVKTLEKNREIVLEALSPLGEGSVKGGEGAIYLWAKLPDLDAHDDFDVVRWLANKHGVAVIPGKACGCPSNLRISFGGLTENDCRAAAERLKKGLEELVRDGLRE

SEQ ID NO: 91992 - protein, 450 aa, Glycine max
  Coding DNA Sequence Number=SeqID_307
  Gene Ontology: Mol. function=glycerate kinase activity; Cellular component=chloroplast; Biological process=oxidative photosynthetic carbon pathway
  Homolog annotation: Hit_ID=A7P7I0; Match level="QueryCoverage=80%, HitCoverage=93%, E-value=1e-157, Identity=74%"; Hit description =Chromosome chr9 scaffold_7, whole genome shotgun sequence
  Subcellular localization annotation: CTP_CleavageSite=20; ConfidenceScore=5.69e-01
MATLNLFSQPWQPTISPSFCCSNTNNNNNVVYAYHNHNSNSNNSKLHLFSNSRQFSVLSQLSTNSSKSGSGSSWLQNSSFVAGIEYRKRPLYSVFPTKPAQVSSVEDLYEFICSGPLLDKIGITQEQVAESIDNWLLYGRYLCRLFQLNELYLTEPQKARIYHYYVPVFLWCEQQIAEHQSKFKDGEDIPPLVIGFSAPQGCGKTTLVFALDYLFEVIGRKSATVSIDDFYLTAEGQNKLREANPGNALLELRGNAGSHDLALSVETLLALTKLTREGMKMKLPRYDKLLKADCLLMMQSAFNGRGDRADPSRWPEVEGPMTVVLFEGWMLGFKPLPVEAVKVVDPQLETVNKNLEAYYDAWDKYIKSWIVIKIKDPNCVFQWRLQAEIAMREAGNPGMTDDEVRDFVSRYLPAYYAYLPTLYSEGPNGSDPQHLLTIEIDEGRNPILAT

SEQ ID NO: 91993 - protein, 54 aa, Glycine max
  Coding DNA Sequence Number=SeqID_308
MTHRQDTLNKKRDLRNIRARDEMVVNHEGGRTGLASIGNRLTIVSRFEERRKGH

SEQ ID NO: 91994 - protein, 104 aa, Glycine max
  Coding DNA Sequence Number=SeqID_309
MVSSRTKKKNALQGEAPPPIEVAQEEEEKEEESTHAANKGCVEGGRERSSKVTGVARCMVEGRRKSIGAEESWALLGDHTLIFDVANEIKSSSSSNKVTSELEF

SEQ ID NO: 91995 - protein, 987 aa, Glycine max
  Coding DNA Sequence Number=SeqID_310
  Gene Ontology: Mol. function=protein transporter activity; Cellular component=membrane coat; Biological process=intracellular protein transport
  Homolog annotation: Hit_ID=A6SG58; Match level="QueryCoverage=89%, HitCoverage=94%, E-value=0.0, Identity=48%"; Hit description =Putative uncharacterized protein
  Pfam annotation: Domain name=Coatomer_WDAD; Domain location=319-846; Score=771.4; E_value=5.7e-229; Accession=PF04053.5; Description =Coatomer WD associated region
  Pfam annotation: Domain name=WD40; Domain location=132-171; Score =49.4; E_value=1.3e-11; Accession=PF00400.23; Description=WD domain, G-beta repeat
  Pfam annotation: Domain name=WD40; Domain location=175-215; Score =38.7; E_value=2e-08; Accession=PF00400.23; Description=WD domain, G -beta repeat
  Pfam annotation: Domain name=WD40; Domain location=219-257; Score =57.1; E_value=6.1e-14; Accession=PF00400.23; Description=WD domain, G-beta repeat
  Pfam annotation: Domain name=WD40; Domain location=47-85; Score=11.3; E_value=1.3; Accession=PF00400.23; Description=WD domain, G-beta repeat
  Pfam annotation: Domain name=WD40; Domain location=5-43; Score=20.3; E_value=0.0072; Accession=PF00400.23; Description=WD domain, G-beta repeat
  Pfam annotation: Domain name=WD40; Domain location=89-127; Score =47.2; E_value=6e-11; Accession=PF00400.23; Description=WD domain, G -beta repeat
  Pfam module annotation: Pfam domain module=Coatomer_WDAD::WD40::WD40:: WD40::WD40::WD40::WD40; Domain location=319-846::132-171::175 -215::219-257::47-85::5-43::89-127
MPLRLEIKRKLAQRSERVKCVDLHPTEPWILASLYSGTVCIWNYQSQTMAKSFEVTELPVRSAKFIARKQWVVAGADDMFIRVYNYNTMDKVKVFEAHTDYIRCVAVHPTLPYVLSSSDDMLIKLWDWEKGWICTQIFEGHSHYVMQVTFNPKDTNTFASASLDRTIKIWNLGSPDPNFTLDAHQKGVNCVDYFTGGDKPYLITGSDDHTAKVWDYQTKSCVQTLEGHTHNVSAVCFHPELPIIITGSEDGTVRIWHSTTYRLENTLNYGLERVWAIGYLKSSRRVVIGYDEGTIMVKLGREVPVASMDNSGKIIWSKHNEIQTVNIKSVGADVEVADGERLPLAVKELGTCDLYPQNLKHNPNGRFVVVCGDGEYIIYTALAWRNRSFGSALEFVWSSEGEYAVRESTSKIKIFSKNFQTVRHPTVAEVMRGEKRIIMRGKDQKEELGCNDLAYVARGVGRECGGARMKMYGLDPGLISVTVIIFREKRSVRPTFSAERIFGGTLLAMCSNDFICFYDWAECRLIYRIDVNVKNLYWADSGDLVTIASDTSFYILKYNRDVVVSHLDSGRPVDDEGVEDAFELLHEMNERVRTGIWVGDCFIYNNTSWRLNYCVGGEVTTMFHLDRPMYLLGYLANQSRVYLIDKEFNVMGYTLLLSLIEYKTLVMRGDLERANDILPSIPKEHHNSVAHFLESRGMIEDALEVATDPEYRFDLSIQLGKLDVAKSIAIELQSEPKWKQLGELTMSTGKLEMAEECLKYAMDLSGLLLLYSSLGDAEGISKLAILAKEQGKNNVAFLCLFMLGKLEDCLQLLVESNRIPEAALMARSYLPSKVSEIVAIWRKDLNKVNPKAAESLADPEEYPNLFEDWQVALAVESKAVETRNVYPPAEQYVNHADKSQITLVEAFRNMQIEEGEEHLENGDSTHELTEQSGEEHYTEDQEEQNGEEGSQEEAVVVDADSTDGAVLVNGNEADEEWGTNNEGAPSA

SEQ ID NO: 91996 - protein, 376 aa, Glycine max
  Coding DNA Sequence Number=SeqID_311
  Homolog annotation: Hit_ID=A7P5I5; Match level="QueryCoverage=88%, HitCoverage=74%, E-value=2e-27, Identity=43%"; Hit description =Chromosome chr4 scaffold_6, whole genome shotgun sequence
  Pfam annotation: Domain name=DUF581; Domain location=312-348; Score= -4.6; E_value=0.046; Accession=PF04570.5; Description=Protein of unknown function (DUF581)
  Subcellular localization annotation: CTP_CleavageSite=65; ConfidenceScore=5.44e-01
MADSSSNFSLPCDALSPTQKSFSIFHTSGSWLGVGAKGLPDSESVWSPTSPLDCRLFSNLSNPFSAKSSRPSFQTGHKKQFDGSKVGLGIISSLANETKLNNDILGKFKRKGIIFGPQVKTGILKFSNKNHESLAPYLKSNSFPKNCVISLPSETTIPKSELENFYDVSGKKDGNWESETFKSTVTSLPDSFSPSSLINSTQNSKMGINELGVENTSALMSLPQLTSRGSQVDNCLKIKSNSLPISIDFSKGCIGSLSAREIELSEDYTCIISHGLNPKRTHIFGDCILECHNNDFTEFNKKEEPAFSSSQVPAFSDGSAPYPSGNILSFCYSCNKKLVKEEGIYRYRFVPNISLSYCYFSQVKSASGNILYILQR

SEQ ID NO: 91997 - protein, 218 aa, Glycine max
  Coding DNA Sequence Number=SeqID_312
  Gene Ontology: Mol. function=nucleotide binding; Cellular component =plasma membrane; Biological process=small GTPase mediated signal transduction
  Homolog annotation: Hit_ID=A7PER1; Match level="QueryCoverage=99%, HitCoverage=90%, E-value=7e-66, Identity=60%"; Hit description =Chromosome chr11 scaffold_13, whole genome shotgun sequence
  Pfam annotation: Domain name=Arf; Domain location=28-189; Score= -69.7; E_value=0.00031; Accession=PF00025.12; Description=ADP -ribosylation factor family
  Pfam annotation: Domain name=Miro; Domain location=27-144; Score =11.0; E_value=0.00094; Accession=PF08477.4; Description=Miro-like protein
  Pfam annotation: Domain name=Ras; Domain location=1-191; Score=191.7; E_value=1.9e-54; Accession=PF00071.13; Description=Ras family
  Pfam module annotation: Pfam domain module=Arf::Miro::Ras; Domain location=28-189::27-144::1-191
MGTGKTSIALRFVKGHFFPNQVYFHFIALIEIGKLLSQHNNNYSLGILTLIYAQEPTIGAAFFTQILSLSEATVKFDIWDTAGQERYHSLAPMYYRGAAAAIVVYDISSVDTFVRAKKWVQELQTHGNASNSKSVMALVANKSDLEPKREVEAEVGEQFAQENGMFYMETSAKTAENINELFYEIAKRLARALPPKPTGMNLNSDIQDRGRNYFCCSA

SEQ ID NO: 91998 - protein, 134 aa, Glycine max
  Coding DNA Sequence Number=SeqID_313
  Homolog annotation: Hit_ID=A7P7D0; Match level="QueryCoverage=57%, HitCoverage=16%, E-value=1e-19, Identity=58%"; Hit description =Chromosome chr9 scaffold_7, whole genome shotgun sequence
MGESPPKPYHDSTKWNSCGGFQRPANTEMFECPDFFAVDISGSKNRKFSLTIFSDLPELRELRTLFTGKFGNSLELYISKEFVEKLRQDLPSKEMKIQLLHDVAQEFSIEWNSKALEQRLQSPPQLHEVSFTYH

SEQ ID NO: 91999 - protein, 736 aa, Glycine max
  Coding DNA Sequence Number=SeqID_314
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=99%, HitCoverage=99%, E-value=0.0, Identity=71%"; Hit description=BY-2 kinesin-like protein 10
  Pfam annotation: Domain name=Kinesin; Domain location=227-545; Score =444.7; E_value=1.3e-130; Accession=PF00225.14; Description=Kinesin motor domain
MNGAGRQGLRSGAAGVHHQRQYSDNFLDSSSNGNRWLQSAGLQHLQSSSNQLPPLQDYNLYGGAQGGRMYRNAPRSFNGGNEYYMEPSTPPGGYRASMQKKNGEDLSGDFSPGLLDLQSFDTELLPPEITATEIFNFFESLTLESVILCRIFVDVVENYAHEKLPVSNAYDANSLYQPGRGRSFDDSETYMLSKQTGRARAPENILKSLPADKEKSNSVAKIKVVVRKRPMNKKELAKNEEDIIETYSNSLTVHETKLKVDLTQYVEKHEFVFDAVLNEEVTNDEVYRETVEPIVPIIFERTKATCFAYGQTGSGKTYTMKPLPLKASRDILRLMHHTYRNQGFQLFVSFFEIYGGKLFDLLNDRKKLCMREDGKQQVCIVGLQEYRVSDVENIKDLIEKGNSTRSTGTTGANEESSRSHAILQLAIKRSVDGNESKPLRLVGKLSFIDLAGSERGADTTDNDKQTRIEGAEINKSLLALKECIRALDNDQGHIPFRGSKLTEVLRDSFVGNSRTVMISCISPSTGSCEHTLNTLRYADRVKSLSKGNNSKKDVLSSNFNLKESSTVPLSSVTGSAYEDRVTDGWPDENEGDDFSPSEEYYEQVKPPLKKNGKMESYATTDDKLKKPSGQIKWKDLPKVEPQTTHAEDDLNALLQEEEDLVNAHRTQVEETMNIVREEMNLLVEADQPGNQLDDYITRLNAILSQKAAGILQLQTRLAHFQKRLKEHNVLVSSTGY

SEQ ID NO: 92000 - protein, 19 aa, Glycine max
  Coding DNA Sequence Number=SeqID_315
MAEAREARGKGESDVWSGN

SEQ ID NO: 92001 - protein, 72 aa, Glycine max
  Coding DNA Sequence Number=SeqID_316
MKAELVKGRDEDANLNGCVGSRNQIVDVAFEVVELIIELWKENVKAGMKVRFDELCKSNTLRGMTDPPPTLF

SEQ ID NO: 92002 - protein, 76 aa, Glycine max
  Coding DNA Sequence Number=SeqID_317
MKKLKRYNVQPNPQVCFKGLDLEALGLHSEAASVRGSKSHQKKTEDGSTIVCNKRVPRISHFLNSYPCDRNNKWAK

SEQ ID NO: 92003 - protein, 426 aa, Glycine max
  Coding DNA Sequence Number=SeqID_318
  Homolog annotation: Hit_ID=A7P771; Match level="QueryCoverage=99%, HitCoverage=64%, E-value=1e-106, Identity=48%"; Hit description =Chromosome chr9 scaffold_7, whole genome shotgun sequence
MSNGKTGASYAESKPQEDRLLETVASSGGVRLQPTRDAIQVFLREAAKLDAMALCHAIERKLQSPMWQAFHRQKEDDEDHFSRMASYFAENNVLVLRCSESPQASLREKANKVLGLLGGNQLNSAINSEKAVKTDSAAVAELPDLIDTGDLNDYHGTGDNTKSKNGQNIANLTPSTPPALADDLFENFMNSGVASDELKNDDPFADVSFHSNDNKEHADIFSSMTVGDDKLDHHVSHGLGNRNEPDSDDLLAGLSIDENTSSTKQKATSPAMQSESLFSGLNNHVSHLGPDNGLGSMLGTQAVGFNVSSIFPSGHPPCITQPGIMLNQPYSSQPLNYGAMGNLLAQQQFLATMANFQHLNNVNKNDGSTAQNAGSNGKTPLPDIFQSKFSTQTPSSMISNSKKEETKAFDFISDHLATACDSRRVI

SEQ ID NO: 92004 - protein, 290 aa, Glycine max
  Coding DNA Sequence Number=SeqID_319
  Homolog annotation: Hit_ID=Q9LU25; Match level="QueryCoverage=99%, HitCoverage=63%, E-value=1e-153, Identity=84%"; Hit description =Arabidopsis thaliana genomic DNA, chromosome 3, P1 clone: MYA6
MYGMGFDHSFGLWFIACWLKPDLMIESGAFKGHSTWVLRQAMPDTPIISLSPRHPEKYLKKGPAYVDGNCTYYAGKDFVDFGSIDWPNVMKKHGISDLNRVLIFFDDHQNELKRIEQALKAGFRHLVFEDNYDTGTGDHYSLRQICDQSYIRGGGHNCFKDSDEARIRSRRKKFWEKAVDIEELCGPDEAWWGVRGFMRDNFNHSNKPISYAQHFQNSRYIESILDVYWELPPVAGPSLTHQTRYDPARAPSPIVEDGRYGLFRRLGLANLDNSVFNGYTQMVYLQISEQ

SEQ ID NO: 92005 - protein, 156 aa, Glycine max
  Coding DNA Sequence Number=SeqID_320
MGSLLQGHNWITYQYPVFIARGLTAGHAEGSEIGVEAIEAEEAGARDGAVGRGDADEAARCEEEGEGQEDEKEDDDAREVEGTGTGDSGEVIGGSGGDAEENVLVLLCLGFVGVSVGVAVGAGVDAAGGESPLQHGGRGEIGMTVSRGGGAAALRL

SEQ ID NO: 92006 - protein, 968 aa, Glycine max
  Coding DNA Sequence Number=SeqID_321
  Gene Ontology: Mol. function=hydrolase activity; Cellular component =nucleus; Biological process=tRNA processing
  Homolog annotation: Hit_ID=A7P772; Match level="QueryCoverage=82%, HitCoverage=94%, E-value=0.0, Identity=60%"; Hit description =Chromosome chr9 scaffold_7, whole genome shotgun sequence
  Subcellular localization annotation: CTP_CleavageSite=54; ConfidenceScore=5.72e-01
MAQVSKFGHLLLHSSLPKPSNSNIQFRSLLTLLASSSKRHRSIPPFRRKSTTPKPMEVKEESSSFNKRRAQGRDKNDISQKNLYLKVRKLNPINTISFVQILGTGMDTQDTSPSVLLFFDNQRFIFNAGEGLQRFCTEHKIKLSKIDHIFLSRVCSETAGGLPGLLLTLAGMGEDGMSVNIWGPSDLKYLVDAMRSFIPNAAMVHTKSFGPIFNTDGPIVPHQSKLLDPIVLIDGEVVKISAIILQPNCIEGQVLTPSESSSQERMDHSPETLDSPNGKKLPAAKPGDMSVVYVCELPEIKGKFDPEKAKALGLRPGPKYRELQLGNSVKSDHQNIMVHPSDVLGPSVPGPIVLLVDCPTESHLEALLSMQSLASYCDQTDNLPEAGKSVTCVIHLTPASVVSCSNYQKWMKKFGSAQHIMAGHEKKNVEIPILKASARIATRLNYLCPQFFPAPGLWSLPNHDSSKFGCLASREDSLSEFSEVISAENLLKFTLRPYAQLGLDRSCIPTRADSSEIIDELLSEIPEVLEAVKHVSQLWQECSQTKEDLTPVADHGMMNEEPWLCANGIPACLENIRRDDLEIVLLGTEEVCSWIVVKEPWDNLKEGKYGVTGADDAVRTLRCIWISHIHADHHTGLARILALRRDLLRGVPHEPVLVVGPRQLKRYLDAYQRLEDLDMLFLDCKHTTAASLEAFEDDFPGNSVNSQNLKNNNGDLIASKVNSTLFARGSLMQSYFKRPGSPVDKDVVSPILKKFKGVIQEAGLKALISFPVVHCPQAFGVVLKAEERTNSVGKVIPGWKIVYSGDTRPCPELIEASRGATVLIHEANPSLINQALNLEVFGSPIGKSLAKLTSSTLIINFCTATFEDAMVEEAIARNHSTTNEAIKMGQSANAYRTILTHFSQRYPKIPVFDETHMHKTCIAFDMMSVNVADLSVLPKVLPYLKLLFRNEMMVDESDDVVEAVTSAS

SEQ ID NO: 92007 - protein, 47 aa, Glycine max
  Coding DNA Sequence Number=SeqID_322
MARTEFDGGGNAAPEEREDMGVDFWFGEEGGGNGDGERGDDRIDCRL

SEQ ID NO: 92008 - protein, 702 aa, Glycine max
  Coding DNA Sequence Number=SeqID_323
  Pfam annotation: Domain name=zf-C3HC4; Domain location=643-698; Score= 12.2; E_value=0.0037; Accession=PF00097.16; Description=Zinc finger, C3HC4 type (RING finger)
MPFASASMEKRSEELGLSLMNTDSANHDRIPGVRHQNDTTVPLPLVSPSPFPHWHLHETSQYYNNEPAGVNSMIDSSQFRSYQNFQMDHNYYHRAEHNFLPCETDSCFPCPEGYIGWPYQYDRHNNLTIPVDVRDASFNLNNFEKPGNGGMCVTPSYGSASRLQMANPSGASMSANTGQPSLDMNLGMALCNPNKGCVEPLLTIGKRDERFMTTGSGSNNKESKSSAVTLKFNLTGNSDREFLPPVNIYHNQLGSRSSLNPGLDMNATFSAFQNDSEVISDLAPASNHEALFDSRPGLRLGPSYAFQWPAAGDQNHYLGQVNRDLGLGGVKDTSMEFTAVGHKNGLGCMDLNSLPIVGSLTMPFESGQRWANRQLAPSSSGTVTDKLPTELLPKNNDKFSLQLFSSPPLAVASGSTREQDLSNSWPPVGNHGQSQAGGSIQQSNSLLRPQSTSDVGIQAGKGYITAQVSRPSNLSSLKRAASQPLSSTIQNQQRKTLPTQFIHPSIPTPWTRLAPSVPNTSRAMSPLVRPALSLTPQAPHSVVPPSFPMTWTKSVLQAPNTTWAIPPRMYTAPFLAPNDKRISSSHHPSSHTSPCTNQSNHQALARALTRQRLKAPIIPSAPSIASNYIKFKDQTAEPIGYKCLLCKRDLSYAPEGPISQPPVPPATAVLPCGHTFHEYCLERITPDDQSKYPPCIPCALLE

SEQ ID NO: 92009 - protein, 270 aa, Glycine max
  Coding DNA Sequence Number=SeqID_324
  Gene Ontology: Mol. function=damaged DNA binding; Cellular component =nucleus; Biological process=proteasomal ubiquitin-dependent protein catabolic process
  Homolog annotation: Hit_ID=A7PVH4; Match level="QueryCoverage=67%, HitCoverage=62%, E-value=6e-40, Identity=80%"; Hit description =Chromosome chr9 scaffold_33, whole genome shotgun sequence
  Pfam annotation: Domain name=UBA; Domain location=104-141; Score =14.2; E_value=0.25; Accession=PF00627.22; Description=UBATS-N domain
  Pfam annotation: Domain name=UBA; Domain location=228-261; Score =24.8; E_value=0.00032; Accession=PF00627.22; Description=UBATS-N domain
  Pfam annotation: Domain name=XPC-binding; Domain location=173-206; Score=8.7; E_value=0.012; Accession=PF09280.2; Description=XPC -binding domain
  Pfam module annotation: Pfam domain module=UBA::UBA::XPC-binding; Domain location=104-141::228-261::173-206
MEICRNIIFPLRRLCLALSARLKPRKNGAGLLKLQDDVQTCGYQDVQVMWEMLQRTEAFWNKCYEIENFAGFAGAEPASLAGTGDISGTDTYGQAASNLVAGSSLEQTIQQIMDLGGGSWDRDTVSRALRAAYNNPKRARIPEAAEIAVPAAPYPISQTTETGGVTAGAVSGPVLQELGKQNLSLSRLIQEHHGEFLQLINDPVEGSEGDIFDQPEQDMPHAINVTPAEQEAIGRLEAMGFDRASVIEACDRDEQLAANYLLENAGDFED

SEQ ID NO: 92010 - protein, 900 aa, Glycine max
  Coding DNA Sequence Number=SeqID_325
  Gene Ontology: Mol. function=binding
  Homolog annotation: Hit_ID=A2YIP7; Match level="QueryCoverage=99%, HitCoverage=93%, E-value=1e-148, Identity=34%"; Hit description =Putative uncharacterized protein
MAETTQLTRHIESYVDSSSTPAQQASSLNAVASLVNTDALPLEALVRELEMYLTTTDNVVRARGILLLAEVMTRIESKPLNSATIHSLVGFFKDRLADWRAVQGALVGCLALIRRKSVVGMVTDSDATTIAQSFLQYMQVQSLGQYDRKGEDLIYGICEAIDAEKDPDCLKLAFHIVASLAQLNPDSSSLLASYAKDSAFSSTPLFEPFVIPLLLEKLSSSLHSAKIDSLKYLRVCSSKYGAERIAKYAGAIWSSLKDTLSTYLGEPDFSFTIAPVDGIGFPENEFVIEALSLLQQLIAQNSSLLVSLIIDDEDVNTIFSTITSYETYDAIPVQEKKKLHAIGRILYITSKTTISSCNAMFESLFTRMMDNLGFSVRFPNGDISPSQRLKFGFLYLCIELLAGCRELIVGSEEPALQYVFEHETCCTMLHSFSTPLFNAFGSVLAVSADRGPLDPDTYVGAFGMLFLPVAPMVFSSSGLIFTLLMLIHENGGSEDFVMQFAVDIWSQAGNCMDLSTPFEGKGLLDAMMKAMRLSVGSCSVESQNLIIRKAYSVLSSHTNFQLKEVERLPLTPGKYDISLRDEGIISLFASVVIAVCPKTYIPNIRVLVHLFIITLLRGVVPVAQALGSILNKLVSTSSTAENSSDLTLEEALDAIFNTKISFSSTDMLQRCNGTSNGNEMVFTDICLGIANDRMLQINAICGLSWMGKGLLLRGHEKIKDITMIFMECLISGTKSASPLIKDSLENTEEQIQDLLVIKCATDAFHVLMSDSEVCLNRKFHATIRPLYKQRFFSSVMPILQQIITKSHSSLSRSFLYRAFAHIMSDTPMVAIVSEAKKLIPVLLDCLSMLTEIQDKDMLYGLLLVLSGILMEKNGQEAVVENAHIIINCLIKLVGYPHKMV

SEQ ID NO: 92011 - protein, 169 aa, Glycine max
  Coding DNA Sequence Number=SeqID_326
  Gene Ontology: Mol. function=binding; Cellular component=cytoplasm; Biological process=single fertilization
  Homolog annotation: Hit_ID=A7PFI8; Match level="QueryCoverage=80%, HitCoverage=53%, E-value=8e-37, Identity=56%"; Hit description =Chromosome chr11 scaffold_14, whole genome shotgun sequence
  Pfam annotation: Domain name=TPR_1; Domain location=54-87; Score =10.6; E_value=0.29; Accession=PF00515.19; Description=Tetratricopepti de repeat
  Pfam annotation: Domain name=TPR_1; Domain location=95-128; Score =21.1; E_value=0.0041; Accession=PF00515.19; Description =Tetratricopeptide repeat
  Pfam annotation: Domain name=TPR_2; Domain location=54-87; Score =10.7; E_value=1.4; Accession=PF07719.8; Description=Tetratricopeptide repeat
  Pfam annotation: Domain name=TPR_2; Domain location=95-128; Score =8.8; E_value=2.4; Accession=PF07719.8; Description=Tetratricopeptide repeat
  Pfam module annotation: Pfam domain module=TPR_1::TPR_1::TPR_2::TPR _2; Domain location=54-87::95-128::54-87::95-128
MDGGSGSREEQNHAEKQQQTEQEPEHDVPRSTESSENNATINEEESRQKALDQANDAKVKGNKLFGDGKYEEVLSQYELALQVAPDMPSSVEIRSICHSNSGGCFLKLGKYDNTIKECTEALELNPVCVKALVRRGEAHEKLEILKRPLLRLEPLAAEKREKMKEEMIG

SEQ ID NO: 92012 - protein, 407 aa, Glycine max
  Coding DNA Sequence Number=SeqID_327
  Gene Ontology: Mol. function=metalloendopeptidase activity; Cellular component=mitochondrial respiratory chain; Biological process =proteolysis
  Homolog annotation: Hit_ID=A7P710; Match level="QueryCoverage=97%, HitCoverage=81%, E-value=1e-171, Identity=74%"; Hit description =Chromosome chr9 scaffold_7, whole genome shotgun sequence
  Pfam annotation: Domain name=Peptidase_M16; Domain location=72-218; Score=177.7; E_value=3e-50; Accession=PF00675.11; Description =Insulinase (Peptidase family M16)
  Pfam annotation: Domain name=Peptidase_M16_C; Domain location=223 -398; Score=143.4; E_value=6.5e-40; Accession=PF05193.12; Description= Peptidase M16 inactive domain
  Pfam module annotation: Pfam domain module=Peptidase_M16::Peptidase _M16_C; Domain location=72-218::223-398
MYRAVASRLTLPKGNGRTLGASRGLFNWLTGESSNPLPPLDTPLRGVSLPPSLPDYVEPSKTKITTLPNGLKIASETSPNPAASIGLYVDCGSLYETPLSSGASHLLEKMSFKSTANRSHFRVVREVEAVGGNVGASASREQMGYTFDALKTYVPQMIELLVDCVRNPAFLDWEVNEELRKVKSELGELSNNPQGLLLEAVHSAGYSGALANPLLASESALNTLNSSLLEEFVAENYTASRMVLAASGVEHEELLSVAEPLLSDLPSVPCPEEPKSEYVGGDFRRQGEPGVAHVAIAFEVPGGWKKEKEAIVLTVLQMLMGGGGSFSAGGPGKGMHSRLFLRVLNEHQQIHSFSAFNSLFNNTGLFGIYASTGSDFVAKAVDLAARELIAIASPGQGLICIAFCLLL

SEQ ID NO: 92013 - protein, 68 aa, Glycine max
  Coding DNA Sequence Number=SeqID_328
MAMLMFSSTAEEVNPALKAVHVGAVRERKKARKLFSGSRKIQATGNLIGSVYCCRLIVTIIGVSDWKR

SEQ ID NO: 92014 - protein, 489 aa, Glycine max
  Coding DNA Sequence Number=SeqID_329
  Gene Ontology: Mol. function=protein serine/threonine kinase activity; Cellular component=integral to membrane; Biological process=protein amino acid phosphorylation
  Homolog annotation: Hit_ID=Q9FUU9; Match level="QueryCoverage=97%, HitCoverage=53%, E-value=1e-171, Identity=64%"; Hit description=Leaf senescence-associated receptor-like protein kinase
  Pfam annotation: Domain name=LRR_1; Domain location=406-428; Score =9.6; E_value=5; Accession=PF00560.24; Description=Leucine Rich Repeat
  Pfam annotation: Domain name=LRR_1; Domain location=430-452; Score =15.1; E_value=0.27; Accession=PF00560.24; Description=Leucine Rich Repeat
  Pfam annotation: Domain name=LRR_1; Domain location=454-473; Score =13.9; E_value=0.6; Accession=PF00560.24; Description=Leucine Rich Repeat
  Pfam module annotation: Pfam domain module=LRR_1::LRR_1::LRR_1; Domain location=406-428::430-452::454-473
MGMSRSFLVTFLGCLVLAVLIQAQDQSGFISIACGAPAGVNFTVPNTGLNYTSDANFINTGVSRTIVPELRDQFLQNVWNLRSFPEGQRNCYKINITRGSKYLIRASFLYGNYDGLNMLPKFDLLLGANRWLTVNINNASVSLDFEIIYVPSLDYVHICMVDTGLGTPFISAIELRTLRNDIYETEFGSLETYTRVDLGSNRGYRYNYDVYDRYWSGADLDTWRPLNFPIDADSLVQNDYKPPAVVMSTAITPANVSAPLVISWKPDDPKDSFYVYLHFTEIQVLAKNQTREFNITLNGNPWTENISPRYHSVNTIYSTSGISGEKINFSFVMTETSTLPPIINAIEIYTVKVFPQPDTYQRDVDAITTIKSVYGVTRDWQGDPCSPKDYLWEGLNCTYPVIDFPRIITLNLSSSGLSGKIDPSILNLTMLEKLDLSNNSLNGEVPDFLSQLQYLKILNLENNNLSGSIPSTLVEKSKEGSLSLRYGSY

SEQ ID NO: 92015 - protein, 537 aa, Glycine max
  Coding DNA Sequence Number=SeqID_330
  Gene Ontology: Mol. function=protein serine/threonine kinase activity; Cellular component=integral to membrane; Biological process=protein amino acid phosphorylation
  Homolog annotation: Hit_ID=Q9FUU9; Match level="QueryCoverage=90%, HitCoverage=52%, E-value=1e-162, Identity=63%"; Hit description=Leaf senescence-associated receptor-like protein kinase
  Pfam annotation: Domain name=LRR_1; Domain location=413-435; Score =9.6; E_value=5; Accession=PF00560.24; Description=Leucine Rich Repeat
  Pfam annotation: Domain name=LRR_1; Domain location=437-459; Score =17.5; E_value=0.05; Accession=PF00560.24; Description=Leucine Rich Repeat
  Pfam annotation: Domain name=LRR_1; Domain location=461-480; Score =13.9; E_value=0.6; Accession=PF00560.24; Description=Leucine Rich Repeat
  Pfam module annotation: Pfam domain module=LRR_1::LRR_1::LRR_1; Domain location=413-435::437-459::461-480
MRMSRSFLVAFLGCLLLAVPIQAQDQSGFLSIACGAPAGVNFTVPITGLNYTSDANFINTGVKSTIVSELRDQFQRHVWNLRSFPEGKRNCYKINITRGSKYLIRASFLYGNYDGLNMLPQFDLLLGANRWRTVNIKNASVSRHFEIIYVPSLDYVHICMVDTGLGTPFISAIELRSLRNDIYETEFGSLEKYIRRDLGSNKGYRYDDDVYDRYWNYDDADTWYDNVDKWKQLNFPIDADSLVQKQYQPPAVVMSTAVTPANVSAPLVISWEPYDPKDSFYVYMHFTEIQVLAKNQTREFNITLNGKLWYENESPRYHSVDTIYTPSGISGKLINFSFVMTETSTLPPIINAIEIYRVKEFPQQDTYQGDVDAITTIKSVYGVTRDWQGDPCSPKDYLWEGLNCTYPVIDSPRIITLNLSSSGLSGKIDPSILNLTKLEKLDLSNNSLNGEVPDFLSQLQYLKILNLENNNLSGSIPSTLVEKSKEGSLSLRKKKRERGRGQKEHVTPIVASVRGVESYPSRSQKLSCCHLTEKFKD

SEQ ID NO: 92016 - protein, 108 aa, Glycine max
  Coding DNA Sequence Number=SeqID_331
MLRFHCYANSDAHYKLRVRERGTNLFAEKKKKALARLAEKKLHGEEKKQVPGEEEAVPGEKKLCSGTGEKKNLFEKKWQNGTFNQLLGAPAILLGAPSNSPLGVVLHT

SEQ ID NO: 92017 - protein, 215 aa, Glycine max
  Coding DNA Sequence Number=SeqID_332
  Gene Ontology: Mol. function=RNA methyltransferase activity; Cellular component=endoplasmic reticulum; Biological process=RNA processing
  Homolog annotation: Hit_ID=A7P6V9; Match level="QueryCoverage=88%, HitCoverage=34%, E-value=2e-67, Identity=68%"; Hit description =Chromosome chr9 scaffold_7, whole genome shotgun sequence
MACVVFFFFFFFFFFFLCSVLAAVQECWRDPQLGFSPYSVHSHKGFLKHLMLRTGRDVTTYQPEVMVNFVTSSYKPELLKFLVDKVSVFPEVVSVVNNVNTSVGEEEYTLYGKSSITETLRGCTFQISANSFFQTNTYQAEVLYKLIEDCAGVRGDGSEIVLDLFCGTGTIGLTLARSDRHVYGYEVVPQAITDAHLNAKINGIKKCNICPGRSQ

SEQ ID NO: 92018 - protein, 259 aa, Glycine max
  Coding DNA Sequence Number=SeqID_333
  Gene Ontology: Mol. function=zinc ion binding; Cellular component =nucleus; Biological process=regulation of transcription
  Homolog annotation: Hit_ID=Q0GLF0; Match level="QueryCoverage=24%, HitCoverage=45%, E-value=5e-35, Identity=100%"; Hit description=Dof1
  Pfam annotation: Domain name=zf-Dof; Domain location=15-77; Score =142.6; E_value=1.1e-39; Accession=PF02701.6; Description=Dof domain, zinc finger
MQDPTLFQPMKPHFPEQEQLKCPRCDSTNTKFCYYNNYNLSQPRHFCKNCRRYWTKGGALRNIPVGGGSRKNTKRSSSSNNNTKRASPSPPVSSAPAPEPDPTRIGPTPVVGGGSFSSLLASSGHLGLGNLLEGLNSSGSNLKTVQMEEFGENVSSGPVADPDSGRNPGLEMQSNGNAENFLSLQNGDSSCWNDICRTIMEDHKPEGHCYRIISYINDGREMESKSYFRAGYGGYMNVVVVRLFSVSSRRGSVAMAWRF

SEQ ID NO: 92019 - protein, 220 aa, Glycine max
  Coding DNA Sequence Number=SeqID_334
  Gene Ontology: Mol. function=phosphoric monoester hydrolase activity; Biological process=metabolic process
  Homolog annotation: Hit_ID=A7P6T8; Match level="QueryCoverage=99%, HitCoverage=94%, E-value=1e-58, Identity=50%"; Hit description =Chromosome chr9 scaffold_7, whole genome shotgun sequence
  Pfam annotation: Domain name=Put_Phosphatase; Domain location=4-193; Score=171.4; E_value=2.3e-48; Accession=PF06888.3; Description =Putative Phosphatase
MAGNVVVFDFDSTIIECDSDNWVLDEFGLTEKFYQLLPNMPWNPLMDKMMNELHSQGKTIEDIVQVLNRTPMHPSIVPAIKASYSLGYIPFSFLFSLTLYYKYDMPNSIVGTKGMIIERIQNSVDAAGKKFIYLGDGSVDFCPSLKLKDRDYLMPRKNFPLCDLVSENSNLIKAEVHAWRDGEELYDVLLHFINKAIGEGNGSISSSTPIISVDCKLEFN

SEQ ID NO: 92020 - protein, 759 aa, Glycine max
  Coding DNA Sequence Number=SeqID_335
  Gene Ontology: Mol. function=phospholipase D activity; Cellular component=cytoplasm; Biological process=phosphatidylcholine metabolic process
  Homolog annotation: Hit_ID=A2Q468; Match level="QueryCoverage=99%, HitCoverage=99%, E-value=0.0, Identity=84%"; Hit description =Phospholipase D/Transphosphatidylase; C2 calcium/lipid-binding region, CaLB
  Pfam annotation: Domain name=PLDc; Domain location=296-333; Score =26.0; E_value=0.00014; Accession=PF00614.13; Description =Phospholipase D. Active site motif
  Pfam annotation: Domain name=PLDc; Domain location=603-630; Score =34.1; E_value=5.1e-07; Accession=PF00614.13; Description =Phospholipase D. Active site motif
  Pfam module annotation: Pfam domain module=PLDc::PLDc; Domain location=296-333::603-630
MEEKPKLLIHGTIEATIFNATPYSPSFPFNCVCTNGKPAYVTINIDNNRVAKTTQEHERVWNQTFQIQCAHPEDSTTTITLKTSCSVLGKFHVQAKRLKEESLINGFFPLLMENGKPNPQLKLRFMLWFKPADMEPSWTKILSNGEFQGLRDATFPQRSNCQVKLYHDAHHSSTFQPPFDLCGAPRKLWEDVYKAIEGANYLIYIAGWSFNPKMVLVRDPQTEIPHAREIKLGELLKKKAEEGVAVRVMIWDDETSLPFIKNKGVMKTHDEDAFAYFKHTKVICRKCPRLHHEFPTLFAHHQKTITVDTRAPNSVRAREIMSFLGGVDLCDGRYDTEKHSLFQTLTEESHYHDFYQTNIAGASLNKGGPREPWHDAHASVTGDAAWDVLTNFEQRWTKQCDASLLVPANTLENLIPTCSSPPKERNWKVQVYRSIDHVSASQLFRKLTVERSIHEAYVEAIRRADRFVYIENQYFIGGCHLWQKDRHSGCRNLIPVEIALKVVSKIKARERFAVYIVIPMWPEGVPESEPVQDILHWTRETMIMMYKLIGEAIIESGEPGHPRDYLNFFCLANREKKGKEEYLSPHSPHPETQYWNAQKNRRFPVYVHSKIMIVDDIYILIGSANVNQRSMDGQRDTEIAIGAYQSQDGADHHIISRGDIHAYRMSLWYEHTGITEELFLEPESLSCVKRMLSIGDHMWGVYSSEETVDMEGVHLVSYPVKVTQEGSVKDTVDGGDHFPDTKSPVKGKRSKFLAPIFTT

SEQ ID NO: 92021 - protein, 860 aa, Glycine max
  Coding DNA Sequence Number=SeqID_336
  Gene Ontology: Mol. function=hydrolase activity, acting on glycosyl bonds; Cellular component=beta-galactosidase complex; Biological process=carbohydrate metabolic process
  Homolog annotation: Hit_ID=A2Q448; Match level="QueryCoverage=98%, HitCoverage=98%, E-value=0.0, Identity=86%"; Hit description=Beta -galactosidase
  Pfam annotation: Domain name=Gal_Lectin; Domain location=782-859; Score=177.4; E_value=3.7e-50; Accession=PF02140.9; Description =Galactose binding lectin domain
  Pfam annotation: Domain name=Glyco_hydro_2_N; Domain location=456 -594; Score=-57.0; E_value=0.06; Accession=PF02837.9; Description =Glycosyl hydrolases family 2, sugar binding domain
  Pfam annotation: Domain name=Glyco_hydro_35; Domain location=35-361; Score=642.6; E_value=3.5e-190; Accession=PF01301.10; Description =Glycosyl hydrolases family 35
  Pfam annotation: Domain name=Glyco_hydro_42; Domain location=57-418; Score=-259.5; E_value=0.091; Accession=PF02449.6; Description=Beta -galactosidase
  Pfam module annotation: Pfam domain module=Gal_Lectin::Glyco_hydro_2 _N::Glyco_hydro_35::Glyco_hydro_42; Domain location=782-859::456 -594::35-361::57-418
MVICLKLIIMWNVALLLVFSLIGSAKASVSYDSKAITINGQRRILISGSIHYPRSTPEMWPDLIQKAKDGGLDVIQTYVFWNGHEPSPGKYYFEGNYDLVKFIKLVQQAGLYVHLRIGPYVCAEWNFGGFPVWLKYIPGISFRTDNEPFKHQMQKFTTKIVDLMKAERLYESQGGPIIMSQLTRVGMSTKTVIFTTGVFVQIENEYGPMEYEIGAAGKAYTKWAAEMAMGLGTGVPWVMCKQDDTPDPLINTCNGFYCDYFSPNKAYKPKMWTEAWTGWFTEFGGPVPHRPAEDLAFSVARFIQKGGSFINYYMYHGGTNFGRTAGGPFIATSYDYDAPLDEYGLLRQPKWGHLKDLHRAIKLCEPALVSGDPTVTKIGNYQEAHVFKSKSGACAAFLANYNPKSYATVAFGNMHYNLPPWSISILPDCKNTVYNTARVGSQSAQMKMTRVPIHGGFSWLSFNEETTTTDDSSFTMTGLLEQLNTTRDLSDYLWYSTDVVLDPNEGFLRNGKDPVLTVFSAGHALHVFINGQLSGTAYGSLEFPKLTFNEGVKLRAGVNKISLLSVAVGLPNVGPHFETWNAGVLGPISLSGLNEGRRDLSWQKWSYKVGLKGEILSLHSLSGSSSVEWIQGSLVSQRQPLTWYKTTFDAPAGTAPLALDMDSMGKGQVWLNGQNLGRYWPAYKASGTCDYCDYAGTYNENKCRSNCGEASQRWYHVPQSWLKPTGNLLVVFEELGGDPNGIFLVRRDIDSVCADIYEWQPNLISYQMQTSGKAPVRPKVHLSCSPGQKISSIKFASFGTPAGSCGNFHEGSCHAHKSYDAFERNCVGQNWCTVTVSPENFGGDPCPNVLKKLSVEAICS

SEQ ID NO: 92022 - protein, 46 aa, Glycine max
  Coding DNA Sequence Number=SeqID_337
MERRKKVSQREKVTLFFAKGEKGMTSQLGLILPTLSAFRGMGIHIQ

SEQ ID NO: 92023 - protein, 370 aa, Glycine max
  Coding DNA Sequence Number=SeqID_338
  Gene Ontology: Mol. function=phosphoprotein phosphatase activity; Cellular component=nucleus; Biological process=protein amino acid dephosphorylation
  Homolog annotation: Hit_ID=Q9FN02; Match level="QueryCoverage=62%, HitCoverage=68%, E-value=2e-67, Identity=48%"; Hit description =Serine/threonine protein phosphatase 7
MVVEAGNRGILFPEGCIEPVGSQQCKTGEGVPSENQIYVFNGNCVHKGAWGIEVFLVLLAWKVLMAHRVYLLRGNHESRYCTARYGFKKEVWAKYGDQGEDVYNEFLVCFKELPLASVIVDSELSEVKRSFVDFPYEGPNILLSDILWSRPSNRDGLRDNTGEELGLRWGLDCTEAFLKQHNLKEGPDARAGRDEFGDMLSGYSIDHDGESGKLYTLFSAPDYPQFGKRRYNNKGAYAVLKSPDFASLSFHSFKAAERPMASISTLSAPQRFYPDGMRPEFDFGALGIYNAPCWNVELRDGSGGTQVVEVPRAPLAEGLPLPPNIQTAYEYLFELVNGLKHMIVTRETENRARVSALRSRARKRKGKGNS

SEQ ID NO: 92024 - protein, 1270 aa, Glycine max
  Coding DNA Sequence Number=SeqID_339
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9LNQ4; Match level="QueryCoverage=97%, HitCoverage=96%, E-value=0.0, Identity=68%"; Hit description =Putative phospholipid-transporting ATPase 4
  Pfam annotation: Domain name=Hydrolase; Domain location=419-951; Score=4.3; E_value=0.023; Accession=PF00702.17; Description=haloacid dehalogenase-like hydrolase
  Pfam annotation: Domain name=Hydrolase_3; Domain location=713-974; Score=-83.5; E_value=0.095; Accession=PF08282.3; Description =haloacid dehalogenase-like hydrolase
  Pfam module annotation: Pfam domain module=Hydrolase::Hydrolase_3; Domain location=419-951::713-974
MARGRIRARIRRSHLYTFGGCLRPTTTEEVPHPLQGPGYSRTVYCNQPQLLEKNSLFYCKNDVSTTKYNVITFFPKALFEQFRRVANIYFLLAACLSASPISPFSPLSMIAPLAFVVGLSMAKEALEDSRRFFQDVKVNRRKASLHKGNGIFGLRSWQKIMVGDVVKVEKDQFFPADLLLLASSYEDGICYVETMNLDGETNLKVKRSLEATLSLDNDGAFKDFSGTIRCEDPNPDLYTFVGNFEYEHQVYPLDPGQILLRDSKLRNTDHVYGVVIFTGHDSKVMQNSTKSPSKRSTIEKKMDYIIYTLFTVLISISFISSIGFVAKTKYQTPKWWYLRPDNIEYQFDPGKLGLAGMSHLITALILYGYLIPISLYVSIEFVKVLQATFINQDIQMYDDESGTPAEARTSNLNEELGQVDTILSDKTGTLTCNQMDFLKCSIAGTAYGVCSSEVELAAAKQMASDLEEQELDLSNFPMRKESNVQWENITEDEETELGTVVTSRDDGARRPAIKGFGFEDDRLMNGNWLKEPNADVLLLFFRILAVCHTAIPELNEETDSCTYEAESPDEGAFLVAAREFGFEFYRRTQSSVVLRERFFALGQVVQREYKILNLLDFTSKRKRMSVIVRDEEGNIILFCKGADRTLGPSIGFYNGIIKILFMLVEFIFYLLLPYYTITATPCFQRMPVKIHIIIFDRLSKNGKMCLEATTRHLNEYGEAGLRTLALAYRKLDDQEYSDWNNEFQKAKTAVGSEREAMLEQVSDIMERELILVGATAVEDKLQKGVPQCIDKLAQAGLKIWVLTGDKMETAINIGFACSLLRQGMKQICITMNSDSVTNDGKEVIKGNILSQITNASQMIKLEKDPHAAFALIIDGKTLTYALEDDVKHQFLGLAVGCASVICCRVSPKQKALVTRLVKEGTGKTTLAIGDGANDVGMIQEADIGVGISGVEGMQHVTFVEVVELKLANSFQAVMASDFAIAQFRFLERLLVVHGHWCYKRIAQMAFAGFSGQSVYDDWYMILFNVFLTSLPVISLGVFEQDVPSEVCLQFPALYQQGPKNLFFDWYRILGWMGNGLYSSLVIFFLVIIIFYDQAFCVNGQIADMAAVGTMMFTCIIWAVNCQIALTMSHFTWIQHLVVWGSITTWYIFLLLYGMLPPQYSKSAYQLLIEVLAPAPIYWTATLLVTIACVLPYLAHISFQRCFNPMDHHIIQEIKYYKKDIEDQHMWTRERSKARQVTKIGFTARVEAKIRHFKGKLQKKQQSSLGALSPS

SEQ ID NO: 92025 - protein, 355 aa, Glycine max
  Coding DNA Sequence Number=SeqID_340
  Homolog annotation: Hit_ID=Q0WMU2; Match level="QueryCoverage=45%, HitCoverage=85%, E-value=6e-33, Identity=44%"; Hit description =Putative uncharacterized protein At3g13780
  Pfam annotation: Domain name=FHA; Domain location=86-143; Score=13.6; E_value=0.088; Accession=PF00498.17; Description=FHA domain
MLENVKDNVPDFCTGMGMLAISKEEFPFLNDFYKNNINLNDFYKPEQSTSLKRRKKLFWVAENQSMEVEVHGEDGSKFALGRDQKTVFGRGCGFSTHDRTVSRRHVSFELDHSHSEDANARVSFQVMGKNPFWVYDGEALRLFRKFDKGHLQLGHRFCFSPNTPLWFTLTNIQPLPQLNLDEIHVSEIDPVKEFGFLVMGHEFDHYPKGMIRNAKNWDWFLEERRKDSEDEEDVEKQRRKMRGKRKMGKVNEDDEWTGESEDDKGLVANMRKGKLPRYSTRSKDSKGGIKDTKASKNSKQKKATSGDDTGEEEDDDDDDETLGGFIVADEGDDKEEENDDEEEEEFEDDDDELDD

SEQ ID NO: 92026 - protein, 325 aa, Glycine max
  Coding DNA Sequence Number=SeqID_341
  Gene Ontology: Mol. function=glucuronosyl-N-acetylglucosaminyl -proteoglycan 4-alpha-N-acetylglucosaminyltransferase activity; Cellular component=membrane; Biological process=heparan sulfate proteoglycan biosynthetic process
  Homolog annotation: Hit_ID=A5C241; Match level="QueryCoverage=87%, HitCoverage=87%, E-value=1e-96, Identity=60%"; Hit description =Putative uncharacterized protein
  Pfam annotation: Domain name=EXTL2; Domain location=46-310; Score =297.7; E_value=2.3e-86; Accession=PF09258.1; Description=EXTL2, alpha-1,4-N-acetylhexosaminylt
MTSPATAILLAATLIGVVSAATRPPDPPECVPEPNQNLQILRRDKLTVLMNGFSESRIPLLQSLAATYSLSPIVSSVLVLWGDPATSPRVLHRLAHNLTLSSSSSAPISLLLQPSTSLNNRFLPRPNDISTDAVLVCDDDVEVDPTTLEFAFRVWTQNPHRLVGLFARSHDFDLDRREWAYTVHPDRFSIVLTKFMLLKTRYLFLYTCPGGPRMARVRGVVDEVRNCEDILMNFVVAEEAEVGPVLVGAKRVRDYGDARNEEKGVSVVGLSSRKGEHRKRRGWCIREFHRLLGTMPLRYSYGKVVDSVGEQALCFKGRKLVYCDQ

SEQ ID NO: 92027 - protein, 128 aa, Glycine max
  Coding DNA Sequence Number=SeqID_342
MAVLWRLTKESNSYCVPNSRLTGHFHLFHDVVLSTRQVTVWGLRSSYKDIVQREHRSDSLCSEMIGMADKAMQIYASMIGLLLLLPPISSLSPYRSDIYKHDLVETLKQDCLHYVDSPHARTRHVDFV

SEQ ID NO: 92028 - protein, 390 aa, Glycine max
  Coding DNA Sequence Number=SeqID_343
  Gene Ontology: Mol. function=protein binding; Cellular component =peroxisomal membrane; Biological process=protein import into peroxisome matrix
  Homolog annotation: Hit_ID=A9PBL7; Match level="QueryCoverage=78%, HitCoverage=97%, E-value=4e-43, Identity=66%"; Hit description =Putative uncharacterized protein
MFDWNLEEIERQFALYTPQGIGPTLEYRKLEDEDAAKTRPRLVIVKPPQSLPLAASLSLSLRHTIEKPNCTCAHTFNEVLLFSNSPPPKPWEQAGSSSGPAPFKPPSAGNTSDVVEASGTAKPGEIVSSSDRSAAVNRNTLGRPVPSRPWEQNYGNSTYGGYGSTMNYNSGYGSGMYGSSYGGLGGGMYGSSYGGGMYGNSMYRGGYGGLHGSSGMYGGGMYNSALGGPIGGYGMGGGPYGDQDPNDPFGAPPSPPGFWISVLRVLGVLMSHVRQYTMISGVMLMQGVVNFFGRISILIDQNTQAFHLFMTALLQLFDRSGMLYGELARFVLRLLGIRTKSKKVYPPGPNGQPLLGPGPHNPSGNVNYIEAPKAAPSGSWDNVWGNDANQ

SEQ ID NO: 92029 - protein, 673 aa, Glycine max
  Coding DNA Sequence Number=SeqID_344
  Gene Ontology: Mol. function=Rab GTPase activator activity; Cellular component=intracellular; Biological process=regulation of Rab GTPase activity
  Homolog annotation: Hit_ID=A7QAM3; Match level="QueryCoverage=85%, HitCoverage=82%, E-value=1e-149, Identity=50%"; Hit description =Chromosome chr5 scaffold_72, whole genome shotgun sequence
  Pfam annotation: Domain name=TBC; Domain location=216-409; Score= -25.8; E_value=9.5e-06; Accession=PF00566.9; Description=TBC domain
MHSSVGTGSLAYVVGSKVMDMRTSSKDGRKSQAKIEGSTYDNNVEVGKCYDRSIICTEVENSSHWESSNNGVDLVSLRVSADNAACDSSGKKNSSSPKSGGEEEESDRVTECSFDFPPLSVTNLFEKSGKDKNSGTEHGDKLPAPEQSRFEVDSMHSFQINNNVELVIESNCQQPLATLNPMDSEIGIASPDEEEPELLSENQVYEAQMVNQLKISDVPQPAMIRSPISQGWPVNEERVSEWLWTLHRIVVDVVRTDSHLEFYEDKRNLARMSDILAVYAWVDPSTGYCQGMSDLLSPFVVIFEDNADAFWCFEMLLRRMRENFQMEGPTRVMNQLRALWHILELLDKEMFAHLSKIGAESLHFAFRMLLVLFRRELSFNEALSMWEMMWAADFDESMAYDLEENCLEALELQLPRDSSNDMREEIADSDGGSVKSGSRSNHNENDNTKASPQSNHERADHSVYDSKLKSLSSHTFCGLARNIWPRNHQVQMSSISLTRKGNNELAIFCVAAILVLNRQKIIRETHSFDDMIKAGALIFCFTQHLITAMKMFNDKVLKINVKSCITKAIKLRKKYFNKGYDQNSYLSKGQPSPHQRGVELDSSSNSKMVSESILTVIVGSITIQARPPIIGPHRKGTKLKVVLLSEVHPAAVCPLSSLLFFTRSLDGLYQAFL

SEQ ID NO: 92030 - protein, 304 aa, Glycine max
  Coding DNA Sequence Number=SeqID_345
  Gene Ontology: Mol. function=DNA binding; Cellular component=nucleus
  Homolog annotation: Hit_ID=A7QAL5; Match level="QueryCoverage=99%, HitCoverage=97%, E-value=1e-76, Identity=50%"; Hit description =Chromosome chr5 scaffold_72, whole genome shotgun sequence
MANPSGNHQEHTHVVSSSAPETSGAALAMKHNPGISLDWTAEEQAILEDGLSKYASESNIVRYAKIALQLQQKTVRDVALRVRWMNKKENSKRRKDDHNLTRKSKDKKFWNRQNIVSVKFSNQEEASMACCFLIFGLLNRGWFSILAERVSDPAVKSSNFTARSNVSPYAPPMITMDNDDGISYTAIGGPTGDLLEQNAQALNQISTNLSAFQCMMLLDALEAIFESGVSSITYLKATKQRESRCEQVQENINLFCQTRDNILKIMNELNDSPEVMKQMPPLPVKVNEELASSILPRTNLPPQS

SEQ ID NO: 92031 - protein, 945 aa, Glycine max
  Coding DNA Sequence Number=SeqID_346
  Gene Ontology: Mol. function=transcription factor activity; Cellular component=nucleus; Biological process=regulation of transcription, DNA-dependent
  Homolog annotation: Hit_ID=A7P6L1; Match level="QueryCoverage=67%, HitCoverage=98%, E-value=1e-149, Identity=47%"; Hit description =Chromosome chr9 scaffold_7, whole genome shotgun sequence
  Pfam annotation: Domain name=CBFB_NFYA; Domain location=825-881; Score=129.6; E_value=9e-36; Accession=PF02045.6; Description=CCAAT -binding transcription factor (CBF-BNF-YA) subunit B
  Pfam annotation: Domain name=LsmAD; Domain location=190-261; Score =138.3; E_value=2.2e-38; Accession=PF06741.4; Description=LsmAD domain
  Pfam annotation: Domain name=PAM2; Domain location=449-466; Score =2.2; E_value=4.4; Accession=PF07145.6; Description=Ataxin-2 C -terminal region
  Pfam annotation: Domain name=PAM2; Domain location=540-557; Score =26.9; E_value=7.4e-05; Accession=PF07145.6; Description=Ataxin-2 C -terminal region
  Pfam module annotation: Pfam domain module=CBFB_NFYA::LsmAD::PAM2::PAM 2; Domain location=825-881::190-261::449-466::540-557
MNLQQAGQSKSSNGYGRRKSEREGATKSENKILSGKLNANRLANAGAVTGSKGGSYESPSHDRLVYVTTCLIGHQVEVQDGSLRGQKSGTEFVSKPLSKILIIPAKDLVQVTAQDVAITRDGLANEYHHDMHQEIMVDSLISQSRHVDLGRELKPWVPDEDDPQCPELENIFDGHWNRGWDQFETNEALFGVKSTFNEDLYTTKLEKGPQTRELERQALRIAREIEGEETQDLHLAEERGLHLHEDFDIDEETRFSSVYRGKRVDDSGFDEGVLFDSHNSETFGGETFGGVFGSVVKRPGEISGGKGNDGAQTLANSSSVDISINDYFFDKLSESERENEKDKADIIAQKEKLNELDTTEDHTLSSQSNTGVDLSRSGSSDHAKQLASELPAKSYSTSDGESRIQENSNSNQHGDNGITKEENLIQAEDVQLSKSEDSQGPLYMNKDGSDKGVLSPNASSYAPSSHTSSKTHEKMGSHGDLVDGSASGKANGETKSVNSRGTQSGSDLVGSIPASSALGLSPSSSVGSLSSEKSTLNPNAKEFKLNPNAKSFIPSPARPPTPVSDGSFYFPTNVTTVPSMPGMPMGIGIGPTFASPQPVIYNPQVAQMPSQGYFHPNAPQYGQLLGHPRQALYMPSYMPVGLEPEWKTMNCLCEKDSGLFSSHSTAPYVLGCPSWATSEFEVQRSSMSRSLSSKVDVLPQQCHNSKTFNFQFQEQDASSTKSTDQSYPEVGTVQSGQISVQHSSTDSTLIRNEGKSMGCVIRSFMGSQDFPFPPPLLDHRPILAHIACHYADPCYSGLVAAAYSPQSKPVETAPVRIPLQLDFAEEPIYVNSKQYHAILRRRQYRAKLEALNKPIKDRKPYLHESRHQHALKRARGAGGRFLNTKKQLQSNHTPGNIAESKMHHIENYRDGADVSYAFNSDARNMQNDAADKGGGTTQQPLFVYM

SEQ ID NO: 92032 - protein, 302 aa, Glycine max
  Coding DNA Sequence Number=SeqID_347
  Gene Ontology: Mol. function=metal ion transmembrane transporter activity; Cellular component=membrane; Biological process=metal ion transport
  Homolog annotation: Hit_ID=A5AVP9; Match level="QueryCoverage=65%, HitCoverage=35%, E-value=1e-77, Identity=75%"; Hit description =Putative uncharacterized protein
  Pfam annotation: Domain name=CorA; Domain location=47-288; Score =53.6; E_value=7e-13; Accession=PF01544.9; Description=CorA-like Mg2+ transporter protein
MADLKERLLAPKPASALNVREVSNRPSASGRQAFQGVDVLGLKKRGQGLRSWIRVDTSGNSQAIEVDKFTMMRRCDLPARDLRLLDPLFVYPSTILGREKAIVVNLEQIRCIITADEVLLLNSLDSYVLHYVMELQRRLTTTGVGEVWQSDSSDMNRRRGSRNFENVFSNSSPDYLPFEFRALEVALEAACTFLDSQNAKSIESSVATFFRESQYVPLRPILDENHTYFLLAVALKDSVLLQSPPSTAVNPLCDYERKHFFLHPIVEKAMRGSLGCAVISTSSIVSLLSEDEFQFGKSFSLC

SEQ ID NO: 92033 - protein, 825 aa, Glycine max
  Coding DNA Sequence Number=SeqID_348
  Homolog annotation: Hit_ID=A5AIH8; Match level="QueryCoverage=91%, HitCoverage=100%, E-value=0.0, Identity=56%"; Hit description =Putative uncharacterized protein
  Pfam annotation: Domain name=DUF936; Domain location=1-735; Score =713.8; E_value=1.2e-211; Accession=PF06075.3; Description=Plant protein of unknown function (DUF936)
MANLVPGVLLKLLQHMNTDVKVGGEHRSSLLQVVSIVPALAAGGELFPNQGFYLKVSDSSHATYVSLPDEHDDLILSDKIQLGQFVFVDRLEGASPVPILRGVRPVPGRHPCVGTPEDIVATHSLAFLDHCSDKNGVSSGAGDTDRSKSPRKVFGGGVGEKEKKERVRSNVGGGSGKEDVQSSKASAVFGRSKSQPQQPQPIKPALKIQVKKESLTRLKSTNSRSIPSSPSSCYSLPSSFEKFANGVRQHQAKVGAKVGVAETEKSVRGASSSVGKKIVVGNPIRNLVQGIELGTKALRKSWEGSMEVKTKESSKTRVASKFDPKPEASIPRRRSISNEKLLSKEESRIQAPTKPSKEQHKIQTPTKKANANGTVEEPEKSSKQRTSIGKKSAEVSNSGLPGNLVKVAVSNRKVTDGSVQWASLPSSISKIGREVMKHRDAAQMAATEAMQEAAAAESLLQCLRTYSELTNSAKEHNLQPAVEQFLTLHASLNSTRTIAESLSKPIPDGSSPDYERSTVEEALKVKSDRQKQSASWVQAALATNLSSFAVFTRESQSSKPPTSSNSQNQKTVVGSQHMLVLHNSSEDASSKVHAKTRLTAYSKHASLGTLRKPGDALLNGQKQLVQPPPEWVRGNGLNEVVNLAEMLQLQSRDWFLGFVERFLDSDGDTTLSDNDQIAGMLTQLKSVNDWLDEIGSSKDEGESCEISAETIDRLRKKIYEYLLTHVESAAAALSGGSQSSPQVQTIQSKAKRNNSNVQHKVLSWKNEAQLCKINFGLKISRKSKSKDDKNVCNGIFLVPQAVIVSCNHLSQVTGNSEKEDGIKAG

SEQ ID NO: 92034 - protein, 942 aa, Glycine max
  Coding DNA Sequence Number=SeqID_349
  Gene Ontology: Mol. function=nucleic acid binding; Cellular component= lysosome; Biological process=regulation of transcription from RNA polymerase II promoter
  Homolog annotation: Hit_ID=A7QYR4; Match level="QueryCoverage=96%, HitCoverage=95%, E-value=0.0, Identity=49%"; Hit description =Chromosome chr5 scaffold_253, whole genome shotgun sequence
  Pfam annotation: Domain name=RRM_1; Domain location=20-85; Score =66.3; E_value=1e-16; Accession=PF00076.13; Description=RNA recognition motif. (a.k.a. RRM, RB
  Pfam annotation: Domain name=RRM_1; Domain location=202-268; Score =30.1; E_value=8.2e-06; Accession=PF00076.13; Description=RNA recognition motif. (a.k.a. RRM, RB
  Pfam annotation: Domain name=RRM_1; Domain location=97-162; Score =67.7; E_value=3.9e-17; Accession=PF00076.13; Description=RNA recognition motif. (a.k.a. RRM, RB
  Pfam annotation: Domain name=SPOC; Domain location=470-566; Score =83.5; E_value=6.6e-22; Accession=PF07744.4; Description=SPOC domain
  Pfam module annotation: Pfam domain module=RRM_1::RRM_1::RRM_1::SPOC; Domain location=20-85::202-268::97-162::470-566
MPPPSKSVEGEEWGTPTNNLWVGNLPTEVTDSDLMELFAPYGSLDSLISYSSRTFAFVLFRRIEDAKAAKSNLQGALLRGFQIRIEFARPAKPCKQLWVGGFSPTVAREDLEAEFRKFGKIEDFKFFIDRGTACVEFLNLDAAARAMKVMNGKRLGGRQICVDFLRSQSTRRDFLVDHGQFQARPQHLQPSIGRNNQPSKILWIGFPPSFQIDEQMLHNAMILFGEIEKIKSFPSRHYSFVEFRSIDEARRAKEGLQGRLFNDPQITIMYSSSELAPGKDYPGFYPGGKGPIPDGLGNEHPFRPLQTDVFGHNRPMVPNNFPGQLPPGHNVPMRPFGSQGLEPLISGPDFNEMGPSWKRPSPPAPGMLPSPVPGIRPPTRSTSGAWDLLDINQFQRDSKRLRIDDALFIGDAPFPLRNIDDRGLGVEQPFAIDSVIDGGGSGPKSHLGPVGTRITSGVPGSVQPDIDHIWRGIIAKGGTPVCRARCVPIGKGIVTEIPDIVDCAARTGLDMLTKHYADAIGFDIVFFLPDSEEDFASYTEFLCYLKAKNRAGVAKFVDNTTLFLVPPSDFLTKVLKVTGPERLYGVVLKFPLVPSSTSMQQPMHLPSPSTQYMQRIPPSQAEYGSILVKEEQVLPMDYNRLLHEDSKHLPKPLHPATNVPPSAHSVPSDYAPTYTASASQAVTWTPELIASLTSLLPATTQSSTTGGPMAVAGPSIVKPSFPSVAPNDGNQSHLWKQAQQIPDPSSHPPQQFGSIHNVQYQPYPPASSTDHPAQVVSGSSCFQDTNSSLQQPVAVSSTPMTNFILPPQNGQVAVSPQVSQQYQVEVPHGTEKDYGVVQGTDASVLYSSKAFQQPNNFISSSNQVANAASQQQSVMPFTVDKDNSVPTNQQPQPALFGVGQGVSELEADKNQRYQSTLQFAANLLQQIQQQQTQGGHGPGNQQ

SEQ ID NO: 92035 - protein, 175 aa, Glycine max
  Coding DNA Sequence Number=SeqID_350
  Gene Ontology: Mol. function=electron-transferring-flavoprotein dehydrogenase activity; Cellular component=mitochondrial inner membrane; Biological process=electron transport
  Homolog annotation: Hit_ID=A7QYQ5; Match level="QueryCoverage=81%, HitCoverage=26%, E-value=2e-66, Identity=80%"; Hit description =Chromosome chr5 scaffold_253, whole genome shotgun sequence
  Pfam annotation: Domain name=ETF_QO; Domain location=100-174; Score =31.9; E_value=1.1e-10; Accession=PF05187.4; Description=Electron transfer flavoprotein-ubiquinone ox
MIHVILSLLLIGKSYIHEESIPYPVFPGGAIIGCSAGFMNVPKIKGTHTAMKSGMLAAEVTFGALNEGLDMDMYWDALRNSWIWEELHKSRNYRPAFEYGLIPGLALSGLEHYIFKGRHPVTLKHGKPDHEAMNAAKSHSPIHYPKADGVLSFDVPTSLHRFWNTYSLLLLTVES

SEQ ID NO: 92036 - protein, 155 aa, Glycine max
  Coding DNA Sequence Number=SeqID_351
  Gene Ontology: Mol. function=fructokinase activity; Cellular component=cytoplasm; Biological process=carbohydrate metabolic process
  Homolog annotation: Hit_ID=A5B8T3; Match level="QueryCoverage=88%, HitCoverage=41%, E-value=3e-63, Identity=89%"; Hit description =Putative uncharacterized protein
MALNNGVPATGTGLIVSFGEMLIDFVPTVSGVSLAEAPGFLKAPGGAPANVAIAVSRLGGKAAFVGKLGDDEFGHMLAGILKENGVRADGITFDQGARTALAFVTLRADGEREFMFYRNPSADMLLKPEELNLELIRSVCIFSLSLALSTFSENI

SEQ ID NO: 92037 - protein, 157 aa, Glycine max
  Coding DNA Sequence Number=SeqID_352
MAWDELKAITDGMMAPWAMAGYFNFVLFNQSSTGSLYFNQNYTLKALGLMGVTLLRHPSYCPSWLKETSPGTYPCFEEWMEMEALNILLPPDICNMIAPKESSEDVPIWKGSKDDSFSLKEAYLYLAKKIDDNRNMNSDHFKLLRKWKGPQKVRVFL

SEQ ID NO: 92038 - protein, 836 aa, Glycine max
  Coding DNA Sequence Number=SeqID_353
  Gene Ontology: Mol. function=binding; Cellular component=nucleus
  Homolog annotation: Hit_ID=A7QM62; Match level="QueryCoverage=93%, HitCoverage=98%, E-value=0.0, Identity=58%"; Hit description =Chromosome chr5 scaffold_124, whole genome shotgun sequence
MGVMSRRVVPVCGNLCVFCPSLRARSRQPVKRYKKFIADIFPRNQAAEPNDRKIGKLCEYASKNPLRIPKITDNLEQRCYKDLRNENYGSVKVVLCIYRKLLSTCKEQMPLFANSLLGIIRTLLEQTRADEMQILGCNTLVEFIDSQTDGTYMFNLEGFIPKLCQLAQEVGDNEQALLLRSAGLQALSHMIISVILENFKDLQSKSNLAKVEKLNSQSQSQLVQGFPEKGAETEPKLDTKDPAYWSKVCLYNIAKLAKEATTVRRVLELLFHNFDSENHWSSEKGVASCVLMYLQSLLAESGDNSHLLLSSLVKHLDHKNVAKKPILQIDIINTTMQLAQNVKQQASVAIIGAISDLIKHLRKCLQNLSEASSNGNDAYRLNAELQSSLEMCILQLSKKVGDIGPILDLMAVALENIPITTIIARSTITAAFPDALFHQLLLAMAHPDCETQIGAHSVFSMVLMPSMFSPWLDHKTKIAQKAQNDSFSTQHETFSGAENLNGKLEEGKAIASVNGKKYVIHPYHRYSFSPKLTDGKDDRSSLRLSSHQVSLLLSSIWVQATSVENGPANYEAMAHTYSIALLFSRSKAVCIESEKIIYGSQEDEFTAVKSLSAVELDDKLLKETDELSSVKNQLLQGFSPDDAYPSGPPLFMETPRLCPPLAQIEFPYYDEIMVPDDLIEEETEPEHSGSQPDRKTSISANYPDVLNVNQLLDSVLETARQVASFSTSSTPLPYDQMKNQCEALVTGKQQKMSVIQSFKHQQESKAIILSSENEVNVSSLPAKALEYSNGDLKLVTQQQFQAQDQARHQSHESGQQHSLRLPPSSPYDKFLKAAGC

SEQ ID NO: 92039 - protein, 571 aa, Glycine max
  Coding DNA Sequence Number=SeqID_354
TRMSLTENATSCCMAPDEHIMTGHHSCKLRNQVDVICLRVSSDSNMKFWHSLSVEDKSYAVNSFHLFANVLVAFWLFLVASSYFLLSKNVNLSGGCRGKRAEKVSSSVRTISDATTENDATAANDTFSCSESFSSNNSWGELCTKCDAYYEISDFDKASYMHSLLSLEGEDSEWLADSMPCELSYENPSTPLSSYKCDAYHEISDFEQGSYMHSLLSLDDESEWLSDSKSFGVQSENPSTPISYNLEHEDSEWLSNSKPFGCSSESISTPLSYKCHASSVISDFSKASCMHSLLSLEDEDSAEWLSDSKSFGWSSENPSTPLSSKCDAFSDISDLDKSSYMHPSISIEDENSDWLSVSKSYGFSSENSTPLSYKFDAYNYEISDLDKASYLHSLLILEDEDSEWLSDSSSWSIVVPPSVSTSSSFTGVNCGNSEEEFSADEPLFWPFEGKLNWNSEEPWTSFCSSPRRRFDSRSTTSRIKGCNNKQKGNEALCIVNYETSRLSMWPKSSEKIVPLVCEDFYSNKDHLLGKEYSALCQELTIEALVGLKEFDGHEGLDSEFDQVFLMDQYLQ

SEQ ID NO: 92040 - protein, 147 aa, Glycine max
  Coding DNA Sequence Number=SeqID_355
MKSSIVRIKVLSNGGHGGKAWRNFEKTPQIAVAWQVTSGGRHSHDGSWQNSGKGGIAALFVFFAVGVGLTRPNPIIYFEQRSSHEQKQNSSGPAPAPISHHYQQRRPAAARPREAATSTRTTPRSSDQHPHPAALQRPADQQHYERW

SEQ ID NO: 92041 - protein, 130 aa, Glycine max
  Coding DNA Sequence Number=SeqID_356
  Gene Ontology: Mol. function=ARF guanyl-nucleotide exchange factor activity; Cellular component=intracellular; Biological process =regulation of ARF protein signal transduction
  Homolog annotation: Hit_ID=Q9SZM0; Match level="QueryCoverage=36%, HitCoverage=2%, E-value=2e-12, Identity=74%"; Hit description =Guanine nucleotide-exchange protein-like"
MELDLFFVGKKVITKQIDVVHVPAAHQLADILTKALSPASFVSFRSKLRSFAYMVYLEHCLLPRVNAYSRIVNGLLKTALGPPTGSTTALSPAQDITFRHESVKCLAKQHRQEMGGIMDSTVIDYLESQK

SEQ ID NO: 92042 - protein, 263 aa, Glycine max
  Coding DNA Sequence Number=SeqID_357
  Gene Ontology: Mol. function=protein binding; Cellular component =cytoplasm; Biological process=apoptosis
  Homolog annotation: Hit_ID=A7PLS7; Match level="QueryCoverage=75%, HitCoverage=80%, E-value=1e-78, Identity=73%"; Hit description =Chromosome chr14 scaffold_21, whole genome shotgun sequence
  Pfam annotation: Domain name=Phosducin; Domain location=11-237; Score= -62.2; E_value=5.1e-06; Accession=PF02114.7; Description=Phosducin
MGDYHFVYKDLEGASTQWDDIQRKLGNLPPKAPAFKPPPFTPASDDQPKDKTWIDSKTSEELEDLEDNLDDDRFLQEYRKKRLAEMQEAAKVLRFGSVIPISGSDFVREVSQAPSDVWVVVILYKEGIPECGLLMQSIEELALRYPSTKFVKIISTDCIPNYPDRNLPTLLVYNNGAVKGNYVGLHSFGRRCTPEGHALCSALFLLFGEEIKNIIASKEVPAEGCEEYRMREENDLLAGLLLVFYNGLEIKEVRLIEHETDEK

SEQ ID NO: 92043 - protein, 108 aa, Glycine max
  Coding DNA Sequence Number=SeqID_358
MSLGSKANNSGDSEGSSLWLRRPEVFRYEDVSTLSEAQPIAEENLVDPVEAFALFLLLALFSAASAQELSPASSPAPSPEAGAADSVPCSAIMIGASLVLSLMAVFKF

SEQ ID NO: 92044 - protein, 294 aa, Glycine max
  Coding DNA Sequence Number=SeqID_359
  Gene Ontology: Mol. function=drug transporter activity; Cellular component=membrane; Biological process=multidrug transport
  Homolog annotation: Hit_ID=A5BC98; Match level="QueryCoverage=99%, HitCoverage=73%, E-value=4e-96, Identity=60%"; Hit description =Putative uncharacterized protein
  Pfam annotation: Domain name=MatE; Domain location=165-294; Score =11.3; E_value=0.00048; Accession=PF01554.9; Description=MatE
  Pfam annotation: Domain name=MatE; Domain location=7-164; Score=34.2; E_value=4.8e-07; Accession=PF01554.9; Description=MatE
  Pfam module annotation: Pfam domain module=MatE::MatE; Domain location=165-294::7-164
ILGIAFPAALAVVADPIASLIDTTFIGHLGPVELAAAGVSIALFNQASRITIFPLVSITTSFVAEEDTIQSKPKVGKKRIASASTALLFGTILGLLQTAILTFAAKPLLYAMGLKHDSPMLIPAEKYLRLRSIGSPAVLLSLAMQGIFRGFKDTTTPLYVIASLAARLGSIPMAAFQPGLQIWLASSLLADGLAVAVQTMLACSFAEKDYNKATAAATRTLQMSFVLGVGLSFAVALGLYFGPGIFSKNANVVHLIKISMPFVAATQPINSLAFVFDGVNYGASDFAYSAYSLA

SEQ ID NO: 92045 - protein, 109 aa, Glycine max
  Coding DNA Sequence Number=SeqID_360
  Gene Ontology: Mol. function=protein binding; Cellular component =nucleus
  Homolog annotation: Hit_ID=O81652; Match level="QueryCoverage=46%, HitCoverage=20%, E-value=2e-20, Identity=88%"; Hit description=Phyb1
MQGILDGNITQTGLDKGQLICGNKHCNEKDGLASYEVNFCYFEAGENKQALVKLVTCERCAFKLNYKRQKEKELLEKRQEEQDRRKRNRSKSDDDLDDFQESKERRRKE

SEQ ID NO: 92046 - protein, 997 aa, Glycine max
  Coding DNA Sequence Number=SeqID_361
  Gene Ontology: Mol. function=nucleotide binding; Cellular component =mitochondrion; Biological process=defense response
  Homolog annotation: Hit_ID=Q19PN1; Match level="QueryCoverage=74%, HitCoverage=56%, E-value=4e-77, Identity=30%"; Hit description=NBS -LRR type disease resistance protein
  Pfam annotation: Domain name=LRR_1; Domain location=590-612; Score =11.2; E_value=2.6; Accession=PF00560.24; Description=Leucine Rich Repeat
  Pfam annotation: Domain name=LRR_1; Domain location=614-636; Score =14.7; E_value=0.34; Accession=PF00560.24; Description=Leucine Rich Repeat
  Pfam annotation: Domain name=LRR_1; Domain location=638-660; Score =14.8; E_value=0.34; Accession=PF00560.24; Description=Leucine Rich Repeat
  Pfam annotation: Domain name=LRR_1; Domain location=662-683; Score =12.4; E_value=1.5; Accession=PF00560.24; Description=Leucine Rich Repeat
  Pfam annotation: Domain name=LRR_1; Domain location=685-706; Score =13.1; E_value=1.1; Accession=PF00560.24; Description=Leucine Rich Repeat
  Pfam annotation: Domain name=LRR_1; Domain location=708-734; Score =8.3; E_value=8.7; Accession=PF00560.24; Description=Leucine Rich Repeat
  Pfam annotation: Domain name=LRR_1; Domain location=892-916; Score =4.1; E_value=53; Accession=PF00560.24; Description=Leucine Rich Repeat
  Pfam annotation: Domain name=LRR_1; Domain location=918-939; Score =3.7; E_value=64; Accession=PF00560.24; Description=Leucine Rich Repeat
  Pfam annotation: Domain name=LRR_1; Domain location=951-973; Score =0.3; E_value=2.6e+02; Accession=PF00560.24; Description=Leucine Rich Repeat
  Pfam annotation: Domain name=LRR_1; Domain location=975-996; Score =3.1; E_value=83; Accession=PF00560.24; Description=Leucine Rich Repeat
  Pfam annotation: Domain name=NB-ARC; Domain location=216-521; Score =113.1; E_value=8.1e-31; Accession=PF00931.13; Description=NB-ARC domain
  Pfam annotation: Domain name=zf-C2HC_plant; Domain location=11-65; Score=8.0; E_value=0.0048; Accession=PF07567.3; Description=Protein of unknown function, DUF1544
  Pfam module annotation: Pfam domain module=LRR_1::LRR_1::LRR_1::LRR _1::LRR_1::LRR_1::LRR_1::LRR_1::LRR_1::LRR_1::NB-ARC::zf-C2HC_plant; Domain location=590-612::614-636::638-660::662-683::685-706::708 -734::892-916::...
  Pfam module annotation: Domain location=918-939::951-973::975 -996::216-521::11-65
MGRPRGDEKYWNEVTSFEENGKQKWKCKHCEKTYGGGYSRIKLHLDKEQKGQGITKCPVYCSNEEVLNIIASTSIHPQETVNTLNPLQVVEDVVAGEMIVPVGAPINHQTNNESTSLFEGWAPEHAIVGSNNSNGIFQSKISVINELVSDLSREEDDIKEQLEWLESRGKKRKGDVDDWMDELRDLKKHVADVDWLGFTNFYASDLVDKLRKHKIDKPLVLSNEFVGEQFELNVGKMWKLLVDDQVFVIGINGMGGVGKTFLATYMENEIKRKGSFRHVFWVTVSHDFTTFKLQHQIAKKIGVKLDGDDERCRATILSSELEKIENSVLILDDVWRYIDLQKVGIPLKVNGKVNGIKLIMTSRLKHVCRQMDCLPDNTIQIYPLKKEEDEEEDWELFLLKLGHHGTPATLPPQVVEIARSVVRKCDGLPLAINVMARTMKGCYDTIMWKHELNKLENLEMGEEVKEEVFTVLKRSYDNLIEKDLQKYLLYFAQIPNNSGFQSKSYLVKKLVESGLLKNVKRSLREVFDEACAMANKLVDHSLFVGYDYHTKMHGLVRNMACRILNESNNYMVKCEGNLSEIPDVKEWIVDLEVVSLGGNRIKEIPEGISPNCPRLSTLILSGNCIGHIPEGFFIHMNALTVLNISYNDFLTSLPHSLSNLRSLVSLVLQNCSNLEYIPPLGELQALSRLDISGCSIRQVPEGLKNLINLKWLDMSINEHLTLAPRCVLPGLTNLQYLDLRCDSAIIAEDVQGMSMLECFGGIFLGKDNYNSYVQEILDRGHGPKTYDIHVEDVRDLIFAFDIDDPVSLYEDHQNVRFWQCEGLLYLLPRDLKKLSMERNDQWVCLCGALSSSGPLSSLNQIDIIGGYSFTAICEEDAVDLTRSLSPRGVFSNLKKFQLSQCHEIETLLTPLLVPQLQNLEVLSVESCRSMREIFAVSNSGNDDNFNIILPKLIRLRLWNLPELTTVCREILVCGSADILFINHCPKLERLPRIVVYD

SEQ ID NO: 92047 - protein, 529 aa, Glycine max
  Coding DNA Sequence Number=SeqID_362
  Gene Ontology: Mol. function=nucleic acid binding; Cellular component= nucleus; Biological process=embryonic development ending in birth or egg hatching
  Homolog annotation: Hit_ID=A7P7U7; Match level="QueryCoverage=95%, HitCoverage=57%, E-value=1e-146, Identity=55%"; Hit description =Chromosome chr3 scaffold_8, whole genome shotgun sequence
  Pfam annotation: Domain name=RRM_1; Domain location=398-474; Score =64.0; E_value=5e-16; Accession=PF00076.13; Description=RNA recognition motif. (a.k.a. RRM, RB
MEAKSIAPRHFLSPTCPIPFPILSAVEEDANRAIELKNGTSVEGRKIVVKHAMPRPPCEERQSKPNKEGKTDDLTKPKDDDEDSTLSGAEKNVSVLKEEETKKSALCDDVPDEGSCSEKQRVARTVIFGGLINSDMAEEVHGKAREIGTVCSIKYPLSRKDLEQHGLLQDGCTLDASAVLYTSVKSARASVATLHRKEIGGGNIWVRQLGGEGSKTQKWKLIVRNLPFKAIQKLNGSKFAKRLIAVDWAVSKKIFSSDTNNALASEKGQQNMSDEDSTDEDFELVDKRSGQGDSDTDYSSAMEEEGTPPEDNFDKEADIAKKVLNNLLTSSSKGTSVNNDSMLIKENKGSRSDEIVKDADEKASNESEKVSGVSKPEISSRNNLLNPKGTEDDLQRTVFISNLPFECDNEEVKQRFSGFGEIEYFVPVLHQVTKRPRGTGFLKFKTVEAANTVISTARAASGMGILLKGRPLKVLKALDKKSAHDKELEKAKNEVHDHRNLYLAKEGLILEGTTAAEGVSASDMLKRLE

SEQ ID NO: 92048 - protein, 633 aa, Glycine max
  Coding DNA Sequence Number=SeqID_363
  Gene Ontology: Mol. function=small protein activating enzyme activity; Cellular component=nucleus; Biological process=protein modification process
  Homolog annotation: Hit_ID=A7P8V9; Match level="QueryCoverage=91%, HitCoverage=95%, E-value=0.0, Identity=63%"; Hit description =Chromosome chr3 scaffold_8, whole genome shotgun sequence
  Pfam annotation: Domain name=ThiF; Domain location=10-190; Score =47.5; E_value=4.8e-11; Accession=PF00899.12; Description=ThiF family
  Pfam annotation: Domain name=UBACT; Domain location=377-443; Score =122.9; E_value=9.5e-34; Accession=PF02134.12; Description=Repeat in ubiquitin-activating (UBA) protein
  Pfam module annotation: Pfam domain module=ThiF::UBACT; Domain location=10-190::377-443
MAYSSPSVIKDAKVLMVGAGGIGCELLKTLALSGFPDIHIVSSLLYSGLSNFELCVFGDIGGVCESEEGSHVGAYSLLASIAFVLIEVRDDGSRVFVSGVSVFHQSDEVFNQVARDAVLKFRPHINITPYHANVKDPEFNVDFFKQFNVVLNGLDNLDARRHVNRLCLAANVPLVESGTTGFLGQVTVHVKGRTECYECQPKPAPKTYPVCTITSTPSKFVHCIVWAKDLLFAKLFGDKNQDNDLNVRSSDAASSSKNVEDVFERRKDEDIDQYGRKIFDHVFGYNIELALSNEETWKNRNRPKPIYSKDILSDEPAQQNGNLEKKYESDELSVSAMASLGMKNPQDIWSLKENSRIFLEAFRLFFTKREKEIGNLSFDKDDQLAVEFVTAAANIRAASFGIPLQNLFEAKGIAGNIVHAVATTNAVIAGLIVIEAIKVLKNDIKNYRYDVISPPAKLGMNLPLIMCASNLLYEAGDVEDDMIAIYEANLEKALAELPSPVTGGTMLTVEDMQQEFVCNINIKHREEFDEEKEPDGMVLSGWTQPVSAAENKDKSVGNGASTSDALITAVESEKDDEITIVSALKKRKLPDESDISNSAAEAKNQKQLEVIDDEDDLVMLDGDLNSVKKRRLS

SEQ ID NO: 92049 - protein, 364 aa, Glycine max
  Coding DNA Sequence Number=SeqID_364
  Gene Ontology: Mol. function=heat shock protein binding; Cellular component=cytosol; Biological process=protein folding
  Homolog annotation: Hit_ID=A7P8W7; Match level="QueryCoverage=100%, HitCoverage=100%, E-value=1e-143, Identity=71%"; Hit description =Chromosome chr3 scaffold_8, whole genome shotgun sequence
  Pfam annotation: Domain name=DnaJ; Domain location=6-68; Score=112.8; E_value=1e-30; Accession=PF00226.22; Description=DnaJ domain
MVKDTAYYDILGVNYDASAAEIKKAYYVKARIVHPDKNPEDPKAAENFQKLGEAYQVLSDPGKRAAYDEHGKEGVPQDSMMDPTTVFGMIFGSEFFEEYIGQLALASLASIEIEEDSQDPEVLRQRIQEKMKAWQKEREQKLSTFLKDRLQPFVDGREDEFTAWAKSEARSLSKAVLAPMWFLNQEQGKDNEMNTPGLSGAFGEAMLHTIGYIYTRKAARELGKDIRYMNVPFLAEWVRGKGHCIKSQVTAASGAVSLIQIQEELKKLNQGENKEESIVKAIEDKKDAMINSLWQINVIDIESTLSHVCQTVLKDPSASKDVLKSRAKALKKLGTIFQGAKIAYNRENSLRRESGKTPDAASSS

SEQ ID NO: 92050 - protein, 472 aa, Glycine max
  Coding DNA Sequence Number=SeqID_365
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=A7P284; Match level="QueryCoverage=91%, HitCoverage=51%, E-value=1e-176, Identity=67%"; Hit description =Chromosome chr19 scaffold_4, whole genome shotgun sequence
  Pfam annotation: Domain name=Trehalose_PPase; Domain location=158 -406; Score=266.6; E_value=5.3e-77; Accession=PF02358.7; Description =Trehalose-phosphatase
MEAIFLTNSSPTYTTFTTKNMLQLFHWPLFSANDVYILPVSYPDVALVTSLRDGMNLFAGAAQSLGAGAILVNPWNITEVATAISKALNMPSAEREKRHKHNYEHVKTHTAQEWAETFVSELNDTVVEAQIRTNQVPPRLPTETAVECYLQSNNRLLILGFNGTLTEPIEREGDRFKERELTVHPELKQPLAELCSDPKTTVVVLSGSCRTVLDENFKEYDIWLAAENGMFLNPSKGEWMTTMPEQLNMEWVDSVKHVFDYFTDRTPRSYFEEREASLVWSYRHADVEFGRLQARDMLQHLWTGPISNASVEVVQGSRSVEVRAANVTKGAAIDRILGEIVHSKSMTTPIDYVLCIGHFLTKQDEDIYAFFEPELPRSKVTEGVKFPVERVSSSQNKGQRPVSNSEKKTNNHVCRLPRRPAPEKISWNVLDLKKENYFSCAVGRTQTNARYTLASPDEVVAFLKELHTLSQS

SEQ ID NO: 92051 - protein, 310 aa, Glycine max
  Coding DNA Sequence Number=SeqID_366
  Homolog annotation: Hit_ID=A2Q4S5; Match level="QueryCoverage=60%, HitCoverage=29%, E-value=2e-17, Identity=34%"; Hit description=IMP dehydrogenase/GMP reductase, putative
  Pfam annotation: Domain name=DUF1723; Domain location=123-172; Score =62.5; E_value=1.4e-15; Accession=PF08330.1; Description=Protein of unknown function (DUF1723)
MAEDVPQVTEDVPHMTDDVVQRSEDVPQMTADIDATVAKDLGADGAEGSHADEGFPGGSRDPSVLTSFAEHVAHAIWTGQERLELKLVSHVRKVELIGRSVPAIEGLVVATRLSPLIECLVVTDDPKLISTFVERWHREINTFHLPVGELTITLDDVSTLLHLPIGGAFHSFEALSVDKAVFLLMELLEVSGEEARAETAFRDLGQSGGYAWGAAALVHMYDQLDETSRTTTRQIGGYLTLLQCWIYENFPSVHQCVTNDAYEETSPRASRWLTMKAHRKGITGASYRVRCDALTVTDVVLVALQRPSRG

SEQ ID NO: 92052 - protein, 57 aa, Glycine max
  Coding DNA Sequence Number=SeqID_367
MEFVGALRSIKNLSLAGNFIARPFPIKELSLLPNLEVLDLSMNHLVSSVTTQVLNGN

SEQ ID NO: 92053 - protein, 53 aa, Glycine max
  Coding DNA Sequence Number=SeqID_368
MTVISKRGKCQFTNHKMLLNYPVVRSKWNGNVGNSGLVLRVDVTNNKALSLCE

SEQ ID NO: 92054 - protein, 157 aa, Glycine max
  Coding DNA Sequence Number=SeqID_369
  Homolog annotation: Hit_ID=A2Q4S5; Match level="QueryCoverage=51%, HitCoverage=13%, E-value=4e-09, Identity=38%"; Hit description=IMP dehydrogenase/GMP reductase, putative
MKAHRKGITGASYRVRCDALTVTDVCWLPYSDHRGVRGFELISSFQGQLRWGPTVVTIRPEKVLHQFGYIQSIPPPSVSASFSYDDIDDRWIHFSDHVVVVGDLCVVSGQTSDQPRHAPAPDHEDYMQPDIPQVPVAFDPPRHAMMITKAMRRSQKG

SEQ ID NO: 92055 - protein, 68 aa, Glycine max
  Coding DNA Sequence Number=SeqID_370
MLVATPRIFPPLESAPVSLAFARPRRARCDTYTHICFVRTTKLESGTLCKLTILTLLLLARLTLVGYN

SEQ ID NO: 92056 - protein, 86 aa, Glycine max
  Coding DNA Sequence Number=SeqID_371
MDICYCLLGKMEMNCSGKCNLADWFLKGVSMQSAVGWTKDYFEISKERDVGVIFRKFCQGKNMEIWTNNLMLLLYVVVIVPKAKTT

SEQ ID NO: 92057 - protein, 488 aa, Glycine max
  Coding DNA Sequence Number=SeqID_372
  Gene Ontology: Mol. function=metal ion binding; Biological process =double fertilization forming a zygote and endosperm
  Homolog annotation: Hit_ID=A7P221; Match level="QueryCoverage=91%, HitCoverage=98%, E-value=1e-146, Identity=58%"; Hit description =Chromosome chr19 scaffold_4, whole genome shotgun sequence
  Pfam annotation: Domain name=DUF641; Domain location=68-200; Score =222.9; E_value=7.3e-64; Accession=PF04859.3; Description=Plant protein of unknown function (DUF641)
MESVKPSAVTPRKKLARNFAKVLHVKALIGIASVDGLKNVISDANLKDEGNIGKSKATLNWSESFNEDDDEDLQEREANEALLAKLFASISTVKAAYAELQYAQSPFDPDGIEAADQLLVSELKNLSELKQCYLKKQFDPSPKTAILEAESKELQGVIKTYEIMGKKLESQVRLKDSEIIFLREKLEEANRQNKAIEKRLNQSGQLSGLDNLHITGLSPSHFITVLRHTVRSIRNFVRLIVDEMRYAGWDVDATVDAIEQNVVYMAEDHKCFAIEAFVCREMFDAFHIPNFALSSESLLDKNRRQQWFFGKFNEMKSMKAKYYLAEKPRSSFAKFCRVKYSRLVHPKMESSFFGNQSHRNLVNAGGFPDTEFFASFAEMAKRVWLLHCLAFSYEPQASIFQVGKGCRFSDVYMESVNDEVFLYSEVESDPQVAFTVVPGFRIVVVRCTLGFANVLKASWAPHVKQTLFNEVGVEGACEDNICKPFFVP

SEQ ID NO: 92058 - protein, 181 aa, Glycine max
  Coding DNA Sequence Number=SeqID_373
  Gene Ontology: Mol. function=hydrolase activity; Cellular component =mitochondrion; Biological process=cell division
  Homolog annotation: Hit_ID=A2Q1P1; Match level="QueryCoverage=69%, HitCoverage=41%, E-value=4e-16, Identity=63%"; Hit description =Dynamin central region; Dynamin GTPase effector
MTNRVSVLHQMLKELYPLIFTFSAWCFLGNNGGSSWGISSLFGGDDSRMTVKENIASKPHTEQPVHSKEQSFSTIHLREPPPILRPSESNSETDVIKITANKLLLRSYYDIELPLEAETVENGYNLPETTCVPVIHGLPTPSMYSTSNDGDDYYAASPKYPKSDRFQWKQKAVHVRFLSYG

SEQ ID NO: 92059 - protein, 654 aa, Glycine max
  Coding DNA Sequence Number=SeqID_374
  Gene Ontology: Mol. function=binding; Cellular component=cytosol; Biological process=protein folding
  Homolog annotation: Hit_ID=A7P1Y9; Match level="QueryCoverage=80%, HitCoverage=77%, E-value=0.0, Identity=66%"; Hit description =Chromosome chr19 scaffold_4, whole genome shotgun sequence
  Pfam annotation: Domain name=TPR_1; Domain location=226-259; Score =29.4; E_value=1.3e-05; Accession=PF00515.19; Description =Tetratricopeptide repeat
  Pfam annotation: Domain name=TPR_1; Domain location=260-293; Score =14.3; E_value=0.1; Accession=PF00515.19; Description=Tetratricopeptid e repeat
  Pfam annotation: Domain name=TPR_1; Domain location=418-451; Score =24.3; E_value=0.00047; Accession=PF00515.19; Description =Tetratricopeptide repeat
  Pfam annotation: Domain name=TPR_1; Domain location=464-497; Score =9.7; E_value=0.36; Accession=PF00515.19; Description=Tetratricopeptid e repeat
  Pfam annotation: Domain name=TPR_1; Domain location=498-531; Score =31.6; E_value=2.9e-06; Accession=PF00515.19; Description =Tetratricopeptide repeat
  Pfam annotation: Domain name=TPR_1; Domain location=532-565; Score =14.6; E_value=0.094; Accession=PF00515.19; Description =Tetratricopeptide repeat
  Pfam annotation: Domain name=TPR_2; Domain location=226-259; Score =30.1; E_value=8.4e-06; Accession=PF07719.8; Description =Tetratricopeptide repeat
  Pfam annotation: Domain name=TPR_2; Domain location=260-293; Score =19.6; E_value=0.011; Accession=PF07719.8; Description=Tetratricopepti de repeat
  Pfam annotation: Domain name=TPR_2; Domain location=418-451; Score =28.4; E_value=2.7e-05; Accession=PF07719.8; Description =Tetratricopeptide repeat
  Pfam annotation: Domain name=TPR_2; Domain location=464-497; Score =21.6; E_value=0.003; Accession=PF07719.8; Description=Tetratricopepti de repeat
  Pfam annotation: Domain name=TPR_2; Domain location=498-531; Score =21.3; E_value=0.0036; Accession=PF07719.8; Description =Tetratricopeptide repeat
  Pfam annotation: Domain name=TPR_2; Domain location=532-565; Score =18.1; E_value=0.033; Accession=PF07719.8; Description=Tetratricopepti de repeat
  Pfam annotation: Domain name=TPR_4; Domain location=260-285; Score =7.7; E_value=4.7; Accession=PF07721.5; Description=Tetratricopeptide repeat
  Pfam annotation: Domain name=TPR_4; Domain location=418-443; Score =10.3; E_value=2.3; Accession=PF07721.5; Description=Tetratricopeptide repeat
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2::TPR _4::TPR_4; Domain location=226-259::260-293::418-451::464-497::498 -531::532-565::226-259::...
  Pfam module annotation: Domain location=260-293::418-451::464 -497::498-531::532-565::260-285::418-443
MSRSSGKPVSEVVGIDATFADRFRDALTCDDGSNNNNNINKPDFRELDLGSPVSPLRTTRGPAASSSSSSSGSFSGRTGPTRKPESAQNNSNTNTHTHSLSNNNNSGELSGSSENSPTARKPGHRRSDSGSALVPLIYSGQTATSPAMNVLPTGNICPSGKILKAGMMANRSSRTSRSDVLGSGMGNYGHGSIMRGGGKVEPASSRGGGGGNETVKKGGHVQSVDPEELKRLGNECYKRGNFADALSLYDRAIAMSPASAAYRSNRAAALTGLGRLGESVRECEVAVRLDPNYGRAHQRLASLFLRLGQVENARKHLCYPGMQPEPSEMQRLQVVEKHISKCGDVRRVGEWKSVLREVDAAVAAGADSSPQLFMCRAEAFLKLHQIDDAESILLSIPKSELQINSSSQARFFGMLSEAYSYFVRAQIEMALGRFENAVTAAEKACQIDSRNVEVAVLLNNVRMVARARVRGNDLFKSERYTEACSAYGEGLRLDPSNSVLYCNRAACWFKLGQWEQSIEDSNQALHIQPNYTKALLRRAASNSKLERWEEAVKDYEILRRELPNDNEVAESLFHAQVALKKSRGEEVYNLKFGGEVEEVSGLEQFRAAISLPGVSVVHFEVASNLQCKQIWPFVNTLCGRYPSINFLKVSHFTT

SEQ ID NO: 92060 - protein, 1208 aa, Glycine max
  Coding DNA Sequence Number=SeqID_375
  Gene Ontology: Mol. function=N-acetyltransferase activity; Biological process=metabolic process
  Homolog annotation: Hit_ID=A7P1Y6; Match level="QueryCoverage=82%, HitCoverage=95%, E-value=0.0, Identity=41%"; Hit description =Chromosome chr19 scaffold_4, whole genome shotgun sequence
  Pfam annotation: Domain name=PHD; Domain location=771-828; Score =26.2; E_value=1.1e-05; Accession=PF00628.20; Description=PHD-finger
MLISNETEDLCDDNFEGSNEERQIFSEVFSGNGIFQSNQKCLVPVAISFEHESAKNTFKSFCSSNENSVVLHPSSSRLTHPEEEDFNVIQHSKEAALGCVPESFICEDQNDEDVNVKLSNLSRAATSCDSEPIAFHLVESSKHGVISSCYLLNHNKVNKQAAKDKVDVTNFNSTTADGNIAKELCVSKAAASPVSQESFANRRVVTSPSTTVVKKSGSPLNPEEMVESSNVGISNASSMLEEEDPRTILQFHILQLLKMAGWSIEKRQRPSRRYPESVYRTPEGKTIREFTKAWRLCGELLSVEKCNFMCRDYKEWTDISQFWSDLSSTLINVEKTKMQSEDPAAVLAYRWWLLDPFVVVIFFDRKIGVLKKGEAVKATWSLVSSKYMVACAPIGSSSGNLNQVPGGSNVGAVHQARIRNSKSFDKQSSENYLETNKIIDGDLPMDMSEENNASSVSHGLVHSHDSRDMQQSECSEEEGGKISVDSVFGKDNKYSASDVILKKKMRRKCKRVSEIKLSMFYHSDMLGSTVTDQVQLLDGEASGLEEVQDYLVDNAGKKRNCRKLSSVGAIQRNIRKTNCPTAGTDKSNRCQIKDDDLLVSAIFRNKDFSPKAIRGNSSAKSRKSRGQRKLKSQKGRCRLLPRNPCNAGKHNKDCNRFYLGARTILSWLIDNGVISLNDVIQYRNPKDNVVIKDGRITKDGIICTCCDKVLTLSEFKFHAGFTVNRPCLNIFMESGEPFTLCLLQAWSAEYKARRSQNQAVHADDNDKNDDSCGLCGEGGELICCDNCPSTFHLACLSTQVYSGLQTQVGLVNQVADGISWTLLRCIHDDQKVHSAQWFALKAVCNTKLAVALTIMEECFVSMFDPRTGIHMIPQVLYNWGSEFARLNFQGFYTIVLEKKDVLISVASIRVHGTTVAEMPLIATCSQYRRQGMCRLLVSAIEQVEKLVVSAIPDLVETWTKGFGFITVDDIERQRLNKINLMVFPGTVLLVKSLHGKEKIEGLCDLSILATDESIKAGICSEGMAISESFAQVVGNITTNKGGAKSEHEPVDGKNQSDYEAGSETGRDDKIQAVDTAIEAKESTEISSSSREEKVTQLKVSGDSEKSIEENNVNELRTSNKAEMTSDSVQQSSENCCADKDGAEPAISIVEDKNIKIVCKLNQKLKESRCLERWCDDAHNKLVGYLRETNCKIWKNNRLGKVKGGCATN

SEQ ID NO: 92061 - protein, 101 aa, Glycine max
  Coding DNA Sequence Number=SeqID_376
  Gene Ontology: Mol. function=extracellular-glutamate-gated ion channel activity; Cellular component=integral to membrane; Biological process=ion transport
  Homolog annotation: Hit_ID=A7P1W1; Match level="QueryCoverage=99%, HitCoverage=18%, E-value=1e-26, Identity=60%"; Hit description =Chromosome chr19 scaffold_4, whole genome shotgun sequence
MAMVVWLFVALIITQSYTANLASMLTAERLEPTIDDIDQLRNSNIKVGYGKGSFLKNFVQEVLQFHPSNMRHFGALEEYAEALRRKEIGVAFLEVMLQKIL

SEQ ID NO: 92062 - protein, 281 aa, Glycine max
  Coding DNA Sequence Number=SeqID_377
  Gene Ontology: Mol. function=protein serine/threonine kinase activity; Cellular component=cell surface; Biological process =protein amino acid phosphorylation
  Homolog annotation: Hit_ID=A7QRC1; Match level="QueryCoverage=78%, HitCoverage=39%, E-value=1e-49, Identity=39%"; Hit description =Chromosome chr13 scaffold_149, whole genome shotgun sequence
  Pfam annotation: Domain name=Pkinase_Tyr; Domain location=186-279; Score=-174.4; E_value=0.098; Accession=PF07714.8; Description =Protein tyrosine kinase
MDFTFGSVLFEKQDLIPVLAVWFANMCGAAVSARYLPFLDGKGLGCPCFISYNSYCITINGKPECECPDHYSPFEHDNLTGCRPDIPLPSCNKDGWEQNKDLDMCKQKCLEDCFCAVAIYGEGQCWKKKYPLSNGRKHPNVTRIALVNVPKRDLDKSGREQTTLVLVISIVLGSSVFLNELEEATTGFKQMLGHGAFGTVYRGVLTSDTSRYVAVKRLDKEVPEGEHPLLVYEYMRNGSLSSFLFGISRPHWYQRVQIALGIARDLTYLHESAALRSFIVT

SEQ ID NO: 92063 - protein, 337 aa, Glycine max
  Coding DNA Sequence Number=SeqID_378
  Gene Ontology: Mol. function=translation initiation factor activity; Cellular component=nucleus; Biological process=translational initiation
  Homolog annotation: Hit_ID=A7Q7W8; Match level="QueryCoverage=89%, HitCoverage=50%, E-value=1e-89, Identity=58%"; Hit description =Chromosome chr18 scaffold_61, whole genome shotgun sequence
MFKKAVEAKSHQRLSGADRKKLRRSIKQKFQRVSDSDLDALLPPKAEITVAKLQNRVHVYAVEGGFPMFFDVDGRGSDIFPTVYALWMVPELLPVFVLKGGEVSRFVIGGADLMFPGIIVPPDGLPSFRAGEPWAAKVPGNPAPIACMHYLILGLANQGHWETAEGRCVPNAGFFEDVVFEDPSLLQASHDSDLTEVAGETSIDQQKNPKSDGSEESLDVNELQTDSAPALATPNGDENDTTAEVTEGVADLKLPDTVSANDQDDQLTLSTADVDSLLDKCLLQALHTTVKDKDLPLPGSTLWWNFLPLFLLVDLVEPFEIDWPKNLANHEFQLTIK

SEQ ID NO: 92064 - protein, 176 aa, Glycine max
  Coding DNA Sequence Number=SeqID_379
MRLSEESRGLAATQQCDNSEEVWRCITSDECWSVMWKIGEEKENGVPRVRKREISSESQKDKVRKLEGSQEERETQGDAGVLVDVVLGGAAIVWIIISIKEHNYRVIEIMPMEDEMVAAPHCFAKGKNVEVVTKLDEEDTIKHNGIGGVEGDGKSREKKEINWRGEEERIEQPTPK

SEQ ID NO: 92065 - protein, 283 aa, Glycine max
  Coding DNA Sequence Number=SeqID_380
  Gene Ontology: Mol. function=Rho GTPase activator activity; Cellular component=intracellular; Biological process=signal transduction
  Homolog annotation: Hit_ID=Q3E875; Match level="QueryCoverage=90%, HitCoverage=67%, E-value=4e-94, Identity=69%"; Hit description =Uncharacterized Rho GTPase-activating protein At5g61530
  Pfam annotation: Domain name=RhoGAP; Domain location=139-278; Score =65.1; E_value=2.3e-16; Accession=PF00620.18; Description=RhoGAP domain
MECPRVKLKEAKESAGTFVGEVTKDTKSNVAEVAGRVGSMVKSRWALLQQPSTRHAVQDRFISAAATTGTLLRRGFSGTKDKVVVGKSKVEEVAKITAQKSKTILTDIERWQKGVASTDVFGVPIEVTVQRQDCCKPIPQILINCADYLIVSGLNSPHLFKSEGDKKVIHQLVSLYNQDSTASVPEGTTPVDVAALVKYYLASLPEPLTTLELYNEIRGARSSIYSMRNILKRLSSVNYMTLEFITALLLRVSQKSLLNKVGVFSAWFSRSRDGWVGDWVSYA

SEQ ID NO: 92066 - protein, 404 aa, Glycine max
  Coding DNA Sequence Number=SeqID_381
  Gene Ontology: Mol. function=metal ion binding; Cellular component =integral to membrane; Biological process=ubiquitin cycle
  Homolog annotation: Hit_ID=A5APA2; Match level="QueryCoverage=81%, HitCoverage=78%, E-value=3e-51, Identity=37%"; Hit description =Putative uncharacterized protein
  Pfam annotation: Domain name=zf-C3HC4; Domain location=129-169; Score= 18.9; E_value=0.00064; Accession=PF00097.16; Description=Zinc finger, C3HC4 type (RING finger)
MELDLNQEPSDPTHASPDEFDSLLEELESAHEHVQDRIRRLEAITSRTRQYSSWPLFHTPIQITNSTGQTSALADAREEEMPSREVEERVVESGRGFKRKGAHLVAKALGRIETDANKEGGSTGNFYDCNICLDRARDPVLTCCGHLFCWPCFYQVQIVYSNARECPVCKGEVTETGIFPIYGNSSADGSCESGLKGAGLRIPPRPAAPRIESFRQQLISQGASSSVILNIRRFHHLIGGLGARVQSQNPNAATDRNNGLLAQSRPPSSNDRGTGSSQTPISTLLVQGAASFSSLSSALNSAMDSAERLVEDLESYFHNHQTNGVNTSSTHNGNVAATDSTPAASTSPFSRNVDTTANIGSEIQTTDNNIQTETSTLDPSSSRRGSTRVSTSRQVTNDRRRRSR

SEQ ID NO: 92067 - protein, 824 aa, Glycine max
  Coding DNA Sequence Number=SeqID_382
  Gene Ontology: Mol. function=exonuclease activity; Cellular component= intracellular
  Homolog annotation: Hit_ID=Q9LEN6; Match level="QueryCoverage=71%, HitCoverage=86%, E-value=0.0, Identity=63%"; Hit description =Putative uncharacterized protein
SGFRKCLGSRATLLEVQPLLQDAIAERGKDEVGGNTSLEGGGLLAAELREIRFGSLGLARHLTNIVSVLAKACVGRKQRASSLLTMEDDLLDTEDRNNNGSSTAKKSKQRRKRKEYMVDEDGQVGAREKLAKRILLSLTRPSYVLGLGPKPLRVEHRARLRYLLRRLVSQHHWVAASGVLSVYLKGTLDDNSPYRNRLKFWVLLELLKHVENHSINPTRIKNLYDIWSKKIGSMKTWPVEQSRYAVHLEFMLFCLLQGNAEDAYQLALCLGQEKGDIGPMSKMMMGLTFYELWYSSIPKEFQWRNSDQFDLQENSDMEGTSFNNETVQSERYNSVESHMADSQSQRDSDASVMNDKKISGDVVFNEDMEVDANKREKPHQNFQPEGFYLNSEEHKGFGDPFSNNGGLTQDILYGLGELDLWLLPLRLSDDHSFEEFMYLQGNQPNDYYKNAVKYLQLALDSEPSASAALLPLIQLLLIGGQVDEALNMLEKQCCNSASVLPIRVRAALLERFDRNNSLLLLSCFEDILKKDPTCSDTLAKLIKMHQNGDYSLVSLLEMIALHLDATDAEYNTWKVFSSCFLRLSSYEEDCMSSCPIQNEDGHKQHFPLNKTPKIFTDGISGKSWRLRCRWWLTKHFSNSKLESEINTGDLQLLTYKAACASYMYGREFSYVAKAYSHLEKEDDKELLFAQKTQTCGEHMKKPKQTLLSPNWVQLQQKLKLNGSKASRTFKTSDEDTPESILGKRKERPDDESNDCQINPLVPVNDDSSLTDAVAMDCEMVGVGQGNKSALGRVTLWTSPAVLDFEIPLEVPNGQGYGIGLLSGY

SEQ ID NO: 92068 - protein, 106 aa, Glycine max
  Coding DNA Sequence Number=SeqID_383
MPSNTWLGIQLSANFETCWMRISGSRNTNTCLFEQLVSIDSASAIVVSLSIHCHEQFNKVTVVTSKPTQSEERKWEESLRWSLRAGLIDASSAELTWPLQMISSPG

SEQ ID NO: 92069 - protein, 343 aa, Glycine max
  Coding DNA Sequence Number=SeqID_384
  Gene Ontology: Mol. function=DNA binding; Cellular component=nucleus; Biological process=regulation of transcription
  Homolog annotation: Hit_ID=A7P1S3; Match level="QueryCoverage=99%, HitCoverage=98%, E-value=1e-114, Identity=60%"; Hit description =Chromosome chr19 scaffold_4, whole genome shotgun sequence
  Pfam annotation: Domain name=NAM; Domain location=8-136; Score=321.3; E_value=1.7e-93; Accession=PF02365.6; Description=No apical meristem (NAM) protein
MDHTEAHLPPGFRFHPTDEELITYYLLKKVLDSTFTGRAIAEVDLNKSEPWELPEKAKMGEKEWYFFSLRDRKYPTGLRTNRATEAGYWKATGKDREIYSSKTCSLVGMKKTLVFYRGRAPKGEKSNWVMHEYRLEGKFAYHYLSRNSEDEWVISRVFRKSNTTPITNGGSTMSASTNSKKTRINNTTSLIHEPGSPSSVFLPPLLDSSPYTNTTTNTFTDHHNSSYDSATKKEHVSCFSTIAAATAVVSPNNNFNNASFDLPPSQPLATDPFARFQRNVGLSAFPSLRSLQDNLQLPFFFSTAAAPPFSGGGSGDFLSWPVPEDGVSNMPLGVSELDCMWGY

SEQ ID NO: 92070 - protein, 686 aa, Glycine max
  Coding DNA Sequence Number=SeqID_385
  Gene Ontology: Mol. function=binding; Cellular component=nucleus; Biological process=metabolic process
  Homolog annotation: Hit_ID=A7QFH9; Match level="QueryCoverage=90%, HitCoverage=100%, E-value=0.0, Identity=48%"; Hit description =Chromosome chr8 scaffold_88, whole genome shotgun sequence
  Pfam annotation: Domain name=PPR; Domain location=179-213; Score =37.8; E_value=3.9e-08; Accession=PF01535.11; Description=PPR repeat
  Pfam annotation: Domain name=PPR; Domain location=280-314; Score =51.1; E_value=3.8e-12; Accession=PF01535.11; Description=PPR repeat
  Pfam annotation: Domain name=PPR; Domain location=381-415; Score =34.3; E_value=4.3e-07; Accession=PF01535.11; Description=PPR repeat
  Pfam annotation: Domain name=PPR; Domain location=452-486; Score=3.6; E_value=2.9; Accession=PF01535.11; Description=PPR repeat
  Pfam annotation: Domain name=PPR; Domain location=77-111; Score=31.9; E_value=2.3e-06; Accession=PF01535.11; Description=PPR repeat
  Pfam module annotation: Pfam domain module=PPR::PPR::PPR::PPR::PPR; Domain location=179-213::280-314::381-415::452-486::77-111
MVHLVMRGSNMGSELKKCFAWGLKSLHQAKQCHCLLLRLGLHQDTYLINLLLRSSLHFAATQYATVVFAQTPHPNIFLYNTLIRGMVSNDAFRDAVSVYASMRQHGFAPDNFTFPFVLKACTRLPHYFHVGLSLHSLVIKTGFDWDVFVKTGLVCLYSKNGFLTDARKVFDEIPEKNVVSWTAIICGYIESGCFGEALGLFRGLLEMGLRPDSFTLVRILYACSRVGDLASGRWIDGYMRESGSVGNVFVATSLVDMYAKCGSMEEARRVFDGMVEKDVVCWSALIQGYASNGMPKEALDVFFEMQRENVRPDCYAMVGVFSACSRLGALELGNWARGLMDGDEFLSNPVLGTALIDFYAKCGSVAQAKEVFKGMRRKDCVVFNAVISGLAMCGHVGAAFGVFGQMVKVGMQPDGNTFVGLLCGCTHAGLVDDGHRYFSGMSSVFSVTPTIEHYGCMVDLQARAGLLVEAQDLIRSMPMEANSIVWGALLGGCRLHKDTQLAEHVLKQLIELEPWNSGHYVLLSNIYSASHRWDEAEKIRSSLNQKGMQKLPGCSWVEVDGVVHEFLVGDTSHPLSHKIYEKLESLFKDLREAGYNPTTEFVLFDVEEEEKEYFLGCHSEKLAVAFALISTGAKDVIRVVKNLRVCGDCHEAIKLVSKVTGREIIVRDNNRFHHFTEGSCSCRDYW

SEQ ID NO: 92071 - protein, 166 aa, Glycine max
  Coding DNA Sequence Number=SeqID_386
  Homolog annotation: Hit_ID=Q9FKM4; Match level="QueryCoverage=79%, HitCoverage=23%, E-value=6e-45, Identity=61%"; Hit description =Arabidopsis thaliana genomic DNA, chromosome 5, P1 clone:MUA2
MRISNVLSSAFPAMQLANGLDILLQTREWFPPSRALDALSAFRQMHRAFPANKHFVPDDAYAAESIDDDPLAASSGQVIVDVESRYHVVYRLVNDNYVLEITVANHDNSVNVFECIHIVNQTVSVMVTTCRGIDVTPEKLSRKYVSEGGGGGTWRRRRDGFPNSLP

SEQ ID NO: 92072 - protein, 34 aa, Glycine max
  Coding DNA Sequence Number=SeqID_387
MYRFRGMNNYEPSSSKLSPLPLRRLSNLMGLWPF

SEQ ID NO: 92073 - protein, 493 aa, Glycine max
  Coding DNA Sequence Number=SeqID_388
  Homolog annotation: Hit_ID=A5B680; Match level="QueryCoverage=100%, HitCoverage=94%, E-value=1e-150, Identity=53%"; Hit description =Putative uncharacterized protein
MTSSRERLVKAVKQFVEVRYKVFSNRYGQNIIDILDFPIKVVLSPFTLAFDIAGSAPRGFGVPELISKLSATSVFEMEIKGHFLDAASFAYLDSENVFVFVIKIIGYATAYTLRENVIAHSGLTAGARAGISHVEDGGYIGEKATAESVADAIANNRAELVHIPSSLDFQKPLPSKECPTCDGTGVMSCPECKHRLLHVRISADDVSIVDSMIMEPPWQAYNVLKKIDYPYEHILHSMKDPSIAAFWLITFPQIMGGFTYDDDVKQKIWWQYKENMRYDQLRDVVAKRKPGWEYLQDALISIDPARARDDPVIVKNVPYYKAKKALETEVMKIDPPPRPPNWASLEHCYEDDLCEVHSMVKPWLLLSNVLNFNIKENWQELDLPLNASSWSEEDLQDPDKFYEMTVLLNAQREISDKILDAQWETKWRQDKIIPYALLVHNVLGILGSCFKIQDAKLSVLNEMLEAKVKPYIQDIDNAVLPEPILLKPQNQEK

SEQ ID NO: 92074 - protein, 67 aa, Glycine max
  Coding DNA Sequence Number=SeqID_389
MKMLLIPHGVAPCGACRPWIFFINGVFFFLKINGSGMEKKIDDWRRHFKEKMIQEQAHHHRKPWIRA

SEQ ID NO: 92075 - protein, 230 aa, Glycine max
  Coding DNA Sequence Number=SeqID_390
MEIDDEGVLLDSYLNVRACVLALKFLAVAHPSIKMLTGWPRIYPYIRNVSGTTCPDKALKLNCAGGGFGTDRFGASIGTKLMLVLPLASEPSNLGTSSFSRCGAATDPDAKNEDTSGCAWEGLNLVASRCASLSESVSIFASTVAENFANNSSIFSKDNAFDLVPSTMLQTLCSMKTPMMPSVRGLGNLPLRVPHEKVELVEKKGRRFREERKRKSLKEISFWKFSLPFA

SEQ ID NO: 92076 - protein, 175 aa, Glycine max
  Coding DNA Sequence Number=SeqID_391
MKREKYACYSSHNSCKSLSEELRDYYEGRHRSHLRPHSHRREKERKPQEANINLPYFHGKDNKDQGQGILGVTPSKPKDDKGKTIEKQSPKASYYFTFLSESEEAKGEESSEEIYPQEEGQPLVVKEKCKETLASIATPLGLGFISQVKKLLDEGVEGRSPEYEEPQDLRSNPFQ

SEQ ID NO: 92077 - protein, 221 aa, Glycine max
  Coding DNA Sequence Number=SeqID_392
MEVPKGVEIDADGGGVGAQGAGGVEEEGAVVEALGLGACALWVPGNVIEGSSRDSKVRESETTPQATHKAVISAGKPSLEDQILHQELPGRTLCIKYKSLPWDVESGSQLLRVYASDVDCSPGSRTSGVSRKTFREGHIYVLIHLPGQGFMPVLPLKFPAELIILRDVKNHIPLWKNVLSISLLGTLRYESSGVIGLPGSGDSGFPLPGGHLHKKESQESS

SEQ ID NO: 92078 - protein, 61 aa, Glycine max
  Coding DNA Sequence Number=SeqID_393
MTKSKGKDPLEGLGGSMTRARARKAKEALQQVLSILFEYKPKFQGEKSKVLHSAIKVFLIP

SEQ ID NO: 92079 - protein, 88 aa, Glycine max
  Coding DNA Sequence Number=SeqID_394
MKFWHLGDVSSIGPSEWRRKRERRRHFKEKMSLEEAHHHRRPWIRAWRKKEMNEGRGREEHEILCSKRALKSEPTNPRSIPRFSTKCA

SEQ ID NO: 92080 - protein, 147 aa, Glycine max
  Coding DNA Sequence Number=SeqID_395
MAGAPSNTPICYTVVYKSKGERKDIELAEEEKPWIGADCSSATSNKSEIYKEEAGNAAQKHKAKMVESVNADAEAFGDQWKTGDSTVLKIGDSAKVVIKEDMKGGEHKYGFNNNKREKPEKVKVVDDETGDKHELYEVLRMPSRTKN

SEQ ID NO: 92081 - protein, 295 aa, Glycine max
  Coding DNA Sequence Number=SeqID_396
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMSTLDRSMRQKVNKHIQDLNSALHQVDLIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 92082 - protein, 217 aa, Glycine max
  Coding DNA Sequence Number=SeqID_397
KDKAAEGTSSAPEYDSHHFMSAEHQQRFEAIKGWSFLRERRIQLRDDEYTDFQEEIVRRRWASLVTPMAKGQWIPFDADALSQFLGYPLVLEEGQEYEYGQRRNQADGFDEEAIAQLLCIPGSATSSPTIIIPTSPCRSVSWHPLDPDKSNRALGFPALITGLCQSFGVPVAPSKVIRPPITRAFIEKYCTQRQAQGDAPQAAVRAATSSGWPNWII

SEQ ID NO: 92083 - protein, 130 aa, Glycine max
  Coding DNA Sequence Number=SeqID_398
MGEVEEVQEQMKSNTEALKEKMAMMSIKEIMEANAIAVATASVVAKVNLMPPSGLKQMNHPTSDMDVNNSAPIVIEIRQPHHVHVSQPMGETHEIPHHNLADFEPCLEYATEGLRAIEGGEDYAFANLEE

SEQ ID NO: 92084 - protein, 95 aa, Glycine max
  Coding DNA Sequence Number=SeqID_399
  Gene Ontology: Mol. function=alpha,alpha-trehalase activity; Cellular component=periplasmic space; Biological process=trehalose metabolic process
  Homolog annotation: Hit_ID=A4WBE4; Match level="QueryCoverage=71%, HitCoverage=11%, E-value=9e-25, Identity=82%"; Hit description=Alpha, alpha-trehalase precursor
MIIPQKLRPRLLPMVLGSALLAVAASGYAEEMNAGQTNSPDILLGPLFSDVQSAKLFPDQKTFADAVPNSDPLTILADYRMQRRQSGFDLRHFVE

SEQ ID NO: 92085 - protein, 112 aa, Glycine max
  Coding DNA Sequence Number=SeqID_400
MAPTLCTHIEILGLILGSISAEVDVSLSELNALSECHPLRKASTRLADRRNLEGNLPCRHALNASSAHLASRLSPSRLSASLALRKNSLTRAKRENGAKHDVEVSEPLLSLE

SEQ ID NO: 92086 - protein, 83 aa, Glycine max
  Coding DNA Sequence Number=SeqID_401
MDPKRIKVIPEWPTPPFVAPLIELVRNYVLSWEDGQERGFQSLPYSNIPNITESLKFQEPRDLWSNPFPGGENDAILPGKGIG

SEQ ID NO: 92087 - protein, 104 aa, Glycine max
  Coding DNA Sequence Number=SeqID_402
MSHAVKDNRGKWAPNYEGPFVVKRAFSGGALGQDHLELPSGVETKHEQQKPIKVHRNGCKWGWGHDRLIVAPFSTLSKRRMSLQGSPVSFVFAVFFYFLFFKNK

SEQ ID NO: 92088 - protein, 91 aa, Glycine max
  Coding DNA Sequence Number=SeqID_403
  Subcellular localization annotation: CTP_CleavageSite=67; ConfidenceScore=5.09e-01
MASSSIKCSTGVPAGDPCGVLSSYTGVDTGDAYGLASTIIGSASGSVSGLGSSLSMYSFASWKINGSGMEKAEREETPLQGEDESRRSSPP

SEQ ID NO: 92089 - protein, 115 aa, Glycine max
  Coding DNA Sequence Number=SeqID_404
  Gene Ontology: Mol. function=endonuclease activity
  Homolog annotation: Hit_ID=Q9AY32; Match level="QueryCoverage=54%, HitCoverage=95%, E-value=7e-27, Identity=96%"; Hit description=RRNA intron-encoded homing endonuclease
  Subcellular localization annotation: CTP_CleavageSite=59; ConfidenceScore=5.42e-01
MVVTVKKLVVGPWVGSIGPPSGVHRSARPFCRRCAPVLNWPGRASERKLGARRRSDTVLVSTINDADQGSADVAFRTPLAPYEKSKSLGSGGSMVARLKLKGIDGRAPPGVEPAA

SEQ ID NO: 92090 - protein, 107 aa, Glycine max
  Coding DNA Sequence Number=SeqID_405
MSILYPLGSKKRKRKENFQSKEKAKKEKKGNFPKSKRVGRKQKRKEKKIPNQRMGESKKEEEEGKKAPDQGSKENRRNVQKGLWTRQYLNNTELSPNEQKEGRETTT

SEQ ID NO: 92091 - protein, 134 aa, Glycine max
  Coding DNA Sequence Number=SeqID_406
MVKVGTSYVPINVSFSPKVGPELPGINRDTRDLFILRSDLPSQVFISAQSASAVPPVQLLTGVVRNGKKPPPDISAGKCSGPAARNHHTPPRLMRRYRARPIRHSGCATVGKGDRCGPLRYYASWRKGDVLQGD

SEQ ID NO: 92092 - protein, 223 aa, Glycine max
  Coding DNA Sequence Number=SeqID_407
  Homolog annotation: Hit_ID=Q6WAY6; Match level="QueryCoverage=95%, HitCoverage=54%, E-value=5e-13, Identity=40%"; Hit description =Putative uncharacterized protein
MGSSQMPSLKKRFYQVKVKSLGTTSLKELGQLMGQLQRQAFRKAYGKIWDLAMVEVSTVGHCLPAQYYDQPMRCFTFGDFQLSPMVEEFEEILGCPLGGRKPYLFSGFYPSLARISKIVQISAQELDHRNSLCMVSFTPFSPKKKGGENWDQLLASKEGASVNWFPRWKEGRTGVLISCGGFPNVPLMGTRGCISYNPVLAIRQLGYPMRGAPLKEELAPIIA

SEQ ID NO: 92093 - protein, 133 aa, Glycine max
  Coding DNA Sequence Number=SeqID_408
  Homolog annotation: Hit_ID=A7QXA5; Match level="QueryCoverage=65%, HitCoverage=42%, E-value=4e-08, Identity=38%"; Hit description =Chromosome undetermined scaffold_217, whole genome shotgun sequence
MSRNTRRSTWLRMLTRRTLDQPRPIVAVDAATGRGSGPHKEKFHNYLGVVAREKVPIVHNSWKDVPVTLKELVWNEILAKFDIPEALHAKKKVMSTTVTRWRQFKSSLTSKFVFSIYEDQHKEDPSIKYGFDA

SEQ ID NO: 92094 - protein, 108 aa, Glycine max
  Coding DNA Sequence Number=SeqID_409
MFVPAAEGTSATPEFDSHRFRSAEHQQRFEAIKRWSFHRERRVQLKDDEYTDFQEEIARRKARSASLVREGTGPMDLTKRPLPNCYAYRVRILPGPLPGGGCGSCAPA

SEQ ID NO: 92095 - protein, 129 aa, Glycine max
  Coding DNA Sequence Number=SeqID_410
  Homolog annotation: Hit_ID=UPI0000498F17; Match level="QueryCoverage =27%, HitCoverage=41%, E-value=2e-08, Identity=83%"; Hit description =beta-galactosidase
  Subcellular localization annotation: CTP_CleavageSite=43; ConfidenceScore=5.35e-01
NLRPVRKPFPLAAVVTTLSVQSCTGSNSCSPGDPLVLERPPPRWSSNSPYSESYYNSLAVVLQRRDWENPLALPNLIALQHIPLSPAGVIAKEARTDRPSNSCVSLNGEWDAPCSGALCVRLGVVVSAA

SEQ ID NO: 92096 - protein, 135 aa, Glycine max
  Coding DNA Sequence Number=SeqID_411
  Subcellular localization annotation: CTP_CleavageSite=53; ConfidenceScore=5.33e-01
MYPPLFSLNNLVDVSSTRTDPQEMYPLLFSVTTTQVDVPSTCTTKDVPSNVLRQSSQAVSPLKLCEGGNKRHLRREKGDTKEFRRLVLRSFGKGRRETQKEFRWLVLGEFILAKGEGNEKMNSTSFIFKVWKPET

SEQ ID NO: 92097 - protein, 122 aa, Glycine max
  Coding DNA Sequence Number=SeqID_412
MAKFDPDIVLEFYANAWPTEEGVRDMRSWVRGKWIPFDADAIGQLLGYPLVLEEGQECEYGQRRNRSDGFDEEAIAQLLCIPGARFCPDCCRETGADHAHQHDHPDSDMDDFAAQQHPAHRS

SEQ ID NO: 92098 - protein, 93 aa, Glycine max
  Coding DNA Sequence Number=SeqID_413
MDLWYIANIKDARHIRYTKIQSYMQCGTMSVKNLVRRLGGDQSASQCFARMLQPYGIGTGLKEHSNRVTPKAYTLKSPLEPFPPDSGPTLKTF

SEQ ID NO: 92099 - protein, 46 aa, Glycine max
  Coding DNA Sequence Number=SeqID_414
MEENVEEALAAHELRFRIGNRLQGPISLLGNRLQDVVIDYRLPVHV

SEQ ID NO: 92100 - protein, 191 aa, Glycine max
  Coding DNA Sequence Number=SeqID_415
  Gene Ontology: Mol. function=transferase activity, transferring acyl groups, acyl groups converted into alkyl on transfer; Cellular component=chloroplast; Biological process=branched chain family amino acid biosynthetic process
  Homolog annotation: Hit_ID=Q6D0G8; Match level="QueryCoverage=97%, HitCoverage=35%, E-value=4e-80, Identity=80%"; Hit description=2 -isopropylmalate synthase
  Pfam annotation: Domain name=HMGL-like; Domain location=1-191; Score =226.1; E_value=8.2e-65; Accession=PF00682.10; Description=HMGL-like
MGVDVMEVGFPVSSPGDFESVQTIARTIKNSRVCGLARCVEKDIDAAYESLRVADAFRIHTFIATSPMHIATKLRSTLPEVIERAVHMIKRARNYTDDVEFSCEDGGRTPIDDLCRMVEAAINAGATTINIPDTVGYTLPGEYANIIGQLVQRVPNIDKAILSVHTHDDLGMATGNAIAAVLAGARQSKAR

SEQ ID NO: 92101 - protein, 385 aa, Glycine max
  Coding DNA Sequence Number=SeqID_416
AFVAHFAGNQLDALLRQQRSQRIGDALVFDVVAVPAERQLGHAVGLVGWGDIAPMVPARQQAISREPVALIADAGMIEQRDRVKQIAHPAAETGIASAFRALIEQQKIAALFEATLFRFFVVVFAFQFYTGVDQLIADLRQHPDRDIINQRAVAEVVIKRGDFQLGLLIAHHAVRTGANGLTGEVAQCRPFTRQNHGADAGQQPRQPAVRLAEMDIQRPRCRRVQLVDVRKQRLAAHPVQRGDDILHLQLAAMMKADCRPQEEAPVQRRGLLPVMGDVGGDFPLFLIYTRQAAEYLSRQMAAPAGRCDPAPAGLRRAAAVAPVRCSRSSAASVYRDQLQPARSASPPPAWRSADYACGGVSSAAVRPARSAWFPDPGPDSVATGE

SEQ ID NO: 92102 - protein, 36 aa, Glycine max
  Coding DNA Sequence Number=SeqID_417
MRNTLHLGSMENTFQRNGPEEACLKEVQEGQGGRRN

SEQ ID NO: 92103 - protein, 134 aa, Glycine max
  Coding DNA Sequence Number=SeqID_418
  Gene Ontology: Mol. function=transcription factor activity; Cellular component=nucleus; Biological process=regulation of transcription, DNA-dependent
  Homolog annotation: Hit_ID=A5AVA4; Match level="QueryCoverage=98%, HitCoverage=99%, E-value=2e-36, Identity=55%"; Hit description =Putative uncharacterized protein
  Pfam annotation: Domain name=AP2; Domain location=16-68; Score=86.4; E_value=9e-23; Accession=PF00847.11; Description=AP2 domain
MEEHQKAGKLQGKEEVRYRGVRRRPWGKYAAEIRDPSKQGSRLWLGTFDTAEEAARAYDRAAFNLRGHLAILNFPSEYYSQIRGSPPYPPHLATPSSSSGAQQRPVFEIPCLDDKVLEDLLGQSEEHKKKNKGD

SEQ ID NO: 92104 - protein, 274 aa, Glycine max
  Coding DNA Sequence Number=SeqID_419
  Homolog annotation: Hit_ID=A7PLY2; Match level="QueryCoverage=90%, HitCoverage=63%, E-value=2e-12, Identity=31%"; Hit description =Chromosome chr14 scaffold_21, whole genome shotgun sequence
GSHASLEHIDDKIPQLDSPLCLLKQISFEMSCKSPRDEIGHKTTLAILNKLSNYEWNAKAVLTMAAFALEYSDPNNPLAKSVAILKRVPVLTRQAALQKHRQTIVEEWTVEYDNKFEDFKCKMPWFAVQHSRTIASLYMVVVLSPQGKVQHSNAFHLIQAHGKRAFPFTFVKQEQINNEIYWVGSEIGNIYPIINTWFTKNVSILASDAAITEANISIEWLCVEKEDKSVMRRFWGGIESLFVTKVHKAVDAVTQEVQKMLSFKNESGWDGSPY

SEQ ID NO: 92105 - protein, 75 aa, Glycine max
  Coding DNA Sequence Number=SeqID_420
MQRSLEGTSEPPAPVVDLSSPQPAADPSTLVVDTPEDQTTPVLTLNTSPPATPVLHLTDEEDVQTQDTQDLSQDF

SEQ ID NO: 92106 - protein, 94 aa, Glycine max
  Coding DNA Sequence Number=SeqID_421
GNKNPDPVNDPVQSPWHAHSDPVQECLMVNPKEEAQVEWALRPLECRPPGLQRPHPLLKEKAGLLAEGPERIGAAGGEGRPEVDGADAGEQGQL

SEQ ID NO: 92107 - protein, 71 aa, Glycine max
  Coding DNA Sequence Number=SeqID_422
KWRILYLRGGVSEETLDSRDIRQHFAMRGSDLAGRDNQVVMAAALNEAHLPRPPKQRQDQGQSSRSLAFAI

SEQ ID NO: 92108 - protein, 108 aa, Glycine max
  Coding DNA Sequence Number=SeqID_423
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=1e-11, Identity=33%"; Hit description= UPI00006A17C9 related cluster
  Subcellular localization annotation: CTP_CleavageSite=71; ConfidenceScore=5.50e-01
MVRTCSPLKVRTCSPLKVRACSPLKVRMCRPMKEKACSPLKVTTSSPLKARTCRPLMARTCSPLKAWTCSPLMARACSPLKVKSYSPLMARTCSPLKARMCSPLNVRK

SEQ ID NO: 92109 - protein, 45 aa, Glycine max
  Coding DNA Sequence Number=SeqID_424
MVQMMSLVTACYQALSLTSEEANFSGECGDEDVSHCLPLGFESYG

SEQ ID NO: 92110 - protein, 51 aa, Glycine max
  Coding DNA Sequence Number=SeqID_425
MNPKRIKVILEWPTPPSVEGRSPKYEEPQDLRLNPFQGGGNDAILPRKGIG

SEQ ID NO: 92111 - protein, 383 aa, Glycine max
  Coding DNA Sequence Number=SeqID_426
MRSRSSSTTRSTDGLAHQTTGGSSGDAGLGWRWRERNSGTRHIRWKIPPGGRRTAADPFHLPHAQENPERQPQKSTPLPGRRFEAARLVFLALLFWIQYPINSPTVQAGRITQQERQHEHSMARRISRGHHQTEARFLAGRGRHPPGPGAPDRQWRGRRGDDGHGGRKRPARARGKAGGAAHRGRDRARPRAGGVGRGRDRHRARGGIRAPGGADRRRWADGVSRPDVQVGRARNGGVLPRRGAGQSPAHPAVQQPARLRRRPDAGPGGAVAGGTDHRRHQGGILRHHPRDRPDHALRRPPSGGLRRRRPGAGKRRAGRDRLGLGHGQRRAESVGGPAAAGGRRRLQARPHAVRGAHAAVPPGHRGQAGAAHQAGRAPYHRQR

SEQ ID NO: 92112 - protein, 49 aa, Glycine max
  Coding DNA Sequence Number=SeqID_427
MHENLTFFIKGVDAILPRKGPITRTMSKRLQEDWARAAEEGPRVLMNLR

SEQ ID NO: 92113 - protein, 208 aa, Glycine max
  Coding DNA Sequence Number=SeqID_428
  Gene Ontology: Mol. function=ubiquitin-protein ligase activity; Cellular component=ubiquitin ligase complex; Biological process =protein ubiquitination
  Homolog annotation: Hit_ID=A7PI07; Match level="QueryCoverage=100%, HitCoverage=53%, E-value=5e-58, Identity=56%"; Hit description =Chromosome chr13 scaffold_17, whole genome shotgun sequence
TCPKTQQTLVHTALTPNYVLKSLIALWCESNDIELPKRQRNCRTKKYGGSCLSKDAATALIKLLCEGTPTGKKDAATAIFNLSIYQGNKAGAVKAGIVAPQIQFLKDVGGGMVDEALAIMAILASHHEGRVAIGQAKPIHILVEVIRTGSPRNRENVAAAVLWSLCTEDPLQLKLAKEHGAEEAQQELSENGTDRAKIKAGSILELLQ

SEQ ID NO: 92114 - protein, 67 aa, Glycine max
  Coding DNA Sequence Number=SeqID_429
MEGKCAELPPTFIRGKRRKNRKRCGLRTLSVKGSGVVFTHGEADKSKEDCLRRWTLKRCLVIFADKA

SEQ ID NO: 92115 - protein, 214 aa, Glycine max
  Coding DNA Sequence Number=SeqID_430
MTSSGSPPEAGEFEGPRNLVERVAFAGILKECFNAAHQCTRAVALQRRCGCRLFGGSAKCLDDVEVQAVGDLLHERTVAQQQPGCLGPDGFHGHVSAPHYMVDPKNMRDAAHVAQVWCVTQAVRDAEQFLQKVAAVSPEQASTRVHEGVYGIATARGQAGAGQQLWNVRFQGDQDGRNAADPVADPPIVLGKEEGPSSQNLGIQPREARAEQVQ

SEQ ID NO: 92116 - protein, 75 aa, Glycine max
  Coding DNA Sequence Number=SeqID_431
MSHAVKDNRGKWAPNYEGPFFVKRAFSGGALGQDHLELPSGVRTKCGQQKPIKVLRNGCKWGWGHDRLIVALSLC

SEQ ID NO: 92117 - protein, 59 aa, Glycine max
  Coding DNA Sequence Number=SeqID_432
MKVDCMVFSLLKKRGKRARTLEEVVNIDFMAKTDHIINITPGLDRDTRSDIGTSLAAVT

SEQ ID NO: 92118 - protein, 195 aa, Glycine max
  Coding DNA Sequence Number=SeqID_433
  Homolog annotation: Hit_ID=A5B939; Match level="QueryCoverage=39%, HitCoverage=55%, E-value=7e-23, Identity=66%"; Hit description =Putative uncharacterized protein
MESRAPSGPFLVSRNWRCGMNRKLGYGAQLRANLDPTKGVGRLRQQGRWSWKSKSAKDLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 92119 - protein, 43 aa, Glycine max
  Coding DNA Sequence Number=SeqID_434
MVWRRQNAAKVVTAERSNARKRRCEELPAKGANATKRRRGAMK

SEQ ID NO: 92120 - protein, 69 aa, Glycine max
  Coding DNA Sequence Number=SeqID_435
MKLASTLMVIRTFCQPEASEPVDTQRLTSSSAPFVNQGQASLFYVRHLETFKPDDAQDSSLLGKNDQVR

SEQ ID NO: 92121 - protein, 316 aa, Glycine max
  Coding DNA Sequence Number=SeqID_436
  Homolog annotation: Hit_ID=Q2HW90; Match level="QueryCoverage=47%, HitCoverage=37%, E-value=3e-13, Identity=29%"; Hit description =Putative uncharacterized protein
PNLGAGIRPQKASKKWGGWNTEKMFGGKSKNLGRGVLFPNVDGLVDLAGIDAFLAYHDHKESPVVAMLADLYDTFGRRCEKSNTRTVCCTPALYVWLVSHFFRQEEHLSTGSLDGRKEESEFLFHAEDFQMMGTRGCISYNLVLAIRQLGYPMRGAPLEDELTPVRKAWAMLQKKDKELRGSNNGPIGGYRKWLKAHVQGLVWLPSLRTAKREEVEALEEDEEAQALRAELKQAQPIKERFKSAALKIRKENAELRDINIATTKALEQETKRACREEHGQNKFRGALWGSNSELKLRREEKDQSRVDSLILKDELK

SEQ ID NO: 92122 - protein, 88 aa, Glycine max
  Coding DNA Sequence Number=SeqID_437
VARAKRYPRGLSTIRCDMHKAKPTLFAKPLWHPGRERALLLDLQLSMIPGDSNLWKLGIDTRATFSAEISFRREMLRFHHTEFDKFKV

SEQ ID NO: 92123 - protein, 93 aa, Glycine max
  Coding DNA Sequence Number=SeqID_438
VRLGFILYRNRKPSWKIPLQLKGSSRCGVSMENNDGLWWLMVAVGDGESAWDTKFQEHPTFNEGWEAFLPRQLHVAYSRSFIKRLPQEASLRS

SEQ ID NO: 92124 - protein, 224 aa, Glycine max
  Coding DNA Sequence Number=SeqID_439
  Gene Ontology: Mol. function=motor activity; Cellular component=cell projection
  Homolog annotation: Hit_ID=UPI00016621D1; Match level="QueryCoverage =95%, HitCoverage=40%, E-value=3e-22, Identity=34%"; Hit description =UPI00016621D1 related cluster
ATHPRLRGLHLLAFRGLHVLAFKGLHALAFRGLHALAFKGLHALAFKGLHVLTFRGLHVLTFIGLYVLTFRGLHILTFRGLHVLAIRGLHALAIRGLHVLAIRGLHALTFRGLHVLAFRGLHILAFRGLHVLAFRGLHVLTFRRLHVLAFRGLHALAFRGLHVLAFRGLHVLAFRGLHALTFRRLQILTLKGLRILAFKWLHVLAFRELHVLAFRGLYVLAFSG

SEQ ID NO: 92125 - protein, 123 aa, Glycine max
  Coding DNA Sequence Number=SeqID_440
  Homolog annotation: Hit_ID=A5B0A4; Match level="QueryCoverage=90%, HitCoverage=7%, E-value=6e-13, Identity=31%"; Hit description =Putative uncharacterized protein
MVWKIGCGDKIDFWHDRWVGECTLKQQYNQLFMISSQQHSLISMMGNFSQDNWRWDLQWRRNLFDHEHDLAVSFMEDITSICIQRNVKDIMMWKAEPNGVYSTKSAYSLMLKLNDSGSQDKVF

SEQ ID NO: 92126 - protein, 87 aa, Glycine max
  Coding DNA Sequence Number=SeqID_441
MITKDDDKGDDKKLKGQSKNEFKIFKIESRTLQDSRGKLISRIKIQEIKISRIKIQEIKRSRLKIQESRIKRRLNQDKYEKVFSKIE

SEQ ID NO: 92127 - protein, 129 aa, Glycine max
  Coding DNA Sequence Number=SeqID_442
  Subcellular localization annotation: CTP_CleavageSite=59; ConfidenceScore=5.13e-01
GSFQQDTQWTQRSPTGPWGFQLWLWASVSPIGCPSPPARDRARKTPSGPGQVQQGLGVSSSDYGPLSVLRSACRPQQGTGQGTTAACGWPAAGNRRTAATSRAPQLIHKKVRALPTTHGRPIGDQVQSQ

SEQ ID NO: 92128 - protein, 155 aa, Glycine max
  Coding DNA Sequence Number=SeqID_443
MTTLTQIWMTLLLSNIMRTTTTPISPCRSVSWDRAHKTPYGPGEVQQGPGVSSSGYGPLSVLPGAYPPQQGIAPARHPVDPEKSNRVRGFPALITGLCQFYGVPITPNKVIRPPINRAVIKNYCAPKAGAGRDTTTAWGWPGASNRHIAATSRAP

SEQ ID NO: 92129 - protein, 169 aa, Glycine max
  Coding DNA Sequence Number=SeqID_444
  Subcellular localization annotation: CTP_CleavageSite=37; ConfidenceScore=5.04e-01
NFGKVAVFHSFAKPSCWLSENSLSVTFSGLSARKNPKEDELSSLLSAPLQVNKHIASAHPLSEISALSDPDLRHEHEQGHLFKPEIRFAKGVWTFLEKLCMHEGSRERKRCEFEAKAVLRLEMSLRFSDYGKLNPLLDLPYSGNWSDSKVLGSTGQSYCAIIRDRGTRT

SEQ ID NO: 92130 - protein, 107 aa, Glycine max
  Coding DNA Sequence Number=SeqID_445
MRDTMHEPQANLGADQKGLHALAIRGLHVLTFRGLHALAIRGLHVLTFVGLHALTFRGLHVLANRGLHALTLRGLHVLANVGLHVLTIRGLHALTSRGLHVLALRGL

SEQ ID NO: 92131 - protein, 95 aa, Glycine max
  Coding DNA Sequence Number=SeqID_446
MKLLLHLPLVKVKKQKGKNLVKKSTPKEEGQPLMVKEECKETNIKETSPLRQPPHLLLFKKTLVSTATPLGLEVIRQVKELLDEGLVLLGTKSLK

SEQ ID NO: 92132 - protein, 75 aa, Glycine max
  Coding DNA Sequence Number=SeqID_447
IDSRCFDDNKDDNKKSKRMTSRLSQEQFKNQESSFKFQVSSFKFQESRIKNQESRIKSNQDQDSRIKKRLNQDKY

SEQ ID NO: 92133 - protein, 65 aa, Glycine max
  Coding DNA Sequence Number=SeqID_448
MTLGAEFNVESLTCRDWNTSSKVYQKVCVRFCARKKRTTYISMKFSRFKKLGLGFDMLMKDRDTG

SEQ ID NO: 92134 - protein, 30 aa, Glycine max
  Coding DNA Sequence Number=SeqID_449
MSAGKYAVAASHDRCRLEMFDRRHQVMLLF

SEQ ID NO: 92135 - protein, 249 aa, Glycine max
  Coding DNA Sequence Number=SeqID_450
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLALSLPAAQPPATAAHGEAHSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 92136 - protein, 51 aa, Glycine max
  Coding DNA Sequence Number=SeqID_451
MVILTQIWDIESGDVGYVGVAQCLFFGEQVQAIIFDHCNKYKHKLLGDRLR

SEQ ID NO: 92137 - protein, 218 aa, Glycine max
  Coding DNA Sequence Number=SeqID_452
  Gene Ontology: Mol. function=transporter activity; Cellular component= 1-2nm peptidoglycan-based cell wall; Biological process=transport
  Homolog annotation: Hit_ID=A0G609; Match level="QueryCoverage=91%, HitCoverage=93%, E-value=1e-82, Identity=78%"; Hit description=Polar amino acid ABC transporter, inner membrane subunit precursor
  Pfam annotation: Domain name=BPD_transp_1; Domain location=18-214; Score=72.7; E_value=1.2e-18; Accession=PF00528.13; Description =Binding-protein-dependent transport s
MAWHRGRTPAVPPAAGDAGLVITLLLSIAAIAGSTLLGLLAAVLRTSRLPIAREIAVLYTELFRGTPVLITLMFIYFGVAYFGYEINLFAAGILGLSIYQGAYIAEVFRAGIEAVPKGQWEVSWILGLSKRQTFLSVVLPQTRGIVLPPLVGQYLSLIKDTSIVSMIGMSELMHQGQAIVDRIGQPVVVYGLVALLYFAVCFPLSRWVQHHQTRSQLS

SEQ ID NO: 92138 - protein, 102 aa, Glycine max
  Coding DNA Sequence Number=SeqID_453
  Subcellular localization annotation: CTP_CleavageSite=70; ConfidenceScore=5.26e-01
LSPPVQLLTGWCVTAKARRTSALASVAVPPARNHHTPPRLMRRYRARPIRHSGCATVGKGDRCGPLPLLRQLAKGGCAARRLSWVTPGFSQSRRCKTTASEL

SEQ ID NO: 92139 - protein, 179 aa, Glycine max
  Coding DNA Sequence Number=SeqID_454
MAAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSPEEVMSASEADSTEDSGPREMAISGGSSSYHRYGQLALDDTDVVGIRTGDVLDRITAVAGNSSAG

SEQ ID NO: 92140 - protein, 96 aa, Glycine max
  Coding DNA Sequence Number=SeqID_455
MEKSEKKNHSEKKLKKAYITWDENDLESSDDSENEEINLCLMAKVTKVMKRRGHGISTCYFKKNYSNIKMIWVPKGSSVYTNMQGPNKIWVPKSKT

SEQ ID NO: 92141 - protein, 114 aa, Glycine max
  Coding DNA Sequence Number=SeqID_456
MTKNGLKSSRYHPRKRLGSVTEENEGGACHPARPGELGCFLQKAPPSGELPGRPKTSRIVQQCFLLTSGMSQNFVDCLTMGVKYLEVVKRGLHPNNRMVGKFEVQEIANTRLGQ

SEQ ID NO: 92142 - protein, 75 aa, Glycine max
  Coding DNA Sequence Number=SeqID_457
MTKGANYDVTNFHCSEDTSCYNEASSFANDTSLESSCSMTNFRYGKSCTRCGVCLLNILVFNIHIRCGKSSHSFT

SEQ ID NO: 92143 - protein, 164 aa, Glycine max
  Coding DNA Sequence Number=SeqID_458
RNIQLNRSGYRYIEQLTEMPQNVLTMPLGYINGVGTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMPLALG

SEQ ID NO: 92144 - protein, 45 aa, Glycine max
  Coding DNA Sequence Number=SeqID_459
FSTFTGIGCKPLVYLLKRPVTIQSEITRLVRWWGCRKTTSKVQNK

SEQ ID NO: 92145 - protein, 67 aa, Glycine max
  Coding DNA Sequence Number=SeqID_460
MWVLWGLSEDNFPIDFRREEKEKSDFRKEDDKEKREGKVFEHAWLLKSQFLTYKHNNIGFLWITNVN

SEQ ID NO: 92146 - protein, 65 aa, Glycine max
  Coding DNA Sequence Number=SeqID_461
MSVKNLVGRLGGDQSGSQCFARMLQPYGINIGLKEHSNRVTPKAYTPKSPSGPLPPDSGPTQKIF

SEQ ID NO: 92147 - protein, 114 aa, Glycine max
  Coding DNA Sequence Number=SeqID_462
  Subcellular localization annotation: CTP_CleavageSite=69; ConfidenceScore=5.19e-01
MAFLGETSSQTVVNSTLGFFFQMDPLFTTIVVFPFKLPLQFPFEYLTGNQFRFQCMQMKDDADVNTMLMCNHEFSFVGPIELLCSIARTPDDILNLLQAIMTPTHDALLYYNGR

SEQ ID NO: 92148 - protein, 132 aa, Glycine max
  Coding DNA Sequence Number=SeqID_463
MRILSLMTLSTLMVKRELNKCFQHLEREHEDLKKPYQAHLVDFVLKTTSPGDVQDTFVCEDVKALLDEKLRGYEVLKELLPKIEKLYEEIETLRDNLGKFFGSHEALNKIIKVQKNPKTNLAMVSKAKGCAW

SEQ ID NO: 92149 - protein, 93 aa, Glycine max
  Coding DNA Sequence Number=SeqID_464
RGRGGHHCHGWRRKRKERGRMRRWKRDSTSEEFEVSCGAFFEESEGDTAEKVFPIEGAVGSFGSEKVKVGGGGVNLMEACLWGFYGGWIFELQ

SEQ ID NO: 92150 - protein, 140 aa, Glycine max
  Coding DNA Sequence Number=SeqID_465
  Gene Ontology: Mol. function=ER retention sequence binding; Cellular component=endoplasmic reticulum; Biological process=protein retention in ER
  Homolog annotation: Hit_ID=A7R7N5; Match level="QueryCoverage=83%, HitCoverage=42%, E-value=2e-41, Identity=65%"; Hit description=ER lumen protein retaining receptor
  Pfam annotation: Domain name=ER_lumen_recept; Domain location=2-140; Score=-96.1; E_value=3.6e-06; Accession=PF00810.9; Description=ER lumen protein retaining receptor
MCVGWGCLCVGVGVQLHDCVGGLVVPSAILAILIHPFTTHWRLVRIVWAFSLYLEAVSVLPQLRFMQNAKMVETFTGYYVFALGVSRFIALAYWLIQIYETRGAYLFLVGSGYFWFLAAFLSEMVQSFILADFCYYYMKR

SEQ ID NO: 92151 - protein, 53 aa, Glycine max
  Coding DNA Sequence Number=SeqID_466
MAVMMVIVVGGMTTIVRMVVAVAVAVTGMMVIKMMMIEILSYNLILPQDTIMM

SEQ ID NO: 92152 - protein, 220 aa, Glycine max
  Coding DNA Sequence Number=SeqID_467
MRSWVRGQWIPFDTDALSQFLGDPLVLEEGQQCEFSQRKNKANGFDEEAIAQLLCILGQDFTRTTVGKRVRIMRTSMTTLTQTWMTLLLSNVLPSYHNSDLPLPKCQLVYAILTWMSVHVAQVIADAIYLFASMAPSRHPLDPDKSNRALGFPVLITGLCQSYEVPITPSMVIRPPITQAFIEKYCTPRQAQGDAHQAAGAPPPPQQDDPSRPLGMEHYL

SEQ ID NO: 92153 - protein, 102 aa, Glycine max
  Coding DNA Sequence Number=SeqID_468
MGRITLESLTPNVILESYLDTPHVIKFTATSSQNQPVSNPYVDYQLEKVRELIGCLLRKNHLQSHIIGDLKDKVQARNFLKHTTLLSEIEPQHIDDVMTNEY

SEQ ID NO: 92154 - protein, 399 aa, Glycine max
  Coding DNA Sequence Number=SeqID_469
  Gene Ontology: Mol. function=hydrolase activity, hydrolyzing O -glycosyl compounds; Cellular component=periplasmic space; Biological process=polysaccharide catabolic process
  Homolog annotation: Hit_ID=Q54468; Match level="QueryCoverage=98%, HitCoverage=44%, E-value=0.0, Identity=99%"; Hit description =Chitobiase precursor
  Pfam annotation: Domain name=Glyco_hydro_20; Domain location=56-399; Score=429.0; E_value=6.9e-126; Accession=PF00728.13; Description =Glycosyl hydrolase family 20, catalytic domain
MAVSGAYELKIGKKEARVIGFDQAGVFYGLQSILSLVPSDGSGKIATLDASDAPRFEYRGIFLDVARNFHKKDAVLRLLDQMAAYKLNKFHFHLSDDEGWRIEIPGLPELTEVGGQRCHDLSETTCLLPQYGQGPDVYGGFFSRQDYIDIIKYAQARQIEVIPEIDMPAHARAAVVSMEARYKKLHAAGKEQEANEFRLVDPTDTSNTTSVQFFNRQSYLNPCLDSSQRFVDKVIGEIAQMHKEAGQPIKTWHFGGDEAKNIRLGAGYTDKAKPEPGKGIIDQSNEDKPWAKSQVCQTMIKEGKVADMEHLPSYFGQEVSKLVKAHGIDRMQAWQDGLKDAESAKAFATSRVGVNFWDTLYWGGFDSVNDWANKGYEVVVSNPDYVYMDFPYEGTRTSA

SEQ ID NO: 92155 - protein, 22 aa, Glycine max
  Coding DNA Sequence Number=SeqID_470
MTDRGYGKVWMTPLPVKEDKSG

SEQ ID NO: 92156 - protein, 235 aa, Glycine max
  Coding DNA Sequence Number=SeqID_471
  Homolog annotation: Hit_ID=Q2AA09; Match level="QueryCoverage=67%, HitCoverage=50%, E-value=1e-07, Identity=30%"; Hit description =Retrotransposon gag protein
MERSMIDAASGGALGDMTPAEARNLIEKMASNSQQFSATNDAIVIRGVHEVATNSAASPETKKLEGKLDALVNLVTQLALNQKSVPVARVCGLCSSADHHTDLCPSMQQPGAIEQPEAYAANIYNRPPQPQQQNQPQQNNYDLSSNRYNPGWRNHPNLRWSSPQQQQQQPVPSFQNVAGPSRPYIPPPIQQQQQPQKQPTVEAPTQPSLEELVRQMTMQNMQFQQETQSFHSELD

SEQ ID NO: 92157 - protein, 84 aa, Glycine max
  Coding DNA Sequence Number=SeqID_472
MTTLCWKGTCALWFGHPTVLRQYMLSHTTWLVSKMDPVKYILRSPLNDYQPMHSEFPDEDIMASFEEKLDKNRVIEAVPESNKH

SEQ ID NO: 92158 - protein, 112 aa, Glycine max
  Coding DNA Sequence Number=SeqID_473
MGDQEETQEQMKADMSALKEQMASMMEAISAAEADPTLPATAHHPLPNAIGREGSKLGHISNPHLGYNQVAYPYGLPPNYMPPVMHDDAGHVPPLVLEGEPPRTVRRGSRGS

SEQ ID NO: 92159 - protein, 104 aa, Glycine max
  Coding DNA Sequence Number=SeqID_474
  Pfam annotation: Domain name=Ins_element1; Domain location=4-60; Score=-22.4; E_value=0.02; Accession=PF03811.4; Description =Insertion element protein
  Subcellular localization annotation: CTP_CleavageSite=73; ConfidenceScore=5.77e-01
VLPVASVSISCPSCSATDGVVRNGKKHRRTSALASVAVTLRVTTTPAALNAPLQGASHSPFRLRNCWEGRSVRASSLLRQLAKGGCAARRLSWVTPGFSPVTTL

SEQ ID NO: 92160 - protein, 44 aa, Glycine max
  Coding DNA Sequence Number=SeqID_475
EKEGEACHPARPGELGCFLQKAPPSGGTSWKAQVGRVAICTPIY

SEQ ID NO: 92161 - protein, 68 aa, Glycine max
  Coding DNA Sequence Number=SeqID_476
  Subcellular localization annotation: CTP_CleavageSite=55; ConfidenceScore=5.02e-01
MTKLGLCLSSGPPPLDDKRGADNRKVRITRKVSSAGYQLSGHGNKKRCGRQKRGSCSSVSSNEELRPT

SEQ ID NO: 92162 - protein, 234 aa, Glycine max
  Coding DNA Sequence Number=SeqID_477
MYEYLEEERAPDLESILADFMRYQASSKGSYYGMQQQGTQFERNQSSAGYQWESSWQPDYYDKAEGVLNLDDLLMQFKDTVDSMQQAFTRTATQISKLVDDMANTAARQEEEWAEIETHEERIFKVTSIHHQMTTEEKTFEVSSTPKYSCPASADYVGGTEKGRLELSEEEVEQEIVLSASTMIQQIPLEKELGDEIDSLVDNEKCDDPKDNCVDHVVFEELEKMRPPEKPIIN

SEQ ID NO: 92163 - protein, 39 aa, Glycine max
  Coding DNA Sequence Number=SeqID_478
MAFFLSYLDYKAQNAQVSNALGNGNFVHTPYISKIPTIK

SEQ ID NO: 92164 - protein, 273 aa, Glycine max
  Coding DNA Sequence Number=SeqID_479
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=2e-32, Identity=30%"; Hit description= UPI00006A17C9 related cluster
  Subcellular localization annotation: CTP_CleavageSite=65; ConfidenceScore=5.75e-01
MARTSSPLKMRTSSPLQARTSSPLKAMACSPLKVRVCSPLKTRTCSPLKARMCSPLKVRACSPLMARTSSPLQARTSSPLKERVCSLLKVRMCSPLKVRTCSPLMARTCSPLKVRACSPLMTRTSSPLKLRTTSPLQAKTSSPLKQRACSPLKVRMRNPLKVRTCSPLMARTCSPQKVRACSPLKTRTCSPLKARTCSPLNARACSPLKVKESRPLKTRTCSSLKARTCSPLKVRACSPLMARMCSTLKVRVCRPLMARTCSPLKAWMCSPLK

SEQ ID NO: 92165 - protein, 148 aa, Glycine max
  Coding DNA Sequence Number=SeqID_480
  Pfam annotation: Domain name=zf-CCHC; Domain location=74-91; Score =24.2; E_value=0.00032; Accession=PF00098.14; Description=Zinc knuckle
MSLATLFGKLQEHEMELLRLNKHEENDKKKKGIALKASSSIQEESYKEDLIDLDEDDDLSLFVKRRIEDSSSTPKCYECNQPEHLRVDCPIFKKRMEKSEKKNVSEKKAKRAYITWDDNDLESSKDSKNEVINLSLMAKSYESDEKNH

SEQ ID NO: 92166 - protein, 92 aa, Glycine max
  Coding DNA Sequence Number=SeqID_481
  Pfam annotation: Domain name=zf-CCHC; Domain location=20-37; Score =33.4; E_value=8.2e-07; Accession=PF00098.14; Description=Zinc knuckle
MERSHNFNNGKRSQEVSPTLKCYKCNQPGHIKANCPTNELWPEKNEKKSYKERRSKKAYIAWDDNDSSDGSEKEINLLSKDYESDENISQED

SEQ ID NO: 92167 - protein, 118 aa, Glycine max
  Coding DNA Sequence Number=SeqID_482
MTRGNPGDLQPFDLEIDTTFHRLVRHSVHPGHSVHFEHPDHFEHSVAGDSEYSDFEHLAINFHTKNMAQAPPHERTLREMAAPDFTYESLCIQYPDEDVPYVLKTGLIHLLPKFHALA

SEQ ID NO: 92168 - protein, 190 aa, Glycine max
  Coding DNA Sequence Number=SeqID_483
MESNTATAAATITVIEADPALRTVVHHPVPNIVGQGRSTLGHVSDPHPGYNRGAYPYGLPPNYAPPAMHEDAGHIAPLILEGQPPRHPDGAHEDPREHAQEDVGSYSPFPAEGPAPNALPQPNITGKPRTHPTQPMLMSVGGPPPAAEGKEKLDLLEERLKAIEGFGNYPFVDMTDLCLVPNIVIPPKFK

SEQ ID NO: 92169 - protein, 93 aa, Glycine max
  Coding DNA Sequence Number=SeqID_484
MCLLGKSCEAKKSSTHRIFGWQSKGEDHFRSWFPFFPYLVVTILYCLDIVWSKVMQSYPARELDRKLQVDWAKDAREGPRVLMSLRVDFGPMG

SEQ ID NO: 92170 - protein, 283 aa, Glycine max
  Coding DNA Sequence Number=SeqID_485
  Gene Ontology: Mol. function=oxidoreductase activity, acting on the aldehyde or oxo group of donors; Cellular component=mitochondrion; Biological process=electron transport
  Homolog annotation: Hit_ID=A8GF15; Match level="QueryCoverage=100%, HitCoverage=24%, E-value=1e-143, Identity=88%"; Hit description =Pyruvate flavodoxin/ferredoxin oxidoreductase domain protein
  Pfam annotation: Domain name=TPP_enzyme_C; Domain location=148-283; Score=-44.3; E_value=0.027; Accession=PF02775.12; Description =Thiamine pyrophosphate enzyme, C-termina
MASRLDNLTAEKDNYDFFLQLPEIDPAQLERIDIRTSQLITPLFEYSGACSGCGETPYIKLLTQLYGDRLLIANATGCSSIYGGNLPTTPYTTNAEGRGPAWANSLFEDNAEFGLGFRLTVDQHRARVLRLLNALAPQLPERLVNALQMGDVAPEPRRKQIAELRTLLANLEGEDARQLAAGADYLVDKSIWLIGGDGWAYDIGFGGLDHVLSLTENVNVLVLDTQCYSNTGGQQSKATPLGAVTKFGEHGKRKARKDLGVSMMMYGHVYVAQISLGAQLNQT

SEQ ID NO: 92171 - protein, 102 aa, Glycine max
  Coding DNA Sequence Number=SeqID_486
  Gene Ontology: Mol. function=antiporter activity; Cellular component =integral to membrane; Biological process=transposition
  Homolog annotation: Hit_ID=A7VN75; Match level="QueryCoverage=100%, HitCoverage=92%, E-value=6e-50, Identity=99%"; Hit description =Multidrug efflux pump SsmE
  Pfam annotation: Domain name=Multi_Drug_Res; Domain location=1-86; Score=118.0; E_value=2.9e-32; Accession=PF00893.10; Description =Small Multidrug Resistance protein
MAIVAEVIATTMLKASEGFTRLWPSLLVVLGYGVAFWGLSMVVKSMPLGIVYAIWSGMGIVLVSVAAVFVYQQKLDWPAIVGMGLIIAGVLVINLLSKATVH

SEQ ID NO: 92172 - protein, 214 aa, Glycine max
  Coding DNA Sequence Number=SeqID_487
  Gene Ontology: Cellular component=integral to membrane
  Homolog annotation: Hit_ID=A4W8D0; Match level="QueryCoverage=92%, HitCoverage=61%, E-value=6e-69, Identity=65%"; Hit description =Putative membrane protein precursor
MGYRLYLRLGLPGGTITRIFSLSIATNWLGYILLGGVVFVAGMVPIPPGWFIGEGTLRVIGAVLLAMVAVYLWACAFAKKRRWTVKGQHLQLPSLRMALFQFAVSCANWMVMGTIIWLLLAREVDYPIVLGVLLISSIAGVIIHIPAGIGVLEAVFLALLSGQHASHGEIIAALLAYRVLYFILPLLLALVLYLWLESRAKHLRQKNERKMAAR

SEQ ID NO: 92173 - protein, 237 aa, Glycine max
  Coding DNA Sequence Number=SeqID_488
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRGLVVRPPGHTPSSTRAGNEREPTNGEGRIKATRAESQWIVAARPLCHLQYPVAYLSRLQRILPAARWELRFKASRRANPPHEGHQRHVPLGGRGPLLLVATRTAGARVAPSPDSDLEAFSHNPTH

SEQ ID NO: 92174 - protein, 50 aa, Glycine max
  Coding DNA Sequence Number=SeqID_489
MRQASDVKEVLIGSHPLAQCALCAKRIILHALSEYSSALSVPNPYPLAEG

SEQ ID NO: 92175 - protein, 107 aa, Glycine max
  Coding DNA Sequence Number=SeqID_490
  Homolog annotation: Hit_ID=Q5XM22; Match level="QueryCoverage=85%, HitCoverage=66%, E-value=2e-16, Identity=42%"; Hit description =Resistance-like protein HAAS-2
CTLFAKKSATYVHVVFLDTLHDLSQTRRYAWGAAALVHMYDHLNGACISSSRQLASYITLLQCWVYEHFPSVAECIADPDYDEVSLHACRWIATKKTVKIISTETYR

SEQ ID NO: 92176 - protein, 133 aa, Glycine max
  Coding DNA Sequence Number=SeqID_491
MQFADHLLPVGQLCLVPGQVSADYMEWFFRISHPFMTPTQAADQQRDAPAADPEDYIQTPSPQVPVAFDPPPYVDDYKGYEAIAQRLERVLNLRIVTAGTELYDIMQDYPTIARGGPSADVTVRARQRHRTDF

SEQ ID NO: 92177 - protein, 178 aa, Glycine max
  Coding DNA Sequence Number=SeqID_492
MIEVSVESIASLTQYYDQPLRCFTFGDFQLVSTMEVGIPRRHLEEKAKALADQGEWASFIDVLELLVFGVVLFPNVDGLVDLAVIDTFLAYHHRKESLVIVVLVDAYDTFDRRCEKSNIRIVCCTPALYVRLVSHLFRHESRPICPLQGHRMFAEKGKANWEQLLPSMVRASINWFPR

SEQ ID NO: 92178 - protein, 59 aa, Glycine max
  Coding DNA Sequence Number=SeqID_493
MSEVVLSTQCFDIASFASSYSALHIHFRSPLGAMWLKGVKTPVCVSGNHDERAKRAGCA

SEQ ID NO: 92179 - protein, 95 aa, Glycine max
  Coding DNA Sequence Number=SeqID_494
MTINSWGSELRFDGGGCTKSARQSIRWAPGLDGGGCMNGNQDARTALGNQFSGSSDSKMANMLARNENQFMGLRISLMVRMHEQLAMAKIIRGAP

SEQ ID NO: 92180 - protein, 150 aa, Glycine max
  Coding DNA Sequence Number=SeqID_495
  Homolog annotation: Hit_ID=A5AKH3; Match level="QueryCoverage=82%, HitCoverage=21%, E-value=4e-12, Identity=30%"; Hit description =Putative uncharacterized protein
  Pfam annotation: Domain name=zf-CCHC; Domain location=25-42; Score =26.4; E_value=0.00011; Accession=PF00098.14; Description=Zinc knuckle
MATKGNRRRSNFNPKKKGEESSSVPKCYECDQPGHIRVDCPIFKRRMDKSDKKTFKDKKGKKDYITWEDNDMNSSGDSENEVVNFSLMAKNHESEEEDSLKKSWYIDSGCSKHMTMEAMSSKVILMMPKNQELSKFFKQRFKNQEKTQSR

SEQ ID NO: 92181 - protein, 145 aa, Glycine max
  Coding DNA Sequence Number=SeqID_496
MEASKREEEENLLRMKKLKVRIEELIKLELRMKTSTLLRIITDVLAKLRTVESILEKEEDKLEEPFEMEEKVEVAAETAQNVPEVAVGERTPIVFMKDYLFNIENVQNLFNTPIFHTYVKIVCRLGPLHGEPSNFSIPFPQFPYD

SEQ ID NO: 92182 - protein, 56 aa, Glycine max
  Coding DNA Sequence Number=SeqID_497
MFIVAVVGSSSSTYEMDEDQWMYDSIMSKEVDMDDQNEQECGVNEHVDCSDAFNTS

SEQ ID NO: 92183 - protein, 56 aa, Glycine max
  Coding DNA Sequence Number=SeqID_498
MMIWKQRAKLVMHTARWALKHPAYGIMILRLGIYAGRQKRGSCSYVPSIKEKIIPT

SEQ ID NO: 92184 - protein, 102 aa, Glycine max
  Coding DNA Sequence Number=SeqID_499
MFKCYCIAFLASSYFAHIKPSSSGGGGASVAQEHDTEEPPTPTPVEDEEETTPDQTPRPSPAPAHIPEDVAPIAEPEQLIKDSSTTPTLDLNEDQPQEEQDI

SEQ ID NO: 92185 - protein, 178 aa, Glycine max
  Coding DNA Sequence Number=SeqID_500
MVIDVVVWKEVVGLDMGGVHKFHEISDGYNKMQTYRGILLDPARNLRNRLGVGGLTTKDRMLVYHITYIFTSRSSNHALVIDDDLHIVYGMKSGIKMNWVLLIKDIILKSHHLVDYEFLYVVLASTFIDYFNVDVSNESMDFTKASSEITERHLKKLGMRFIDHEWIIAEKPLAGNFD

SEQ ID NO: 92186 - protein, 109 aa, Glycine max
  Coding DNA Sequence Number=SeqID_501
MTLPSYSNFVWGLSFVDLLILASRLTVLNDSYNVKQRIIQCSDQECKKYQKVGKRVFSLVFLDPSLPRLASSSPGTPNSFMVKKPTLLGELIASALSFSLPGRATTAPK

SEQ ID NO: 92187 - protein, 118 aa, Glycine max
  Coding DNA Sequence Number=SeqID_502
MLRRPQMSRHLIRRGQAGSFDTERYLRHLVRQQAANHRAHVQTHDCLYQLSLSMQSQGFASFSCPTPDQFRAEVAWPGDWPEAQAGEAPPEAPGDGEEAHEDEEMTDLLDFLGGSGAT

SEQ ID NO: 92188 - protein, 75 aa, Glycine max
  Coding DNA Sequence Number=SeqID_503
DVELLGCCGILEGLMGPGVERNEDKGYVGVVLGDMSRGSGDLGDVRRAPGSQQIKGTKTTKQGGLCGGWPAVNFD

SEQ ID NO: 92189 - protein, 59 aa, Glycine max
  Coding DNA Sequence Number=SeqID_504
MEKDNLGKILMLSQMKKKMKEAMRILKIMGLEQIMNFQENGKPQEIIPSTTLLVISQKG

SEQ ID NO: 92190 - protein, 15 aa, Glycine max
  Coding DNA Sequence Number=SeqID_505
VNAVKIFPEARNGLG

SEQ ID NO: 92191 - protein, 99 aa, Glycine max
  Coding DNA Sequence Number=SeqID_506
  Subcellular localization annotation: CTP_CleavageSite=20; ConfidenceScore=5.24e-01
MEPKSRIDKYKIQQSSQPVVATYPSAGGRRVTRGMRVPRKEYARSRHQRLSEENVGKTGKDAIYELLSERFGSCIYARGRVFPFAPTYSSIWDEKIRPT

SEQ ID NO: 92192 - protein, 202 aa, Glycine max
  Coding DNA Sequence Number=SeqID_507
  Subcellular localization annotation: CTP_CleavageSite=28; ConfidenceScore=5.64e-01
MDTPPSSPPPPPPSAASHSTSTLKRTTKATRLRSLATRPVGVERPLVHVDPAIGKADSLHRKKLRTYLGIVARDKVEVTYENWKQVHAAQKDLMGGYSGCAEKDTDHLETKHCPLRVVSWGLWISRKQDSLEEQASQGSFVAHGRQDVLTAAIGRPEHPDRVCAAGTDVMIKQYFGSTPRTSNTSSSMAPEDLEQLTQKIKD

SEQ ID NO: 92193 - protein, 50 aa, Glycine max
  Coding DNA Sequence Number=SeqID_508
MSVEIKSESTDKSFKVNGHRLKPFLTNPSFFTFSGGGDLLTSSYFSSAMT

SEQ ID NO: 92194 - protein, 87 aa, Glycine max
  Coding DNA Sequence Number=SeqID_509
MVLASCVRVTPLWERGLEDLSGSYHSQMVSDEGRQEVFIHHWEWGEFLKWPRREVPCCVGITGRASRVRSWNLGSFPLGGCLRLHGC

SEQ ID NO: 92195 - protein, 223 aa, Glycine max
  Coding DNA Sequence Number=SeqID_510
MQSQGLALPPEPLVGPSGPRVSTKGNCVDPSRNDLETGDSDRCGLYIEADPARLVALGRVYEGSTIIHNTPLLLGQGKVGVEEVTDADALVPVPTDDIIDEENFKAPEEDEELRALKTELGKARLAKEKFKLVATDIRKECSGELKLRREERDQSQAHSMVLKEELAACSRSKRNLSQRLCETETNMLAIVSKYQEELNLATAHEHKVAGEYARVYAEKEARG

SEQ ID NO: 92196 - protein, 100 aa, Glycine max
  Coding DNA Sequence Number=SeqID_511
  Subcellular localization annotation: CTP_CleavageSite=65; ConfidenceScore=5.38e-01
MKTPQNAQNSYQHNHLNFSIRAGSSLPTQVEGPPTTEKTPAQYAAPATPRLTNNTTPGTSYDNPRRSPRDQFSPIPMAYSELWPSLLENHLVVGIPGFIP

SEQ ID NO: 92197 - protein, 132 aa, Glycine max
  Coding DNA Sequence Number=SeqID_512
MECLEGVWETLEGNERCRFRGTIRLTTTSLVHSEEPARTLQHPVEWILPTPTPYRLVEPVQVIKVSSSEEDLKEDPEELPPKPDMDALDLPEDDEDPLPDVDSPEDIMSASEADSTEESGPGGTANSEDSSS

SEQ ID NO: 92198 - protein, 104 aa, Glycine max
  Coding DNA Sequence Number=SeqID_513
MGQNTPNDYDDGWLKFSQSVIKAKKEIGKEELPKLWWRKSRVVATYPSAGGRSVTRGMRVPRKECAQSRHQRLFEENVGKTGKDAIYELLSERFGSCIYARGRC

SEQ ID NO: 92199 - protein, 51 aa, Glycine max
  Coding DNA Sequence Number=SeqID_514
VTGCTICGGAHEFGHCIPLEEQMQEVSYMGNQQRQGYNQGGFSGFQEGQWR

SEQ ID NO: 92200 - protein, 76 aa, Glycine max
  Coding DNA Sequence Number=SeqID_515
MEDRIATDQAPPLPGAKQAENVAAGQPSSSEQTLTHKEGGDMVNVPLKKMAGKQPMGRFGVRVFAVFGACTQFHKG

SEQ ID NO: 92201 - protein, 219 aa, Glycine max
  Coding DNA Sequence Number=SeqID_516
  Subcellular localization annotation: CTP_CleavageSite=41; ConfidenceScore=5.23e-01
MEEPSKKRKGSSSTAAAAAHRRHGPSEASTTPIHPSLSSPRSSTLFSSDDQHLRYLSQFSSRIILDPKYLDVEFFNDETFDCYQVFQNSGLVYFMSLKLPHYPELVKVFYCNLKIQDGIISSEVHGTPMIIDQSLLFSLTHLPSQGAPFEGTIVDDWKFDYSSHDARRMVWFVLISGIVIIKKGEIVDKGSSRCFDDAKRSHASQSFIQDKAIKDIQDG

SEQ ID NO: 92202 - protein, 101 aa, Glycine max
  Coding DNA Sequence Number=SeqID_517
  Subcellular localization annotation: CTP_CleavageSite=63; ConfidenceScore=5.76e-01
VPPCSATDGVVRNGKSTARTSALASVAVTLRVTTTPAALNAPLQGASHSPFRLRNCWEGRSVRASSLLRQLAKGGCAARRLSWVTPGFSQSRRCKTTASEL

SEQ ID NO: 92203 - protein, 188 aa, Glycine max
  Coding DNA Sequence Number=SeqID_518
  Gene Ontology: Mol. function=aspartic-type endopeptidase activity; Cellular component=small subunit processome; Biological process=DNA integration
  Homolog annotation: Hit_ID=A5AFV0; Match level="QueryCoverage=84%, HitCoverage=13%, E-value=7e-19, Identity=33%"; Hit description =Putative uncharacterized protein
  Pfam annotation: Domain name=zf-CCHC; Domain location=126-143; Score =12.0; E_value=0.023; Accession=PF00098.14; Description=Zinc knuckle
MKVTALKQTSHDMIAHVGKARAAVEELRKFLVADSLEEVNKKLDKFYMVLILRSLHSDFDHVRDQVLAGDQVPSMDSLITRLLRVPHLSKDENPTDSVETSAMVASRGRGGGRNSRGGRNGRGGRPHCTYCKRMGHTQENCYSLHGFPDKVAQVSRSEKAESKFSDEEYQEYLKLKSERPSNQAQSSS

SEQ ID NO: 92204 - protein, 170 aa, Glycine max
  Coding DNA Sequence Number=SeqID_519
MVQKKDKELRGSSNGPIGGYRRWLKAHMQGLDWLPSLRTTKGVEVEAPEKDEEVQALRAELEKAQTVKERFKSAALKIRKQNAKLRDVNIATTKALEQETKRARREEHDWNKFRGALWGSNSLPKVQESQRLCETKTNMLAIIRKYPEELNLATTHEHKVADEYARVYAE

SEQ ID NO: 92205 - protein, 42 aa, Glycine max
  Coding DNA Sequence Number=SeqID_520
GRLRQKDNLTYKAQPQKITDQRMKSLRGKEIAVVKVQWGTGL

SEQ ID NO: 92206 - protein, 98 aa, Glycine max
  Coding DNA Sequence Number=SeqID_521
MPAQPGGSSCALSELILVERIIDNSYASRIFYALSHELLRLADGSLSQRIGLNSNSSAQRANSLSPIQKYDIPEKKLGLALRVALSEFCSSNSSANLA

SEQ ID NO: 92207 - protein, 55 aa, Glycine max
  Coding DNA Sequence Number=SeqID_522
MVREFGYVQTIPPHSLGSRLSFEDIDDRWMHFFEYLAPVGQICVVPGQCAPDYMH

SEQ ID NO: 92208 - protein, 135 aa, Glycine max
  Coding DNA Sequence Number=SeqID_523
  Homolog annotation: Hit_ID=A7UQU7; Match level="QueryCoverage=97%, HitCoverage=22%, E-value=2e-18, Identity=34%"; Hit description=IMP dehydrogenase/GMP reductase, putative
MSWGIRCTLFANKNATHVHVVFLDAFRDLSQSGSYAWGAATLVYMYDNLSGACKSGDRQLARYITLLHCWIYEYFPSISKAFMDPDYDERSPRACRWTSTKASTKLIPASTYQKHLDRLTITDVCWMPYSDHRAV

SEQ ID NO: 92209 - protein, 176 aa, Glycine max
  Coding DNA Sequence Number=SeqID_524
MWFTDENKKTDFKMIYAVKNKAVAGLDSKMQTYRGMLLDPTRNLRNRLGVGGLTAENRMLVYLITHTLTPRSNNHAQVIDDDLQIVYGLKSCIQMNWELLIEDIMLKNCRLVDYEFPYVVLASRFIDYFNIDVSKEIVDFTKASNEITERHLKKLGMRYICWTSGLNNLREGGGGG

SEQ ID NO: 92210 - protein, 229 aa, Glycine max
  Coding DNA Sequence Number=SeqID_525
TLVSTATPLMLEVIPQVKELLDEGLVLKSLNPRALLVPKIGIIRHQIPKIGDMMNVLSGATLVCKITHAANIFMIRVHMDSLARLVRLARIMRQERYLARLASWENLEENLRSICTLSASSARSARRLSFPALRVPSLLSGCSLTRAKRENGAKRTFEGAQLEALTETLSCAICGGAHESGYCISIEDHAHEVNYMGNQPRQNFNVGGFSGFQQGQNYNQRYGQWRAHP

SEQ ID NO: 92211 - protein, 147 aa, Glycine max
  Coding DNA Sequence Number=SeqID_526
MDDNIVNEVIIDFTNTSIMDKDPEVSNVVKVDEVMHPSQQKESASKQLETSHEATPNEKDVPDVVIIYSTSLSHTPINYAPPNIGTKGQVQEMIGQAMDTFVERQRQENEKLKLYAKHYQHSTHQSWCCIDSELATSSVYDNKDINS

SEQ ID NO: 92212 - protein, 126 aa, Glycine max
  Coding DNA Sequence Number=SeqID_527
MAFSSSSVLCQSSHSKSSQKSLELGQTQEEQLPHQIPPIEVPELQTFHQFSQSRVKLQARPPAQGTTLLIEWTLEELPSLWASGPADANGGTGVDGEGMSSVLTLVFLFLDAIYNEKNSKFTLDYI

SEQ ID NO: 92213 - protein, 126 aa, Glycine max
  Coding DNA Sequence Number=SeqID_528
  Homolog annotation: Hit_ID=A2Q1D6; Match level="QueryCoverage=67%, HitCoverage=13%, E-value=4e-11, Identity=42%"; Hit description =Ovarian tumour, otubain, related
MLIVLRHSILLMCFLLEMMFCSGLDQSLMKFDLWRARLDGEVNVWESQSLVGHPYAGQLTKDKKIIIADMTRSMVKPRNILLMLKEHNVNSCTTIKQIYNARSAYRSSIRGSDTEMQHLMKLLARD

SEQ ID NO: 92214 - protein, 102 aa, Glycine max
  Coding DNA Sequence Number=SeqID_529
  Subcellular localization annotation: CTP_CleavageSite=43; ConfidenceScore=5.24e-01
MVFSLFFLGPSSLRLAFGSPGPPNNFKAKGLAHLGKLKLAWASCNRSKGCFKGLGGSEVEGIERIKKEKEEERRGNETEALPNRNYDRPYVVSRSVFFAPIG

SEQ ID NO: 92215 - protein, 144 aa, Glycine max
  Coding DNA Sequence Number=SeqID_530
MVREFGYVQTIPPHSLGSRLSFEDIDDRWMHFFEYLAPVGQICVVPGQCAPDYMHWFYMISHPFMTPTQAGDPPKHPHVMKYETYMEPNMPGFLIVATAMEEAPAHAPSDVEHPRHAMEVCQATAGRLEHLLNLRIVIEPKDSD

SEQ ID NO: 92216 - protein, 275 aa, Glycine max
  Coding DNA Sequence Number=SeqID_531
MGEVEEVQEQIKANMLALKDQMASLMEAMLSMRRLIESNAATAATASTAAEVDPALPSVANLAHQLSPDMVGRGGDILRNTNSSRRRYNRHAYPYGLPLNFSPPIVNKNVDHVVPFTFEGQPPQPVGGAREEPREHAQGDVDSYPLFTTEGLTPNALPQPNIVGVSQPYPMQPLLFSVGGPPPAAEGREKLDLIKERLRAVDGFGDYPFANMTDLCLVPNVIIRPKFKVSDFDRRWGRTRGMRNCSCTSSKTAWSEPQSFGTPTWKHLASARGKT

SEQ ID NO: 92217 - protein, 211 aa, Glycine max
  Coding DNA Sequence Number=SeqID_532
  Subcellular localization annotation: CTP_CleavageSite=33; ConfidenceScore=5.35e-01
PPQPQQQNQPQQNNYDFSSNRYNPGWRNHPNLRWSNPQQQQQQPAPSFQNAAGPSRPYIPPPIQQQQQPQKQPTVEAPPQPSLEELVRQMTMQNMQFQQETRASIQSLTNQMGQLATQNSDKLPSQAVQNPKNVSAISLRLGKQCQGPQPVAPSSSANEPAKLHSTPEKGDDKNLPNNFCAEAAHSPSSIPSKSSFQQKNGRGRERDIGNV

SEQ ID NO: 92218 - protein, 48 aa, Glycine max
  Coding DNA Sequence Number=SeqID_533
MAITEATGLQMSRRRPGKMTDRGLKKKHHPMTPIEHFLTDIMQISFTD

SEQ ID NO: 92219 - protein, 114 aa, Glycine max
  Coding DNA Sequence Number=SeqID_534
MQRSSRLPQTLSVISFNDIGVHERGQLLAIHVGEYQSTPKKSSFHHERSFIIRGPLASIVLNSVGHLLQHKVPLVKLARTYLLVKRVFYPSLIQTPMAHGRQTLTFNKVELVIA

SEQ ID NO: 92220 - protein, 15 aa, Glycine max
  Coding DNA Sequence Number=SeqID_535
VNVVKIFPDAQNGLG

SEQ ID NO: 92221 - protein, 132 aa, Glycine max
  Coding DNA Sequence Number=SeqID_536
  Homolog annotation: Hit_ID=Q1SN17; Match level="QueryCoverage=98%, HitCoverage=34%, E-value=2e-13, Identity=33%"; Hit description =Transposase, putative
MKTKLVFATRDDILNWTRAVAYEIGFVAFIMRKPVVGGQRWMVKLMCESHNHESVKSLVGHPYVDRLTKDDKIIIVDMTKSMVKLRNILLTRKEHNVNSYTTIKQIYNARNAYHSSIRDNDIEMQQLMKLLE

SEQ ID NO: 92222 - protein, 216 aa, Glycine max
  Coding DNA Sequence Number=SeqID_537
MSHLLEFGMTGPLNESISCFLKRVDPWVLVPSPSEDYTSSPSEGYTPSPSEGCMPSPSGDYTSSPSEDYTSSPSEENTFSPSEDYTSSPSKDYTSSPSEGCTPSPLEGYAASPSEGYMHALRGLRVLTFRGLHALAFRGLHALTFRGLHVLTFRGLHVLAFRGLHILAIRGQHVLAFRGLHVLAIRGLHALAFKGLRILTFIGLHAHPQRTTRPHL

SEQ ID NO: 92223 - protein, 149 aa, Glycine max
  Coding DNA Sequence Number=SeqID_538
  Subcellular localization annotation: CTP_CleavageSite=22; ConfidenceScore=5.56e-01
MGITLTFCPSVIFAFPLAFAVRSGGVNTRPVWVMPLSPMILVTLADSELMSVAPSFLSLRGRLGSCVSGQMYHQRIRLSKTFLICGLHAYVLLFTPLIADFQPALVYHLLQQGLVDKPSRGRHVLQRFGPARSTQIDGINRSPSMIDKR

SEQ ID NO: 92224 - protein, 126 aa, Glycine max
  Coding DNA Sequence Number=SeqID_539
MGYYFYQPSNHKVFVARGATFLEREFLVEGNHGKEIELDETQVTNDNITQEHEMETKRPFFDVLKLGQSSSTQTIIAQELAIVQEQVVVQEEVNEPILEQLQQPLNPTQEPLRRSTRMHCAPNKLN

SEQ ID NO: 92225 - protein, 259 aa, Glycine max
  Coding DNA Sequence Number=SeqID_540
  Gene Ontology: Mol. function=DNA binding; Biological process =regulation of transcription
  Homolog annotation: Hit_ID=A2Q5E6; Match level="QueryCoverage=23%, HitCoverage=19%, E-value=3e-12, Identity=62%"; Hit description =Homeodomain-related
MVKVGTSYVPINVSFSPKVGPGLPGINRDTRIYLFCEVIFRHSCPSCSATDGVVRNGKSTPRTSALASVAGPAARNHHTRPRLMRRYRARPIRHSGCATVGKGDRCGPSSLLRQLAKGGCAARRLSWVTPGFSQSRRCKTTARIRSEVYVDTGFTCLQKATPKAIMRTMNVKGLTLFHLKSHLQKYRLGKQSSLSIPSTSRGGPSGKPVVPAALMNRPTRGGEAVCVLGASGVYTGFTMLALMRVSVKCFMWQEKKAAP

SEQ ID NO: 92226 - protein, 387 aa, Glycine max
  Coding DNA Sequence Number=SeqID_541
  Gene Ontology: Mol. function=endonuclease activity; Biological process=DNA modification
  Homolog annotation: Hit_ID=Q30XD1; Match level="QueryCoverage=100%, HitCoverage=35%, E-value=0.0, Identity=95%"; Hit description =DEAD/DEAH box helicase-like
  Pfam annotation: Domain name=DEAD; Domain location=6-199; Score= -41.0; E_value=0.049; Accession=PF00270.20; Description=DEADDEAH box helicase
  Pfam annotation: Domain name=ResIII; Domain location=2-193; Score= -9.8; E_value=0.00032; Accession=PF04851.6; Description=Type III restriction enzyme, res subunit
  Pfam module annotation: Pfam domain module=DEAD::ResIII; Domain location=6-199::2-193
MLADARENGAGMTYLCDHSAGSGKTSTISWTAHDLVKLREDNGDAVFNSVIIVTDRNVLDGQLQDAVKQIDHQFGVIAAIDRQKSSKSKSKQLSEALLSGTPIVVVTIQTFPYAMEAIITDKALKGKNFAVIIDEAHNSQTGSTAAKLQAALGMSGQGKMSTMTVDELLEQLQKSRARPDNISYFAFTGTPKHSTLMLFGRPTDPSQPASNDNPPQAFHLYTMRQAIEEKFILDVLKGYVPYKTAFNLSKQLEDSKRVSGKAAKRALAQWMSLHPTNVTQKVQFIVEHFTKNVAHRLDGKAKAMVVTSSRAAAIRYKKAFDRYIEQHSEYGFIHSLVAFSGKMTGKQVMHQDDSEFKDDVFIVDENEEFTEQSMNPDVQGQDLRFAF

SEQ ID NO: 92227 - protein, 80 aa, Glycine max
  Coding DNA Sequence Number=SeqID_542
MTGPLDGPIACFLIKVDPWVPVPITFRGPYVLAIRGLHILACKELHALAFRGLRVLIFSVLHTHTLEEYKGSRPQDAQWA

SEQ ID NO: 92228 - protein, 358 aa, Glycine max
  Coding DNA Sequence Number=SeqID_543
  Gene Ontology: Mol. function=hydrolase activity; Cellular component =cellular_component; Biological process=metabolic process
  Homolog annotation: Hit_ID=A8GAA9; Match level="QueryCoverage=51%, HitCoverage=81%, E-value=3e-90, Identity=87%"; Hit description=2,3 -diketo-5-methylthio-1-phosphopentane phosphatase
  Pfam annotation: Domain name=ARD; Domain location=181-343; Score =140.7; E_value=4.2e-39; Accession=PF03079.5; Description=ARDARD' family
  Pfam annotation: Domain name=Hydrolase; Domain location=1-165; Score =6.1; E_value=0.017; Accession=PF00702.17; Description=haloacid dehalogenase-like hydrolase
  Pfam module annotation: Pfam domain module=ARD::Hydrolase; Domain location=181-343::1-165
ESEVAAPLAALRAEIDQPQADLDTLIAALYRFMDEDRKSTALKALQGIIWRSGYREGDFRGHLYPEVAGQLAAWQRQGVKLYVYSSGSVEAQKLLFGHSDAGDLQPLFSGYFDTHVGAKRETASYRNIAQAIGIAPEELLFLSDIHQELDAAQAAGWHTCQLIRDDADDQSRHPQVNRFDRIDLGDDTAPQQPLWQSRDAQEIQRQLAQIGVRFERWQADRELGDNPQPEAVIAAYQHEIDRLVAEKGYQSWDVISMRPDHEQRQALREKFLSEHTHGEDEVRFFVEGAGLFCLHLDGKIFQILCEKNDLISVPANIRHWFDMGSAPHFTAIRVFDNPEGWVAHFTGDKIADAYPRLD

SEQ ID NO: 92229 - protein, 256 aa, Glycine max
  Coding DNA Sequence Number=SeqID_544
  Homolog annotation: Hit_ID=A8GAB8; Match level="QueryCoverage=100%, HitCoverage=100%, E-value=1e-132, Identity=89%"; Hit description =Putative uncharacterized protein precursor
  Pfam annotation: Domain name=DUF949; Domain location=35-226; Score =438.1; E_value=1.2e-128; Accession=PF06104.3; Description=Bacterial protein of unknown function (DUF949)
MSKIALLFAMLVSMPMITACSASEQVPEAPVVKQQLLGSPVYIQIFKEERKLELYAKMGNEFRLVNTFPICNFSGGLGPKRREGDFKSPEGFYSVDARHLKPDSKYYRAINIGFPNDYDKSQGYSGAYLMIHGECKSIGCYAMTNTYMDEIYRYVEAAFAYGQSRVNISIYPFRMTEQNLKRHASSSYIAFWRQLKPGYDYFAKNHQPPTMGVVNGQYVLGQPLMSSGGMMTQYASASPTPNTNPFAQNKPLTEVK

SEQ ID NO: 92230 - protein, 229 aa, Glycine max
  Coding DNA Sequence Number=SeqID_545
MAPRKLASKRSRKDKAAEGTSSAPEYDSHRFRSAVHQQRFEAIKGWSFLRERRVQLRDDEYTDFQEEIGRRRWASLVTPMAKFDPEIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSSPRRARLLPPEATAFWRNILEGPSGPGFYLHPHFY

SEQ ID NO: 92231 - protein, 77 aa, Glycine max
  Coding DNA Sequence Number=SeqID_546
MGELICAIARSPPSTTYDGVVPGDMSRGSGDLGDVRWGAIAQNQAWLIPTQPGHSQSVRTCDVPKQASSWQSTNKRT

SEQ ID NO: 92232 - protein, 116 aa, Glycine max
  Coding DNA Sequence Number=SeqID_547
RSTARLDRHRVAHRRPQTHRCHLIRLIQLGHLTRSGIYGIWFASRRPTTGCMCRPMTVSTSSASVCRARVSLLFRALLQIGSGQRSHGPKIGLRPRPGRRPQWLPAMQMRPAWTRR

SEQ ID NO: 92233 - protein, 86 aa, Glycine max
  Coding DNA Sequence Number=SeqID_548
MGDQEETQEQMKADMSALKEQMASMMEAMLGMRQFMEKNVANTAAVSSTVEADPTLLATVHHPPPNTLGRGRNTLGHNNNPHLGYN

SEQ ID NO: 92234 - protein, 156 aa, Glycine max
  Coding DNA Sequence Number=SeqID_549
  Homolog annotation: Hit_ID=A5AK77; Match level="QueryCoverage=60%, HitCoverage=11%, E-value=2e-09, Identity=36%"; Hit description =Putative uncharacterized protein
MTTGNPGDLQPFDLERDRTFHRLVRHSVHLGHSVEGDSKYSNFEHSTTNFYTENMAQPPPCERTLREMDAPDFTYESLCIQYPDEGVSYVLKTGLIHLLPKFHGLAGEDPHKHLKESHIVCSTMKPPDVQEDHIFLKAFPHSFEGVAKDWLYYLAP

SEQ ID NO: 92235 - protein, 162 aa, Glycine max
  Coding DNA Sequence Number=SeqID_550
  Homolog annotation: Hit_ID=A7Q9A6; Match level="QueryCoverage=87%, HitCoverage=28%, E-value=3e-12, Identity=32%"; Hit description =Chromosome chr19 scaffold_66, whole genome shotgun sequence
  Pfam annotation: Domain name=DUF827; Domain location=11-160; Score= -96.1; E_value=0.0029; Accession=PF05701.2; Description=Plant protein of unknown function (DUF827)
MVHDKLVLQQGGQLNGKNRELVLQKDIELQLFETCHSKLKDKESKTESIVENLQQNVKLQHMKNDTTELKMEVAVTKLVLQNAETKLRVTVEEMEAANAAEASVVDQIKVLSMRTSHSHSSPSEPGARITISREEFESIVHKVKESDKLADIKVVVAATQPL

SEQ ID NO: 92236 - protein, 75 aa, Glycine max
  Coding DNA Sequence Number=SeqID_551
MGCNNWTQPWPMGSEIYPKVHENPRAFFSSSSPIFLEPLAHGSSDWSLPRKDCIRIEHGDGELDKKLFHLDKSSS

SEQ ID NO: 92237 - protein, 92 aa, Glycine max
  Coding DNA Sequence Number=SeqID_552
MAKNDGKSLRNHPRKYFRSVTEAPRFEFSLRKRPSPIYREKRVMLAAQLASASSALPGKQEFYGSITEVLKARFHKKEGGACRPARPGELVA

SEQ ID NO: 92238 - protein, 125 aa, Glycine max
  Coding DNA Sequence Number=SeqID_553
MGDQEETQEQMKVDMSALKEQMASMMEAMLGMRQLMEKNVVTAAAVSSAAEADPTLLATTHHPPPNAVGRERSTLGHNSNPHLGYNRAAYPYGLLPNYTPPVMQDDAGHISSPILEGEPPRQPDE

SEQ ID NO: 92239 - protein, 70 aa, Glycine max
  Coding DNA Sequence Number=SeqID_554
MGVQIAIRPIWALQKIPPEGGYFWRKPPCSPGRAELAWGRSEEEFRSPLLIFSRSSMFFVRSSSFFGLQP

SEQ ID NO: 92240 - protein, 56 aa, Glycine max
  Coding DNA Sequence Number=SeqID_555
MERYLQHLVRQQAANHRGQISLGLRSHGPEIGPRTRRRRHQQELPMMQRTPAWMRR

SEQ ID NO: 92241 - protein, 205 aa, Glycine max
  Coding DNA Sequence Number=SeqID_556
  Gene Ontology: Mol. function=motor activity; Cellular component=cell projection
  Homolog annotation: Hit_ID=UPI00016621D1; Match level="QueryCoverage =85%, HitCoverage=42%, E-value=2e-20, Identity=36%"; Hit description =UPI00016621D1 related cluster
RAHTFPFRGLHVRAFKGLQVLAFRGLHVLTFRETHILAFRRLHALTFRGLHVLAFRELHALPFKGLHVLTFRGTHILAFRLHVFAFRGLQVLTFRGLHVLTFRGLHVLAFRGLHALTFRGLRVFAFRGLQVLAFRGLHVLTFKGPHVLAFRGLHALSFRGLHVLAFKGLQVLALKGLHVLTFRGPSSSPSEGYTPLPSEDYTSSP

SEQ ID NO: 92242 - protein, 241 aa, Glycine max
  Coding DNA Sequence Number=SeqID_557
EDIVAFEGMQRLKTLSSSKYYRIGHLRMLPDFSQVGRRVLCIIGLEHLWMTKVKSTTIFNMIRSGRPSSSRYHRTCSSLDDKRDFDSLWIGRVWVTICCLRASLDLSSLDDEGADNHKVCPRATRPSGHDSRIETFSRSRPDDANISEKDNHKVCSRATGPLGHDSEIETFLRSRPEDADISGKLTKGADNHKVCPHATGPLGHNSEIDTFLRSRPEDVDIFGKDADDHIGLCVSTGSFVS

SEQ ID NO: 92243 - protein, 68 aa, Glycine max
  Coding DNA Sequence Number=SeqID_558
MELTSEDTSLVDQFKWRVHPPRLFKENKGGSIPCGSLLVKDFTRLKEISRTGGCLGTRCKARVVAEPI

SEQ ID NO: 92244 - protein, 15 aa, Glycine max
  Coding DNA Sequence Number=SeqID_559
VNAVKVFLDAQNGLG

SEQ ID NO: 92245 - protein, 55 aa, Glycine max
  Coding DNA Sequence Number=SeqID_560
MEVADPTCLTCSYLLRKCLKEDRSPPAQAVAAQKRKLLYNHGGCTSSVPSPGLKS

SEQ ID NO: 92246 - protein, 86 aa, Glycine max
  Coding DNA Sequence Number=SeqID_561
MNEKVKVYLWMNALLEPKLLNPRKTMICWQPNPITSLESLSDSFCEKCRQRIKLNVLMMPKDHMLLKALFKTKKLKIFKMDDQDSL

SEQ ID NO: 92247 - protein, 103 aa, Glycine max
  Coding DNA Sequence Number=SeqID_562
HTYLLILDTYSLNIALPSNTCSPRVRYSILTILYYLRDPVHLPGSNNNLFKPEIRNGRGVWAILKAFACLEISRERKFQVPESFESICCAKTGRELSLKRKPS

SEQ ID NO: 92248 - protein, 218 aa, Glycine max
  Coding DNA Sequence Number=SeqID_563
ESDTSPKKLPETNERGTNDFDHDLLRQLIKSLYFMYDTPVEFKWDGSKFGLSNVVASFFLTFSDVNEIVAGYKCLNISILQLWMLFLDEWGSTLGHASVYGFLEPQSIHNAKDRRAEYVDHAIIISSAMKSTNTTADGTNNPATPKWIEVKSHVQSGGYECGYYVMHWMWNIVSGGLKNDWSMWFLDGTTLDNETITTIRQKWAAYFLKVQSNQCTKS

SEQ ID NO: 92249 - protein, 171 aa, Glycine max
  Coding DNA Sequence Number=SeqID_564
MGDFISRLSFPACLHFSEENTETFSSLTSYPELRRSEFLIGGYVGARASLLSTTPPFVIQNYVELRRSEFLIGGYVGARASLLSTIPPFVYHDSRAGSREDALRLSAPRHSVTPSVIDEQRPIWSSAPFPEMSAFSDGDFSSLASYQELRRSEFLIGGYVGARALLLSAAT

SEQ ID NO: 92250 - protein, 102 aa, Glycine max
  Coding DNA Sequence Number=SeqID_565
MKFMIGLKDVVTIFGKTQKKALSETNIWKKRQDKGCFEKSSRPSWHGYTRAATSDIARLANVFAPSMSYNVNKREEKFLSMSTESKSPVRILFKYQEPCIPQ

SEQ ID NO: 92251 - protein, 210 aa, Glycine max
  Coding DNA Sequence Number=SeqID_566
  Gene Ontology: Cellular component=mitochondrion
  Homolog annotation: Hit_ID=A6H5B3; Match level="QueryCoverage=31%, HitCoverage=84%, E-value=1e-27, Identity=88%"; Hit description =Putative ribosomal protein S3
MDVDKILPSSSTLGWHSLKVKGEVQTKKGLWWIPRHPETRKGVVSDEMLRGVKISVDPGIPDIGQPFELLLNPRAGQRQPAKWEQLNRENGVVGELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 92252 - protein, 93 aa, Glycine max
  Coding DNA Sequence Number=SeqID_567
MDKSLKKEKMRGGRRREGARHFVPQMSSFFHGLFPSGWCLLSAFLLYLPLHIHGEKSPLKDLIEAQRASLHRSFTSKLPSSGIRAQELQVGAP

SEQ ID NO: 92253 - protein, 145 aa, Glycine max
  Coding DNA Sequence Number=SeqID_568
MTPSLLENHLVVAIPGKVLQPPYPKWYDPGAKCVYHSGVPGHNIDSCIPFNVNAVVEDGPSRTKRLGDVATSRRFIYQSLQAACMVSRDGDERDECLFHLGESHDMETCPVVEELLQRLIPCGQLEVFIGGKEEPQICMQSEEKK

SEQ ID NO: 92254 - protein, 86 aa, Glycine max
  Coding DNA Sequence Number=SeqID_569
MVILCPLSFRFRKSSDKHVETNYGHSAPFVIQGQGDRAGGITQRQIMVILRLAIPGSIVSEGTQRQIMVPLAGRLTWPNGVSLERN

SEQ ID NO: 92255 - protein, 76 aa, Glycine max
  Coding DNA Sequence Number=SeqID_570
MAAEWRRKRERRRHFKEKMSVEEAHHHRRPWIRAWRKKEMNEGRGREEHEILCSKRALKSKPTNPRSSPRFSTKCA

SEQ ID NO: 92256 - protein, 27 aa, Glycine max
  Coding DNA Sequence Number=SeqID_571
ILWKFFIVLRRSSSFFIRSSFVLHSLT

SEQ ID NO: 92257 - protein, 70 aa, Glycine max
  Coding DNA Sequence Number=SeqID_572
MNPKRIKVFPKWPTPPSVAGRSPEFQETLDLRSNPFEGEGNDAILPSQGHWIEDSKKIGPEMQDKALGFS

SEQ ID NO: 92258 - protein, 115 aa, Glycine max
  Coding DNA Sequence Number=SeqID_573
MEADMEAMKEQMAAMMEAMMSVKKIMEANAVAIAATSVVAKVNLMSPSGINQMNHPTSDMATEGQAVGGIHPTKPFGGPSVSLSSYTSCIPQQVKTLMLWQKWKVGSSRGKAQGH

SEQ ID NO: 92259 - protein, 269 aa, Glycine max
  Coding DNA Sequence Number=SeqID_574
  Gene Ontology: Mol. function=motor activity; Cellular component=cell projection
  Homolog annotation: Hit_ID=P15305; Match level="QueryCoverage=96%, HitCoverage=80%, E-value=1e-17, Identity=23%"; Hit description =Dynein heavy chain
LHILAFRGLHALTFRGLHVLAFRGLHALTFRGLHVLTFRGLHVLASRGLHALVFRGLHVFAFRGLHVLAFRGLHVLAFRGLHVLSFRGLHVLAIRGLHVLAFRGLHAIAFRGLHVLAFRGLHTLTFRGLHILTFRGLHVLAIRGPRVLAFRGLHALAIRGLHVLAIRGLHALAFRGLHALAIRGLHVLTFRGLHSLTFRGLLVLAFRGLHALAFRGLHALAFKGLHALAFRGLHALTFRGLHVLAFRGLHALVFRGLHVHMVACMTSFV

SEQ ID NO: 92260 - protein, 85 aa, Glycine max
  Coding DNA Sequence Number=SeqID_575
MHRSPTGNLVPLDLEIETTLRRNRAERRRKLLQDRTVASILKEEIHFSDLLSPDSPSSRESATQLPKVITMAEEHDQRITLEDYS

SEQ ID NO: 92261 - protein, 142 aa, Glycine max
  Coding DNA Sequence Number=SeqID_576
  Homolog annotation: Hit_ID=Q6WAY6; Match level="QueryCoverage=83%, HitCoverage=20%, E-value=3e-13, Identity=31%"; Hit description =Putative uncharacterized protein
VDWDQHFAGIRGNTINWFPRWKEGNEGVLFSCGDYPNVPLIGTRGCINYNPALAIRQLGYPMRGAPMEESLSPFLVRDFGAQSLKVVQRVHKVWRSPLRKDKELSGIRNGIISGYHEWLRVHTRGLDWLSKLKVINWRFYLS

SEQ ID NO: 92262 - protein, 177 aa, Glycine max
  Coding DNA Sequence Number=SeqID_577
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=1e-23, Identity=30%"; Hit description= UPI00006A17C9 related cluster
  Subcellular localization annotation: CTP_CleavageSite=22; ConfidenceScore=5.64e-01
MWSPLKARMYNPLKARTCSPLKARACSPLKARTCSPLKARTCSPLKARTCSPLKARTCSHLKARMCSPLKVRICSPLKVRTCSPQKARTCSPLKARACSPLKARTCSPLKARAWHPLNARACNPLKVRTCSPLKARAYNPLKARICSPLKARACIPLKMRACSPLKVRTCSPQGKDV

SEQ ID NO: 92263 - protein, 243 aa, Glycine max
  Coding DNA Sequence Number=SeqID_578
MSSRKRKSIGARPTTQYDTRRFHSFEAWTRYTENVLGRHILAKRKVEIYHTELDEFMAELERRNFHKRLINLADSHPGKILRKDLTTLTQVWSVLSYSNLALTSHTLDLTVDRARLIFGLVSQLDMNVGALISGQITSMTQSNSSRLGFPALITTLCRSRGVAYDSLVFERLSPIINLAYIRKNYWNLDDLTVSIRGARRARARPIELPSTSAAPTPAFTSASPSVPAQSNSQRFEAMLQSIH

SEQ ID NO: 92264 - protein, 398 aa, Glycine max
  Coding DNA Sequence Number=SeqID_579
MTKRSAETSRADMRPKKPTRVKIQEGKQEEKEEEERPLIRKRKLPTTSTKFAEQTETGNSQAQVPKKKKKVKQVEPEPSVAVEGGEPAKKKKKKTKSSKEQGDHQPVDVQPPSTDIDGTEVEAAPSIAEMGNPVEQPNSPQEQPTVEVQQNVSAEEIPSCARTSPTPEADAVNVEKWGEGQGIGSSSPHGWAEVDDPHEPNQSDNTIPHESSQKSSSEENFFDEDAIKEAEAGGSDIYPVSSTSKLSASIGIAEDTFIQMQNGDPAAALRLLLNTSQANTSSEKIPGASSSSDAEINSSVRQDSLLLKLSTEYARKDVLKSIEENPSAAFGHLNFLKKLHNPLTSDETLGKVIQIEAIIDQFASTVQRKRENGTRLDAQKQAHILLLEKARAAQHEVE

SEQ ID NO: 92265 - protein, 174 aa, Glycine max
  Coding DNA Sequence Number=SeqID_580
  Homolog annotation: Hit_ID=A7NTC5; Match level="QueryCoverage=68%, HitCoverage=35%, E-value=1e-42, Identity=72%"; Hit description =Chromosome chr18 scaffold_1, whole genome shotgun sequence
  Pfam annotation: Domain name=Omt_N; Domain location=76-172; Score =73.8; E_value=5.5e-19; Accession=PF02409.9; Description=O -methyltransferase N-terminus
MSDANGEIEPSTNRVEWELRVLVCRDCYDNSVAVSRPGYPGQLPRLWLRHWSEDQAGQELKLPDLLNSDAVREIHANIEKEWDFLQRSACQTAAGRALWKHAIHDPLADLLAGETYLRNLHEKIKKDILNNARETSGVILAVRTLWFDSRLEDALNSTNSREAQVVLLGAGRGI

SEQ ID NO: 92266 - protein, 125 aa, Glycine max
  Coding DNA Sequence Number=SeqID_581
MRGADSVARFDSRLLHWYIQRNPHACMLQRTVEWILPTPTPYRLVEPVQVIEVSSFEEDPEEDPEELPPEPAVDALDFPEGDEDPLPVVDSSEDVMSASEADSMEESDPGGIATSGDSSSWQTAP

SEQ ID NO: 92267 - protein, 84 aa, Glycine max
  Coding DNA Sequence Number=SeqID_582
MKAPMKITHILFKLGDACIHTIKATIQGIKSFTNIGLRNHLVEEEEKEYAHLVEVECPSSAIANHDPYDNQMKLLHQHLWKNIS

SEQ ID NO: 92268 - protein, 827 aa, Glycine max
  Coding DNA Sequence Number=SeqID_583
  Homolog annotation: Hit_ID=Q6WAY6; Match level="QueryCoverage=28%, HitCoverage=43%, E-value=2e-30, Identity=33%"; Hit description =Putative uncharacterized protein
MDEFAGLRSNLADVGGTEERLNQWNEIKLKKEEEDKVELVCPATSLTKATSLYKLRRSLTKAASLYKSSLKKTPACVSIFKTFDHLELEEYGVLSESVQSWKDFCGLHMPLVCPDGAVIAYAWKKAGVAAYDVQRYVKESDWAAQCTRQDKMSNEELKLQDPRFLGLECFVSHLDVTLTSSVGPECVELISIVCVELISIVCVELISIVQRAISEWLLGRDCTGSDVGDVAPNWVNNSLVLFTCLICSYGHIQAACSEARCRDILTLPDVLKSLEKDVPNLKILTFERLDWLKRASTLTSSTNESSLEHNYHGSNKLRLGSVGTVAAEKVAMIELLFPSIFRAVLSWHPVGSMDPDAVAFFALDEVLSSQNQELRGRQFVRIGAIDGSTPTSSLPQGLWEDLGPSYDRNLCGSNCIPYPLVPTVEEFEEILGCPLGERKPYLFLGFYPSMARVAKAVKISMQELDRVKQNRNEVVGIPRKHLEGKAKALANQGEWVLFIDTFALLIFGVVLFPNLEGLVDLVAIDAFLAYHHSKESPTISILADLYDTFDRRCEKSSACCTPALYGKANWEQLLASVAGASINWFPRWKEGRAGVLFSCEGFPNVPLMGTRGCINYNPALALRQLGYPMRGAPSEGSIMPFIAQGFSDPNPRDKELRGISNGVIGSYHKWMRVWTQELDWLPKPTAAREEGAAAPEERALWGSNNELKLRRAERDQSWVEGMILKDELKACHRSKRSLSQQLSKTKGNMWATIDEYKEKLYLAVTHEQKQEEEYAKVSVLQVKREAKERVIDSLHREAMMWMDKFAFTLNGSQDLPRLLAKAKAMAD

SEQ ID NO: 92269 - protein, 79 aa, Glycine max
  Coding DNA Sequence Number=SeqID_584
MCQLCTGGLVGVCALSATLAHLACISEFWLIARLFAQGMDSSGALRGISPRSVNMHSSSFFQILPHAQLQEWCAQRMAR

SEQ ID NO: 92270 - protein, 71 aa, Glycine max
  Coding DNA Sequence Number=SeqID_585
  Subcellular localization annotation: CTP_CleavageSite=31; ConfidenceScore=5.38e-01
LNQSQTYQGNPCGVCPDLSSFTGSGVYPNLSSFTGSGVYPDLSSFTGSGVYPDLSSFTGSGIIQIFVACIK

SEQ ID NO: 92271 - protein, 205 aa, Glycine max
  Coding DNA Sequence Number=SeqID_586
  Gene Ontology: Mol. function=protein serine/threonine kinase activity; Cellular component=chloroplast thylakoid membrane; Biological process=protein amino acid phosphorylation
  Homolog annotation: Hit_ID=A7P5C1; Match level="QueryCoverage=93%, HitCoverage=84%, E-value=8e-65, Identity=36%"; Hit description =Chromosome chr4 scaffold_6, whole genome shotgun sequence
  Pfam annotation: Domain name=PPR; Domain location=100-134; Score =21.9; E_value=0.0024; Accession=PF01535.11; Description=PPR repeat
  Pfam annotation: Domain name=PPR; Domain location=30-64; Score=33.5; E_value=7.6e-07; Accession=PF01535.11; Description=PPR repeat
  Pfam annotation: Domain name=PPR; Domain location=65-99; Score=42.4; E_value=1.6e-09; Accession=PF01535.11; Description=PPR repeat
  Pfam module annotation: Pfam domain module=PPR::PPR::PPR; Domain location=100-134::30-64::65-99
MNAWSQAGFLEKCKEIYNNMLKSGVKPDGHAYSILAKGYVRAQEMEKAEELLTVMTKSGVQPNVVIFTTVMSGWCSVGRMDNAMRVFDKMGEFGVSPNLKTFETLIWGYAEAKQPWKAEGMLQIMEEFHVQPKKSTILLVAEAWCFAGLKEGAKTLLITVKTEKMINSIDGDNNITAKMSEKICQKPHTNAPFCSLLKDFIYIFH

SEQ ID NO: 92272 - protein, 103 aa, Glycine max
  Coding DNA Sequence Number=SeqID_587
  Homolog annotation: Hit_ID=A5C0Y9; Match level="QueryCoverage=74%, HitCoverage=6%, E-value=4e-12, Identity=48%"; Hit description =Putative uncharacterized protein
  Pfam annotation: Domain name=Chromo; Domain location=10-61; Score =24.5; E_value=0.00041; Accession=PF00385.15; Description='chromo' (CHRromatin Organisation MOdi
MLTDELELRVEPLAVKAVKNDPAGTTEVLIQWKDLLYFETTWESVDVMKQQFPAFHLEDKVALLGGSIVRLPIKQVYEGRTHDKYKRKSEQHLKQPEPGLVAD

SEQ ID NO: 92273 - protein, 42 aa, Glycine max
  Coding DNA Sequence Number=SeqID_588
MDKSLKVGEDEWMERERKSTKFCASNEPTNPRSSPRFSTKCA

SEQ ID NO: 92274 - protein, 112 aa, Glycine max
  Coding DNA Sequence Number=SeqID_589
  Homolog annotation: Hit_ID=A5AGE5; Match level="QueryCoverage=52%, HitCoverage=4%, E-value=6e-15, Identity=69%"; Hit description =Putative uncharacterized protein
  Subcellular localization annotation: CTP_CleavageSite=49; ConfidenceScore=5.23e-01
MFAHSIKGCRPLGRACGVLIPSPSRLFRFFRRFPQINVGGDSARIPFVEHASRESRVALPPKDCLLRGWIIGTLSEEALGLVVGLDTAHPIWTTLKYLYAEDSQERGFTLRQ

SEQ ID NO: 92275 - protein, 86 aa, Glycine max
  Coding DNA Sequence Number=SeqID_590
MSDQEEKQEQMKADMSSLKEQMASMMDAMLGMRQLMENSVAAAAAVSSAIEADPTLPSTVHHPIPNVEVILGRFPTSNHTPNVHNK

SEQ ID NO: 92276 - protein, 202 aa, Glycine max
  Coding DNA Sequence Number=SeqID_591
  Homolog annotation: Hit_ID=A7UQU7; Match level="QueryCoverage=62%, HitCoverage=22%, E-value=2e-19, Identity=44%"; Hit description=IMP dehydrogenase/GMP reductase, putative
  Pfam annotation: Domain name=DUF1723; Domain location=143-192; Score =41.3; E_value=3.4e-09; Accession=PF08330.1; Description=Protein of unknown function (DUF1723)
MVKTRGLGHALGRVVARGLGKGDDDDSDDAPQRRVPVIVDDVVPAVPADSPADTGPETDAQDIGAQDATDEPEGFPGGPRDPSVLTEYLDHVAASVWSGQECPKLKLSSHGRKVHNLGRPVPAIEDMVVGIGLSPLIACSIDTGDRGLISSFIERWHRETSSFHLPMGEVSITLDDVASLPHLPIVVAFHDFQPLRTDGAMV

SEQ ID NO: 92277 - protein, 60 aa, Glycine max
  Coding DNA Sequence Number=SeqID_592
SSANSLVTGDEAITNDQTQQIEPKEIRFSPEQYKALLALIQQPSEGNSDRCTHSSQDWYS

SEQ ID NO: 92278 - protein, 137 aa, Glycine max
  Coding DNA Sequence Number=SeqID_593
MLICPCGRIVPTRHPVDLKESNKALGFPALVTGLCQSYRVPVPPARSCRHDIGIAPARPPVDPEKSNRVLGFLALITGLCQFYGVPVAPTKGETPQQPGDGRQRAIDAPPPPPEPLSSSTKARALPTTRGRPARDQV

SEQ ID NO: 92279 - protein, 127 aa, Glycine max
  Coding DNA Sequence Number=SeqID_594
MYNYYEKGRAPYLESVLADFMTYQASSKEGLSNLDDLLMQFKDIVDSMQQAFKRTETQLGKLVDEMTKVVDKREEEYAKIEAHQESILQVTTIHHQLINEEEKDEASSTPDNPCMATTGYVVGTDKG

SEQ ID NO: 92280 - protein, 89 aa, Glycine max
  Coding DNA Sequence Number=SeqID_595
VPPVQLLTGWCVTAKAPPDISAGKCSGRVPFAIQAAQLLGRAIGAGLFAITPAGERGMCCKAIKLELVKGIYKIVELSSGLLGTGRRHK

SEQ ID NO: 92281 - protein, 367 aa, Glycine max
  Coding DNA Sequence Number=SeqID_596
  Gene Ontology: Mol. function=phosphoprotein phosphatase activity; Biological process=intracellular signaling cascade
  Homolog annotation: Hit_ID=A7R8Y3; Match level="QueryCoverage=50%, HitCoverage=56%, E-value=2e-32, Identity=37%"; Hit description =Chromosome undetermined scaffold_3090, whole genome shotgun sequence
MWAWERCTTLAPKRTPPIMENKPLGHRWLRRGNQHIGNDDLIVFRRKLDIMKRHEFLWEPYTTTVMSMLPPICLVGSMAWCAVVPLICFHVVEWHQPDRVLRQFGMQQPIPESPSQPWNVHGLTLKGKMDENWFQLLAPFISQWNNQAEFRVDVYARQEGLLSFNSDYMVWYRRKTKMFIDPNNANTATLGEVTETLQYMVSPQGRNTWTVDDLVPYVEKLAILSQEQERITEPVAHGPASERRFPPQQFHMLQSSVETRGFDKRREIVQAEDFSQHMEQCGHGMYYTPPTFAQYPSQMYQYPFEGHDTDMSASEHSFGGVAETQPNFSWPTMTPSQQHDAPMATPNAPLGQQWDVPGAIPAMGDLL

SEQ ID NO: 92282 - protein, 168 aa, Glycine max
  Coding DNA Sequence Number=SeqID_597
MFPRSPSLPLPFFCWKLLLEGIEEGYAASSEVGQVHLQMRKMLLVEVLDTAFPTSIQLSHLISQALNGGSGLLLKLHVLHSHLPHKFFKGRRNVWSTWTNNILEGRSRLLLLLLLRARPSEIRVIPPSGIVSVAAEVIIVLLWLILLLRLRRLLHRRAKVCMVVGKGA

SEQ ID NO: 92283 - protein, 155 aa, Glycine max
  Coding DNA Sequence Number=SeqID_598
  Homolog annotation: Hit_ID=Q6UUU1; Match level="QueryCoverage=67%, HitCoverage=89%, E-value=1e-30, Identity=58%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGFTGVIPLLWPRLSQSTPDAQFP

SEQ ID NO: 92284 - protein, 36 aa, Glycine max
  Coding DNA Sequence Number=SeqID_599
AHENPRAFSCIFGPIFLESSIQCPCGVGLHQQAFRK

SEQ ID NO: 92285 - protein, 91 aa, Glycine max
  Coding DNA Sequence Number=SeqID_600
MSVFTCDSPQISASPHQLDLAPYASEPYNAQWNAPGLLRDKHTLRSSRILEEMEVDEPWLGLWLPLNYQIDMGASQHRTLELGWCLSLEVR

SEQ ID NO: 92286 - protein, 80 aa, Glycine max
  Coding DNA Sequence Number=SeqID_601
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=A2Q588; Match level="QueryCoverage=56%, HitCoverage=15%, E-value=4e-18, Identity=97%"; Hit description=NADH -ubiquinone oxidoreductase, chain 49kDa; Respiratory-chain NADH dehydrogenase, subunit 1
MEKIAENRTIIQYLPYVTRWDYLATMFTEAITVNGPEQLGNIQDPCFGLPEYNGISVKWIIMNVTKNLIGKFNGKKKEIP

SEQ ID NO: 92287 - protein, 132 aa, Glycine max
  Coding DNA Sequence Number=SeqID_602
  Subcellular localization annotation: CTP_CleavageSite=31; ConfidenceScore=5.31e-01
MQISFSELVSLSRNPLFSLSMQILAQCNFLCTMARSAGQFLLNAIPSRVENVLSAPFALSKTSKVVIFKILTVRLWRNVLGSSRKTLKTIQRLMNPGSRFYWNRFRCKYQPNALSMIKQIGEVEIRPRRMAL

SEQ ID NO: 92288 - protein, 66 aa, Glycine max
  Coding DNA Sequence Number=SeqID_603
MGVQIAPRPTWALQKIPPEGGEEVKKERAEALPKRFRNVFREESRKGFNRSSTFFIRSSSFFDLQR

SEQ ID NO: 92289 - protein, 255 aa, Glycine max
  Coding DNA Sequence Number=SeqID_604
CPLVLQLGPYITYSDLTVDRARLIFGLISHLDMNIGVLISGQMTFIAQSNTSRLGFLALITALCRARGVVSDSLTFECLSPVINLAYTRKNCWNPDDPTVSIRGARRARARPAELPSTFAAPTPASTSIAPSVPMVAPLDFIPTVEQFDKMVAWPGTQPSLHREDEGPTAQVPQHMEDKSSEATILEPFDIGEEAEETHIRQRNEERKRERRRHFKEKMSLEEAHHHRRPWIRAWRKKEMNEGRGREEHEILCSK

SEQ ID NO: 92290 - protein, 203 aa, Glycine max
  Coding DNA Sequence Number=SeqID_605
  Gene Ontology: Mol. function=oxidoreductase activity; Cellular component=cytoplasm; Biological process=electron transport
  Homolog annotation: Hit_ID=A4W776; Match level="QueryCoverage=82%, HitCoverage=100%, E-value=5e-84, Identity=81%"; Hit description =Alkyl hydroperoxide reductase/ Thiol specific antioxidant/ Mal allergen
  Pfam annotation: Domain name=AhpC-TSA; Domain location=39-143; Score =50.1; E_value=7.9e-12; Accession=PF00578.12; Description=AhpCTSA family
LAGALSRDGFHSERAEWDGEPSPAPGGAAGFLENHMVLVTRPAPDFTAAAVLGNGEIVENFNFKQHTNEAWREVVGVSFDSEFVHNAWRNTPVDKGGIGAVKYAMVADIKREIQQAYGIEHPDAGVALRGSFLIDANGIVRHQVVNDLPLGRNIDEMLRMVDALQFHEEHGEVCPAQWEKGKEGMAASPDGVAKYLSENVSSL

SEQ ID NO: 92291 - protein, 134 aa, Glycine max
  Coding DNA Sequence Number=SeqID_606
MRSSFLFSSTAGGGPPADKAPRRGPGSRNICLLGHALDDPREPRPTVEEAPLQGWGEGYDPRHHDRMVRGSWESASAAELTATAVAALFSISGLIPSMASIMEAICSFKADMLAFIYSCTSSWSPIILDLDLVR

SEQ ID NO: 92292 - protein, 116 aa, Glycine max
  Coding DNA Sequence Number=SeqID_607
  Subcellular localization annotation: CTP_CleavageSite=78; ConfidenceScore=5.62e-01
MVFLRCSSGFCFYQLSPPVQLLTGWCVTAKSTRRTSALASVAVTLRVTTTPAALNAPLQGASHSPFRLRNCWEGRSVRASSLLRQLAKGGCAARRLSWVTPGFSQSRRCKTTASEL

SEQ ID NO: 92293 - protein, 170 aa, Glycine max
  Coding DNA Sequence Number=SeqID_608
MDMNLGYLISHQISIIAQHDSSRLGFLAFIAALCKARKVTSDSRSLESLSPAINLAYIKKKCWNLDDPTVTFRGPRKARGKRSEASPTSVAPNTFAPSLPDPSTAHSTTIPSSSIAAPLPAPSLSPSGGGEALAAQELMPVEEPMPDAEDEPVPPEPFIFETDQSLRRKQ

SEQ ID NO: 92294 - protein, 40 aa, Glycine max
  Coding DNA Sequence Number=SeqID_609
MASIIAAICSFMASMSASIYSCTSSTLPFTLALARVWTWG
